United States Patent 6,747,137 (NUCLEIC ACID SEQUENCES RELATING TO CANDIDA ALBICANS FOR DIAGNOSTICS AND THERAPEUTICS) - sequence listing, part 5

SEQ ID NO: 14176 - protein, 545 aa, Candida albicans
ASAITKKYVYSCKRLLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADNKEDTLNNFEFETIGPNKLAVVAESMDESDPFLNIDIENFDTNELEVQSKMEYLVVRLSRKLEQVHLGYEDAVPALVKVTGRMLHLVKKYPVLHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPLIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNEL

SEQ ID NO: 14177 - protein, 226 aa, Candida albicans
TQLTSILDSSILLSTPITSFKSIQESIFYFLHNIELYNGGVNHTPPILIVLLSFLGNINTSVNGWNKIGYDLLYTVIDLIIAYKIIIINRWYNNYRQQKRNTNNKKKEGVEEEEEEEGTSGKFDDYLIGCFYLFNPLIILTNLSHSSIIFSWIFIMRSIIQIVQYENIARSMISLAIASYLSFSPIYLLPSILALGHVIIRDKAISAKQQQEKKESAPPAGKSDRG

SEQ ID NO: 14178 - protein, 154 aa, Candida albicans
VYTWIFILPFTIRFFQYKNNKITSLLGDSFLAVILCLCWISFIKPYPILGDLGIVLSLLPILNDTIVQYCKLKYITGMTLIIGLLLAPIFYYIWIVLGTGNANFFYSITLIWGAIHGLILMDLIWTKLTLDYYNDNGIDINGEGGILGLSLAQI

SEQ ID NO: 14179 - protein, 84 aa, Candida albicans
TFNTIPPFDKPYWTFLTNLWPYSRLETRSVMSSNYYGAPDDEETGMPAFMLDTRPALDNLTNARDRFTHWAYPLWKKAMGEVRD

SEQ ID NO: 14180 - protein, 122 aa, Candida albicans
YVREGRHPSSPEVKINNQPFPYNIRNLEDPKKSRGGLAEPVNHKILLPYDVVVEKEGEYVAQFFTTFGITKHGIVKYTSPEFDADFYKSDKLIKDEEILKTLEEPLNTKPVKKKGTTATEQN

SEQ ID NO: 14181 - protein, 161 aa, Candida albicans
TFVLLGRVEDCTKGDELMNEELSKIYNSKKTKNTPKGIAFPTCVNPNHIPAHLAPVNAEDEANITLHNGDVVNIMLGIQIDGFPSIVAETLVIGASKESPVTDKRADLLNAAWTASEAALRTFKPSNRNWDVTNVVSKVAKEYETVPLENMLSHNQERLVL

SEQ ID NO: 14182 - protein, 121 aa, Candida albicans
SNNQSNAERRNSFEEEDALHDHYHEYSVSLVQHEKNKQEISMVEIERLKKANSEYRDLIEKLKEIFDLHDQKIYLQAEAFYLLMKTVLELVDEKYQLKIERNKLRKELVHAQARLIEFKDE

SEQ ID NO: 14183 - protein, 224 aa, Candida albicans
EPTTESQISNTTNTSSAAPHDTATIKTEETIEKLESEIDKAYVLVEHKFQELWENASKNAEKYHLEEYKQNFIEQLNTTKQSLNEKTSELHVQESLKSIEDQLKKIKLQDISTQANSALDVLDSKLEVVEREAGKYFGNFTTFLSNIVSISPGDDSTNNNNNANQKTKEVLFNSSLNQYNNYGTTRYDTDLLKLHTTEEFYLSDELDDENEIKNLHHAVEGPHL

SEQ ID NO: 14184 - protein, 463 aa, Candida albicans
  UNSURE (442): Identity of amino acid sequences at the above locations are unknown.
QNKPKRNKSIMLSFKSLLAAAVVASSALASASNQVALYWGQNGAGGQERLAQYCQEADVDIILLSFLNLFPDPLNVNFANQCGNTFESGLLHCSQIGADIKTCQSLGKTVLLSLGGGVGDYGFSDVASATKFADTLWNKFGAGEDPERPFDDAVVDGFDFDIEHGGATGYPELATALRGKFAKDTSKNYFLSAAPQCPYPDASLGDLLSKVPLDFAFIQFYNNYCSINGQFNYDTWSKFADSAPNKNIKLFVGVPATSNIAGYVDTSKLSSAIEEIKCDSHFAGVSLWDASGAWLNTDEKGENFVVQVKNVLNQNACVAPSSSATTQSTTTTSSAVTQSTTTTSAAITQSATTTSAAVATKSNQIVTSSSSSSSSIFYGNSTTESSTGIATGTVLPTGSNENAATTGSGSNTKLAISTVTDVQKTVITITSCSEHKCVATPXTTGVVVVTDIDTVYTTLLSFD

SEQ ID NO: 14185 - protein, 256 aa, Candida albicans
IFTRKKKQLLLLPPLPPLLLQQQFLVFLPAVKLVKLILLILLVSSISSTTSSTTSSTSSSSTSSSTSSTTSSSTTSSQISTTSTAPTSSTSLSSSTISTSASTSDTTSVTSSETTPVVTPSSLSSAITIPGDSTTTGISKSSSTKPATSTTSALSSLTTTVATIPDDKEIINTPTDTETTSKPPAIITESDATTITQNLTPSTTTKNVKTTSTNIVTEWVWAPTTLRTLTTTYQILTTRTHIETVFAEPSTVVIYN

SEQ ID NO: 14186 - protein, 130 aa, Candida albicans
IGDTNIDEDYLETLYNIRSKRSNKKVALGHSEKTPLDGDDYAKDVRTRVVLFWMIANLVFIMTMVQVYEPGDTGRNIYLAFILWAVAVLALVRAIGSLGYLIQTYARFFVESKSKWMKRGYTAPSHNPLN

SEQ ID NO: 14187 - protein, 285 aa, Candida albicans
FIFIKYGQVLIHLVEIFSYTLNFTIILINHIESWFSIGSYFLVFRILTTSLGDKALGFAPVKILSVIFLWLYLASIVTTFVLSFVNIPKGTEKFYVTIVIFFAILMAYMIFAAIFMAVHSIQDIYRSGTRITVSLFFQNSEFRDLVVATSSTYALYFLASFLYFEPWHMFTSFVQYILLSPSYVNVLNIYAFCNIDDISWGTKGEVGGKSLGEAKLREDGTFDVSVPISKEQINQSYLDQLEKIRDPAPPEEKVLVTNTEDYYAFIRSMTVLVWMFTNFLVIALF

SEQ ID NO: 14188 - protein, 134 aa, Candida albicans
  UNSURE (101): Identity of amino acid sequences at the above locations are unknown.
SSSSTFIPYSISFTMSNFRDSSSPRRGYSEFDPESGEGLGRKKSLIRPERSRMDESHPRFHYTQVANQESNHIKVQPSSTGVDPRKSNELSTSRSHLSNYXTPPHQEEEEDEGIPLMDIHNVFTPMLAVTKIMI

SEQ ID NO: 14189 - protein, 116 aa, Candida albicans
EDYHFTIFNSNIFPMTKPRFLTDIERAKVLEFQDMIHYSPRYSDDSYEYRHVMLPKNMLKAIPHDYFNQETGTLRILTEEEWRGLGITQSLGWAHYETHAPEPHILLFKRPLNPGQ

SEQ ID NO: 14190 - protein, 91 aa, Candida albicans
IQHEGPTETHWTTGQAPPAPINPCPGAGSEDPEGRVWGPTPAQAQGSKGAMRAGGQLGKEVPKGALDQDGVRLQAPGAEGRGLARCSAKED

SEQ ID NO: 14191 - protein, 458 aa, Candida albicans
RHNRDGNSTALNNGSYDSAISSSPVSSISQSSDTSGVSSRESPQPVKYSASQIKQEKLFENGVDIDDTDLNLQSTPVLCDGGISTPPRYPPKRQKLNEYTTTSGPTRSTFNSNFQLPNDILKNLTPVSNTTVSRDNSIPTLRKQEILQNIQIKLLEKSSRISRKLLDLHRKRQLNQELRLKKLNDELQLANIRRNQYLNMVRQRAAKFYRDVGDTDNRGARIIIQKSQRTNIMSIGGSTNRNHRYMPKSFDINLFVPLQKLVQRFLFHKYVKLIANSQFLDNFQIYSFNRVLKFSNSDNDLKTGIHFILKYLRVPHLLGSEYKSFFYCFIMIADFNSCMNHDGNNLGNSLSINYNHPGFNVNTDTKDEKEMFFHNCIWLIVFKFGQYLVDEFKTIIQKKSLTEQFLKYWDEYNFIFKIFKWNHYNSLKSLLISSINIIDKQINALSHLKNDILVADLK

SEQ ID NO: 14192 - protein, 193 aa, Candida albicans
RQAIINYYHTSKHSGFNYKDFRGLNHHYLSSAFLITLEVPCTIKEPPSSILVFGDFESDLTSKLSRNLFIWKSIAPLILRNQLKAIVLECSNCKEIAANELYGHLTPKLLIYELKQLAHECKQLDTATTSTEQPLLGLNVIVNHVKEPIADPNQESQLHDPRKRILAELNKLNEIEKLGCNISIALSGTSIIV

SEQ ID NO: 14193 - protein, 305 aa, Candida albicans
MAEFSDAELRKMMGTLSLLVQDSRREINHLHDKLENNSDSKYQSLETYINSKYADTIKSFEKLKYLDIDNSELVNTWIMCFNQVKRFHPQVFDAFMEAENEDEIGIEKIQYTPYTGKHLNDMIRIFYMKISELIERKVSPNVSREMNDGQPQFVPNLFKKVYEMIISKPDVSAAERIGKALFKLQSKLRELERESAFLLCQHLMTNDHQHDDIILKFLVSGVSPWYLHLQIYMLSYKLGFSNLFLEIYAQHYELYKADPIYKLPDSMTLLNEIRSNRDYPKVVNAAKNTVQVNNVSSKNNKKKDE

SEQ ID NO: 14194 - protein, 63 aa, Candida albicans
DYKHICYPPLSSISAHSGPSVDLAIFAIHLTSISSLLGAINFIVTTLNMRSIGIHMIDMPLFV

SEQ ID NO: 14195 - protein, 120 aa, Candida albicans
KYEYSDFVDSIGETIEFESYVIPDDMLEPGALRLLDTDTSIVVPVDTHIRFVVTANDVIHSFTIPSLGMKIDATPGRLNQVSALIQRTGVYYGQCSELCGVNHGMMPIKLECVSIEDFIE

SEQ ID NO: 14196 - protein, 63 aa, Candida albicans
GIRLQDSATPNAEGIHELYDHIMFYLCLILGLVSYILYVIIKDYKDNRFAYKYVRHGQVIEII

SEQ ID NO: 14197 - protein, 389 aa, Candida albicans
PNKMSPSLVHQILAITHPYVEYLEENITKWYILVPGILIVLNVLTTLHTKYLEYKFNAKPVTNFIQDYTFGVITPLILIYYKSQGTVMEFANNFWNFKFLIKIPNVGTRELTIFGMHLIENPRNPGEYQGGYWVTQFNHFSLGTRHGFLYSLLGDGIFTLDGAGWKHSRSMLRPQFAREQIAHVKILEPHMQVFFKHIRKNKGKTFDIQELFFRLTVDSSTEFLFGSSVESLRDETIGMSPSVKNLAGRDEFADAFNYSQTINAYRFLLQQFYWLCNGTKFRKSIAAVHKFSDFYVQKALSLSQDELDEQKGYVFLYELAKQTRDPKVLRDQLLNILVAGRDTTAGLLSFVFFELARNPEVYAKLKEEIYNKFGSGEDARIDEITFESL

SEQ ID NO: 14198 - protein, 103 aa, Candida albicans
QIKITTSMSSTTFNDIIDSVLPYLTKWYTILIGAGLIFVLSTNLKNAYYSYKLGCKNPVHLKRAGWTGIPALIDAIKAKNSGKLAEFGGDTFDELNSKNFYLN

SEQ ID NO: 14199 - protein, 239 aa, Candida albicans
IPLKKKSKKNLKGGYVFLYELVKQTKNPKVLQDQLLNIMVAGRDTTAGLLSFAMFELARNPKVWNKLREEIEANFGVGEEARVEDITFENLKKCEYLKAILNETLRLYPSVPINFRTSTKDTTLPTGGGPNGTSPIFVPKGSTVAYTVFKTHRLEEYYGKDSHDFRPDRWFEPLTKKLGWAYLPFNGGPRICLGQQFALTEASYVISRLAQLFPVLESRDEQYPPNRLFNSPFTAMAII

SEQ ID NO: 14200 - protein, 665 aa, Candida albicans
YNCLIHSFAMSITKTYNGDPTSLVPTQLVKESLRLIEDLKFFVATAPANWQENQVIRRYYLNHDEGFVSCVYWNNLYFITGTDIVRCIVYKFEHFGRKIIDRKKFEQGIFSDLINLKCGADAILEPPRSEFLEFLFKNSCLRTQKKQKVFFWFNVPHDKLMADALERDLKKEKMGQRPTTMAHREPALSFHYDESSSLYTQLGKHMETQKRINDAATSSTSNTATTLTDTGVSSGLNNTTSGGGSDSATSTHNNNEASTKPSNGSEKSSPEYTTTARGRDEFGFLNEATPSQYKANSDYEDDFPLDYINQTTQNSEDYITLDANYQTGSKTNMMEDNYDSFLDATLFIPPSLGVPTGTAATATTSNQVAFNDEYLIEQAQPIRTPLPPISSSTISGLLQPKSAAKFFSLQSANGGEEFFPAYQNDPSTANAGFVPPISAKYATQFATRQVATPTYIKAIPQTGAAAATGNGGQPQQYYDQATGNAFYPAEIPVLYNVVHPESEYWTNNSGAVATTAAAAAPMYDASGFPIPINQSYMVMNEHEMVPYQYMNSNGAMIGMIPPHQQQQQQQQQIAMGYQSMLRQQQQQQQQQQQQQPSSTMTKKKKQIHSFNNNKSLSSNGGGITKKSHDNNNHSKVKTLYGSLNDVVNSKVTKVINKEEVKQSQT

SEQ ID NO: 14201 - protein, 109 aa, Candida albicans
HDTTNLHHLSNLAFRMTPVKTHIQEDSDLDYVKHKLKRSRPNSPGPSTLPSSPVLGLSTNTTPLISASNSSTNLSSLGMIASFKPSMLHSQSSDALPSIKSLNLPEFNK

SEQ ID NO: 14202 - protein, 342 aa, Candida albicans
NMTPNGSRRHSAYMGSPRSQHSSTMETGYNPYEAVQKKQELYQNNNGNSPTVIIEEDPYIPNYKELSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLLSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERERRR

SEQ ID NO: 14203 - protein, 107 aa, Candida albicans
AEWHKHYEQVKGDWNKALDDLSTQWNDSKTQLNGRFDTEKDRAIKGVEDAKSNFEKLSNDLANDASKNQKLKDAQDHFGKSLENLKLFGDDVYNDFAKRFDDLFNRK

SEQ ID NO: 14204 - protein, 224 aa, Candida albicans
HIIMSAGKYLLGTAALVGGVYYYDQYVQPILPRQQHQELAYQTQRVENKGSELNNKLTKKIEEGKKFVNEKTESVTKQVKNSDVYQKLQSNTEDYKKHVEDAVDNDKNVFVVGIQKYIDFVNQLGEGKVQTGTTQYSTVSPNVEVKEKSIFGNWFDKSDNKVDQLKNDADKKINEAKDKAESTKSDFFNWNSKKADELDKKANEAINWTNKQIDYASAEWHKHY

SEQ ID NO: 14205 - protein, 147 aa, Candida albicans
NNYGVTLVYLVNTKSIYRCRFFRRVLANILLTKKTNLSPITSLSIFNPMPTATIDCSSAQDILNNPSTNDNDLIFTPYGLMLLEIQGELNLPNEFPQGQPKTDEDHEYLNNFITINEIQHAVKFGNLVFDEQDNSNFQHALEGPHWL

SEQ ID NO: 14206 - protein, 246 aa, Candida albicans
NYSHTHTYRKTTIMASTMTSRDRFRTEGTTTLDDTNHLLYDLERKLSLTSNTSSQQTHTSSVVHSSHLLGLGRQNIQSQVLNQIMNDEELNNQDDKHQRIHNSIFNPDEIFQERQNNKYMTSKFAKNYNDDNLTKNHKLNRKNSLNISKSRLERNSCTSEDIQNNKPLPPAPQLQENNEYDINKSISGIHEVEDPSMSESEEELLANHLQMPQEVEHYHNSNYNYQEEPTYGLSYGGDDYDDSDSG

SEQ ID NO: 14207 - protein, 236 aa, Candida albicans
DHCYNTWLFTKMYTIIQKIKWPLVLCDFVFKNFNTNYRTLELLNLKESRLREIRFSGGHVKELSIDLFPVSVENLTLMEMGIHELSASFESLKNLYRLSLMGNQLRNVNSVKLPVSSLEVLNVRQCNLRLISPFLVSMLEEKNQNANLRVEATGNLNVNINDARKVMKAIKGLSLELNRLNDSILKISNHSYRLEAVYRDFDPYFETPQSSETEEVVSDYDSDDLYNGSVFYLDEN

SEQ ID NO: 14208 - protein, 258 aa, Candida albicans
SFPGSSQTSLRNHCYNTWLFTKMYTIIQKIKWPLVLCDFVFKNFNTNYRTLELLNLKESKLEKISICGGGIKKLDVDLFPISVKDLALVEMGIHELPASFKRLNNLRQLSLMGNQLRNVNSVKLPVLSLDVLNVRQCNLRLISPFLVSMLEEKNQNANLRVEATGNLNVNINDVRKVLKAIKGLSLELNRLNDSLLKISNHSYRLEAVYRDFDPYFETPQSSENEEVVSDYDSDDLYSGSVFYLDEEDNAYNNKKRKE

SEQ ID NO: 14209 - protein, 114 aa, Candida albicans
YLLPFYAILRSIPDKLGGVIAMFGAILILLSLPYTDRSIIRGNSFKVLSKLAFYLFVFNFILLGNLGQLHVEVPYIQLGQFATAYYFAHYIIVVPVISTLENILYYIGTQTRVK

SEQ ID NO: 14210 - protein, 397 aa, Candida albicans
NSVPLTNYRNRKILQKNVQPQTQHFFLNKSLIMLGRIAKRSISITTNTPLKLPFIPLVSETGFPGAIGNTPLLKLPRISESINRNIYAKAEFMNPGGSIKDRAALYIIKDAEEKGLIKPGGTIVEGTAGNTGIGLAHVCRARGYKCIIYMPNTQSQNKIETLRLLGAEVHPVPAVAFTDPENYNHQAKRHAERLDNAVWTNQFDNVANRQAHIETTGPEIWAQLDGKVDAFTCSTGTGGTFAGTTRYLKDISNGKVKAVLADPPGSVLYSYIKSGGKEMIRGGSSFTEGIGQGRVTDNLQPDLELVDDAVKIPDEDSIAMVYRLLDEEGLYLGGTGALNVAAAVEVAKLLPEGSNVVTVLADLAHKYADRIFSKKWLAEKGLYDAIPPHLQKYAVLD

SEQ ID NO: 14211 - protein, 69 aa, Candida albicans
ISTMSSIPNINWNDPNNGKSNTSRQSQPQPQLPSNVSPPNSRAVPTSGSISGPQYGSSQFSNEYPRDPN

SEQ ID NO: 14212 - protein, 206 aa, Candida albicans
PGSEYADSITVNPHKMLGIPNTCSFLLLPQVANFQTAMSLKAPYLFHGRELGSDENYDLADGTMGCGRRSDAFKFYLGWLYYGEQGFAKRVEHAYSIMEYFVQSIRSNPNFEIVGPQSPQCLQVCFYYHPATVNKSNTEITRYVSRKLHKLGKYLVDFSPNPVDDTQGEFFRVVFNSPILSDKIVDELIASIISVGKELEYTGTVR

SEQ ID NO: 14213 - protein, 185 aa, Candida albicans
  UNSURE (174),(178),(180): Identity of amino acid sequences at the above locations are unknown.
DGMGGLPKKKKKLFCMFTLWISSQSTRILCKYWISICYWDNLYMIKGVSFLGQLMLKRSFSKVANTSNRLVTTTKMSTDYTNWSKEDLISKINQLESNSFTTFNGETSSQRSIKPVKKQKKKEFDWSKQNMRFVAFKFAYLGWNYNGLALQLEPTPLPTVEELFLRALAKVTCXNQHXSXSKPPL

SEQ ID NO: 14214 - protein, 172 aa, Candida albicans
NCFDWTGSAFLWHQVRCMVAILFTIGQSLESPLIITDLMDTNKFPTKPQYEMAHDIPLVLYDCEFPSMEWKSTDDEYRLHRVIQGFTRMQYDLQLKTQMLQIMEDTLFKNQDPTTTTTKILKTMNNGDGVGRSYNKYMPILERERTESYEVLNLRWMEKKGYRRGQEKLNKE

SEQ ID NO: 14215 - protein, 64 aa, Candida albicans
IHQQFDSMSVEDSIISLDSLQDQGINAGDINKLKSAGICSITVRIIKFTSCLFLVFTTGLQGPR

SEQ ID NO: 14216 - protein, 143 aa, Candida albicans
GDSYIIHHPLNIVVPKLSESELEDLRNGFDWGDLKPWIYLFKGLSFYVCGNNLSARFLKERIERFSGDLSKHFIECCYIVIPDNHSRPLMLREIDKMSNQISREMVIDENGGSSRIPHFVTEAFVQASIKMNYIPDPDDYKFR

SEQ ID NO: 14217 - protein, 724 aa, Candida albicans
  UNSURE (707),(715): Identity of amino acid sequences at the above locations are unknown.
PFCRSFSAYSCDHNSRVYMTYFLNDIRPPSPNDITPSFTLLTKELFDKLDGVRKESLGDFRTVTEKKAFIIKTFINTFRTHIGNDIYPSAKLIFPEKSGRIYFIKEVALARLLIKMYKIPKESEDYITLHDWNKLYQRSRRCSIDEKKIRELPLQASRIISKMEPIVDKLEEYTVPQINSSLDQLALEKVSQGQIDILKPLFDNLSIPEVRWLIHILLNKSILTSMERFFFNTWHPDGYRVFSICNDLQKTLQFSTNPDLRLDPLQLAIHPCFKFKPQLSERLTTSYKTLVKKLQRKHEMDPPYEKKFQELGLENKFYIEEKMDGDRMLLHKDGDSFKFFSRRLKDYSYLYGESFQFGALTKFLAHAFAGNVQSVILDGEMVAYDYERNVILPFGTLKSLAIQESVRQFTTIDQYEQQTAYPFFLVFDILFLNGKDLTNYPLFFRKNILNRILRPIPNRFEVLDTRLGSSLEDIERAIREVVSSRCEGLVLKNVQLKYEIDGFRNPDWIKVKPEYLEKFGENLDLVVIGKSPAIKNSYMCGLKSVTDGVYYSFCTCANGIEIEEFDKIERLTHGKWIKTDVAMPPELLIKFGTKIPTFWIHPSDSLVLEIRARSIDTRAGTLYAVGSTLHNNHCRKIREDKSIDECVTLQEYTHIKANYINDLNKAQTALGEKREPVYSLNNELKLKKIKVESDLFSGDKFLIMSDXREADREVXTHRRNESNG

SEQ ID NO: 14218 - protein, 180 aa, Candida albicans
RPGFLAKTLYDRLIQECLNLQNSGKESKVYSSILKNKSKFLIAHASTGYLQGLEEVLDDPQTKKRLADTKFLEELEALQRFQRALNDDDGRAWYGLEEITKALNMDAVRYLMVSDALFRSDDIEESRHYIDLTEQAKTLGAKVYIFSSLHESGEQLNQLTGIAALLKYPIPDLDDSDEED

SEQ ID NO: 14219 - protein, 512 aa, Candida albicans
NLRQMNRLVSELTSRNDHKLAVCQLYRALLRKTNQLASIPASINKFELKYNIQERFRSNYGSTFQISEQILKGITLNEALSLALGGNWDDLKQFIDIQRKEVFLYQKRRADYLTNKEKIEESAKKTARGKVKRNLLARSRRKTKYYAPDLRMPDSEQQFIKDGLANAKYQGDTVLKQFLHELQSLKKIPDPKLLPYSPELIFTAGDNLNFDHIIRGTSSKSLENFDQDILKAIVIPAMEYDINKLYLDQLKSDLDNKGPYKATVHEALAGTVPVPYIMQPTKKKIGREEIAKLIKKQIFFRRMINIWESQTHLTEENKQKDGSYPIKGSHGFGPEELVYPREYYQELYDAEEMYEILLQIHINELNGKPNDPLDLEQFSWSESLDIASNYLRDAYKQVIQDSKMDFKELQDHLQKSFNNHYDEQVEKYGRLITNLQKHNVFKHSEIVSPPGSRSIFDVAAKRSIDFFPKEEVIGKGKTLGEFMAESGFKHYKHGYKLTKRIAQIMKKLGKDF

SEQ ID NO: 14220 - protein, 248 aa, Candida albicans
RMQLLRLTLLFNGYLIGDNEEQNLAGFLKLFLYVVSDYNANKREYTTLEYFTVSIFTQLVRKYHKPDNNEFVLLLFKYISGIETSNYGNAQETDTTKSLELCFNFVRLLNVAFTRNNDTNITDIIYKLNIMLISNASSLDQSIPELVNDLVSYIKLTDIDLKFCYKIKALIFILNGNYMVNQSRDTLNQIKEDIMELKKIFYSSMKKLTTATENLDLVMMVQDAFHQLEYLNNMIESFQHEDLFYNDI

SEQ ID NO: 14221 - protein, 216 aa, Candida albicans
YQLTMVFGFGKDDDKDKNDRRDNDSYGSSNRRNNDDSYGSSSFGSSNDDYNSYGSSNKRSNDSYGSSNTDSYGSSNRRDNDSYGSSNNDSYGSSKTDSYGSSNRSGNDSYGSSNNDSYGSSNRKGNDSYGSSNTDSYGSSNTDSYGSSNTDSYGSSNKRGNDSYGSSNDDSYGSSNDDSYGSSNRRGNDSYGSSNDDSYGSSNRRGNSDSYGSSDY

SEQ ID NO: 14222 - protein, 96 aa, Candida albicans
VDDKDDLEFLETFAGAIFTERSFDLNFNLIENELTKENNEVLLLPDTTEEIVSWINKLPYDTPLSWIYLSDDANLLVKKQLGLEIVESVLDLSEDL

SEQ ID NO: 14223 - protein, 228 aa, Candida albicans
  UNSURE (131): Identity of amino acid sequences at the above locations are unknown.
CDNLKTCHTSHGSVMAETAVINHKKRKNSPRIVQSNDLTEAAYSLSRDQKRMLYLFVDQIRKSDGTLQEHDGICEIHVAKYAEIFGLTSAEASKDIRQALKSFAGKEVVFYRPEEDAGDEKGYESFPWFIXRAHSPSRGLYSVHINPYLIPFFIGLQNRFTQFRLSETKEITNPYAMRLYESLCQYRKPDGSSIVSLKIDWIIERYQLAPSYPRLPEFRRPLPCRCCF

SEQ ID NO: 14224 - protein, 109 aa, Candida albicans
APRAFDIANHLAEWQGFNCDRSAIPEPSISNPVLVNWCCGYLNDMNASKEIVESLIDEIKAYYGLPGFYWGIWAMIQSELSNIDFNYLNYGKLRLEEYWQWKNDYLKNK

SEQ ID NO: 14225 - protein, 73 aa, Candida albicans
CSQNLKLWINDLKNDRIIIGFCRFSTSIPDLVEKLKLGKPLNYYNREEFYKYYNYGYNSYDESEKQVIGKPLA

SEQ ID NO: 14226 - protein, 263 aa, Candida albicans
TLVFNTLSQRIAFAPSTRYRATKDNIPTDLQLEYYSQRSEYPGTLIITEATYTSRQGGLVPYVPGIYNDAQTKSWKKINDAIHANGSFSSVQLWYLGRVANPKDLKDAGLPFVGASSVYWNEESEKLAKEVGNELRELTEEEIDHIVEVEYPNAAKRALEAGFDYVEVHSAHGYLLDQFLNLASNKRTDKYGCGSIENRARLLLRIIDKLIDIVGAERLAIRLSPWATFQNVDVEGEEIHSYIIDQLQERAIFTTGLKDPPMR

SEQ ID NO: 14227 - protein, 308 aa, Candida albicans
SINTSNNPPISKLFYFCLSLQQTTFLYFTTNYFPFVKMKFSKIACATVFALSSQAAIIHHAPEFNMKRDVAPAAPAAPADQAPTVPAPQEFNTAITKRSIIGIIMGILGNIPQVIQIIMSIVKAFKGNKREDIDSVVAGIIADMPFVVRAVDTAMTSVASTKRDGANDDVANAVVRLPEIVARVATGVQQSIENAKRDGVPDVGLNLVANAPRLISNVFDGVLETVQQAKRDGLEDFLDELLQRLPQLITRSAESALKDSQPVKRDAGSVALSNLIKKSIETVGIENAAQIVSERDISSLIEEYFGKA

SEQ ID NO: 14228 - protein, 105 aa, Candida albicans
KRNQRERKRKAQLPKVHECTFEGCDKSFAKISDYKRHYRIHTGERPYICEHCGASFNQRYRLTTHTRIHTGEKPFQCKYCGKTFARGDAVQSHIFSIHRAKGEAF

SEQ ID NO: 14229 - protein, 219 aa, Candida albicans
QIKGEMLFQATLIPNLRKLCITAEYQIISYRLEELTMLEYLLLNSFGFTSFYALEMNVPNLKTLILTECEGLSEYDGLEDCQHLKHLTINDCAYPFEIFNETRFLELESFEYSGSGYINPKYFEKENLTFPPNLKQLSIKTSDFVNVRSSQIVFPTSLIRLELLDVSFIDQYFHLDDNLQYIHIETPKLLFDNKFNIPFMTEELILKVFTTRSKVRTYV

SEQ ID NO: 14230 - protein, 149 aa, Candida albicans
FCSTTYTSLVGVLKKNINIQNEMGRIHGFLGGVLLTSSLAYSTSQYINKNQQFISQNLRQSDYIINNRILSDADAKLRENYVPDSHVKYQSRVNFAETCKDIWNEEIITMVNWVYSLNWYKMGLDIDAKVNQWTDRIAESVAKKAEEKK

SEQ ID NO: 14231 - protein, 312 aa, Candida albicans
  UNSURE (4): Identity of amino acid sequences at the above locations are unknown.
ERLXEVYIHRTQVVAEFNHDTQPKGSSLNAIQPPAPVPAPPPQTHTNVTNEKYQKATLNESTAKPIPPKRNNNSVKPSTKRTLTSGPSDILVSRSQEGNPLLSTPIMQATPWSFDKSLLSDYYINPKFQIIFLTLKYHKLHPEHIWNRWKKLNQGSSTVHTRGDDALRVLLVVVDVDSHQDLLRKLLDFCIKHDLSLVLAWSYEEAANYIALCKQLDKAPLKGRKIIEGTKGSDYNSSVVKAFTGIKLVNKTDVSNLLANCKSVKEIVLQSCQNDNDDGIGLASIPGLGAKKLENLKKVFLEPFISNKDYDT

SEQ ID NO: 14232 - protein, 415 aa, Candida albicans
FDLFFIFNFLTEFIYLFKEFLPVTIINLMMPSIDTDIDIFVVLGKLPSDIVGLILDYLPKCMLHELLYFPPIREVVASAILSKILILKVIHRNTDHNECNCDLLDITPKKLKRAIDQWNIFPKFVVMKDFNLFKAVLDLSPQVLHNAINLYGVFCVKSDADRQKSLEIFVNSNVKFSHFALMNFGHVTTLPTVTTSLTLGDTTLASYMVDGLKRLHVSQGFIEERVTSYNFPSSLEDLEIEGPRSPKVILPPNLRKLRFATIPDSIESMPGQAAKMEELLLALPHIESFDEIGFVSPNLKILNIEYCGKLTNYDGLKKFQNLKELSIKYCNYLIGVFAGNLFPELKKFEYMGTDYDFGIPDFIPTDLFGTTLEFPPNLKYLSIKFASFMRVDLSTLVLPSQLRHLELWGVKLGFG

SEQ ID NO: 14233 - protein, 446 aa, Candida albicans
RPAVTTSLTLGDTTLASYMVDGLKRLHVSQGFIEERVTSYNFPSSLEDLEIEGPRSPKVILPPNLRKLRLATIPDSIESMTGQAAKIEELLLTLPHIESFDEIGFVSPNLKILKIEYCGKLTNYDGLKKFQNLKELSIKYCNYPIGVFAGNLFPNLEKFYYQAKDIDDTLEDFELSEYFDNVTLKFPPNLKHFSIKFANFMTVDLNTLFFPHTLKHLELWGLLFSDGYLHLSENLEYVRIRSPELEFDDNFRIPQKMKYFQVTVNYFYFETSDFMYHLPDGLEHLQLVSRKDGDMGQLYNKVQWPKSLKIFRLHYFSFNPRSLAFLKLSKSCLEEIDIRGGHYKRLNADSLPKSVRVLILKKMGIQELCGSFERLNNLNKLLVTHTNLRNQAPIKLPVSSLSLIDLRYCKLDTKSPFVVSIRQEKNKNTCLKVKESDFWGMSDMEM

SEQ ID NO: 14234 - protein, 293 aa, Candida albicans
SSLDFETDFFFSNINKPHLSFDFLLPMSQDRDISSLIINQTFKIYKSNSSLSSSIKLTKKQLEKFRITLCKYLYQRYQQTLQIEDDLLVQYELYRDIVPELTIYNNSIEEHSQYKIQYLIIKCANNRLISRQVFIFVSNDDDFTLVLNRITNHPSINEYILELLEDINDYPLIIKPLDLPDYLIPNLVDQLGNKLDSLGDLQLVYSSSTSNRLRNFIIDIPKNDLPKLSSDGKLYQDIVKFMYNNTKIKFEKLRIEKFINNLINIASDGKFKLIINDNQLIWFLIESIKSSLQ

SEQ ID NO: 14235 - protein, 532 aa, Candida albicans
GIILNLAKDSLPELRLRHSNKLVVQKWGTLLLEIIDNESVVTNIYQLTNTYWTHLPPEICVPQNLTKLNNAILSGTTISNSDIARILPTPKQLLLNLILALPLVNQTSLTDLEYKTQIQQIFQKTLHELRPNDKLGVIFLGIDGSKKPCAKGSFVGCTEPSWSEWKQVIRDITIVPNSFQSNLQEINVAIEKCMELYPFIPRTTSSVNKFLILSPNTYSQLPKDAPKSKSIDAINEKLSCTIVCVGSTYGNYQPFKSITTFGTPFLRFESFAKFGSLLVYYINENLHKICIPKLTLTLKASQGFRFTDLDSRGAIDGSQLTLTIKDIVPQTQKLIVLKVQANPQFVASKYQTLPIFEYDGYWFYEKYLDTKLISTRVKIGVSQQPPTPIDAEARGSFTEYYLDIPLLPPVSPARDAVFAKRQTELTIINSLKKSIALGESQVSLDIIKSCISLAHGLIRTSLEGSTKSHTNESSPECEYSMLQLLMAVRYTDKGNVEYIDFLVNHMKSIAKLLESDLDAGKLRCSDLMNSLI

SEQ ID NO: 14236 - protein, 314 aa, Candida albicans
IQIPVGGILWGRKRASVSGTSVNVTDGDQVVYEIDSELPNKQEWLDLLAGTELNWLQAFISTDRIVQGSKHVSNPLHDILTPAKHSKVTIDKKTKKLTAFENIKGDLLPVVEIELVKPNTIQLSLIEHRTADANPVALPFLYKYNPADGFAPILEIMEDRNERIKEFYWKLWFGSSVPYSNDINVEKAILGDEITISSQTISEFTHAIGNKCDAFVDRPGKATLAPMDFAIVIGWKAIIKAIFPKSVDGDLLKLVHLSNGYKMITGAAPLKKGDVVSTKAEIKAVLNQPSGKLVEVVGTIYRDLHHEGRGPRLF

SEQ ID NO: 14237 - protein, 110 aa, Candida albicans
RYEASQWTFARGAAATIDREFGFVGKHIFHDIIETHVLHHYVSRIPFYNAREASEAIKKVMGIHYQHSDENMWVSLWKSARWCQFVDGNNGVLMYRNTNGFGVDPKKQTH

SEQ ID NO: 14238 - protein, 441 aa, Candida albicans
LSIMAAATTSFSSGFNNNNNADQSTDSSATISKSGNVASFKTTSTTSTYQTNLTAIDTYGNEFKVPDYTIKDILSAIPTHCYERRLLQSLSYVFRDIFCMVVLGFIANNYIHLIPNQFIRFAAWTGYVWCQGLFGTGIWVLAHECGHQAFSDYGSVNDFVGWILHSYLIVPYFSWKFSHAKHHKATGHLTKDMVFIPYTKEEYLEKNKVEKVADLMEESPIYSFLVLVFQQLGGLQLYLATNATGQVYPGYSKIAKSHYTPTSPVFDKHQYWYIVLSDIGIILAFTTVYQWYKNFGLFNMMINWFVPWLWVNHWLVFVTFLQHTDPTMPHYTSKEWTFARGAAATIDRNFGFVGQHIFHDIIETHVLHHYVSRIPFYNAREATDAIRKVMGEHYRYEGESMWYSLWKCMRMCQFVDDDKEDAKGVMMFRNVNGWGPVKPKD

SEQ ID NO: 14239 - protein, 403 aa, Candida albicans
FKDLSSFYTMALQYSPAKSSKVSKRPLSKSPIMSFQKDVRKILLPSTKVYKDAVSNQKLQSPTTLEDNKLTVKDYKVRLDYQQFSGKDIMVAIDTILNNKWAESTQLHNRYPTKQGTMEERIFGLRVLSNALKTDILKFRRNFPMGLVTTTQLYSIFLNESNTFVDKSLESHIRSGKLKKIVISNAAPIILRSVNKFQLGKVTYGFENVELVVKSDSYFLVISGMRDLLEEEELKNNQLSGALQSKKQSSISSLDKFMKYLKEHPTALYISYSADNGGFTAEEITYLVNSGFVTLASNHLIEIEINVYSISYPGCGAYLKLVNSGRSWLVKVLGKNKHKELLEDQIISKWEGVNATGESKMNNFRSPFYGYDLNWVLADALGAGVVEVFNTPVGRGWRLTGKI

SEQ ID NO: 14240 - protein, 641 aa, Candida albicans
KPAIHLSIGDSLHILFFFCSLNLQRAIFVSTMASQTTDTDLFTRLAKLPPNVIALIVDNLLKCILPPLLYFPPIQEITTIAILSHVSITDRVWRHEKTNLYSINNDGCNCTLFSIQLSKLEDAVKRWNFYPRSISFVDLGQYRNTLENFPTVLEKAQDVNCHFFCSNGKERGYLKQILSTSCRFNRLNLHDLGAIPKISSVVKDLLLRNTWLDNYFIPGLKLLQCDLTHKNQAVDYCFFPTDLDELSVTINDRNIVSLPPNLKRLQVVTTHRTANLTGQKMLNLKNLQLCFPNIRTFGEAKIIAPNLEVLDLECYKLTSFDDLKSLRFLKSLNFVGCVFPVSLFKQVYFPELEFFKYEGTVPLFLTKKPKIDKTVPEEFKNLSLKFSPNMKRLKIINAKFLDINLSDTLFPASLEFLHLSEVTFSDGYLRLGENLKTVYIETPRVAFDKSFRIPKAATEFIIIVDFLSFENSDFMYHLPSCLESLHLNGSKKSSMKPLEQKVKWPLSLKVFVMRCFNIDSKTFEMLNFQESELQEIYMYKGDIKKLDADALPASIETLTLNRMGIQELSESFEKFKKLKHLALEKNPFKKLSPVRLPMPSLKKLKLTKCNIKLVSPFLVSKLDEKYLKSRLAVIAIVNIQT

SEQ ID NO: 14241 - protein, 381 aa, Candida albicans
TNVMKKQRLNHQEIINSCFKPPQEAIDDLQKHKELFPLGFITSDCSTLLDKYGTLKVYQAIDTSLNETGKNHAEILSHYPEYIENDSFECFSLQITISNKETGYTCEELLKLREELIYIHRTLDFTIVHKLMAFVTFVEEPVYDNNSLEMMTLTNLINNLDLDFNGTVEHIKVDQFKNRQLLSFQLPMYIRSQARSLFETNFLNKKDKIVKEYDPVILYTQPPGKKGQSEIKDYVCYFIVDLYSGQIPKRRIITTTTTTTKRKSTKTKANSGKQKNILDKCTSKVVSRCRFCAYCRAMTHTKYQCPFIKPCTKCGIKGHKTSSCKNDTLTAKEDTKNLKKKQYFPPLPNKEVQRYTEKESIKSKTLKEPKREVNILLLKKN

SEQ ID NO: 14242 - protein, 591 aa, Candida albicans
RNNNKKKKNPKDTPSSITTTDHIYPELILQESEHGNKYYSCFQSYNRQFINDPTTTTTTTNNINHHSEIVRWTGSTIELTASIILDNWLNQSSGNGTKSNNNSGSNSTTTTLKRHISRPNALFVWASTDEYIEERKKELRRLQKLKDNGQDQTQDKSQQIQNGTNNRPTDDSKNKNNSSTGKSKQDIVKQNLKQKLDIEFSNVAINNKLNRIIEIESNKFIHARIQRIKAHYSEQMEKQINERKRKDQELYLKKLKLKEEEYEQESSLRSKNSTNSGGGTFLGNLFGFNSATVGGTSVNTLESTYNNRSSTESSRTMDSTNASITTPSVMTPSAKPKRFPLFSVAGLFGGSSKKNSSKTVLFEPNEINEDGKDETNLSTPTIENNELVDPENGTRPNIVIDQDLESKPLPSPPLPPKPKPCENRLTPDLNQDDTNNQHPTQPQTTATTTTTTNNFFSIDELEQHIKKSAEPSPSKSNKFNDFLAKGQPTENGTTSTNDNNDYDEDDEEFDDFTSAQPIHDNNNDITIFQDPPKLNRNFFSIDKAKGNSVSKSGHNQINNDLLEIFSPTRTSSAPVSKLPSPAFNELSLLDL

SEQ ID NO: 14243 - protein, 333 aa, Candida albicans
  UNSURE (304): Identity of amino acid sequences at the above locations are unknown.
IYQIDNLGNLEIIELGSVPKSLHDGRYGLFIIDSENVLRYYNGEFHTIDDNASSIRVDQNKGYIYLLVNDKKLIKLSKTGQVVFTTEIEVGSIKEFNKGILLTGNDQIFKFDEHDKTFKRIENDSFKNLVIVDNNLLYATLNDAVQLIHVTKNQKTELLEVIKLKPNAKVELFTTPLNAFLVVSYQNLKQVHDLTDLLDTKDAKSIKQLILKLSLDFPHLLVSINKDQLNLLLINDQLVGEVYSLFDGSKVESIYPQFHQYSSKANKYIIVDEPESESIKHELELILHEGDGVYVLTNWNPKVXRHLAELGKFGSVFNYKNLFTSNESLEFVK

SEQ ID NO: 14244 - protein, 93 aa, Candida albicans
KPFVIDKMLLILAWGFNLWYQPPPPTAQTEKEIEHTINSHKIVIYSKTYCPFCDQTKHLLNEQYPQESYEVINLNILDDGLTIQNQLIIILVL

SEQ ID NO: 14245 - protein, 135 aa, Candida albicans
RPAGSIQQQQQQQQQQQQQQQQQQQQQQQQQKSIDNDQDSTNEELDPKRFEKISNIIKTYKQSITKLRTNFKNLIIRGSNGTNFYIDIITDNMFIMIVLKDKKDTQNMIQQHEELLISDNIKAARTWFEKIENNE

SEQ ID NO: 14246 - protein, 253 aa, Candida albicans
  UNSURE (2): Identity of amino acid sequences at the above locations are unknown.
YXIKTYSSSQLSLNHIFFTAKFLTPYTYTPSHNIHSFMVESSASIRKSQDSANDNNSEIDQTELRYFTEVDIDEQPSNNTFDEEEDDEEDISSSANSAIEEEKGVSNKQSWRKVLMLCFLSLGSIYGDLGTSPLYVLNSIKYSSYPPNKEDIYGAVSIIFYIFTIIVIFKYVLIVLFIGVNCNHGGQVAIFAKIARHLGIGPRGVSLPGAPEASDMQLLTRQDTTTSSIKSTQTRVEKIKENPILLSFLQYFI

SEQ ID NO: 14247 - protein, 191 aa, Candida albicans
  UNSURE (12),(26): Identity of amino acid sequences at the above locations are unknown.
LVRFHYLDIPGXGFMYVDSIMTNSPXTLPQLYGKLITSFASIPSEFVFVGIRVLSILYVNSDERILLAPMKIPGHYKCILRFGFMENVQIDKELSSKIMARIPGLSVLTPEQLHNHPIIHFFENDLIRCHQYHSGKRNYFKKFGHLIRKTIINHIYSPLYSLTQDKGGFLWYDNEKEESEKKLFIGGISRI

SEQ ID NO: 14248 - protein, 247 aa, Candida albicans
KKFSSSSIFSVYVIIFFLNGKERIPTQVQSRLESIEFINWNFTHNINMSSEKVKRVEADATDLLASLSIDKSGEKLEEIKKGSTPDPSDLLGGLSLKEGDSKKPEEKKEVVEEPENKEINDDKKDEDKKDESKDEVKDGDGAKEETKEEVKEESKEEPKEPKEPKEPATNLIKSSYEVKVKLADIQADPNSPLYSVKSFEELGLSPELLKGLYAMKFNKPSKIQEKALQWLLSNPPRNMIGQSQSGT

SEQ ID NO: 14249 - protein, 82 aa, Candida albicans
RLVNYDMPTDKYGKPDPSTYLHRIGTTGRFGRVGVSISFIHDRRSYDILMAIKAYFGNVEMTRVPTDDWDEVEKIVKKVIKS

SEQ ID NO: 14250 - protein, 64 aa, Candida albicans
LINLVCLMKLKLDLLVLFSPGETLRVLAWKESDDTVVFQTHVVDRGTIAINNAAIKLVGDKAKI

SEQ ID NO: 14251 - protein, 823 aa, Candida albicans
GGALDGQGGNSKAADIVVDEITKNGGVAVADYNNVLDGAKIVETAVKSFGTVHIIINNAGILRDSSIKKMTEKDFKLVIDVHLNGAYAVTKAAWPYFQKQKFGRVVNTSSPAGLYGNFGQTNYSAAKSALLGFAETLAKEGDRYNIKANAIAPLARSRMTESILPPPILEKLGPEKVAPLVLYLSSAENEVTGQFFEVAAGFYAQIRWERSGGVLFKPDQSFTAEVVAKRFSEVLNFDDSGKPEYLKNQHPFMLNDYTTLTTEARKLPSNDASGAPKVTLKDKVVLITGAGAGLGKEYAKWFARYGAKVVVNDFKDATKTVEEIKAAGGEAWADQHDVASQAEEIIKNVIDKYGTIDVLVNNAGILRDKSFAKMSDQEWDQVQKVHLLGTFNLSRLAWPYFAEKKYGRIVNISSTSGIYGNFGQANYASAKAGILGLSKTLAVEGARNNIKVNVVAPHAETAMTLTIFREQDKNLYHADQVAPLLVYLGSEEVEVTGETFEAGGGWIGNTRWQRAKGAVSHDEHTTVEFIRDNLKDITNFDSDTENPKSTTESSMAILSAVGGDDDDDDDEEEEDEGDEEEEEEDEEEDDPVWRFNDRDVILYNIALGATTKQLHYVYENDSDFQVIPTFGHLITFNSGKSQNSFAKLLRNFNPMLLLHGEHYLKVHKWPPPTEGAIKTTFEPISTTPKGSNVVIVHGSKSVDNDSGEVIYSNEATYFIRNCQADNKVYAERRSFVTNPFPAPKRAPDYQVDVPISEDLAALYRLTGDRNPLHIDPNFAKGAKFPKPILHGMCTYGLSAKVLIDKFGMFDEIKARFTGIVFPR

SEQ ID NO: 14252 - protein, 158 aa, Candida albicans
SQRIMSSKIERIFSGPALKINTYLDKLPKIYNVFFIASISTIAGMMFGFDISSMSAFIGAEHYMRYFNSPGSNIQGFITSSMALGSFFGSIASSFVSEPFGIRLSLLTCAFFWMVGAAIQSSVQNRAQLIIGRIISGIGVGFGSAVAPVYGAELAPRK

SEQ ID NO: 14253 - protein, 362 aa, Candida albicans
DADFPPRGEDWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 14254 - protein, 378 aa, Candida albicans
TLGILIMFYISFGLGHINGVASFRIAWGLQIVPGLCLFLGCFFIPESPRWLAKQGQWEAAEEIVAKVQAHGDRENPDVLIEISEIKDQLLLEQSSKHIGYATLFTKKYIYRTFTAIFAQIWQQLTGMNVMMYYIVYIFQMAGYSGNSNLVASSIQYVINTCVTAPALYFIDKIGRRPLLIGGATMMMAFQFGLAGILGNYSVPWPESGNDSVNIRIPLDNKSASKGAIACCYLFVASFAFTWGVGIWVYCAEIWGDNRVAQRGNAISTSANWILNFAIAMYTPSGFKNISWKTYIIYGVFCLAMGTHVYFGFPETKGKRLEEIGQMWEENVPAWRSRSWQPTIPIASDAELARKMEVEHQEDKLMNDDSNSESKENQV

SEQ ID NO: 14255 - protein, 153 aa, Candida albicans
IRYFNMAVLCGICQVEQSKYKCPKCSIAYCSLTCYKSESHTHDNLPTVTDTTSQPPQQQQQTTTTTTTTPGDDKFLKLLQDDQIKYLLNQPSLQFHLLSIIKILIDPTFTPKNSNIEQKLDIANLKLNDLRIGGIEQNELVEEFVQRCLELMN

SEQ ID NO: 14256 - protein, 623 aa, Candida albicans
KKIQDANHIFFFAKLGMMVGQAELTRESHKLIQELIAVSLYCISYLRDLFPENHYSDYKYYDTTEPTSDSNFILTKKLQGNDNAEINMFINYIEKGINDAIKLEYLKGVLFEIFLSKEHPQLICESYLFTINYLRQEVSINDETSFRATKTTIIQSIQGIVKRLILLTQTFDRLPDEKYFAIRLLFNESCPVRYQPPYFQDATYAKPSSITVNQGYIGLEISQMNAYNNCVKMNILVETCKLENCHSIDPFDLVDKQIDQFEAVPSCNIDLDEYLDDPNMTEVQSQKQKTNTFEVTNCRKCNISIYSVAYGYNKPIKNSITCFKCLLKNKFDNDLSILMSIRLLWHFFMMNEFPSFEKSLELIHLVHTGSVVHVFNKMFSDKILVVTNKAMFGPNSVDFISGSGSFIPTVEGIIANDGKQLQKHSEYFVSFVPRMCTIPSFFAYNKKLDSVYFPNYLVQRADFVLSNLQKFKAGSFGKRIVGSSSSSSLQVTKPNSKSGAICKLKSGGRGRGRPSLVSSLFKPSLHPSGSIYSQSNSIIESTNDMTPLQLKEESSPTTVVECSTQNISETLDDLSFEESLQYLSQSLELQIVKCKQQQQQEQQYYPPNFYQNKISRARKQTYI

SEQ ID NO: 14257 - protein, 92 aa, Candida albicans
CKNFTCCKHRHYLRNIIINSSFEHLNKLLISADNKTIGYPDFMLLTPLLHIFLVHSLYGLLCFFNRIDNSIFVLQEGPLVTPDLTKFQRVSS

SEQ ID NO: 14258 - protein, 355 aa, Candida albicans
YIITKKKTPLIITMSAAVSTLSDIIKRNDAVNVNPPNPIIDLHITEHGTDWLWAVFSVFALFAIVHGFIYSFTDVRKSGLKRALLTIPLFNSAVFAFAYYTYASNLGYTWILTEFNHAGTGFRQIFYAKFVAWFLGWPLVLAIFQIITNTSFTTTEDESDLLKKFISLFEALFTRVLAIEVFVLGLLIGALIESTYKWGYFTFAVVFQLFAIYLVINDVVVSFGSSSHSVFGNALILAFVIVWILYPVAWGLSEGGNVIQPDSEAVFYGILDLITFGVIPIILTWIAINNVDEEFFTKIWHFHLKPENEHAPTATEDVEKAVWLNPQELLGDTAGCSLQVFPEHWLLAPGPKPEG

SEQ ID NO: 14259 - protein, 331 aa, Candida albicans
FNISRYFFLNNLINSFYIYIRFCMIMNMTTDYRDPLLDLFGTESNSGNETSSPSDIPVINRSGTFNHQQFSPLLTQQLLYNTPNSGSTPNIFDPNYTQMHEEQTSPSLNKLQPEDPPIKKMNTISQTKIHQQLEGDEYNSNDNKDLIDLDKPPVVEPSPPFFVESDTTPEFVIPTPTLEQQQQQHHELIAQDYQRSNNSNQFGNLTHYEPNLPPLPPLSESILPQTNTFHPLVLPHDPRHAITAGPANNSQQQQQQQQDSLIPSDGISSKIQQLHAPSLSNNQSASQRKKKESSGPKTRPAFVMKIWSMVNDPANHEYISSSPTGLEGPAL

SEQ ID NO: 14260 - protein, 286 aa, Candida albicans
ASLVLPARCEDSLDSSIGLNSTQKILQWSCISLSIAIFTGVTSYLSEFILNYCGENWIVSLRQLTFFKLNNQDLSFFTGFDTNWSSLEITALLMNDTRDLRNLISQFFPLLANLVSMTLIGIIWSIVSGWKLALVGISFVPLVLLVTVLYGKILESIENKYKCKVNNVELDLYRTITTIRTIKIFNIQQYFETVFKEDLKVLNSIGVYRALQTGIGFAISDLFSSIGQAIILFYGMKLISQFQYNYSQLLQVITLLSFTISNASILIHQLPEITRGQRASSPRDRR

SEQ ID NO: 14261 - protein, 116 aa, Candida albicans
KLTQGLIEKVKKWRIGKTTIFITHEYKNILDDENVIILDQGMIKNQGQFKKMKNEEIVQNYKSQGIETSSYETTSQSFSDNTKLPDGDYNYKTNPYILKDLESQSSPRACQDPSLG

SEQ ID NO: 14262 - protein, 67 aa, Candida albicans
SGGILCPRGTIEIDTVSIDKLDPKYICPDITLLEQNPVIFDDKTIAENIAIDIVDDYDSLQAYLLFE

SEQ ID NO: 14263 - protein, 166 aa, Candida albicans
PPPMRIGLSLGEDWVRMFTWLKFGEIQQSRARMQIYNKIINESQSWYDSKQNLIGQLTQINRCIEELRSCNGEILASLMQTIVLILALLIMSFYQSWSTTLIIMASFPIMALCGWYFGKLTYKAQQDENEVTSKASKVFNWCYVNPEMVRFFNSKNIELTKFKQLI

SEQ ID NO: 14264 - protein, 139 aa, Candida albicans
FFCFYSFKLIEYCSSFFLLYCNYQETIIIKTMFQEKSEKLSFPKRSSSLRSPSDSPAITSKNVFMFVNYSKDWPLILVGILLMGGSAIATPMNTYIYGEIMGKLSQFYLQDQSNHSFSQDIVKLCVGLIGIGCCKMILV

SEQ ID NO: 14265 - protein, 258 aa, Candida albicans
SGIYMPVVKTGISTILKILFRLYDIKISPDSNTTKKYHDQTVKIFNQNLYLINSGLLCQTIAIVPQFPKFFSGTIYDNLTYGINNTNSAGSNSSSSVSDSEIIKILKLVNLHQFIVSLPQGLLTIMNDSDNDNDNGNENENENENGNTILTSSSTSFTFSGGQLQLLAIARALLRNPKILLLDECTSNLDPITTKIIINVIKSLHGKLTILFVTHDKELMRIADNLIVMKDGQIVEQGDFQQLISNDGEFTKITKTII

SEQ ID NO: 14266 - protein, 252 aa, Candida albicans
RLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 14267 - protein, 222 aa, Candida albicans
RKKGEESVEQGENKVKATLDDVNIKTGKVLADGIQKTQDTVDDVGIGAEDIKKGAEAINQKTGKVLADGIQKAQDAVEDVDVSAESIKKGAEAVNQKTGKILSDGIQKAQEVVDDVDISAEDIKKGAEKVNQKTGEVLSDGIKKAQDVAEDVDAGAKDIKKGAEAANKKAGKVLADGIQDAEDLSERVQARHEVKENTKGYANLEDKGRKVPVEQNRPEDLM

SEQ ID NO: 14268 - protein, 139 aa, Candida albicans
PRMDLPARRLKTTTPTISSASTTPVISSASTTSVISSASTTSVISNAISNPASTDVKPTTSSQGTKSTSIDTDSKSTSETTVMVYTTKSVGPTTVESISVAVSSAAQSSIAAISSYEGTGNNMKLSFGVVIAGVAAYEI

SEQ ID NO: 14269 - protein, 303 aa, Candida albicans
  UNSURE (19),(291): Identity of amino acid sequences at the above locations are unknown.
IIPATSGKFQFLIQPNHTXSKHSTSNSSVSVTTSQHSTHDNPSNSCVPPPASSTSSDTTSNKCHKPSKTVVTWTSCSNNACSQSEITTGAIVVTDKDTVYTTYCPLTDTETDTESTTATTSTHSTHTTTSKHSSVESTSVTSSSTHSVSKSTDVTTSTHSSSESSHATTMTHSTSKHSTHATTSKHSTTESTSGITSKHSTHATSSKYSTVESSSSFASTSESSVPVSSLKSTTFESSISTTTSKHLTLKSSTPASTLEYSTSIPPAPATTSNSLSTKSTTLTTISRSSTXGFHTRGLEGAAN

SEQ ID NO: 14270 - protein, 187 aa, Candida albicans
TWICLGLVRTATEGAPVAPESSAPGTETAPATESAPATESSPVAPGTESSPVAPESSAPATESAPATESSPVAPGTETTPATPGAESTPVAPVAPESSAPAVESSPVAPGVETTPVAPVAPSTTAKTSALVSTTEGTIPTTLESVPAIQPSANSSYTIASVSSFEGAGNNMRLTYGAAIIGLAAFLI

SEQ ID NO: 14271 - protein, 132 aa, Candida albicans
SLAFSFVNMRLSTAQLIAIAYYMLSIGATVPQVDGQGETEEALIQKRSYDYYQEPCDDYPQQQQQQEPCDYPQQQQQEEPCDYPQQQPQEPCDYPQQPQEPCDYPQQPQEPCDYPQQPQEPCDNSPQPTCAV

SEQ ID NO: 14272 - protein, 65 aa, Candida albicans
QFRFLSRQLQTTIMKFLQKFIITVALLTNIVFAIDITENKIDRGSVTLSFGEIIIHPGASWSIIG

SEQ ID NO: 14273 - protein, 291 aa, Candida albicans
PIMVKSVLNNEVYHQTTSINGSGCFTANRDSTIYIANVLLPVSTSQNFYLADSQSSIIVQAILTPQVFNVYGFGNGNMVGVTLPLLGNILNPAYSYNPSTGILRLRNLLVYQDFNIGPGYNPSLFLIVTDNGAGLPSTILGSVSYSGPVPPRALPASCKIACKPVPTAPGTNPTEYTTTITTTNSAGKPLTETGVVDILTDSNGSWFSSTTIFPTSSSSSSSSSTVSSTAPSSSSTKPSSSSQPSSTPPPSSSSKASSTTPSSSSQSSSTTPSSSSKPSSTVPPTGSSQSS

SEQ ID NO: 14274 - protein, 712 aa, Candida albicans
SVGPASGLVQNVNHQGPRQLEFSSTIPSSIHQQSLSIQSPSSQESSVSLTPTSSLQSSTNTISSSQDSSSFSPTTSDDSSINSPSSLSDSSTSNVSSTDNTESSVASAPPTDSAISATSSDITIEFTSTWEVTNSDGSVSTESGIVSESGSSLTTLTTFATSGAGQSEFTSTWEVTNSDGSVSTESGIVSKSGSSLTTLTTFATSGAGQSEFTSTWEVTNSDGSVSTESGIVSKSGSSFTTITTFPPSSSSSVVAGVTTEFTSTWEVTNSDGSVSTESGIVSESGSSLTTLTTFATSGAGQSEFTSTWEVTNSDGSVSTESGIVSESGSSFTTITTFPPSSSSSVVAGVTTEFTSTWEVTNSDGSVFTESGIISQSGTSIATLTTFPEPAGTVYPVTTLFTTEYVTTCPNGELSTATGVVVVSTDSKGIEQTVTSVVPSTVYTKETVTSIITHCIKNKCFESTTTLVSSVPCPTQVPGVFTSTDNGHGVPIASIDVTTGAATVSNTIKAQDSTGFTSAGNAITTAITATGAVTTSVGGQGSTDYSNAGNTIAAGSGSDSGSGSGSGSGSGSSSNTVGIVNPKVSSAASGITVAAASASAGQSWPYSSGGSGNGVLPLGANNVGSNQTPTVSGGNSNPSTVTGAAVGVGGVVSGSPSYSGNSLLISFVSSQSGAISSSTGVTIPIATENSGSKFSVGKSAFIAIILTTFIGFI

SEQ ID NO: 14275 - protein, 495 aa, Candida albicans
  UNSURE (7): Identity of amino acid sequences at the above locations are unknown.
LKMLLKXIFLPFFVLFNAINAIDIYQNQVSRGTIDLSIGAITIHSGAYWSIIDNAISALVGTLTVQQDAGFYITGLNPFLGLQVELLGVLNSIKNDGIVSFNGLNSLVGPIYNLVGLSFQNNGEFYLSALGVAPPVFSITAADWHNNGLLVLAQAKRTSALANLGFPTGSIENQGSICLFGTAYQQLTSITGSGCISADRDSTIYIFSSLLPIATTQTLYLADRASSIVIQPVTLPATYTVRGFGNGNKVGISLPLLSVPLLGQPAYSYDPSSGVLTLRGLGVGLLSQRFQIGTGYDSSLFEIVTDDGAGLPTTLLGSVRYNGPVPNNAVPASCNCKYVPPSPGTDESSSLSSSTSEQSSSSATSVSASETSDTSSTQESSLSSEVSSTQEPSSSTPEPSSSSETSSTQESSSTEGPSSSTDSSTEASSSESSTAPSSSAEASSSTESSTEEPSSSTEGPSSSQESSSSEESSTQEPSSSTKESSSTAGPSSTED

SEQ ID NO: 14276 - protein, 606 aa, Candida albicans
  UNSURE (424),(455): Identity of amino acid sequences at the above locations are unknown.
YHPLISGANWSIIDNSISTFIGNLDIKSNAGLYISLTILNLPLLVLLNSGSASITNDGIVSLDARTSTQGSSQFNLVGGSFENNGEFYLAASGAIPMTMGLTGKSWNNNGLIVAYQNERSSGSVKFGVIGQTITNKGQICLTNQVYQQTSKIDGSGCVTAKKNASIYISNVLDPQSVSTEQNYFLADDKSSIITQAVGFNTQVINVFGFGNGNKIGLTLPLKSGNGGQAYSYDSDSGVLSLSSGLFGQKFNIGPGYDSKLFSIVTDNSEGIPSVNNGAVSYSGPVPSQKSLPSACNVECKPVPNAPDDGSSSSSSVVSSTTSTASTDSASLSSTSGEESSASTTTTESSETSNTSSNASETNGSSTESETTGSATTSEASDTINSSESSETSGASETSQSTGTSESSETESSVTESSETDSITXIIWKKLVGVMIIHRLLPAQTVVLIPSLQKQXHIHLPPYMGIHLKYLLEQLVHHQIPCPVPKQTILLLVLVLFWFLLLLVLSNLLVLPIVHQILVMLILNLILLISLHLIILLHLPLLMILVLIQLQLQLLVLVLVLTTTTTTITTITTITTITTITTITTITTLTTVVFLQLILKQVVIFLL

SEQ ID NO: 14277 - protein, 292 aa, Candida albicans
SILNFGSYFSIFSNHQKVFIPMLFKNFLLLFIATATTVFASYDVSSSLIHYHDFNFNVGDIAIRNGASFSLVNTFDCLFKGDLTIEEKSKLYITSTGRALILHIAGLFNKVKNDGLLVVNTLESHAAAICKILGASFVNTGDAIFAFQGRFLPPIIALTARQWQNFGRMHFLQKFPSKSLAMLGHFGGTIENHGTLCFTNQIFKQLTTIDGRGCIALEKSSSFFIENSLFPIDRRQVIYMGEGNPSIQAVVTTFPQTFKVANFGGNGAHKIGLNLPLSISHILHHGAGRFRA

SEQ ID NO: 14278 - protein, 284 aa, Candida albicans
SKMLLSNLVIPLLATSATVSATFDVTSSLTKYAAFDFGVGDISIQKSASFSLINTFDCAFQGDINIEKDCEFLIASTAKALKLTFNNIFHKIENKGKWIVHTLESAAASTCNIIVKSFVNTGEIILAFKGHVLAPIINIAASHWVNHGCLHLFQEIKSISVAILGVVGGTIENHGTICLTNQLCKQVTKIIGSGCIALEKSSSFFISNSFLSIDAQHTFYLGEGNPTIQAQAVSLPQTFKVANFGANGSHKIGLNLPLLSITIWGPWEKMLVLRHQNWYFDIDC

SEQ ID NO: 14279 - protein, 261 aa, Candida albicans
TCLCCLLLFGAPGKKCWSYDTKTGILTLTANGFISQKFDIGLGYDPSKFEVCTDNSVGIVSVIKGSIKYNGPCPHAGRPSVCQICPGVPTPPVITSSATAITSTQSKTTSSSSTSSIATTSTTSSKPKPTTVSTSSIASTTTPDGSYSTSFVTVTAETTKVVTITSCSNNACHPTTAPTGLTVVTLTTSDVKTVVTTYCPLTQTVTLGVTGTKTVDLGCPTGYFGYNGYIGKGVSIGHGGAAASASAGFQIGFDIFKNHHF

SEQ ID NO: 14280 - protein, 266 aa, Candida albicans
EDKLRNRLLPWRDDKRINGAGCFTANRNSTIYIANVLLPVSTSQNFYLADSQSSIIVQAISTPQVFNVYGFGNGNMVGVTLPLIGNIWNPAYSYNPSTGILRLRNFFVYQDFNIGPGYNPSLFLIVTDDGAGIPSTILGSVSYSGPVPPRALPASCKIACKPVPTAPGTNPTEYTTTLTTTNSAGKPLTETGVVDILTDNNGSWFSSTTIFPTSSSSSSSSSTVSSTAPSSSSNKTSSNSQPSSIPTTSSSNKTSSITPIPSNQFS

SEQ ID NO: 14281 - protein, 231 aa, Candida albicans
ETLCFHRLLKTGSGSNNGSGSGSGSTEGSEGGSGSNEGSNHGSNEGSGSGSGSQTGSGSGSNNGSGSGSQSGSGSGSQSGSESGSNSGSNEGSNPGAGNGSNEGSGQGSGNGSEAGSGQGSGPNNGSGSGHNDGSGSGSNQGSNSGAGSGSGSESGSNAGSHSGSNEGAKTDSIEGFHTESKPGFNTGVHTDATATGNSVANPVTTSTESDTTISVTVSITSYMTGFDGKP

SEQ ID NO: 14282 - protein, 183 aa, Candida albicans
PFVLAFIEIYTRTNISFQVITRLLYAQLIYYTNVEGFILVNTFLLSINHKSEQIIVQQFLLEIAPVTKFNQDSNDSINTPKYSSLLKPIGHHSSIINYNFKGNNNMKVVSNFIFTILLTLNLSAALEVVTSRIDRGGIQGFHGDVKVHSGATWAILGTILCSFPWWVRVFTKRDPEAPAICSP

SEQ ID NO: 14283 - protein, 662 aa, Candida albicans
LNTPEDRYEQLQQTASIHNATIDSSIYGRPDSISTDMLPYLSDELKKPPTALLSADRLFMEQEVRHPLRSNSVLVHPGAGAATNSSMLPEPDFELINSPARNVLNNSDNVAISGNASTISFNQLDMNFDDQATIGQKIQEQPASKSANTVRGDDDGLASAPETPRTPTKKESISSKPAKLSSASPRKSPIKIGSPVRVIKKNGSIAGIEPIPKATHKPKKSFQGNEISNHKVRDGGISPSSGSEHQQHNPSMVSVPSQYTDATSTVPDENKDVQHKPREKQKHHHRYHHHHDKQKTDIPGVVDDEIPDVGLQERGKLFFRVLGIKNINLPDINTHKGRFTLTLDNGVHCVTTPEYNMDDHNVAIGKEFELTVADSLEFILTLKASYEKPRGTLVEVTEKKVVKSRNRLSRLFGLKDIITTTKFVPTEVKDTWANKFAPDGSFARCYIDLQQFEDQITGKASQFDLNCFNEWETMSNGNQPMKRGKPYKIAQLEVKMLYVPRSDPREILPTSIRSAYESINELNNEQNNYFEGYLHQEGGDCPIFKKRFFKLMGTSLLAHSEISHKTRAKINLSKVVDLIYVDKENIDRSNHRNFSDVLLLDHAFKIKFANGELIDFCAPNKHEMKIWIQNLQEIIYRNRFRRQPWVNLMLQQQQQQQQSSQQ

SEQ ID NO: 14284 - protein, 927 aa, Candida albicans
SSIWSIVFYFSIYPFLPKKDKIKTKQNKSTNKLLKLLIFNKESVDLLLKEMNSTPSKLLPIDKHSHLQLQPQSSSASIFNSPTKPLNFPRTNSKPSLDPNSSSDTYTSEQDQEKGKEEKKDTTFQTSFDRNFDLDNSIDIQQTIQHQQQQPQQQQQLPQTDNNLIDEFSFQTPMTSTLDLTKQNPTVDKINENHAPTYINTSPNKSIMKKATPKASPKKVAFTATNPEIHHYPDNRVEEEDQSQQKEDSVEPPSIQHQWKDPSQFNYSDEDTNASVPPTPPLHTTKPTFAQLLNKNNEVNLEPEALTDMKLKHENFSNLSLDEKVNLYLSPTNNNNSKNVSDMDLHLQNLQDASKNKTNENIHNLSFALKAPKNDIENPLNSLTNADILLRSSGSSQSSLQSLRDDNRVLESTPGSPKKVNPGLSLNDGIKGFSDEVVESLLPRDLSRDKLETTKENDAPEHNNENFIDAKSTNTNKGQLLVSSDDHLDSFDRSYNHTEQSILNLLNSASQSQISLNALEKQKQIQEQEQTQAAEPEEETSFSDNIKVKQEPKSNLEFVKVTIKKEPVLATEIKAPKREFSSRILRIKNEDEIAEPADIHPKKENEANSHVEDTDALLKKALNDDEESDTTQNSTKMSIRFHIDSDWKLEDSNDGDREDNDDISRFEKSDILNDVSQTSDIIGDKYGNSSSEITTKTLAPPRSDNNDKENSKSFEDPANNESSQQQLEVPHTKEDDSILANSSNIAPPEELTLPVVEANDYSSFNDVTKTFDAYSSFEESLSREHETDSKPINFISIWHKQEKQKKHQIHKVPTKQIIASYQQYKNEQESRVTSDKVKIPNAIQSKKFKEVNVMSRRVVSPDMDDLNVSQFLPELSEDSGFKDLNFANYSNNTNRPRSFTPLSTKNVLSNIDNDPNVVEPPEPKSYA

SEQ ID NO: 14285 - protein, 389 aa, Candida albicans
LPLYYFIFLIYLTSATMSFQEIPIIDLQEAFDPATRSKFLEEVRDAIINVGFLLLKNYESLGPTEEDLQSIKQQAIEFFALPAKEKLQCEMLNSPHFLGYTRLANEITASHTDWREQIDLATELPAPKEGEPLYKNIEGPNLWPNPEVIPKFRPTIERFIEKMTALSNVFKDLVAESIGVDPKALNRYFKENQQCKMKLIAYPDVSELDGTKSAALDDTPETNQGVEPHRDSDLITYIYQATEHQNSLQVQNFQGHWITVPNIPGHLVVNNGQTLQAITGGVAKATIHRVLVPEKGTGTRISIPFFQTIDLDSSKGVVDNLPQEVIDLKNERDKKIKDWGVDTGFQFEPDVSKEPIGHAVFRNRIKSHQDVAKKWYPDVLKSVLQEYTH

SEQ ID NO: 14286 - protein, 1648 aa, Candida albicans
IMAIGNIAARYLSSLEETDTTATTTTTTTSNVLQPSNRLNSPTKFNRKSLDNNSQDLDALARALNITPSKPETPTSISKGSATSLLRTKFESPSATVSSFKSTSSSNGVSPTKKNHFVEITSDETPSWANKNYKDILNKSPTKFNTQSNVHTPLKQLNQPIGTPSSSSLSPAKNASKSSPGYEYLCRIEAIKQWLELVLQEQITQSASQLISYIRNGIHLAKLANVVLPTSKPVFLNDSKLQFKHTENINRFFQLLDFFNMPDLFRFELTDLYDAKNVPKVWFCLHALSYILHKQDPLYPAMNNLVGKVDFSADDIRTANRALVNSPLPNFSSADTGEGKSDTSNNNSSTTSATAAFMDKVTSPVKKTPSPLKRPQQLQKKQLELVEDNKPELTQDSSGLSKISRDDPFTDRVDLAPPSTSNAKLELHTPPSKLLEFKIKLPIIDLSHRDSDYYTPELESHLPNIIKFQSLARGAVFRYLMFVDRILLKSYQDEFTNLFAIIRGNKARRKTVHKHRDELRLYSFEIIELQSIIRKNFVINKKPNFTSITNDVETVELQSLIRGKLTRDWKKYVTNGLEKFTPQIIDFQSLVRMKSIYSKSNKVISYKDEILPSLIELQSIARSQLYHRFSRSNAIDETEIIKIQSIIRRNAVIEDLYTKLSKVRSNKRRLIELQSIARGGVARTKLCNSVLVTLIYEDGILNQLFAKIRGDNYRKKFNSQKSELLKYEKSSIIPVQTLFRGVLSRYTKEVTLSDIFDQIDSVITLQSVARGKLMRGLIYEFSDYYQKHIKQVVKAQAILQRVFAQNAYKQLITSKNPPLKVIRRFAPLLSNNDRDFQDEMTLSDLKDLIIEKCKANEEYENQIEQLDMKLGLLDKNKISIEEFLKPTKGKTFKPIVENVKNLERLNKSLKKKIELWQTLFYFIQTNPIYLTKLFNSIPYTKNQTKSGQDLFQSVIQLFPVRDSSITYHSREEYFLVKLMIQLMQNDTANSNNLGDITKLHLTNWIDFFTNFNNHTFQRQHLKALLGKFVIRIVDNEQVDFESDPIRIYNQIIDHEMKVYGRSEKSRDISPQAAIQLPEVSNKFVGNLMSLRETCSDLLSMLQKNASGNKALLQIPDHVKLICRQGYLCAQRKFPDKSDQQHLAVAGVIFVKHYLGSILQVPENYGILTGNNDTQKAKSKDNLRYLYRVMLQLFSMKPFNDNFLKPLNEYIMASTDTVKSIISQAIINVGEIETVYELHDYDDLVTHQRPKLTISVNSLIQLEKSILQNVDIITTGNDDQLYKTCVEVEKLLISPQDMLTLTDLSSVTLNLNPTTQEESIVDSKTKTLFTQAKRCLLYIIRVQEEDDSDDLLELLISGIKPSHEQRFKEIVQYEKAEQDISLNNSKSVTANTVNKKKSTRPYSGTSLGDLSNLTYHELKKMCLEIILKLESMGELTRKNSFQTLLNQIAMDIKTKDSQRQCRWQQLQVSQKTIKKLSEKENYLKTQLHNYNKHVESVLLELQSKSKSNDKNWKRRLFNIMVIPVFSKQYFYHRELRKHNRLPKFGSYKYLAKKLIDQKVLIDFSTANNVATASKLDFMFSCHQVGKFTIEVASGTVNIPGATNTITLDELLALQYENKTKFELFDGMATFDSNNFMGLIFRKFYDLKKE

SEQ ID NO: 14287 - protein, 601 aa, Candida albicans
FYCFNFIFLLLLPSTFIFTFHYFLSIPILRFSLKKKNLHPMNTGSSQDSIPIDNISLGLSTSPLNTISSGGSDSTIGHLNTPPTSRARSGSLFSIWNEPSVNHNNNVSHSHEMATSTSRNRSYTTTAALPSITIDSFSESLQKSSAPRVSTSPFISVPNNDMIILDNFQTNLPRLRSQTISGTPISSQSTLPHPSESLNAPHHFPQVFETVSLNPSSASILPYNQLPQLFDDVDFTRFLITTSFDNPNLGPTKYLLFDNLPLIINAHKLFGVLSNSLNPRMGNIHGIRITTTTTSKLALVECTSIDTAMSLKASFNHLELVPGNILYVAFAKVDDVQNIGQQRVQPQHSQQLPSPAQPLPQLQQQQQQQPMPLPQLSPNHNTNHNHNHNHNHNQQPQLVQHSLPDKSEKPDPTDILSIQQNLMNSIGKLSSTVDAKKIESLINKCIAYSNDQYQSDFGPLPDPIPLRQFDSPTLRDLRKVLENNEAQLIGQNVDGGEVMSSFELEELCLAMLDELPELSYDYLGNTIVQKLFTLVESSLVKLMMVKEIAPYLTQLGIHKNGTWAIQKIINLCHSDYQQMFLIGANLKPYAVKLLMINLVIM

SEQ ID NO: 14288 - protein, 191 aa, Candida albicans
  UNSURE (3),(178): Identity of amino acid sequences at the above locations are unknown.
GAXVLPVAVCEKSCEISVGRFGARCIRTILESCHDSSSTSPVTNEQVLLVAGLIIEFANELAVNSNGSLLITWYLDTFKDCDSKIELLMSKFLPNIRALCVHKLANLTVLKILNNRIDDKSRVATMDAIFNNKETLEYILQESDNSNTTAGPLFIYKILSNPTLADLVNQHIPTIRKXLMELNIVNFQNYK

SEQ ID NO: 14289 - protein, 114 aa, Candida albicans
NQRKCGRSCGVVKTTAPSGPREQLEEFKLLKRKLDLLSLQYSQHQIKSNQLVSFRTQLETQYQESLIVKQEFDELNQQPAEEDTREQFEGDEQGYRIYKLIGPVLLPQDHDEGL

SEQ ID NO: 14290 - protein, 61 aa, Candida albicans
TIPIKYLIIRYSFFFIQYAFHIMNVNSVIYYILFLFASTILAADKTSSSVSPTLVWVTGTD

SEQ ID NO: 14291 - protein, 111 aa, Candida albicans
SNVIDSWNDTPVVNTCATKPLNISDGSCACYIVKSGDDCDSIATSHGISVADLVDFNNNGHSYNWEGCDKLAIGQGLCLSEGTPPKPECGPYAPGDWKTPPECPNKACCSK

SEQ ID NO: 14292 - protein, 327 aa, Candida albicans
GYCGLTSDFCEKSTGCFSNCGYGNIPSRKPSNFKRVAYWLDNDNGLYYPIEKIASYDLVHYSFATINEDMTISVGSNFRKFLNINAKKIIAFGGWDFSTSSSTYNLFRTAISSGRVQFATNLVEFMDDYDLDGFHFDWEYPGQIDIPGIPVGSNDDGENYNELFKLLAKKAPKKLKSIALPASYWYLKGYPLSDLEKNMDYFVLMNYDYVGQWDYGKPNMGLGCHNDRLITEESIKMIQKSGIGTTKVYGGLANYGRSFKLKDKKCKSYNCPFDGPSSPVPGGSITTTPGFLSIAELNDIKFSETHFNCTSKCSHAVVSPRRAKDPT

SEQ ID NO: 14293 - protein, 653 aa, Candida albicans
AARYFHPVGKKSTIEFGKQLLQLGLLQEHSLNSYGMDVVYNNTSSSQEIVDENNKLVFLLGEQLDHLFDPLLEYSPETMNFIYTPQQTQVPQTKLITSIVNELVTVQTNFTSKLVDLLQNLITPLRANVLDSPDGITRVNQVFPPTIDEITRINCILNESLLKAKSINYLEVLRAVANILPYFYKPFVRHEANLKGFYLRLRKFATSSILAIAKKEYSVREIDSIVTGSLLELPRLKLILKRLYDAIESEKLKLKNFENFDEDETMVNKYYTAAMEVIDAFGGHDEQVDLKQRIFTPTGKILTELATNWPAELHYGWLSRKVVGIFQLERSLVVIFNDYLLFLNIIDNNGYMEELHLKKISVSDALMHSLVNEKPLPNLSCFPAMEVSSWCNINEVIATTFVAPTDDNPKDDFIRFLSTSSTGFQSLSAIKQFSKTYHVENNKSKTIIELINKARLLYKCSPFHLFKANDRHLSIYYTAHEDKVYENEISQSPFVLFLNMKLDVPRYFETCPNLQLLLQASFVGDDKIQITGYNKPSQEQINEFVRPNEFLDFLKHKVFNCFNGIFLTYNKITRCLIKGNSAQLKFVIDDNATSRSEATTLDEVKFTPKQTYKHDKSFSEPITVVNVPLENKVDPPLRRRKSFFHHRGPNPRA

SEQ ID NO: 14294 - protein, 382 aa, Candida albicans
YSIKMITLLIFIFAFLGNVLCYPQAILSHQISPKVMIVSMFQPEEEAWTSKVDFQHNITVPGLHPLYPNVHCTSNFDICQFTTGEGEINAASSIAFLISNSKFDFSKTYWLLAGIGGGDPAKVTTGSVTFAKYAIQVGLQYQIDSRELTNTNHKEGWTSGYFSYGTKHPQDYPDSVYGTEVFEVNEKLRDRAMELSRKNEKLLKLGDDDNVSLRKLYSSPANKIPTILACDVLTSDNYFTGHVLNDYFSSYSQLITNSSANYCSSAQEENATLESFIRVAKNGLIDYERIVILRTISNFVAKPKDLSIDPIEFFNEYPKGGIQHALDNLYIGGWPFVEDVVNNWDSLYKDGQYFRAENYLGDILNTLDGQGKDFGKDSYHIS

SEQ ID NO: 14295 - protein, 301 aa, Candida albicans
  UNSURE (85): Identity of amino acid sequences at the above locations are unknown.
EGPYWMIMDDDDDDEGNLWRPISIIATINKEPELDELNISDVIKQNIELSSDILICGDKVAPGALATAFEKLLKNDKLRKSFLSXFSPSDEKDSNNTIKKEDLLLLKEITPKANNSLLIIDSNKDILTQIQNRYRQKYEKLAIINKIEESTLKDKLNNSIALTGDTERFKFRHWNQLLIYSDTAGRSVSPTSTTRSGESDESDDAERKIRRGKFRRCKVPMSDSESNSSSGDIINGERNQNIVKFNEIENNIVAINDEENPNLTNLEDDKVEDEDSCCDNSSDLTFEIDKFDFDLTSIFKE

SEQ ID NO: 14296 - protein, 524 aa, Candida albicans
RPSGDAANSSIFSLAMKSRKSSIRTVNKESSTQSTAFTNSSNNSVAIPGISSYALKELAAIPDETMLSTEDPIQYALHKLEGKSSSKLTLKRKDDDDDDNDDDDDDEYLKQPHIDDDTQDILNEINNANTEDAIGLSNTSIEISQVDPPLTPIRMSCRNSNSDMIESDPITSTPLNSHYLENPTTAKPTFTIVGDNNVIDTFDFQQPSIPMNSTTPLSLEYQSPKIILDNYSLSSDLLSVLNVLFNDAHISFVLSYDSRSLADHFTMIEKDMLQEIDWKDLIELKWNKELTPVNSWLEIIVNDDYYIENKGVNLVIARFNLMVNWIISEILLTQSPNERIHLISRFIHIAQHCLELQNFATLMQIILALTSQRIQKLKQTWKDLIPGDILLLKNLEELASPLKNFLNIRLTINQIKPSKGCIPFVGLYLSDLTFNAERASIIKEHNHNLSGDGDGDGEGEGEGDTLINFAKFRTSVHIVKSLSQCIEWSSNYKFDIQPDLLSKCLYIKSLDEDEMKYCIQHNQK

SEQ ID NO: 14297 - protein, 175 aa, Candida albicans
PGLRPEGREYGIATGDSMQFKKDNKNKHNDWDSDDEFEDEVPELPEITANKKVSNTKMRKKKGAMTDTSSFSMSSSALFRTEGLTLLDDRYEQMSKKFEHENGEQPHKPFDMKEERHDLEDMLDDFLDNYELESGGRKLAKKDSEKKKLQQAASSVSKGKAARKVNEAFSNMKIE

SEQ ID NO: 14298 - protein, 230 aa, Candida albicans
SPILNCVQVTRTTVFCDFRAVSAPRLIPNSHDRVTRSIFTLWHFISFNTFYSGIFTIVSLFRLFGLKPDMTNHQQEDPALSSTNEFNSSSGEDSSSDSSSSSSSEEEEEDLMITKPIYMSKTTRNKKGSLNNQITNTNEEKGQLEEKSGDNSSEHTNRRKQITISKLDHQVIQDPSDNKLEFDGVDDTDDINPELEYENWKIRELNRFKRDQDIIKQIELEKEDQLRRNN

SEQ ID NO: 14299 - protein, 505 aa, Candida albicans
  UNSURE (349): Identity of amino acid sequences at the above locations are unknown.
IKYLISIIKKLIRTMSKEESKVIKSALKGSDSTTTITTSSSSSSSSSSSSIQFRIFVGSYEHNLLCLSVILDPSNIKDPIFQPIFHFQAHSLSIKSMDLAKRYLVTGSNDEHIRIYDLQKRKELGTLLSHNGTITSLKFSTEVSTENPQNEDISSRGSSTSSSSTSGYSQKTGKWLLSGSEDGKIIIWRTKDWETFGILKGHTGKINDLAIHPSGRVAILVSQDQTIRLWNLMTAKKAAILKIKGKDHLGQLGDFVKWSPDSKGSFFLIGMLNQILIYKTSTAKIIKKIKISPTLMCMEILKFNNKNWLVVGLSNGVIEFYDFNEKVLAGINEETTTTTTTTTSDVDDXEKEEDKVWDSKPEQLIADFTLRGHTNRIKGISFIQDNSETHDIPYLVSVSSDGRIVIWNLLLKDQIAVYDTGERLNCVVTSPEGIEKLDTMKRRFTSLSQITGKGEIDNNDIPSESEYETDGEEIKNIMQGEKNKKGKKSKKNNIKKKRKVSVTLE

SEQ ID NO: 14300 - protein, 125 aa, Candida albicans
LVVGALQSLILFLSVRKFFHLTYLKTLIITSITTMTTSLSPDKFIGANLHVKLSDCRILEGILTVIDPFGNLLLSNVYETSIDKLNDKQLHVREIGLVSVPRESIESIKTGQKNAYKLYLGVATT

SEQ ID NO: 14301 - protein, 313 aa, Candida albicans
SISGIIDMGSDFPFEIKQELDTWKTRGVIYRENPHRLTTRGVNIYQYTDNNNNKSFNRSIDNESEVEPEQDAIRYFEYVTPKLRIEINDILEYPNLKQSSNYHLICSIERCKSLIDSITQFNPTAKFIYEPLPDDCVFENLEFLQNDILPKIHVFTPNLNEARLLLGLKDNENETNKSDDNDELQKISQQFTNHLQLSNSGTVLRCGAQGCYINTKSGDKFQLPAYHQDQTKVVDVTGGGNSFCGGFMMAYHLSDGDWLASGVAGIISSGCIIEKLGMPTVSDDSKFNNKSLRDRLDTYLTENPTLKVDFNWI

SEQ ID NO: 14302 - protein, 327 aa, Candida albicans
  UNSURE (303),(311),(313): Identity of amino acid sequences at the above locations are unknown.
DIDLLAACWDTSPYEASFQLSYLYQSGIIDIVYGSTDLLLTKIDKFILGMEFQSKDFRFVNKNKVLKGLNLSERQFLDLCIIVGCGVQPETFPLFSALSNKPPSGGDMPSSSSTSSYGVGGSAIGSGSAPGAPGSGSGPAGPGAGSQLSYFKIGLDILYQYAQFSGDNSSLLGYIITLNNPKLLDLYYKGVCAIRYMPILNQEGYVELYHVAMAKLGLSENIDFLHQEEKHVVGGQIQAENQQVKSRNAEVKQTKQGGETDNEKSNADSNTLHRSVRIPIDVHEIISQRITPVALFLPIHGLXTCSIIRIXSXRRNYYQSTMRRWHG

SEQ ID NO: 14303 - protein, 165 aa, Candida albicans
LSIYENWISIHGKDVVILFLTLLRRTMANKSPTVDYLVHSKPEIITMLIKGPENLEIGLICGQILRDCIKFEVINKFVLYSPSFYNFFKYVQIPTFDIATDAMMTLHELLTTHRKLVSEFLGNNYDVFITAINKLVTSKNYVTKRLSVKLLDELVSQRSNQQFLS

SEQ ID NO: 14304 - protein, 206 aa, Candida albicans
EQETQNLELKHNKSIHELIKGYFYYGDVYGNRNPYGDPKMSQMIIDNNNDILPSVISPNNQNKKSGNVLSQVIKYILILEFLVFQTKQLLEPLSNVSQIIINGSQSKNTRFLKLLSTVTGLPIIIANHDVARGAQLMALIGKLCSFGWHYDDAFDQAIQNNNNDYLGNENSINIREDYYQLLMTKYEIFKDMASAQQRYRKLMGDV

SEQ ID NO: 14305 - protein, 143 aa, Candida albicans
TTSMDTSTIVAIGVDIGTGSVRVYHNETLTSLPITTENDIYITQSSFEIYSKLIQLLSRPQLDWNFDSICITATCSMVVLSKIIIYEETYLTPVSLNKSHPNSDVLLWMDNSATLQCNQLNEYLKVAYHNILNLVGGQFVPEL

SEQ ID NO: 14306 - protein, 460 aa, Candida albicans
IIMVNTKQLIANLELPKLPFNHEKQTTQKPTHNYLSNTTITDAGIMDPAQFTRKNLKSALHIITQELKKRGTKTPHIFLPFRSKVNDEKLESFLSSIAPLGELRTDNTLLQQLCSETDEFTLISALKYFWSRLPNNEIIGWDVYLEFKRREAEKGYPKNAFLSIMPKCLSSPAHASIVYDFLDLILSITSNSQFNYLSGRKISKMASFWAFSCRQQFLQSPFYDATQEEAEHNFIEGIDTWKKSTNALFHLVLAFLRSMLPETNSETLKIPKTLQSLLVTTQYPPSSDNESDQSMVRGAITIPCVCVSTTQPSKDAYELISKVRHNLKFDKKDDFLSIENYTILKNLFSKKGTFEIVNSLTDESKRILSRISSEPISSKFNISPGWNKSQVETDPDIPLFSEISIKDVSIHDYYIWTWLASIISDQPSVTKQIFGRSIVVEAEVWGFQKWIVVTEKTLSA

SEQ ID NO: 14307 - protein, 544 aa, Candida albicans
  UNSURE (251): Identity of amino acid sequences at the above locations are unknown.
IVFFWGLRLDWSMGNKDEIFAKIVDPDLAAWSAPETEKGLMDLHWFMERIGIVEIASYFQSRGITATTNLLEAKMDEEGKLLKTKLKDHWSSIFPIRATRIFIQYSIEKLNHNSPEYLHLLKLWKPRIQPIVPHILQLLTQIQAYHDPQNWNDLPIEVQSFVKESCTERFWQQGVSIQSKETFMEENVKAALTLRDFADSVGHLIRYTREYAFLTVGSIAQLEDTLYEIPGVALMIWKAVAGDTVGVTLHXWKHMINSCLRVVIKFCPVKYVEVFMSELLPAVFSDLDKLLVDRWAKISGNGIQLQGNEDDETLSEEMMEEHMLRQLTATIVRLLMDVVGQYNTRPATDTQFACKKLVAENKEVLAPFLQICCHLFLFKDTKCSFNTILVIRNILPDVVLKDDEVDKYLSDHLIKSLLQVLLDDYFAETHSEAAIALTTLYCALRSKNDYPARILIQNLQNINTRDISSFESQLVNSKSLRHQRGALLDLVRRSKNQEIDEMSKRKKELEAVSIANRKKRNGGVDVMNDPYTENGALGQLFGED

SEQ ID NO: 14308 - protein, 655 aa, Candida albicans
IFCRFIWIINQMTMDSGGVQQIVSALQIVYDPKSTNDQRREAQTFLDTIKSNEESPFWGYQLALPENNGDNYIVRYFGLSLLQQSITANFHTFDPTKTFAVKQWIIDLSTKVEPSDPHYIKEKFVLLWVSIAKRVWGNHLIKSRDSHHHSVDENTTLSTNLDHNNRLSTSITEQESADGWVSMDADLLKLWNNNVTCRELSLIIIRTLFEDIYLLDDPISSKRSTLLNQLSILIVTPQSVLESMYENNPNVTICKALAEGWFITWSRYLVELLTNNDYKDKICQAFVPKILSAFKTCLHWINPSVLRQENIMQTLIGILTIPDVPMKILAVDCLHILFTRTYTQPEDFDFFIGSVFTSEGITKLSEFYHSLHLDPDDVDEVVYSLLKKTVEMIVSLSEYLNIASRNKVSWESSDVDGYLKLVLETTSHPSLIISGLSLQMWITILRFDELSAKPQFVKLMPDLLEIAANRTINYTYDENNISKKFLDVDFDSTPDANSFLQNYRKFNEDITRITVCKDPENGLAWLENRLQVFFSSELGGKCINEFKLGEKSEEFNYGSSQLSTIDYTLRGVTRWNEWYNREDKNDIKERLNKLVESLCERLLAMNFASPLLVRKQMQTLVHFAPLLKDVNPPLLFRALEKILTTATYPYPNPPF

SEQ ID NO: 14309 - protein, 162 aa, Candida albicans
INEGMSPCLANMILNKRKRIIQITNIIKLSSIAGSKVQYELSLNNLYNLLLRTRKQEEEETFIFPTVSTEEFALEQITFEVSDQMDDDKDSEDDILIKGEEIKKSKKKRQRLDNSTKEFLEKVFEKNKQPNRRERELIAEKHGVSLSQIRVWVCIIKQNIAN

SEQ ID NO: 14310 - protein, 282 aa, Candida albicans
  UNSURE (274): Identity of amino acid sequences at the above locations are unknown.
SLIFLYCLLDMSEVKVDLDQIEENSLDTEAYLQKEIEDENNHAINYRNCSWQRTAGLLFSEYICLAIMSFPWSYSVLGLGLGLIVTVIVSLLCLYTGLIIADYCAAYPHLTDVCDIGRHLIGPKWVWYATAVAFLLNNTLIQALHVLVGAKYFNTISDNHTICSIVFGVVSAIICFLISLPRTFSHMSSVGYFSAITMFIAVVLAMAFVGVQSHPYGFKEGTPVHWRAWPAKGEKYVNIMSAVLNIVYTFVGQITYPSFISQMKHPKKFKKGFXRGDYLLIE

SEQ ID NO: 14311 - protein, 178 aa, Candida albicans
LGFAPSDLQSYHYVMYDKFFNHLDIPRENIHILNGLAANIDEEGAHYEKKIKQYGRIDLFLGGLGPEGHLAFNEAGSSRNSKTRKVELVESTIKANCRFFGNDESKVPKYALSVGISTILDNSDEIAIIVLGKNKQFALDKTVNGKPNDPKYPSSYLQDHANVLIVCDNAAAGLKSKL

SEQ ID NO: 14312 - protein, 104 aa, Candida albicans
DFCRKANIKILGLVENMSGFVCPNCKGESQIFKATTGGGKKLCEELGIPFLGSVPLDPRIGKACDMGECFFDSYPDSPAATAILDVVDALRDQVELSLENLAIK

SEQ ID NO: 14313 - protein, 150 aa, Candida albicans
ERNKPITKKKIYQVQKKIKLHISSTLSIYTYTHLPHNQLNIMTLATQFAETTRYSVSNTELKRRVLHLYRKYIRNANEFADLYELDMPVSNIKTKIRQEFERQRFGNDLSVNNVLLMKGQMEFQELINFWKQQCHVMRYVLVNHKCQPSG

SEQ ID NO: 14314 - protein, 78 aa, Candida albicans
LLVSCFLFCLVSQDDCQKYKVPLKWRDRCAAYFALYQTCIIRQSANSSVSCKHDKHSWEECENLDLIRRKQELKEASQ

SEQ ID NO: 14315 - protein, 434 aa, Candida albicans
RDLYPVAEQQQQQQQQQHLHHFGHQIPAPPAQQGPTPQQPHLHQQIPHPLSHHQTPQPTPQPLAQQQLPQPARQPRQTKKQKQQAQNQDQADAQSQAQQHHMAMMARANQNDMLESSTRKVAPRSSDLFRVGPPFSISKQHQPVYCVGTDMPVTPLLHARIDRGFEMGETGSWIGYKRNYFTLVASFTLQDFDFEKFIGNKFYTYDKVNNKVNGFPPHHPSHPQNQPQNHPGHPHHNQHAGELRVPISYFAIRLVAKCSDEDVAISLIQHTAKRDKGPQFPPPIYPAVPSELPDHETVKVSCNKRNNNKIETMNKIFYFDRGNYYQEYNLDSYKDQSILKSYPSQSISKVARFERIQFTSSIRVKSTNTTARYFTLHVELLGIIEDEDLQIQPILLSSIESPPLIVRGRSPSSYHKDRTSGYRATNTPTPTPPQ

SEQ ID NO: 14316 - protein, 219 aa, Candida albicans
  UNSURE (209),(216): Identity of amino acid sequences at the above locations are unknown.
GRLLFMTNLSFHRKQKSKNKACNLDFKSDSVLELLNSKSKVAPRSGLQFKVGPPFQDTIQVSQLFIKESHQKIVPVLNARIDRGFDLTNNEWVGYKRNYFSVVASFSFEEYEINKSILPKNGFFIVSGEKEYQVKQFAIRLVSKSVQDNTEISLIQHTAKRDRGPISEPPIVPVITGSIPSHIVVKEGSNIRKISKIRHSDSLFCQQPXAGREALXKRR

SEQ ID NO: 14317 - protein, 335 aa, Candida albicans
NSVLSYLEDKIDISELTESHSPSKNTFEEIVDAAIATPEINQVPVFDSQTSPNGIGLDIKHKEFDETSLVVEKKSKETVSDSKSEELTKETQQQENVVMYEPIVPVEEYIKKPEEVNSVEAKQPEEVKSEDKSLQGQKSQQQQQQPEKHSADIGKTKVDLKKSASQKKKVKEESIKKQKDVDSKPIERRHTIAARRHHNDENKENKDVKKRNRFSLLSFYSSYNSSNSNVSLATSKVPSNSENNTTVLKPTSMNTTRKVLEPSNETNIMRKETKQTNSNGSTTSKSTTSSSSSSAPAASSSSSSSTSKRASTATKETSAARKVMDFFKRRSVRVG

SEQ ID NO: 14318 - protein, 64 aa, Candida albicans
WIRYHAHVNPALFVSVALGVSAPLVLLLTPLRRKYLYADQEPVPQVYPLPLRPRDKKLTGFDDE

SEQ ID NO: 14319 - protein, 737 aa, Candida albicans
  UNSURE (60): Identity of amino acid sequences at the above locations are unknown.
KLVFFYKKNAYPSFSDPHCYGHEKRKRTGLDCYNYSFKNEKEFREWLEQRQLGCVWVREXKTPPKGSAYIKYQSYICNKSRSYIPKSLNHQPNQNYAVNEDRAVNEDGAVNENNINNQKAVKKRNRKETIKTQYPAKIIAFQYEQDGKFYADWIYEHNHPLTDSYYHNSRLRKDLTKELKIAIEQKTPIVEIINSMLDPIYKSCHRCNISDRNEIAALFKDYYPQSLDVYSYHLKNISSELFESKVKKGQTIKDSLLGWKNIIKTQYGGWAKFCNEYNTTNSKHHNVFSFQFCVDTQIQLLKNVHLFSLDATHGLVKSLNGQSNAYLFVLTGIIPSSRNTFPLSFMLTNYTGKITIQHWLNNLKTEFGINPTQFVIDADPAEISGIQSIFKDTKIVLCYFHVLRAVTIKLKEVVILPDKEQQKAIHDLITQDLKRILFNSENTENDIQKFLEKYASFRRFKSYFQKQWMSKINMWLRTENNTFDILLLTNNLTENFFSVLKTVILKNQPNKRLDSLVYVLVEIVIPRFWRKEFKVITGDEKPNTRGPEVSQKKQLDILEDEEIKELVKLNIINNLELFVVQSPHRSEMSYNVELNYQNKTGQCSCEMFTIEECSCIHTLAVYRYINIHKNFYREKIRGSPQNAIPLCLRIEMFPLVGQKIGAYVAEELLEELDEKGELETSVSEIMNQLAASNESLEGCLPISSLLSLAIAIIDEASESSNDEAPTILTSNHLGRNR

SEQ ID NO: 14320 - protein, 110 aa, Candida albicans
ICSNACHYRYYPYCICYRGYRYDSLMQYIELLIMFLSVLLAVAFLTVAERKTLGYMQRRVGPNAVGYYGILMAIADAAKLLLKEIVVPTHADKLILFVSPMISLISALLC

SEQ ID NO: 14321 - protein, 108 aa, Candida albicans
LLAKSNPNIDKAGPFECGFTSYQQSRAAFSVAFILVAILFLPFDLEISSILPYVTSAYNNGLYGLIILIIFLMMLVIAFILEIQLRVLKIERSYDKDRSDSNYYDHEI

SEQ ID NO: 14322 - protein, 154 aa, Candida albicans
GFVSSGLFICAGGVLYDRSSTRLITYYRGMAQVMPIFSVLFFILGLGNSGTPLTLNFLGEFMSLYGVFERMPILGVLASTSIVFSAAYTIFMYNRIVFGGSYSIYFVENIGDVTRREFIMLLVFVILTVLFGIYPAPILDGLHYSVSSLIYSIN

SEQ ID NO: 14323 - protein, 75 aa, Candida albicans
ISLGDIVIPFGLSLDSLAMTVIVPVGIITLCVLAYAIEYMSHDPNRNRFYIILSIFAVFMTILVVSDNYLMMFIG

SEQ ID NO: 14324 - protein, 77 aa, Candida albicans
STRITAMKSALSAILLNRMGDTFFVIALGLMINYYHAVDYDTIALVTPYMNTFLLNTLGLLLLLAATAKSAQLGLHA

SEQ ID NO: 14325 - protein, 318 aa, Candida albicans
LGGLTTLVSGLIAIVTNDIKRVIALSTMSQLSIMVLAIGISAYDLAIYHLYCHAFFKALLFMGAGSVIHSFVAESQDMRKYGGLIEYLPFSYTAILIASLSLMAIPGLTGYYSKDIIIESLYGSYTLSGYILYYIAVGSATLTSIYSLRVLYLTFMGVPNANKASYSHIHESLGMMIPMIVLVIYSIFIGYSRDSVIGHYALSLPANNGFIETEYTLPAYIKLLPLILGLTLSAILVYVYEYAYKINRSAVYDYLNNRIYYEQILNNIVIRNTLRLGGYMNAYIDQGLLKVLGSTGVSRAVTYINVIVIINILYLFFI

SEQ ID NO: 14326 - protein, 147 aa, Candida albicans
IMSLISGIASILAIGLLSPVQSILALILLFVTVAINLYTSGYVLMGILYILVYVGAIAILFLFILSLLNIEYKPTGGMHPLVIVLILIPLIPLDIAFEPIAIVESVSTTYNELSIVGTLFYSEYAPMLVIIGIILIVSVIGAIAMTR

SEQ ID NO: 14327 - protein, 221 aa, Candida albicans
TMLSNFKIKPRTLLRGLATAAADPAANPNRVHGGLKDQDRIFQNVYGTYGHDLKSAQKMGDWYKTKEIILKGDKWIIDEMKKSGLRGRGGAGFPSGLKWSFMNPPGWEKNVGPRYLVVNADEGEPGTCKDREIIRKDPHKLVEGCLLAGRAMNATAAYIYIRGEFYNETVVLQNAINEAYKAGLIGKNACGSGYDFEYYIHRGRGAKICGGEHALIEFNKC

SEQ ID NO: 14328 - protein, 124 aa, Candida albicans
GQFKGFSHFYKHESCGQCTPCREGTTWLQRMMDRFYTGQATEKEIDQIFELTKEIEGHTICALGDAAAWPVQGLIKSFIPVMVDRIKEFQQKHAGEHLEYGGWVDGGKVKNGVVIDNPLPSGHH

SEQ ID NO: 14329 - protein, 119 aa, Candida albicans
FQCINDIPEGPVKVEDYKISPPSRSLMKEDMEALIHHFLLFTKGYAVPQGETYTAIEAPKGEMAVYVVSDGSERPYRCKIRAPGFAHLGAFDHIARGNLLADAVAIIGTMDLVFGEVDR

SEQ ID NO: 14330 - protein, 101 aa, Candida albicans
TYTSTVEHISMLKLSARPISRSTGVFSRRSVYTSVLESDINITKNGKVNVAVGAGGRSSRTGYTATVFGASGFLGRYVTSKLARHGTTTIVPVLTTGERPR

SEQ ID NO: 14331 - protein, 321 aa, Candida albicans
RGSGPFVVRHGSTTIVPFRDDMKKRFLKVTGDLGVVNFVEIDARNLQSIEDSVAHSDIVINCIGVDYDTKNFKMADVNIALAERIAEATKKANVPRYIHVSSYNADPNSESVFYATKGIAEQVVRDIIPDTTIVRPAPMYGREDSLLNYLGPKVKMWTPNKNAKEVWPVYVLDVARALERIAYDDSTAGQTFELYGPEKVTFQEIRNMIHGITENYAQVGPWSYQFADYAIPLPLAKAIAKVQQLVWWKLTNPDQVQRLVINQKIDPNAKTFHDLGIDDLTRLPDVLFSYVKQWRHPLIAQKGAPGKKELERLRDVQHFTP

SEQ ID NO: 14332 - protein, 175 aa, Candida albicans
ASSPTFFDNSSGFLLAFFSSSVGSVSILATCSFKCANSNTFQTRIRVKTYANETTPVPSITPLFNGANWFERETYDLFGVFFEGHPDLRRILTDYGFEGHPLRKDFPTTGYTEVRYDEEKKRIIYEPLELTQAWRNFTVGSSVWEPVGEGKDFTPESFKLPTPEPEPEKESDEKK

SEQ ID NO: 14333 - protein, 256 aa, Candida albicans
YSTHTILHIHITTMLVRFIGKSTTTPVGVYASTVSKRYSSIISVHRDTKEDNPNIAFEFNSENKKRAEEIIAKYPPQYKKGACMPLLDLGQRQLGFTSISVMNYVAKLLDMPPMRVYEVATFYTMYNRHPMGKYNLQVCTTTPCQLCGSDSIMKAITDYLKIKPGQTTPDKLCTLQEVECLGACVNAPMIAINDDYHEDLSPEATINLLKQLQEGKELTEIGPVDGKRQSCEPFSGPKVLLNKEPNDIRKFTRADL

SEQ ID NO: 14334 - protein, 208 aa, Candida albicans
KGKKKYPFIIYSLTMSGGPVPVWKKYTTRPQGIWEKIRQLLVLVPNRSSGNPLVSLFRQVPPAERIKEAQNYKDPVTIPAGDIKGNPYFKRDYRRNYPQVHTFNQTKISGLLNLGSESNPRISIGEKGNKELAVFTNGQDVSLASTLKSVPASVVKGEVLGKSGEPIVAPSLNKFKWEILPEPVHGMYSEAYPCRIFTEKKVRSQSSA

SEQ ID NO: 14335 - protein, 214 aa, Candida albicans
TLNFPLFKHITQPSMSDKVEVAEVAPLPDASYKYPNPLANFTKGLGYPEWQPIDTKKEVGQIFRFGFYSTVGAYAWLYFWKRTTFKLELPLSVIGFFSIAKGVQDSIANIREINDCWNTFWGLTAANTVVLSAGFRSMPPKHKIITGALGTSITTILDRAYWAQSTSSPRLDAKYELANTNENLPKQQFWDVWQRRPITQTVEELGVGRGIFKP

SEQ ID NO: 14336 - protein, 100 aa, Candida albicans
FPTPPYNAPILHYSFIMIAVITTLLTYYMSSNNLITLLIAIEILLLTVTLKLIHISGYYDDIYGTIFSLIIIILAGAESAIGLSILVAYYRLRGTIGHSI

SEQ ID NO: 14337 - protein, 546 aa, Candida albicans
CSPQQLVITVYLILVESFDSETEPQSLDEDSPSKSIKSSLSSKELQESSKLRNKQIQQYASSNNLVMVPFEELEKLKSIDDEKLLLTAQERGYHLLTAKEYEELIDEEEMKKRLESKGLVTIPFDELESIKTCLDKPDKAYITDKANLMGLIVTSNDLYDTLVKNANEPSVDHLTAKAKAQNLTLLSNEELEQLKNPSLDQLTKLASKHESRVVSNNEYESLIDPSVETITQKAKSHKMTIVSDAEYQKLIHPSLDVLSTHALDKKHTLVKNSELEELKKSANSPSLSQVKVHADKLNLVTMSKPDFTDLFKTANEPSISHIRSKASDLGYTVVKQQEYDDMTNSINHPDVADLKGKLPDYKISPLSEYDEIYKLAHEPEVDHIKTKATSLNHYLVSNEDYDKLQNPTLETLQLQADTLNHSVLDKTKLADLEKLAYNPDLDHLQKVLKEIDYEALPKQELEALNNPTTDSLLEKASKLNCEIISQEDYKELFSLAHDPSLEHIHANATKLDQTVLSNDEVNELKALAYTSSILHHGTGKIAAYVT

SEQ ID NO: 14338 - protein, 169 aa, Candida albicans
NFTYMQTLINEPTKGEIDSKATKLGLVTMPKTKFEELEATVNKPSSEFLSEKAQLYDSIVISKKQFENPSLEFIKEKSATHEHEVIPSKDLANLKNSLESPSDEYLHDKLKVKGLKLVSNDEYNSLVNLAHKPEKSHLVEKASALGMSLIGIDALNKLKKDLEHPQEDS

SEQ ID NO: 14339 - protein, 217 aa, Candida albicans
SEHEKLIKDSTIPDIDHIKLVAEKQMLTVLTNSAFKDLTERVENLTLDQIKEAAEKNNQVVVHTQEYDALMHPDEVAIKTHADRLSLNVMPIKEHAKLMEDLEKPTLEYLVNKAAKYDSIVVTKDANTKLEKLAYSPDVEHMAEIADAKDLVVVNKEEFANITKLANEPHEDHIISKAKNLGLVTINESDHRELLQPSKSKLEQHASRIDHLLVARK

SEQ ID NO: 14340 - protein, 150 aa, Candida albicans
RLLDKANKSLEKLAQEKGMSVVSPEELRELKENAEKPLDVRAKEQGKTVVGIEEFNELNNKIEKPSLEYLKECCKKHLKKIVLEEDYEQLQLRANQTVEEKAKSMGLVVIKPEELDQLKKSVESPSLDYIRLKAADQGFEVIEKDEFSLI

SEQ ID NO: 14341 - protein, 175 aa, Candida albicans
LIVHPSLINLFPIYIFRIMLRITRLSTRQLVFLRFNSSVTSRPDVARPEASQLTKKDLQSNAFANQAPNRNVTWSPSQEERIEIISKYPYRFVQKDLEEQPRPYAAIDLIAKEPIKYLSHEQGNIAVCDGNRGSTLQGHPKVFINLDQPKAATCGYCGLRYAKEEFKELIEAGEA

SEQ ID NO: 14342 - protein, 108 aa, Candida albicans
LTIIILFFFISGRLDSYENHQRPELVSFDDISYNNLSQVEAARKSMLREQWIRVYELRVTHEALRKCRQYHQEDASRNCKSLVSKYMIMLETYPIPGYMGYQNNDPSQ

SEQ ID NO: 14343 - protein, 143 aa, Candida albicans
EQHQHHYYQHHIILGINVNHLMRTFYYVKKNTMEVLLECMKEGRRVTRCAISVLKDINKYCFDEFKLHYECLEQNNQYFSRCRSSEGVLSKCVFDNMKLVKKIPGVEQQIQDKKNPIYPSDPNDVKKTAEFLKSKEVTAVEQS

SEQ ID NO: 14344 - protein, 289 aa, Candida albicans
SPAIGHLPGAVCEDRINIEPAGRAPNIKGTFFDDEDKDDIKPSIKEVEFLPFEKRESTSSHSHNRSSSDPDGVILEEEDTDNEITNRDKIEEIDQVKCAVIFDEREMEFQNIVANLEYFHQFMNLRTNYLTMTYPRYLERVDGKVQHITKKSVYEILLCMSQINDEHLPAYEQLYLGFMEEIKSVIHMVNDVYSVKIDTLLSSSDRSISEINASLSLDLRKITEKLDQLDFSLNKNIFKKAILKRKGEHSHNVGLIYKILYSCLENIIVVLLRVIWIVVNIYKFLRYIV

SEQ ID NO: 14345 - protein, 406 aa, Candida albicans
FTMKFSQATILAIFASSALVSAAPANIVSEQTMVKREDVNAIVELINEIKHINQKRDLAEGEDLLELQRRADSVIGELVSALYNSGVIGLVWDKLTTDPSISSSLTNIIKSAVQGAIVQGGALIQAVWNSGLLGDVFNKLINDTDLRQALLDVGKALFNSAANLISIWLGGSSSSSSAAPAAAAAAPATNGASKREIMEAAEYLSERDLASILSWIVQTIKDTGIVQSLVNQVINNPDTVISFLTSALKNGLVIVEDLYDWAKQSGLWDQALVYIQNNAGSWIKALAGLFGNALSNGTITASDINNAGSSSKPTGTTTASTATAAPKAATPAAASAAVASKAATSGSSSGSSSNNADLNALINKYGGGSGSTSTPTVDTSGLSSDVNTLFNAAGQAASSLKKRKLY

SEQ ID NO: 14346 - protein, 151 aa, Candida albicans
ETIVAEYGPHSPTMNANLTNLAKYTSPWAGAHFRPFPSKNEQELKEIKLTRLTLQKFKQLSQTSPESSIKFVKGIEYLENPDEHYSKFAYGWSEEIDNFKHKTDKPGFLGVEYDTWVVNSPIYLQFLYRKLSIEYSNINFLKIRLDSLKQI

SEQ ID NO: 14347 - protein, 182 aa, Candida albicans
HILFKVISVNHRKLVFNCTGIGGTSIGGVEDNNVYPGRGQVVVIKAPHIMENVLSWGDREPTYIIKRPYSNDQLILGGYFQKDDWTAATLKEQTQDIVQRTTSLFPKILKENPNGNKIEDLEILRVAAGLRPCRYGGARIEKEVVELGKILIHNYGASGYGYQAGYGMANKATDLALGKSKL

SEQ ID NO: 14348 - protein, 575 aa, Candida albicans
EKLNHHHKSIQNQQQKSPSSSMVSPGFLITQQESSDSQHQPSPALSHLSVSTFGHKKRESMLSTYSGAVEYDAVPMTVKRSSSSKIKYVGNASQGNANNNNYNNMVSSRAHHRKRSSLSSTSTSNKYSDLNTVSDTKLIETSQLLGGDANNSNNTSNSSRRNCSYYDGDEEEEDDSSILMGKLPTRSSKEDELKAQQPDKSVTTNIEGSIPARSPRRPASVMSPNFSSIDMINSSSISNNTTGSKDKSRRKSYVEDNKRRSIQINDGLEKLMLDATSFTSQDENEQQEHEEADYDNTRFIKDVTPNHLNIHRKNDADEYNEDDDITPKFDPSLVAAGSHNGVGIDELDNNIPISSRNSSYELWSRHESKRKSLTQPLNLPPRPTKDNLTKARTISNNLQQQQQQQQNLREHYDTLDGNPDNLNATEGEEILPSTNNYVDDEEYGQEEMPRSQKTNHHVVDDDDDDDGFYDITGEPVIVQPPLVRAKSVKNSIKRPSRHTKSSKDKHNHNSNDSENHHNGKKHHGSGSSSKKHRNNKKSRGTNGGGGLKPFSYTTLISLLESMNDLDHGLADPRSY

SEQ ID NO: 14349 - protein, 308 aa, Candida albicans
QVTSVHVLRAQSSNANSNVIPQQETATENVNTVSQPTSTDTAKQSYHPHESNPFSKMNNNTSQNLTVTNTGTNPFFKSTSQETKIDPHKAEAQRASQRGVASSGGWSDSEEEESEEESPNRAGAAKLASLLFGGMPQPPTTSSSSSNNDTEKVSEQEHENAKQVASTPLSNDDNGKTDSGPSGFAGENELSFSQAPPIPVDAPPAPNSIPPPPPPPPQFSNEAPPVPDSIPPPPPPPSVPSTVPALPDSMPPPPPPPPPPAAPNNTSSSQQASGAPNIGALLGQITGGASLRKVETKVSSGATVGRVL

SEQ ID NO: 14350 - protein, 416 aa, Candida albicans
SFEKMEKLIHEKRILLDALDTEDQANNYSRSSSSMHEKQIIENLKKEIMAVQTKLDERGNDGPSSDERNKLLATLDHLTRDVVPRLISDIHKVNQEISRKKAEVFKLELLKKNPSWNPEDDELQIQGTGPNGEVTDYDRIKYQSRQKLKQRMAALTGKSTGGNSDLDLELKQATEKAQDEASRQSEMIQDIAAGIKTMEDECAAKLSSSVTEDVGHEKWEQGKGISSEVAKFVKELEAFSKEQRRNIAKSQKQEQTREPLAKQQTNASLVSDSGAAKSAYATPEERAAYIKQQAEKRMNERLAKLGITRKSKSTEQKPPVESKSVSNHSPVPDSEVKLVTRNANEVEVQKPKPDSQPVSKNREPAEQPNSKADTNSVGSQNVVSNTNDDTSGDDDDEEYKAILKQKQEMEARERER

SEQ ID NO: 14351 - protein, 471 aa, Candida albicans
VMYNPYQQQQQGMGYNPQQQTGYGYNNYQMPQQPQFNQQPMYPQATGFVPQQPNLYGSNFQTSGGSGMAPQQTGFSQQQTMQPQQTGYIQTQPTGFGGTAPIVTENSELKIPSIRLSFISAEDQKKFEHLFRTAVPKGEQSISGDSASGILLRSGLSAVTLAEIWNLSDIDKTGSLLFPEFALSLHLCSMAKRGEPLPGILPEKWLNEVRSFVDQINFTVPDDPSKILANTPFANFAPKKESDWLAPQSTGYLQNQLAPPMTSFQPQVTGFGGQGLVSQATGGVPMPSTTFGNAAGLTAQRTGGGTLIPLQPQQTAGLIPAQKTGPLNPQTTGFNQQSLQQQRTGGLPQQLTGYQGPPQGQGQQLQQQRTGGFPQVQSQPTGGFVPQTSFQQPQLVSQRTGPMQAQPTGSLQAQPTGRPGEWGFVSMPTGGIPGLNAMQQHFLPNNQLPTSNLHSAMDNKLKENVTWAITK

SEQ ID NO: 14352 - protein, 201 aa, Candida albicans
RGSLQARLEDPGKLDKSVICDMPNYEDRLDILQSITTKMDLSDDVNLHEIAEKTTGFSGADMQGLGYNAYLKAVHVTLEELSQREQDEANNEDGNNNFEKNSIEFFQVGNSEKKLKTNEKIQLLHQIQQFMNPNKDNSDSERKVGQDPMNKSKVLITHENFLESLKETKPSISHSEKIKLTKIYKEFVNDRDGNMPDGTPK

SEQ ID NO: 14353 - protein, 235 aa, Candida albicans
  UNSURE (4),(6),(223),(233): Identity of amino acid sequences at the above locations are unknown.
ASAXIXLSPHFPHHLSNKLIGTKFFIHRPQNKKNFLSVLHIVLLTNLCSLQVLINQMDNHKARISYKTLKSNLVNLPSSLTNLLFTANIQVQDVIIEMVTTTSNGNKKNSTTTKHYAGWSGMSSSDISNLEIDPVFAQSLNLIDKTPIIVNLKLGNYESTNINLEPLTSSDWELVELHAQSIEDKLLSQTRCVALNQVLVVYPSATTSAKLLVTDLGSTDHTXFSHRQPRIRXYC

SEQ ID NO: 14354 - protein, 254 aa, Candida albicans
RQLVKIKTGTETETETVVVRVFTFTEPQNSFKTGTVYMSPILLINLKLQKDSYIEFEPVTQLDTLSNTIPIAESVTISRVSSQITMDKTYQQSFFSSLKTTLSTRLKCVKQGDYLPVVIDTVLAKTMFDNLIEDGNENEETSGSNEGGIDVIPIGNPDAVAWFKITEVKGANSIDTNQFLIDPSKTMLVSSGVESIRLPQNSFVKWYQYLNLPPIFNYEETGDFEYAKEFKKTLSTCLDSKINLKNFNIIDINE

SEQ ID NO: 14355 - protein, 276 aa, Candida albicans
TSIVMPSVASSSNEGSSTREAFESVTSIADVSIINDPSLDQHDTLDIGDALFSKLFPKEEINSTTETVNNKYVLVKLLGAPDYFNKFRIMKLNQVRYQLRESIVITNDSNLVNFNNDSLTLNKAVIKSIDYDDIPKLSQIFVSIPHEIYQLLHEKSQQAIKQKFLTQLLVDNGNVVNEGDSIRLINGTVNLCEPLTQGRVEYDTNIVLINQNEDKYNEQESIDIENERDLESDQDENLDLSSYVSSSLQCDKFDQYTKPENSIRFKGGSINTKIQY

SEQ ID NO: 14356 - protein, 268 aa, Candida albicans
YNTHPPTMLTLAIGDLFVPERAVDLPSKFRKLLAPQPNNTPSNSKINQVICLGNITNSSTILQFLTNISPQFNLVKGEFDNPVVLSQQLSLLNKSSNIPLYNRFVHDNLKIGYTNGFQVIPRGDPLALSAFARELDVDVLIWGGTHKVEAYTLDGKFFINPGSATGAFNFDWPENDEEEREEADKSQDDDEATDKESHDTEEAEPKVENETSTSALDDFKQTLHEVSEINSNIPSFCLLDTHGSTCILYIYTQIDGEVKVDKVTYTKD

SEQ ID NO: 14357 - protein, 301 aa, Candida albicans
TLMQSYIIKTIIFNPQPHHSKILIFRQSISISAPAAAESMNAPHAGQTQTSPVATPEPNPIPTATMQLSDTGLNLELQIQRIIEREVQNAVAKAMDAMLPTIAPHFTVSYPSSVASANGTTNETVVIPRPDLTNNTATSDPSTVALSNSHLATNIMSQPQSSTVTLSDAPASKLVNIRKRLQDLDQKLAPKSVKLTDIARIHEHLAVIHDPNSKLEQLYGEYYDLLWSIPVSERSKEEKNALKQFEIGSLPSHRSIDSRVNFRMWMHELLYFKLKYYIPDLIIGAVIKPAAQKTRATELIC

SEQ ID NO: 14358 - protein, 375 aa, Candida albicans
RGLPLVVKTAGLMCATWLARCGIPFRIIDKRSNEVFAGQADGLQSRSLEIFKSFSEPAFDFATLDQSWKMANHVIDMCFWSPDETGKLIRNSRVADTIPGISRYTESVIHQGNVERWFENSIDYFSDGKVKVERPLLPISLKIDTNKATNPQAHAVEVLVTKLNSEAAKPEQYGKVANGLFRAFDGDQEKFYKNIDDTNEHEYEVIHAKYVVGSDGAHSWVRKQLNIDMEGEQTDFVWGVLDMVPITNFPDIRNRCAIHVKDSGSVMVIPRENDLVRFYIQLKEVERDPATKADDKQFNGNVEDTKAKTKGRIDRSKITPESILKQAQEIFSFHIEMTNLAGTRLINWTRNYSSFLTKPFSFRNAFIFFLQIGQE

SEQ ID NO: 14359 - protein, 192 aa, Candida albicans
IISQADGRPIHIADRLSSDGRFRVLIFPGDIKQYPNNLKILHSFQDLLDDSKNFLKKFTPLNAFQDSVIDIITIHNNNRHEVEIFDFPDFTHPLDYKHRCDYWKLYSGKGDTYHEGKINMYDDYGIDPKHGVILVIRPDSHVAKVVPFSIDGLKQVDEYFKKFMIDQSNNVLASKPIDYDDSKRFIQPRLAV

SEQ ID NO: 14360 - protein, 357 aa, Candida albicans
CGSFQARGEDPQFSKQNRVFISGDACHTHSPKAGQGMNVSMQDTYNLGFKLALVCKGLAKPEILSTYELERLKVARDLIAFDHKLSRLFSGKPMIPNSDILDGVDMDEFHQVYLEGNKFASGTIVDYEDSLLVSKTGALPVDSNDCTMDQKAAKVPIGRRLNSSNIICQANGQPVHIADRLASDGRFRVLIFPGDVVKYPENLKTLHKFQDSLDSKHFFAKKFTPVNAFANSVIDVITVHGSSRHEVEIFDFPDFTHPLDFKRRCDYWRLYSGVGDTYHEGSVDIYDFYGISKSEGVILVIRPDSHVAQVSQYSIDGLKEVDNYFNNFMIPQTNNVLPTKTSDINDSKRFIQPRLAV

SEQ ID NO: 14361 - protein, 1063 aa, Candida albicans
RSCNKSNQYLKRHGSAGDDSSLSNADINFRNSISFLNLYQFFKKIHQDLLRLQQFIELNETGFSKVVKKWDKRSKSHTKELFISTAVSVQPVFHKNEINELSDLVTQSLFDIESIMDGDYSSLLNYNASNSGVVSTTATTGTGNSSTPPAPNFNIPSVPGIGEDQAEEIFTRHSSIVSNQPNNNEIDELYTSFVNVATIKEPDLSLLARWVEKINNGGSKLPEQPFTPVVKYKISKIFLLSITNLKISDSFLELFLQFINYDVDFTFINDDFNNNKTILHQCCSIPTASSQLDPNNNNNSNNHHPHHVTINNGVKVINSTDLINHSRTFIVKYIVEKLQFPSVEEKTKLLVHKDFNGKTCLHYAAQMNRPDLLDLLLLSYPQSHIDELDNDSMSPLLLAIKHGHLNITKKLVRFGSNPFPTASKDTLQYLPINYACKFGDYKTLEYLLSNAKSQELIAKLINQQDVEGLLPLHVASRQGHYKLIKLLIQYGAQINKLDGFNKWTPIFYAAAEGHVKTTQELIKFGAKLNIIDEDGYNVLYYCVVEGHIDVINELLSYYQKAFSSSKLTSDSANSTNSTNSTSMSILGNDKDMDSGEEEEEGVLAITTTTTPTTATATADVDVSSLNENSSNNNNVDSIPDLQLPPPILPLRRYGHNFLEQKVLIELIFPSDQVFINLFNSTADLKPGRITITSNISDIVPRNILLPIKEDSYNNNSNSNNNCVFQTDVDSLCEFRIDFEIFPKFGTRLIAKTTALSFEHITGNSPEINTVLLPLFDLRLKNIGELKFSYQVIFPYSGTLLETSKFDTYWKSSTSFVKNRQTLKLNAAGGLSPNNFLSPGSVSTMPIPNNVNTINNTIDDDNYINSSNGNGPAGGDGTNSTLIPSTQSIVTATSLSGEYIRIKVCLLSDGTHIVCHNWSISINDNIDLYLPKLTLKQLNSITNDIFDYPRIIHDLYRLSNKDIPLIKKLLQIIYLPLDLVLDILNIDINLNLEIVFPSIYELETLPFINNILNNLNQFIDNILSNVFNHIRSNKKRQRETSLLATPLLIITTIIGQLFFFLQIH

SEQ ID NO: 14362 - protein, 196 aa, Candida albicans
KTSTRNLPTGNTPPNNNNNYRSIIFLSSNSLICKILNWKQPNFPVFLIMSGIAFNTKLNKFVKRSTNGLEIAPHVSQPHSQDNLLHSHSTSSSPSSASLELDDLTTRSIKEAVNFTINNNLIGLITSIHLLDLVPKLIPLIRSTGLILVASSDVINEDKDKQDDAILRKELDCYTKTEINGLRFDDVLSFKEDISM

SEQ ID NO: 14363 - protein, 253 aa, Candida albicans
FLFLFDFEPLVSPPPSNNMRLILLLFISTTVTSLNILITTTDSWVSKNTRLLYSSLKEKHNVKLMAPLYQYNLEKNNIPLFSNKLAKDGGEYGHLLSVHQTYFHNLRSINSKRAKGVKFEQDESQSESESSTQDIVQSNQFGQDPLDKNCWYVDSNPFNSLQIGLDVILPNYYPDFKPDLTIIGPNEGLQNQQIINKMIHSTITNNNISTIAFSTEDEHHIYYQDENYFHISSNSIHQLMKHNVFTNKHQVHK

SEQ ID NO: 14364 - protein, 329 aa, Candida albicans
ETNQLTMQFLTSALVLLLSVGALAKNILLTNDDGWQATNIRATYYKLKEAGHNVFLVAPVSQRSGFSGKFDIPTSPTLQTNGEFNYPPAGAPSWGHEVDDNHIWYFNGTPASSAVFGINYVIPKYGDNVTIDLVVSGPNEGTNMSPGLFTISGTVGATYTSIYRGIPGVAFSGSNSNNSFFKDSLDLKDNKEPSTIYANKVVEFVNQIFKAQGNNPRALGLGVGLNVNFPKVGYENETCTNPKWVFTRLTGQYAAGANLVYNETSNSFTWGQKSWDGLTVCNNGDCSLPSENFIVEHTNCQSSVSVFSVDYDANLGLTSQVKQILNPLF

SEQ ID NO: 14365 - protein, 79 aa, Candida albicans
SQKKMYSLIKSLATFATLFSLTLAKFESSTPPVEVVGNKFYFSNNGSQFLIRGIAYQQDAAGSVSSGYDADPNRKYNDP

SEQ ID NO: 14366 - protein, 206 aa, Candida albicans
TPLISYTYQKQYTQQSFVMFSHSGTQTPVSASYQQQSQPHQLQNKVQFHEQLDETITWINDWYSPNLINNNTIRDANYNKSGQFVHYSVDTNKGHQGHSNRVSTINNFEEENSTPAVNDSIRLKGWHRTNLNHKHGESNEHYNNLNPSDVLDLNKWRYFNEVNQNENNTTMTTNKDAGVSSAAVKQEDPVSKDSAVERFSDTIKLQ

SEQ ID NO: 14367 - protein, 533 aa, Candida albicans
IFFFTRCVWSCQRRIYIVRGGLFFFSHPNVIQPKKKINTKISCRQTSHRHTLTLLLNLHHQTCQLTIMATSKIIDYFRLKDIVNQRIVYDLPLNYTDSQSSSTIKVAITITSKYDKNLHNDKEGFEKVLLPEKPKIIVYLQGGPGFPCPVPTSNLGKTKVLLEKGYQIVYLDQRGTGLSTPLEVKTFKNLVLKEYGNFEVDSQLKFILNFRADSIIRDLEQIRKDLIGNHHKWSIMGQSYGGFCCFTYLSLFPESISEVIITGGVPPVQFKADDVYKATYQRTIERNLHYYDKYPRDQSKVVRICEYLNANKVVLPNGGTLSVERFQQLGLRFGGTGGTDGIHLIVSKFDYDLDLFGYPTYDLLNTIQQFLGFETNVIYALFQEAIYCNGNSKSNWSADRLRYALDNEKLFTLNKEQVFFTGEMVYKSMFDDYSELKPFKELAYALHDFSEWSTIYDPKVLKTITWDKVPIVAATYFDDQYVDFEITRKVKQDIIPRGNLRQFITNEYFHNGLGQDPETILSSLFDLLDREID

SEQ ID NO: 14368 - protein, 237 aa, Candida albicans
  UNSURE (17),(237): Identity of amino acid sequences at the above locations are unknown.
LLLFRDEHYSTLSPSAXIPSGDSTDFSVTCGIQVVTVESASALSTDTDTFTLTRNDNKKEATPVAQITDGQVQHQTTGGVSAIKQISDGQVQHQTNAAQPIAQISDGQIQHQTTAKATDTPVQQINDGQIQHQTTVQPVAQISDGQIQHQTAKATATPVQQIGDGQIQHQTTVQPVAQISDGQIQHQTVKASATPVQQIGDGQIQHQTTAAAATTASAVTQINESSPAGAKEQRKGX

SEQ ID NO: 14369 - protein, 179 aa, Candida albicans
IMKYSTLVSIAAFISTSLAATVPDEHYSTLSPSAKIPSGASTDFSGTFGIQVVTVESASALSTDTATSTLTRNDNIKEATPVAQITDGQVQHQTTGGVSAIKQISDGQIQHQTTVQPVAQISDGQIQHQTAKATATPVQQIGDGQIQHQTTVQPVAQISDGQIQHQTVKASATPVQTKL

SEQ ID NO: 14370 - protein, 250 aa, Candida albicans
LTMKFSTVALSLPLIAMVQAGISSPTYYKPEHNEEHGVETVDFEFALGVREKCDDSIIYLVYEVDDGQLERNDKKVDCNCKSKRVFRPAPSPSAIAVVGGNEECDEDCDDEHRKKGSKQYKRGEVENPRETRDCDFCTIEKSFCQDHFTLCEGVLKDQHSAIGSIVSNHQFQFDKPAQKDALHTCGWSIVEKDCVKLLAVDGCTDFWECPVDDCDTYKLYNSAIDAKCKEIEIIVILFEEEEEESKHKSW

SEQ ID NO: 14371 - protein, 91 aa, Candida albicans
KMTLTDGILRDSDDRIGCIVSGHQFQFDGPTPQHGAIYAAGWSVTKQGQLALGDSTKFYQCASGDFYNLYDEPIAFQCHPVTLDVVELIEC

SEQ ID NO: 14372 - protein, 309 aa, Candida albicans
IITNNNSTCHYDMKFSTAALTFSLLAIVNSSVITYDTEFGDNYEHKHDKYDCEIDTFNWKFALVVKEWKYHKDEKFCKDTDLDLVYEGEDGQLYHGCDGTYPYSKCKHCTNVFAGGDDNKWKDDKWDDKYKDKKCHDKWDDKCKDKCDDKHKDDHCKDDKCHDDDKCHDDDKCHDDDKCHDKCKDKKCDDKCKDGDDKCHDDCKDDDKCDKHHCKYPYCEIHNTDCDLLITLCNGVLKDKRDATGEIAANHQFQFDKPPQKDALHKEGFSIVHTEGTYYLALNHKIEFWHCEVDDKGLYQIYDKSIGPQ

SEQ ID NO: 14373 - protein, 301 aa, Candida albicans
FRNFHYGWNTKIGLKDIDNNTRISKLSIPGTHNSAACHTALPSVQCQGASVTEQLEHGVRFLDIRVGKLFVGNDVKDLQVIHGKFPVKIPFPLKLNDTLEEVYKFLAHNSSETVIVSIKQEGSDDWDNSQDEFGKLIWDKYVNPNKDRWHLNTDIPKLGDARGKAILFRRFGVQDEQLKKQFGFSASSWAYNTTNDDRGQFVVQDFCEVNTADDLPKKIDYVKDLAKRAQDYTSKGDDKVFLNFTSASNFFDQSCWPQPIAEAMIKGNIQETFHKGVGIIVLDYAETDNWKLPEALIDTNF

SEQ ID NO: 14374 - protein, 255 aa, Candida albicans
ISFLYILSFNSSKSFFYLLFLHSFFFLSSIGFYFNYLLNMVDYKTWLKDIDNNTRISKLSIPGTHNSAACHTALPSVQCQGASVTEQLEHGVRFLDIRVGKLFVGNDVKDLQVIHGKFPVKIPFPLKLKDTLEEVYKFLAHNSSETVIVSIKQEGSDDWDNSQDEFGKLIWDRYVNPNKDRWYLNTDIPKLGDARGKAILFRRFGVQDEQLKKQFGFSASSWTYNTTNDDRGQFVVQDFCEVNTADDLPKKIDYV

SEQ ID NO: 14375 - protein, 303 aa, Candida albicans
YINSDISIMVDYKTWLKDIDNNTRISKLSIPGTHNSAACHTALPSVQCQGASVTEQLEHGVRFLDIRVGKLFVGNDVKDLQVIHGKFPVKIPFPLKLNDSLEEVYKFLAHNSSETVIVSIKQERSDDWDNSQDEFGKLIWDRYVNPNKDRWYLNTDIPKLGDARGKAILFRRFGVQDEQLKKQFGFSASSWTYNTTNDDRGQFVVQDFCEVNTADDLPKKIDYVKDLAKRAQDYTSKGDDKVFLNFTSASNFFDQSCWPQPIAEAMIKGNIQETFHKGVGIIVLDYAETDNWKLPEALIDTNF

SEQ ID NO: 14376 - protein, 206 aa, Candida albicans
MLQYLAYLIKYPLLTKSITSGVFSGLNETVASVLTNEFQETKIAGIKIKHVFTQKLLTMIIYGSCIATPISHYMYFIINNKIFKGPLTKSGKILQILTSLSTVTPTLAACFVSWIALINNYKLPKGSINPIAELNKIVAIVRAGLKKGYFGVLKSSLVTSSVALVIAQKFVPPELWVVFFNVVYFFLGTYQNTKLKRLQKQQRLAK

SEQ ID NO: 14377 - protein, 385 aa, Candida albicans
RPNSTTHIFFFLTDEISKQKISNIFFDVHLHIHTYLHIHPYSCKYLLHLSLNKNQIFNIKPSKIMTTLFPTYIDDKALAQDLILSQFDNFLIDCDGVIWLSEQLLPKINQFLQFLTKNNKKFTFVTNNSSKSRQSYVTKFKNLGIDGVTIDQIYTTGYSAVLQLKKMGILPGEKIWVLGDEGIEDELLSEGYIPLGGSNELLNQSWSDKNPLLIIDPEVRAVIAGSTLNFNYMRIATTLQYLMHNDKTLPFIGTNGDRNYPGSNGLTLPAGGSMVEYMAYSSQRDYVNVGKPDTTLAETILANTGYDKLKTIMIGDTLYSDIKFGNEAQLGGDNGSGTLLVLSGVTDKEELTNTVNIARETKQGQSLVPRYYIDSLTKLIELLEE

SEQ ID NO: 14378 - protein, 325 aa, Candida albicans
HLLLMTIKPNPKHISSKQEAERILSKYDNFLFDCDGVIWLDEDLIPGVDKFLEWLTKNNKKFAFVSNNSSKSRNAYLKKFENLNIPNITKEILYPTCYSAALELQKLNIPKGSKIWVLGHEGIVDELRDMGYLPLGGNDKLLDEAFDHQNPILTVDPEVKAVVVGSTKEFNYMRIALTLQYLLHDHKSLPFIGCNIDRTYPGPKGLILPAGGSIVNYMSYTSNRDFINVGKPSKQFLDIILEDQKFDRSKTLMVGDTLYTDIKFGNDGNLGGDEENGGTLLVLSGGTKKKDLSHLLHNRHECKDSESLVPLYFVESLGKLIDLLE

SEQ ID NO: 14379 - protein, 597 aa, Candida albicans
MKINRALLFNRCIPIGLLEPYSIQEHLIQGQKLLSPVAMVSLRLSATQQRYGTLERELLTIVYVLQKYKQFMSREVQFYTDHQAITTIGSARLEPANRIKRFIDIIQSFNPSIYFIPGQFNFIADFLSRYNLDKIPHELNEEAILNQTLSIYLPTLRTTEPIPLAPIQPVQRHHIHIDNLTDNQLQQIHDQLCGSYENNNSNELLPTDQFVILQDQFHVVLSSTQVVPVVTADTLANTATKVHEHHHASIRVTDYLVSKIQWHPNHKLLCTNVIRNCLVCQLSSTFETAHRELYPLTPTKTFSRWGLDFIGPLPMSDNLSCCLNAIEYVSGLIYSWPCTSPNSDVVILMLNLIRQVHSTPVEVITDNGSAFTSNATQSFCATAGISIKYASVYHPMSNGRMELGNKLLKKILKSMTDAYYTKWPQVLANAVMVYNSTPTTFNKTPYYLLIGISTDMSEFTTYLANEFEWKEGQLSQSSLLQDLHNDVQVRLAELDGVNKNVEKHNDLRVRRMAYINLMRQPFQKPASFIKGDWDLLRRRVKRKKSEYNYMGPYQIAKVLDKHAYVICDTNGNMINGTIHHDDLKYCYSFNDNSISRP

SEQ ID NO: 14380 - protein, 408 aa, Candida albicans
RSTNYEVGDINGAQVEFSRNKIPETLIKNLSVDGKVITHGYVHGHIHKHKDHTHIHGHIHNHDHRTDLEKINTQINDTSMEPISNQPNFNFSCPALDDLDFCKDVFCNDLDDCFYLNCDDNENSNTCDVNCCDSQVDEICCTNDKCLEPKLEQPPSCEKSEHLECCDDPHCESYNVCHSDLGDLSSVVCTDPNCPEIDTCCSSLPQPTLPSHLENNLCQPQLSKRPIFEDLITNVHLSCKQTQAEEINSVYPPKKKIKRESDFDIHFPHECHQDYKNPFTATATTNHQLHQSCFHTTIPDRKNTSLEYDEKLMSDFDFVIQFNNFNQLLNTATKHEQQGQHEQQKQQNQFVKETTDFNQVSTNRPTLYSCLWENCFPRLNNNTSLNHVIEESLEQEDIVQSEKSNLSM

SEQ ID NO: 14381 - protein, 250 aa, Candida albicans
  UNSURE (227): Identity of amino acid sequences at the above locations are unknown.
FVPIFFLKKNSKSWLVVPWFSFVFPVKNIVCLPYMTTPLSSYSTTVTNHHPTFSFESLNSISSNNSTRNNQSNSVNSLLYFNSSGSSMVSSSSDAAPTSISTTTTSTTSMTDASANADNQQVYTITKEDSINDINQKEQNSFSIQPNQTPTMLPTSSYTLQRPPGLHEYTSSISSISSTSSNSTSTPVSPALINYSPKHSRKPNSLNLNRNMKNLSLNLHDSTNGYXSPLPKAPNSVFTQDAWKELLCSR

SEQ ID NO: 14382 - protein, 245 aa, Candida albicans
EDNVSRITNVFYLAINIGAFLQIATSYCERRVGFWLAFFVPMILYIIVPIFLFIVKPKLKIKPPQGQVMTNVVKILAVLFSGNFIKRLWNGTFWDHARPSHMEARGTIYYNSKKKSAITWSDQWILDIKQTFDSCKIFLYYIIFNLADSGLGSVETSLIGAMKLDGVPNDLFNNFNPLTIIILIPILEYGLYPLLNKFKIGFKPIWRICFGFVVCSFSQIAGFVLQKQVYEQVCKLSEVFFTLIV

SEQ ID NO: 14383 - protein, 148 aa, Candida albicans
SPCGYYATNCDSPAPITAWKASSLFILAAAGECWAYTTAYELAYTRSPPALKSLVYALFLVMSAFSAALSLAITPALKDPNLHWVFLAIGLAGFLCAIVMLAQFWNLDKWMENETNERERLDREEEEEANRGIHDVDHPIEAIVSIKS

SEQ ID NO: 14384 - protein, 265 aa, Candida albicans
FYNQMVSSDFENEKQPDVVQVLTDEKNISLDDKYDYEDPKNYSTNYVDDYNPKGLRRPTPQESKSLRRVIGNIRYSTFMLCICEFAERASYYSTTGILTNYIQRRIDPDSPHGWGAPPPGSPDASAGALGKGLQAASALTNLLTFLAYVFPLIGGYLGDSTIGRWKAIQWGVFFGFVGHLFFIFASIPQAIENANAGLGLCVIAIITLSAGLGLMKPNLLPLVLDQYPEERDMVKVLPTGELIILDREKSLRRVVPPRNSSVPGI

SEQ ID NO: 14385 - protein, 484 aa, Candida albicans
LGFPRVFVAEFPETYELDDEEMERINAMANLELNDAKEQLAEAEGEEETEDNDSGNAPKTSKLVEQIEIDDDLKEYDLENYDNDEDQDDGNNLGNTKISMFPGLSNTDAKLLQDESGEGDKYLSLPTELDEQEEKKENQIYPTDNLVLATRTEDDISWLDIYIYDDGAGAPIGAEEEEEDKLDIDVANGMIRESNLYVHHDIMLPAFPLCVEWINYKPGQESSNIGNFAAIGTFDPQIEVWNLDFVDKAFLDVILGEPNKNSFIATKNKKSKKKNKGGQHITTHHVDAVLSLSHNKIHRSILASTSADNTVKLWDLNSATAVLSFDKIHHNKTVSSSQWHSQEASILLTGGYDSTAAVTDVRISASESSSSSDSSKHYSVVAGEEVENVRWDLSKPELFYAGTDNGNVYSFDIRQDSKPLWTLHAHDAGISSLDVNNYVPGMLITSAMGEKVVKLWKCPSSSDENNTTRKTRSFHGFVERFWCW

SEQ ID NO: 14386 - protein, 156 aa, Candida albicans
SNFGNALHRLMKITPPEKQGPSMVLSRDFGVGNVLTTSYAPDIEVAGNVVIGGITGGLKMWDAFSNSSVRNGFREELKVLQNNARQEAKKNGRASRIARKYNSNSNKEEIMTVEAGGLKDESDSDSDEGEDVPIEMQEKEEEDDDDDEGMSDDDEN

SEQ ID NO: 14387 - protein, 826 aa, Candida albicans
SKVYDIKFSPCGKYFAIAIYRFIQVWKTPDLTEDRQFAPFVRHRIYLGHFDEVLNISWSLDSRFFISTSKDMTAKIFSLNSDEKDVAMTFSGHRDYVINAFFSHDQEIIYTVSKDGALFKWEYTERPKPENEDSDSEDDATDKPMSWRITAKNFFYADGKLKCACFHPQSKLLVVGFTNGEFRLYEIEDFNLIQLLSMGQNAVNTVNINKTGEWLAFGSAKLGQLLVYEWQSESYILKQQGHFDSMNTLCYSPDGSRLVTGSDDGKIKIWDVRSGFCLMTFTEHTSAVTQVQFAKRGQVLFSSSLDGTIRAWDLIRFRNFKTFTATSRVQFNCLAVDPSGEVIVGGSQDTFEIYVWSVQTGQLLDSLTGHEGPISCLTFGKENSILASASWDKTIRIWNIFSRNQTVEPIEIQSDALCLTMRPDCKELAVLTLDGHVTIFDIEDAKQLHLIDGRKDIVNGRYLEDKFIAKNSNRGKYFSTIAYSFDGLTLLAAGNNNSICMYDIENEVLLKRFIVSENMSLDGTLQFLNSSKITDAGTNSDLIDRAGELSDLEDRVDNSLPGSHRGGDPSERRTRPEVRVTAVEFSPTTAAFAAASTEGLLIFSINQELIFDPFDLDVDVTPEATLESLKEKEYLVALVMAFRLNENYLIHRVIESIPLQDIKLVCQDLPVIYVNRVLNFIGELLTKKESPHIEYYLIMVKNLLIQHGRYISLNKFEFQSSMKLLSRFLNKTAKDVINVGKRNDHLLTYLTVSKDLKTASGHSEGEENIEMNEDLEAEDIDIDEDDDDEEGWLGPNGNSVKAANGIVFSGPADSSDEEDEDELIEV

SEQ ID NO: 14388 - protein, 84 aa, Candida albicans
HLRSAPAVCENNQDGAKLLSPVGNRVSCFDLIKSQSFTFDYQHRKNVQCIALYYLYSLMISIDEDGRAILVNFVSRVVLLLFNF

SEQ ID NO: 14389 - protein, 449 aa, Candida albicans
KISIAMFRPSIKFKQLTLSIIARRLKSSAQHQPLRSSFVPSPIVFVAGLAVAAVGGYYCLDSRSAIHEYVLCPLIRTFTDAELGHKLGIFFMKYGLSPRLLDDGKNDQSDVLGVQVFGHKLKNPIGLAAGLDKDGEAIESLFNCGFSYVEIGSITPEPQPGNPQPRFFRLPKDDAVINRYGFNSSGHFNVLATLKLRFNKLLNKFGTSHSSEQHPFSNAFQQGKLLGINLGKNKFGDEVNDYVKGVERLGPYADVLVINVSSPNTPGLRDLQSEAKLTNLLTTVVKERNVLGKNLLGNKPPVLVKVAPDLTEPEIESIANSAKEAKVDGIIISNTTIQRPVDRLLTTDKQLINQAGGLSGKPLKPLSLKALRTLRKYTKDSDLVLIGCGGISNGKDALEFGKAGATFIELYTAFAYKGPGLVGKIRDELAEELRKEGKTWEQIIGSDDK

SEQ ID NO: 14390 - protein, 154 aa, Candida albicans
ASLNRVWHQCRALTFISLKVRIKALGLVFFLFGSEVYKNNTENHSFFSLSHSEYMQLINQFSKSPPLLQFNSPNFKFIFKYSLLLFFLIIVIFLFLYPPSIYQIMSILPETQKVVLHRENGDYDVIEYSDFPTPKIESSHDIIVKNFFTSGGDP

SEQ ID NO: 14391 - protein, 266 aa, Candida albicans
KTKTKKNLIPRIKLLFITYIYITPILPNKTSFINIAEIESKRNQQLLIIIIIIMTVKSQQQIIDSFKQANQDQLFQYYDSLTIDQQQKFIDQLSTIEEPAKLISTVEQAIQFSQTNSTSRNFTQLPNEQTASTLDLSKDILQNWTELGLKAIGNGEVAVLLMAGGQGTRLGSSAPKGCFNIELPSQKSLFQIQAEKILKIEQLAQQYLKSTEKPIINWYIMTSGPTRNATESFFIENNYFGLNSHQVIFFNQGTFTCFNLQGNKIL

SEQ ID NO: 14392 - protein, 235 aa, Candida albicans
  UNSURE (10): Identity of amino acid sequences at the above locations are unknown.
TRTFHFRGAXGVVDQIFMGFAIAIKFDLATKVVRKRDANESVGLIVLDQDNQKPCVIEYSEISQELANKKDPQDSSKLFLRAANIVNHYYSVEFLNKMIPIWISSQKYLPFHIAKKKIPSLNLENGEFYKPTEPNGIKLEQFIFDVFPSVELNKFGCLEVDRLDEFSPLKNADGAKNDTPTTCRNHYLERSSKWVIQNGGVIDNQGLVEVDSKTSYGGEGLEFVNGKHFKNGDII

SEQ ID NO: 14393 - protein, 286 aa, Candida albicans
IPLYIVFDDSGIALDDTEFFKCLRRFAVTDPILLSRNDIGDNDGNNSNDEDDVEDDDLDEEEEAITDEYTFNKTNWLKLGILYHQVSKKSILVDFLNGPLKAEKRKIVRARNVDDTKGSGMAKTARQVQASDISGNQEQNTANMVKSVYQTYIEKYDGNGVNLFKFFINPRSFGQSVENLFYTSFLVKDGRLKLYVNNDGMPCIQRVSSDEIREAQLESNKIFASHHIASFNYKAWKKYTQLYNIREAFLGHRDEPEDQMPPEDIIDYNDEEPIPSSQRRDLNSSD

SEQ ID NO: 14394 - protein, 591 aa, Candida albicans
ILEELVDIYFPVPFNVIIRMVDRVSLIRHVNYLQLLPEHKRGSMDGNILALVWAVVALGEFSSIGGSVKKSLIFAKNAIMALENSFTTTIETIQAMITLGLVYYHLGQWDFSWVLISSGTRMAIDVRLMRNASDEDNPRVQSSASLNNINRQRTWATVYFVNTLLCARMGRSPVVRALDWPVPEINNDGWEEWLPWECYYAPNEIKLESGKFLSTFNETLKGVYILNLAITSTIDTSRGYYQNGEVKSEFKINYDDRQNSNNMTLEMFNDMIDAWLNQLPESFKDDQSNTGLKLPSTTILVLLRGLIWCVLAVRLSSLKGNSEIKDQIIQFRNQKYTEAIVAMKRCINENSENIWKHYFLFDYFLIMTFNFPYMMNFESEFMKYAHIQEMKNILVSCSETSIPCSICWDLLKIMNNGTKQRESSKLHDTPKAQESPTIANLLNDQADTEAVGPQPPAEVQPVASVPPMAPVAPNLSLTSVAPAPESAPAQVAAPPLVMAPAAPPISSSGNALYISNDKNWVNQFGPPTTMLQDLHQVQSQPIYLNSNFHQQHKYYPHQILLEEPTLLLLQVNQIKQENTTLQPNNHNPNVK

SEQ ID NO: 14395 - protein, 217 aa, Candida albicans
DQMKWNTYFIPAISCSISLFAVWYLFPETKGVSLEEMGSVFDDKSSIFSHHASGSVGGSSSSIFNYGATNDLNRRTSMTNDSTPSIAGDLPGAEPGAIDSIHQSAASMARNPTSNNNQQLDGIITGAAPPPMPINTNNNNIIKPVKSDNAADTLSLDSGFGGSQSDIVQEIEPPSLEEILKYKIQKQIEPNAFIATFHWLFSKKGQPNDEESRLLQQ

SEQ ID NO: 14396 - protein, 437 aa, Candida albicans
  UNSURE (385),(391): Identity of amino acid sequences at the above locations are unknown.
SVPFFFIHSFKQNNLVSSKHIINIIMSDEKTTATYESHTKQDSMSSTSSQSIEQISSPTKSEPKKKSWFKMKNLFEKVEDRPTPPQVYNYRIYMTAIMASAAAIIIGYDGGFIGGTVALDSFKNEFGLDKSAHSSFIISNVISVFHAGCFFGALFSYPFSFYLGRRIPLIFAAFLITAGSGIMLAANSSVGLGPIYAGRVMAGVAVGFSTNLTVVYISEIAPPAIRGQLTSSYEIGWRVGDLVGFWINYGVDSHIPEGKRQWYIPFAIQLIPSGLFLLGSIFMKESPRWLMQVGRYDEAIKNLTWFRQLPEDDEYIVYEVNQVKESIEEQKQKIGLGIMDPFYEVSFNNKLILRRLLITMTTYVVCNFLGIQSINYYSPILFQGXGVKGTXSSIFSTGMFGVVKFNCTFNYIWFIVDTIGKTNAFMASSTVGPLVFG

SEQ ID NO: 14397 - protein, 462 aa, Candida albicans
VISHSLIFFGKLVHKMYQQPMHFNMRRSMDIPPPLHLSNQSDNEIPSQYTPITPFDISYGQSMIPSNLLMNSPYFTPPPTASQYFPPQYSRNSSRTGSQSSSPRGTHSKLRLNGNKGINNNHQHDNTRKMHYISSMGNGNPKSAVSMNQMADQPSCSRTVIFKNISENVSMHEFLDAIDFGPIEYCKIFSKPTPRLTKEKYPESPDSMQICYVSFSNYKIALAFSSKYTQDTNLMEGLKEKLKNSTYLKIQLNDTQGKHKSTSYSNQDYLKLKTLNYILEFNATRCLTISFSAAHEIPENVETDSAHESIKSSILNHCEKFGQVEDFVFDIKSSKDICGKVVVHFCSIDSAIKAYENLSKRINQNSRYDRKENSHSDTTNASSTKSFNSLNDIRFSGVEFGKDRCDKNAVYSERPVLYSSSSKNHIQCIPEDEETGTEDQSKDVSNLKEFITSPEIERVPGT

SEQ ID NO: 14398 - protein, 265 aa, Candida albicans
IQIGSLKPGYIFCTQVLTISITMKLSKLLQLAVFSSLVTSKNIFDLESLKQGLQDEETVNNDKREPVNLLYLDRFKMGVSDEAKGNAKFKRDPKNVIDPASLKEGSAEEEQKDKREPKNLFNLQALHEGLKDEETKSKREAKNLPNLEALEEALKGGSLPKKDAKNLIDLVALKQSLEKEAAKRDAKNIPDLEALKTGIEEEEGQVAKRDAKNVINLSNFIETPSKREGKNLFDLTKFQQSGQPINEKRPKNIETREVIICFEFG

SEQ ID NO: 14399 - protein, 118 aa, Candida albicans
DKLMERRNRRTGRTEKARIWEVTDRTVRTWIGEAVAAAAADGVTFSVPVTPHTFRHSYAMHMLYAGIPLKVLQSLMGHKSISSTEVYTKVFALDVAARHRVQFAMPESDAVAMLKQLS

SEQ ID NO: 14400 - protein, 263 aa, Candida albicans
FAVNRNNSNDAQVAPTPVDKVVKKKKKNFLNNKTNFFFSFKKSLLFLFPSIPTTTTTTTTTNSNQTYITMAIELPFEIPKDNPVYINIQKFSVTYQKLVDESVPYTSRRWIGFGILLSLFLLRIFLSQGWYIICYALGIYLLNLFLAFLTPKFDPSLEQELKNESIEEGLDQEDPISQQSNQKYDDDDDDDDDEFRPFIRRLPEFKFWYNAIRATIIALILTFFNIFDIPVFWPILLMYFIILFTLTMRRQIQHMIKYKYLTI

SEQ ID NO: 14401 - protein, 290 aa, Candida albicans
SSSQHMKLNEKNENENENGDADAEVGNEVKEPIEGSSSQVTDEPEQVMDLRERIYEQNIQNDTSSIDESTPLISQNEISALDEIIESPLEDNKNEEVQTESQQLEPIEENEEEPQVSTNEVSRPQKNVLIENTESSVSKKKDNLKSSEAPSVILEQEQEQESASQPVPAPEQKQETEPAQEPVQEQESVSQQEQELVAEPAPAYTQTEEREREGQGDEEVDVTDEQPSNEGTSTEPSTSPEPTGNNENNNAGDTTPLATTIGSSSNNKSNQKKKKKKNGKKGGKEKGKKK

SEQ ID NO: 14402 - protein, 188 aa, Candida albicans
SRSFQARGEDLAPIDQVDSESLESGSPLEKLETATKDESPLQEDELTRLLTPELQSQLMNLQYEQQSDSEESSVASETESTLETTSLVKEAEISESADSKNHLIEDSATPQSELDSKSLEENVPENEQFENINLDGIFKNSSSDASAAEEMREDMPKDFDEEEIYNGQPTVPENYEEVELEIVNQENV

SEQ ID NO: 14403 - protein, 98 aa, Candida albicans
PVGEITYIYKNKNNNNNNMPELVPPTNNRPHIHETPELSSQPSLDSNRQPRELCKKCNQLIVEGHAYELGDDRWHIHCFNCSKCNTSLGCNSNFLVLG

SEQ ID NO: 14404 - protein, 609 aa, Candida albicans
  UNSURE (201): Identity of amino acid sequences at the above locations are unknown.
KQTWLKKEREKEVDTLTEMSCVRYNKFLGVGKLMFSANYCDNTNTTCEYKLPKKKQNKSILKLDVIIETDWKGLANVKTVYRKTVVLLAEVEVSLQIEPFVVAVALLRVQSLFSARFIFIFYFLHFCTFNTTTPHTAITNTFMPGLVSSSLNSPYIKVLNEKLSISLQYLNSQESNQTCVLTFINTADKDVNINPTKQASXGSWLSGLFGLNPSLDEFLSKLNVDTDAPVDLFLGYIQLFGYVVLNYKFEIDTTSLEVNKNPQWWNNTEYLNQYLEINESKDDRIDEHLKLDTVPFIEKNCSEKLTIGGKLGGVQDLVVNNDKILIDNRYLLHDLIGNFNSNSLSKEVQLLPLHDLTEAIVPFYTTPQSLLFTDLSIPKNSSRSFCLKVPIKDDLPPSYNTCLTGSACDQGLISIRYSLIVSLIEEKFSNKTKSVYFPLKMNPKRYGGVHTYLQKRYFDSPIRLDKDWQVEIITDKQKTTHQEKDISEKGSFLQDISTLIDSDLYNMPKVSTMERRKSSVNGMSDEINSDGYISQLPDHLKTQFRLRVNNQELCTIGLSKAYYHPGEDLNYVININPNADNTTKVIGLTTYLEAHEVYRLLENGQKTHL

SEQ ID NO: 14405 - protein, 710 aa, Candida albicans
TPMDPSSQVPSLTPFLNSVCPGYTGLDDNVHYPLDDIPHECGELIWPKSTTNATIKLDYTYLNVARPGLNKNESTTYVSLPLHITNLFDNLVSKSDKTLEGYMHIGANVNALAHDPFKIINLNPGCITRIVDWNRSKNPFADNKTLSFNKLASNFNKLFVKNDLFDDLGNSNVKILNSKPITAAKLLVSSHVNVLNVFALNEKSEYLNTVKKERTTGPPDTEEPVLRLEFNSIITALSTFVLNEDPVAIIGFHSGEIMILKLNEQKYQLFDALKVQKLSEVDAVTCIEAIRHPNYEYLVVAGYSNGEVVILNPYGVKDSYSKSVVDKDVSTTFFKKFDLSPLGKVDNSFVLGHFKVSHKPITSLSSTLPINKPLQPSEAQPLILAIAADDGYVRFVDFIFTYNCNYGDKQQVITTDIISNYFNTSITDIEFSPDFKFFSVVGKGDLIEVFKMSYYNVNGLLHKSSGRRSRSGTVNSAHSGSETRLKETKEMYPPLIKDIQIVGRFKGHTNIVKSTKFVKDDFSTLVYKLVSCGYDGKIIVWEFDYKALPKIKKSHLKPTPTSPRESRSKTSHERKPVLLSPSPLARRNHHTRNRSIEDNQLHTTSMNMLLQDTNTTKTPLSSDQIEVAVTLYKSLYEIRLKRHYKKKSTNQIIICPIENDKLVPSIEVPLLTIDLSRLIKDGKIDNFHIDESTLWCFAKSGDLFRYSILT

SEQ ID NO: 14406 - protein, 164 aa, Candida albicans
  UNSURE (105): Identity of amino acid sequences at the above locations are unknown.
QAIDSEVYISLHLDNQLKIIIMLRSFTRSFTSTAVKRDFAKAQLFGRVGNVDFRESESGTKYVTYSVAVNRYDRESNGNIPTWYRVVAFDPVQIERLEKLLKVGXLVHVDAALRQRRHEDPETHKVTSDISLIQTGFDIASYRKKTEGEGEGEGEGESSSHQEE

SEQ ID NO: 14407 - protein, 162 aa, Candida albicans
KIFISQNRLVEYFDIYSHTLAMLNSTIRSSLFPRNYGVLNSIRNYRPGRPKKTVSKYVQVQLLQDIPHVGVKGEIKLVKPGFMKNYLYVANKACYVNADCPPKIPVVEPEMEIKKEKVKKTKPEEETVEEIVDIVEETEPTAMSLEELSTLFLFTTGLEGTA

SEQ ID NO: 14408 - protein, 106 aa, Candida albicans
FTLKICLMSLTTLVLTLFECIKVSPHHPKNCAQMGDRITCFVKHAKTWQQELTGTSFNHLSPEQYIYAQPVVFLNMAPLQIKGGSVFKFNNKPCLLIHNNGEPLGY

SEQ ID NO: 14409 - protein, 241 aa, Candida albicans
DVNDFLLKEASTSANLSIDCSGVTVFRKLSPRLILRSLKLQRIHLENLLLYHNFEPIEIKNLSLGFEEKAPSVIPIAKIFKLNKIESLELSFETKPTEVEMQQFMSQLVSLKHLSIMSQNFRFDRALNSLDPNSLESFHVIVMGRYDTFLAKIVAEILKNQSESIARLCWSNKRLNVRKRTYGLNDFERVYSVDTVARDQDIAEIRALLSDGYPRLKNVILNESYYRVDRKGSNIDVVLIN

SEQ ID NO: 14410 - protein, 536 aa, Candida albicans
  UNSURE (527): Identity of amino acid sequences at the above locations are unknown.
YLQRFNLDRRMLSKHKRQISMEDYKNLPLPPIPVQETENGKINEESSNKNANEGRKHSNSVSSTSVFSNKKNDMGEFKQNQNVNSARSSAGTSTSNHSQEKATQSAPPYVTRASDIFDKLFSDQFSYIYPILNDTMETNEVDQQNTSSRELATSTSRFTKTTLGDMIAPAKNPVGRKAPPSFVSNSSILEAYTNTPNSQDLFLNHRQSGTPDNTFSPSKSDNNTIDTLKEDKYFEPFDLYHPEMDTSSQQGSVEPYDNYYVGIEAKTSATTAPQKLQPPAATHSQFSQPLQRLPNDILSLPSDSTIVYKDEKFNDDNTIAATPNNGLENINGENMGNELLEEQTKEEKKEELQRKIEEKKQKKKKEKKKLEKQAEAAQLAAAQAAGFPFALLPSNMPPPHIPGMPETPHEKKKNSSTSPKKKKQNSPKKNTSPKNKTPKKVKRIPCDPNKPLPQPTEVVEKQENSNLNSSSATDLESPVRVNDKKLVILSPPENDSIPLLAPPPSNNSIMSSPRNGICSVHQGIPPXPVLQSRGTI

SEQ ID NO: 14411 - protein, 111 aa, Candida albicans
IALRSCVVVMGAHFFFWAKKKILIEKKKNFNKTHYSSTMASPQREGFSIPSSISHAALGQVQSKSLGVKYNCAQCAASFSLSKSDTIRCKECGHRVIYKARTKRMVQFEAR

SEQ ID NO: 14412 - protein, 203 aa, Candida albicans
SSPRQTIYVNNLNEKVSINKLKNELQQTFNVCGKILQISALKTLKLKGQAFITFEDIPSATKALELNKKDLFSKPMNVTYAKSDADVISTDDNIAQRKKLRSKKRKLDKSGTKNDKQIKKLRDEWKELPPNHILLIQNLEKFDDLKIYFEKFAGFDNVRLVKVKNLAFIEFESEDLAKSCLDQTTEDDLKQFGHDVILSFAKK

SEQ ID NO: 14413 - protein, 63 aa, Candida albicans
  UNSURE (40),(57): Identity of amino acid sequences at the above locations are unknown.
EQQPSQSNTSQPVYLSEYVGEFNHSAVKMPCSHIFGKGCXCEWLKLHTTCPLCKYSXLEETAS

SEQ ID NO: 14414 - protein, 294 aa, Candida albicans
RPLVNISSNAALASVVETNIGPNQLTRELVSPTVINTMINDIMLVKISDENGKTQTNKHGINNVVSIIIELIRKNNSDYDLNCGTYSSMLQNGDGGPIEVNSYVMYQWLKDFEQNPPGPRDPIYLGEMLDLFSSNLDRIAALIQTEPIPPPHVTSNILGFTRFKLSELIAELLHCSNMILLNSRKIKKIIQVRDQIRSQQEKRLQKALQEQILFSDSPNINQVTTGLDDVSLDDIHFASHSNDEVHDYGKLLDNLDQEEDSEDDEPSISPENPFVCSERDKSMSLHHGRWKDPH

SEQ ID NO: 14415 - protein, 248 aa, Candida albicans
TISATMSFWPFTNSMNSNNALLKFLDSAQDLSSITAEDLIGDPTLLEELLNELHNIKGNYNSRNGVASFLFLQPQTINEATVSNSDSASFTSSSNDINTGNTKDSRGRKLLEILIQPHILSGLIEYVEKSVDFFYEQSIKENEKVLDLLNENPPETDIQEEEELKKIRQKNGIKSDDDDDDDVEDDENEEEESEDSKFRRCVQAAADILSIDLWIILNRIIETESLIHKLWRIIDANNLYTPRGGTLG

SEQ ID NO: 14416 - protein, 303 aa, Candida albicans
  UNSURE (14): Identity of amino acid sequences at the above locations are unknown.
KIHWGIKLNGYVIXPNSYASSRHTKKGALAQIDPESIAKMKITRDDFLLALNDIRPAFGTDEEDLSQQAQHGIIQFNQTIRNIFEKGQSIIDVVRSSETEHLRSILLYGPPGVGKTSIATTLALNSDFPFIKMLSAETLVGMGELRKIQEIDNVFRDVHKSPLNVLVIDKIENIINYNPIGPRFSNDILQVLMVYLTKKPPKGRRLLIIGTTSQYQVFKHMNLIDSFNDAIAVPPIKHIEEVGKVLDKLGFMNKSEREEILSQLSRYDINIGIKSLIDVLMVSKYSRDTVDEVVNNIVEKMSG

SEQ ID NO: 14417 - protein, 421 aa, Candida albicans
YSVIDLIKDRMIDKDTVPLSSPIIKLSQTLFNRATVLIYYPCFFFLFSLSNKMVILTPFTFFSGSFTKQITEYLTLSNPTNTPLAFKVKTTAPKLYCVRPNASIVQPGDSLQISIILQGFSQPLPNDYKCKDKFLLVSVPAPNSIDPSKVGESWSQLEAQFKPQVVSKKLRVNYVVGPDKPDGGAGVNQQQQQQPSQQQPQFNQQPQQQSQQFQQSQPSQQSIPQLQQQQQQPSQSSIDVGTGAGIAAGAGALAGGVIGSSGYNQAQNVPNGDNSFNQTANRSFDTSSAHNGFNNQSFGGASQQQQQQQQPHQQLQQQHYQQSSYQATGGNGYGGNVGGGVGAGAGAGASQPSPALQRELEALARQVQTLSTKLDQNEKSAASRSPVSSLVGGSGDDVSGISLPVALVLVLIAFLIGWLVF

SEQ ID NO: 14418 - protein, 883 aa, Candida albicans
VDWDLAQVYDPFTVFWTNHPLFLNHGLFILLNTRPMEKLFQFSFLTNQNLKPKVSRLHTIFSSVKNRKVVISECYELIKYEVSQLSKLKHPQLLQVYEVLEETKSKFLFVTEPVIDNLVTVNPKDLDDLSIQKGLLQISKGLQFLHSYGSIIHLNLQPSSVYINNQGDWKLGGFKFLQNLNEISPQERENFYILNNMSVVPFANFNLNFTAPELIIDSHTKLDFANDIWSLGQLIYYLYNHHDLLINCFDANSISDYKQEFRKFEQKFYNHKPTELKYVLKDIPDKLYPLYPQILARYPHDRITLDQFMDSEFFNGSIIKAMWFIDEFSTKSIDEKLVFLKGLSEIDPQQSNNSPLISQFPPSFRSLKLLPLLIDLLTNELNVLTEAAIDPKNDELISDSLTIVLKISDTCSSLTFQDKVFDTLFKDNPRDKKAPQTFTKLINSSVRTSLTLINNFDTIQTKSKDKQFVQFFKGIIDLVLTISPKESNQIELQIQLQEKFLGFIPQFVDKLDFPYIKNTLVPLLSQVFKTTSILSTKLITIDTFEGLVDKKIIDKIIVNEQLFPIMKNLKSRDKRIVTKMLNFFSKLATSEHINLDLETIVESIIPQSYSLAFGCNDCNQLEFNKFIAIINSVQKQLVEKKLSTLTKTSSNGFSNGHKGDTNEAGSNNFEALLHTQTIHDVPDEIYAPKGKVMQPKRKSFTSTTTTTTSSTTTKSNSASSRNTTELRNSNTLRPRPRPTKKPTSGLAFGATNAQSNTTNNRLLNTLNSTFDKKQEEDDFDDFQLASGTSASELSSSNKNGTLNWQGEVNKMKTLPNTPTTAESFKVLKSQPQVETKNVNYPPGFNTNMVLSPKSSSSVNANVKSSISTTSNSNINNSDLLDLL

SEQ ID NO: 14419 - protein, 82 aa, Candida albicans
RDFLKPKSPRINFKSNFIDYHLPELTMLSRLGFSTGIRSIYSVLDQPSFVSEPWVIYPAKHKTNGKIVSVFIFDKSKFETQS

SEQ ID NO: 14420 - protein, 415 aa, Candida albicans
FPVAEMKTSSAHQQRYLSSIIGRLCNDSRCIIEYHLNYDCDSNMPNICEKLIDYLTTLSLQRVEVTPQQKYAYRENRRNGISVYDINKISNLTSKTMSSRPPEPEIYSQFPLEYALQMTSIGCAEAFLRSLYSWAQRGLTNANSKQFTIDNNNKSLSSLRNRSDSTNTSISASRNHSFVNGDSLTDSDNPQQFENQKQRKKAFLEGVRQFNQKAKKGLRYFIDNGFIAADDPKDIAKFLLTTDGLDKATIGEYLGEGDEKNIAIMHAFVDEMEFEETGFVDAMRRFLQSFRLPGEAQKIDRFMLKFAERYVLGNPEVFSNADAAYILSYSVIMLNTDLHSPQIKNRMTIDSFIMNNSGIDDGEDLPREFLEKIYDEIQNNEIKLQSEQHAALLAVIFLFLHPVIFTTGLQGPRFN

SEQ ID NO: 14421 - protein, 491 aa, Candida albicans
EEFKNLMLRMWGFYERYKAQRERFPRDHNLLFIRSFITSYFHEIAQYTVLNTGEDNKPIVPDIEKNEHLVKLWFPVLYGFHDIIMTGEELEVRSRALTYLFDVLMKYGQYFDFEFWKIICENLLFPIFHVLSNHWEIGLDDINDQLSVWLSTTLIQALKSMMTLFTHYFDALNSFLDGYLELIISCICQENDTIARIGRECLISLLIDNAQNFNNEHWGKVSDALSNLFELTTAKELFTSDPLRNRTVKDSEGSSSDIGGEDVEHTESKNSIIDDAEERLKKSKDKSSIVVKSVLQLLLIQSLSELFESDDFYENVPYDYLFKMAKLLFKSYNFAKKFNDDYDLRVRLWNAGVIERLPNLLKQESSSAAVFINITFRMYCDDDKASPANKQSLLDYLVPLCNTIVERYSELDETNQQRNISTWKPVIVEIYEGYVELDDDDFTKHCPALYHLTLKLFSKSMSSELRLAMKAFLTRVGEEFVSISDNNKERR

SEQ ID NO: 14422 - protein, 233 aa, Candida albicans
  UNSURE (220),(221): Identity of amino acid sequences at the above locations are unknown.
PPFKEYDEEDVSRTCIEGIKLSIRIACMFDLNYAKTSFISALVQFQNLHNYEEMKQKNIDSIYIMLELAVSEGDHLGRDAWIQILTYISQLERLQLIAQGVDQDSIPDVTIAKLVTRNSLETSRTSGSFFRSFYYSQTPSQTAASKFHNQQLSPEVASLLTKTELEVAIDKVFTNSANLSGESIVQFVRALSEVAQEEIDSSGQSTNPRTSSWTKSCGFXXICQTSGLISRGL

SEQ ID NO: 14423 - protein, 218 aa, Candida albicans
DSLQQQVSYLKEDEFLVNVLNGKSWMNPEDPTNQAFNSVAIAELNANDRRSLRKRELAGRFSVGEAADLSDGGGGSGVGGGSADNFSSVYNNGGYSSAGKRRRIYATRYSSNDELSSGTTSGMPLNNHYSTRQNGNATSGYESNLSDKDYDTLNVLIMENEDGGASLNLTAKNGGVSQHKVQTRGSNKHFVGPQGLKPEELNEDLTLLRNAIVKKDWS

SEQ ID NO: 14424 - protein, 123 aa, Candida albicans
LISVSCYFYKPYIHQFHLIIHHFSVMSDTLYSQREHQNNQKFEQLASTLHQFRTTVDHDIHNNVQQENSLLDSLNDNFNSLMVLVKQTSGELRTVMNRNASLTRIVGMILLGFFIIWMLYKLI

SEQ ID NO: 14425 - protein, 234 aa, Candida albicans
RLVAIPFLKELLGPDISQYQGGDTDSYLHDMSLLDHFECLLALTNIAATAKPELKHYMVTQLFDSYLDNFIISEDSKIRKATWELIANLSTEVPLLVKFFNWDAEAARKRFGLSMQLLQSGEVSLQATIAIFLLHSTDIDPLAAQIVSDDNKFNTFIDIITDIFSTQLSEKSLILPMEYVLLNLAIAAGNHSKTNFSTLASNTKLKDCCRDILRSGGEEEREVIMEVIKTCQFK

SEQ ID NO: 14426 - protein, 486 aa, Candida albicans
DAFEIMNDQAAIIITSILGINSESEKIMQKLYSSLRWIMKSRVNLPFYLQVYSSLVTHSKVTNPEHLNLFLTFVDGQNEDVHRGVLVLVIQNLQLQKTKTSNVISEYLEMIMDENELSYGSFVNFVSVQTMCFPIIPEICATIYQDDKTRNHLLQRINSIIKGEDIPLALPTLKLITASCIIENCRNYTVSNFLKFLTQGCKISNSKIQVVSSVTISKLLKLLEVEKKDSEISVIHLAEILINYFKHAKVLDEYVEYSVEGLMYLSLYWKVRELIRMDVNLIKLFLAKLKETSTDSTNINTSFQYGVLSIFSNLTKTRDTNDKESNSNTRNRLKTAASPKYGSNNEQENQEGITLFNRELLNDNKIVSTIASLKSYKSGSNNSLSEVIKIIYHLSSDQRKQVRIELVKQGALTIVLNYLINFSEMKRHGNLIRAFPKPQDDIVQQCRSYANKSLAKMWIVVDPQNAFSKYDSRVAIPFPKRMVGSR

SEQ ID NO: 14427 - protein, 885 aa, Candida albicans
TVLSVMDTFTSMTFVNNIFFLVPSQRSTEFKTHIAYTKKKNLKCSHNPTIVYKQEPFFCKTSVYMSSLKDKEYPSLKRKGLSIGSGSYKPVNTLGAAPRNELPNSNNVSEETFLSNITMKESYAPGNDPSFSLERAKERRHRLNGLSQSLKTNHSPVDVTEFQITDCFGSSVNVSAKDLRDEPAVSINLKSFHKVGGAYYRSMSRRQHLLNISKNGDYICIFESDYPKSNFLINIDTQLKSLSFAPEALVMELNEGHETIIASHYGRDNEVREYFQNNPTTKVDPSKTLSGTALHRLEKTVQLDNDNDNDLDATERSVSRTRPIRVRTRQASKAFWSLVAEENKEDPLDIVKITDDSPIESVFVEDDYIPYEKPAPFEPDLQYTFPDNKIFRITAKDFATLYNNDWINDAVMDFCIRYDIEEAINQGVVNREDVYAFNSFFYTKLTSGKTEDYYNKVKRWVHKIDLMSFSHIIMPINEKHHWYCCIIRGLPTLLEMIKLQKEKSNNADSPDSEEMFKRWGVEIFVFDSLGLRRDNVKKPLKAFLIDYCKDKYNYDVNTDQIRVTAAKVPRQNNYNDCGLHVIYNVKKWLLNIEACESFWRKWQRGAARTIFLADERNKMRRYWIETLLKLHSEQAPAIKRSSHANEEEDDDDIVEIVDTKTIVPPPTDQPNLSPPSNQKSNAVFDNSFLNQEFGNEHIPRFVVETLNKIFPKRSLHIPDEMKKLVSAFIKDSQSNVSSEQELKEVFIRNHEVIKKEIENQNRPKNKTIRITDAVSNLRIDPGTFFCPTHKEISSGLRKDQLLEEIDARPIIKAIRTPQESDQNSNEKDAEDHATSDSEHVQVEEVNLEEDRNSRQRFTRSRQRAKQNIMDLAIFDNIDRKRRKCE

SEQ ID NO: 14428 - protein, 69 aa, Candida albicans
YMDKKLSIQLNGSRKIIGILRGYDIFLNITLTDALEVDSKGEKMNIGATVCICFFRGVDEEESFIEDKY

SEQ ID NO: 14429 - protein, 199 aa, Candida albicans
  UNSURE (144),(145),(146): Identity of amino acid sequences at the above locations are unknown.
MASCNLLVIQTTSIIMFSSLLSRPVNSSYDPSYHFSPVPREIKNDSIPNGVVSTTKNATPLAPSKYDTTIPLKKRYPNLVHNFPKPELDENVILETKKIIDSILNPSDEPTNDINYIKYENPNPNSNQEQQQQQQLLLLLKIIXXXHQPEDPMLPPKFKLRKNRHERIIEDVTFVKDLKTKKLTKEARHLFSPGAPDPR

SEQ ID NO: 14430 - protein, 325 aa, Candida albicans
RFITKRPSKMIFIPIIILIYLVSIAASDKSPKIKKNPRNVVAVADFPFGGDTQVKGNVVFSAKEGKHVNVHIDMTGLPKDEGPFFYHIHERSVPGNGNCEAVGLHFNPYNASPVCDEQKNDAYCQVGDLLGKHGCINTTCFELKYSDPYLSLNRKSKSYIIGKSVVFHYPNLTKIACADIEEANELRLQSLIDEYTQTDDAIQLKELNTPLETDYKFDEVEALSSEIYHSDTDSDPPQQELILTEKLYNKTDNVYSPEETRPSDQNKKSHRHSLLPLAKWKKNSPKNYSNISIHGISSDCLNDGMMVTGSVFGSLVLGIAAGIFV

SEQ ID NO: 14431 - protein, 172 aa, Candida albicans
  UNSURE (165): Identity of amino acid sequences at the above locations are unknown.
QFNDDSPEARKITRRWRIGEAADLVGVSSQAIRDAEKAGRLPHPDMEIRGRVEQRVGYTIEQINHMRDVFGTRLRRAEDVFPPVIGVAAHKGGVYKTSVSVHLAQDLALKGLRVLLVEGNDPQGTASMYHGWVPDLHIHAEDTLLPFYLGEKDDVTYAIKFSPGXARIRSIG

SEQ ID NO: 14432 - protein, 160 aa, Candida albicans
LLVHDYECHNYGQRALTWVSGTINVVCAADVLIVPTPAELLDNTSALQFFDMLRDLLQNVDLKGFEPDVRILLTKYSNSNGSQSPWMEEQIRDAWGSMVLKNVVRETDEVGKGQIRMRTVFEQAIDQRSSTGAWRNALSIWEPVCNEIFDRLIKPRWEIR

SEQ ID NO: 14433 - protein, 102 aa, Candida albicans
  UNSURE (93),(95),(101): Identity of amino acid sequences at the above locations are unknown.
IMKRAPVIPKHTLNTQPVEDTSLSTPAAPMVDSLIARVGVMARGNAITLPVCGRDVKFTLEVLRGDSVEKTSRVWSGNERDQELLTEDARADXVXLRDRRXS

SEQ ID NO: 14434 - protein, 368 aa, Candida albicans
LQTTQISMKLLALLTLLPLVISTNLEEKWGGLWPFQGIATFAHLEHFQCLIESEKQFDIGIIGVPFDTAVSYRPGARFGPRAIRDASQRQNNLRGFNPKALFDPYQSWARIIDCGDIPVTPMDNSAAYKQMSEAFKDLLNRKSLNNTEIPPRYIALGGDHSVLLPHIRALHKIYGPVNIIHFDAHLDTWKPNKYPTSEKNDINHGSMLWKAYEEGLTTKHNIHVGVRTRLSGLDDLQDDDEQNFVRIEADDIWLKGPQWVVDKILATIPKDTATYISVDVDVLDPGFTSGTGTQEPGGFLPRELIYLLRSIDGLTVVGADVVEVSPAYDIAEITATNGAQIAYEVLTSMVKRGNIDKSLVKLVVHVFD

SEQ ID NO: 14435 - protein, 422 aa, Candida albicans
EYSDMKLYIFVLVACVSSQTIFRSPSLLDQLYGELHGRTNTAPNLQVQAEDPNQMVTQKVLAMRSKLTLPDKDDTSDIAIDQNMFGGILTYAHFNHFNCFISDDFDKHSTTDQQTTKNIDIAIVGAPFDTGTSYRPGARFGPESIRSNSRRLGSAWKSTKKRFNYPVNPYDETTHNYSIIDCGDVAMTPFDNRIALNQLYRGHRSISKHPGNVNQHPKIITLGGDHTITLMAIKNAHEQLRTKIRVFHFDSHIDTWDPKKLGGGITDYMSLNHGTFLHYATELGYIETKGNYHVGIRAPYIDANYDKQHDADCGFHIIQANDIDKIGVQGIIDELAKDPNIPTYISVDIDVLDPAYAPGTGTMEAGGFTTRELLSILDGLKNKVNVIGGDVVEVSPPYDTNSEITNLATTSVVDSLLKLMIV

SEQ ID NO: 14436 - protein, 354 aa, Candida albicans
ELGNYHEGPNLQFKINNYSLCKDVRKILKHPKLISKDNSIFQSPPLLVLNGFGKILEMSQHEKLMVTIFQNMFPPIQPQQTKVSSIKRVLLISKNKVTNEIELRHYAINTKLVDENRNVKKLIQSHHNLKKKLPKLTNNQDVSDLLLNPYSIGGLTSDSEFEDDAVVEIQQETFVKKEPTKAITTTITATTEKEVESQSQPQPQPQPQQGKSKRAIKLTELGPRLNMSLIKIEEGLIGSSKTIYHSSIQKTEDEIKSLEKKHLLKQQLKLERRSKQQAAVKAKLDKKEAKKARRKAREEGREKDNDDNNNEEEEEEEDSADEEQVDDDDSDSDAVDINPEDYENDSDLYSDVDV

SEQ ID NO: 14437 - protein, 478 aa, Candida albicans
ERYTAIMASPISNDSFLQWDAAQVSTYINSILPHEQRRIGNVFLDNNVDGSLLPFITTEHLKEIGIISLKTRLVIKKGISDLIAAHYSKYPPKSYNDPDYKLNHANISNNYTTVQSLNLYTVLMQDMMKKLNYELHKQKSTFVASSPISPTHDEMKKLNDNFIKLKTDLIPIIRLLKDSKPLPTPTLDPGPVASMDSPSYFSSHHHLEHDSFEKGLSRSGSGNAMTSNNRTPTTIPSPASNRFSSGSLLSMGTGKIVSQSVPKYPENKANNDFTLQKVGLPRNNSNKSLESHDRQQNASGIRPRLVQNPSSNSMHTVTSPGGIPPQSASAVATAAINGHGSGYIPQVSTPPNQLGHHHNPGTEPLKQLRASTDDSCLKILQQAMKRHHIPREDWSRYVLVICYGDKERILKLAEKPVVIFKELLELGKHPAIMLRQLADSSTDDSGPESAMYNDARIGTEIPGGTLYKRIHLNNNTSV

SEQ ID NO: 14438 - protein, 459 aa, Candida albicans
GFGKILNDPNLYTKLKNNPKTSEFMNDPQFVAKLERLKTNPQLGNPDMFSDPRLLTAFAALMGIDMDLPNMGFTAPNESQSNASEPKLESKSEPESKPEPKAEQKEEESTSAKDEDTPMTDAQNDTNDNDAKTQADNAKAEGNALYKKRQFDEAIAAYNKAWELHKDITYLNNRAAAEYEKGDYDAAIATCEKAIDEGRDMRADYKLIAKSFARLGNIYLKKDELPEAVKNFEKSLTEHRTPDVLNKLRSTQREIKTRELNAYIDPEKAEEARLQGKEYFTKGDWPNAVKAYTEMIKRAPEDARGYSNRAAALAKLLSFPDAIQDCNKAIEKDPNFIRAYIRKANAQLAMKEYSHVMDTLTEARTKDVELGGKSIHEIDELMNKATYQRFQAIEGETPEQTMERVSKDPEIVQILQDPVMQGILAQARENPAALQDHMKNPEVYKKINMLIAAGVIRTR

SEQ ID NO: 14439 - protein, 550 aa, Candida albicans
VCPTSVNTMRKELKCIIWAHVGLIVYLLYLSFDLLSLLNDDIFSDALLDVEINPNPSTSLNKPSIIPKIIHQTYKTTDIPEIWKPGQQACINLHQDDYQYFLWTDELAREFINKEFNWFIDTWDNYKLSIQRADPILYLALFNYRGIYMDLDDGCKRKLDPLLTVPAFVRKTAPTGISNDVMGSVPNHPFFLKVIQDLEKYQRNWLVPYITIMMSTGPLFLSIMWKQYKRWGVPEAGKVRILLPQNYKGTTSSYFAIVRGSSWHMGDANFIKSLGDHLVLAVIGGFLLGLLILFVEYLFYSWVISSQCKRLTSKLLSFTWAILMGVLRFFHLDKLLSKCDFWSRSTKYEEMLLPKDSNDLKNINNNNTSNNNTNGGDSNNNDKSDYNNNDNNNNNINNHTGKTRLSSIFNILGGKTKVKRRNRKDSNLPIEIDVLSKLLDDTVIIDASTTETPTNPVSPTPSPISPTINSRTSNNELLIPTNNNNNNNNNDNTNNVNNINNRTTCDDQSTLLPYSTRLSSSSSSSSSSPSSSTSSLPSHETIMKLNNDIV

SEQ ID NO: 14440 - protein, 195 aa, Candida albicans
NNNLLELKNKVGVNLIYQLQFISWVFSGKAGERKIQHDLNFLQEKYVNDHVISIPVSPTRNPALNKLLAETGSLPFEESGAGASSANSGSIGTKRKLESSNGATATAATSADNKSKKSKGAMKGNIDLEKLSQGLTKLSEDDLIVVVQMVTDNRTNEMNIKNDVDNGEFTMDLYTLPDSLLKSLWDYVKKHSGEA

SEQ ID NO: 14441 - protein, 278 aa, Candida albicans
LKYFMWILGKLPTIHSQLKGLSMTHGCLPYIYNVTLDSVDNILESPELVWQLYERYLQFVQSSRLDITRDDVITTFLDHLLRTGDGSSFPVTPAIENYRIAKKITKFYYTVPDIKISSLNIELLIQTALLIHKDYSFALEILKLSRQRGNPFTFNQIYPFIKYHYDNKDYSEARVWYNELVKLGAGSTGIMLSELFGIAKELGWPVNSCTYKFNLTKRKRHNKEALDEIQKDSAMFIEKSNIDTTGNNLKVTTNNDNNDFENELASILQSLNQKLASS

SEQ ID NO: 14442 - protein, 196 aa, Candida albicans
GRKKKIFQKKKIQKLSHLPSNINSNFIGTMLIFEDVISGDELLSDAYDVKLVDGAVYEADCAMVTVGNGDIDIGANPSAEDGEEALEDGAETVNNVVYSFRLQPTMFDKKSFTTYIKGYMKRIKAYLAENDPDSVEAFEKGATAYVKKVLGSFKDWEFYTGESMDPDAMVVLLNYREDGTTPYVAIWKHGVKENKI

SEQ ID NO: 14443 - protein, 357 aa, Candida albicans
  UNSURE (2),(17),(331),(341): Identity of amino acid sequences at the above locations are unknown.
RXYPPYVDELYFKIANXRVFTRCLFFLKMVKALHMTSLPLADLSLFIQHFVEKLDFKDKATKVAKDAVKLAHRMAADWIHEGRRPAGIAGACVLLAARMNNFRRSHAEIVAVSHVGEETLQRRLNEFKKTKAGTLSVKSFREVENLESSNPPSFEKNRAMELKISKKLQQQQTDNFEDLSKMTEEEKQSVFGKLSKEEAQKQLLMNTILSDITITTENLNDQMDRILKMKKSSLENSLYKTPYELALANGSEQDPSKIWNINKPKNLVANLPKTDDILQNVSSEVELNSDDDDEIVLESKLTEEEVAIKERIWTGLNHDYLVEQEKKKLKXRADELTETHXNRPTVILVKETVLITC

SEQ ID NO: 14444 - protein, 145 aa, Candida albicans
LEKTYSYYVNMSKPRKQQKCKTCGHTQFDVNRYTAAGDVSCLRCGTVLEENPIVSEVQFGESSSGAAMVQGAMVGADQARATFAGGRQNAMESREQTLSNGKRKIKRIAAALKIPDYIAEAAGEWFRLALTLNFVFTTGLEGSAI

SEQ ID NO: 14445 - protein, 282 aa, Candida albicans
QPFRRMSSSKPVTPRNDRRQNSGRRHLHRSSGIQLPSMSPKVHHYPIDAENLPMDSPEIVEKFASLAESMETLDLHMHDLCHIHDHISNQFNESFASFLYGLSMTMWCVDFPGCPSREQWEALISKRERKERIEVLKKRLADAQKLNDRLKLRLSDEAKQKPQQLTSQQRTTHGPTRQIKQQPRSVNFNTHLSDSISTNSYTSGDFNTNRRVSRIPQPSRSNLPSSRFQAPSKSGPNLNQPPRYMRGLFDGNNTLNTSNYSRIKKPIHNRSVNNLQNRPPFR

SEQ ID NO: 14446 - protein, 270 aa, Candida albicans
LVELTADRHIPVGVRLSYQHHYQQVQQRQNQQPYMQSAPTYQQPHVQTPKSTRSNKQEKQRLPKGQEQVPKATRTMFEAFTGLNIAVEKLRQRTLDNGREPERLRTEYVNVLSLPERAAEKSTSRSKQSSNQKPVVKQQSSFPPPIKHQQTQEQQGNILPPVSQLLAIQSSTVTSRGSNASGAVMGSGNTQRVASRSFTNTFVAEAVVNNANNRGGPVPPTGPETNTRGGRASTRSSGRPRGNRSTQRAEGNVTGRVARSTDGSQSSNIG

SEQ ID NO: 14447 - protein, 255 aa, Candida albicans
IERFSHHITLSMKAAVVPESVTETKLAEIKEIPKPTIDDDQILIKAEAGAINPTDWKHIIVARSSKPGDIIGCDVSGIVEEVGSKVTNFKKGDAVSAYITGNISPINGAFSEYVAAYPQATIKYTNGLIHSTAVAKASTIIKTFEGAASMTLGLATVAMSFSHHLNISKHQQKQGSDAILIWGGATATGILAIQVAKLVYNLTVITTASPKNHEYLKQLGADYVLDYNDSRIVENIRKIGNGNIKFGLETVSNAT

SEQ ID NO: 14448 - protein, 694 aa, Candida albicans
LVRGSAVRGEYPQARQVEFNLGVGKTKNGSAIHSDSEEEEEDEDPVSNTKKGEADEKDPFDTTDSKLENENSTPSSITGKEIIPHPTGFRGSSEELAIRRKPSIIPIYHDNISQESVIRNANTPTTYNREKFHLRRGSLDESTFIRPKKYYINDVQGTLRELLANEDTDNNCQITIEDTGPKVLRLGTANSLGINQSSIRGTYRLSNLLQELTIASRFGRHQIVLDEARLSENPVDRMKRLISTSFWNNLTRIITKENIVDMAKDTKIKESWIDDQGKLHENQESHRIYVPYNRKDQYEFFQLIKKQRSDIQLDVQYLPQKIDADYIKSINKKPGLLSIATRPDPQAPDSGSLISWPYVVPGGRFNELYGWDSYMETLGLLTDVKIDPSGNPRNLRHLELARGMAENFIYEIHHYGKILNANRSYYLGRSQPPFLTDMALRIFNKTIEVTPELMDEAIDFLKRATLAAIKEYETIWCAHPRLDDKTGLSCYHPEGKGIPPETEPTHFNALLKPYLAKYNDIDQLDFIEKYNSGEIKEPELDEYFLHDRAVRESGHDTSYRLEGKCAYLATVDLNSLLYKYENDIAFILQSFFNDNLQDPYDDNNSYKIHSSKIWLERSHQRKLNVDKYLWNEQDGIYYDYNVKLQQQTNYESATTFWPLYAKLASSNQAAKLIDQSLHKFEEHGGLVAGTLKSR

SEQ ID NO: 14449 - protein, 142 aa, Candida albicans
  UNSURE (131): Identity of amino acid sequences at the above locations are unknown.
TLLPHSLSHLSYSYISLDILVCYSSPFIMFTKNHRRMSFTSSDDDPFDVAEKYYGEERKKKLNRVRTFSAFESTKYGAGPISPLRPTYEPPPVIKETSEPLSSSSSTSSPPTLTPQTSQVQFNLGVGNSPXYFGRTSRPIIL

SEQ ID NO: 14450 - protein, 91 aa, Candida albicans
EKSIYDDLLNKIKELNLDDETMEKIEQFSVKPQRKAPVTPLEKQCGKLTKKGEKCKIAICYKKTCWAHLTKEEYGVLNMNKKDCGECMHIA

SEQ ID NO: 14451 - protein, 195 aa, Candida albicans
CFCKMKDSQSDIIELCNKLNEATKLKRNGKSIKLTNFVSNTQIKLDSWKFLEWDYGKRSVQLPIQARGLFTLNNDTIAVRGYDKFFNVEEKPFTKETNLKTSTHGPYEVTLKENGCIIFISGLSTGDIVVCSKHSTGDRIDDNESDKTTTATATATAPTRNHAKQGESELLQQFDGDQQKVKQLGLHHRAGRSAL

SEQ ID NO: 14452 - protein, 126 aa, Candida albicans
  UNSURE (83),(89),(90),(100),(106),(109),(125): Identity of amino acid sequences at the above locations are unknown.
VMKVVKICGIKTVEAASVAIDNGANLLGCILVPNRARTIDLEVAKQIARMVKRDRNPPPKFAGWYSTQHFEQVAQWIIENGAXLVGVFXXQPKEKVFSYXKEVGLXFIXLHGTGKIAKVFGVQNXG

SEQ ID NO: 14453 - protein, 156 aa, Candida albicans
SFQPPWSKTGRFYLGCLRTSQREQVFRIAREVGLYFIQLHGLEHKLQFLGTEFGLIPRYVVPDELDLLEEHSLLLTQCVSLPLLDSELGGEGKLLDWTFIDKLPTKAILAGGLTPDNLPTFDNILGYDVSGGVETNGVKDSLKIIKFIQKGHAQSS

SEQ ID NO: 14454 - protein, 360 aa, Candida albicans
EICPIINSKAWALVVTWFEHILLLDSDKMIVSNPDEIFESKLYHQYGMINWPDYWKRTISPLLYDVAEIEVNENKRVRYNRFPLYNAPYVRSNIYTDQEREEVPFHDLQGSIAELSTESGQLIINKHTHGKTILLALYYNFYGPNLFYKLFSLGEQGEGDKDTFVAAAVVTRQDYYQVKSFIKTFGYADSDDKFQGVSMGQRNPLIDRKHYEDHVLALLEKDSFKSLSIADQIEQMKKFENEDFDQHNSIPLFTVHCNYPKLDPKLYMSRDDLYDKKEKKLKYRLYGNLKYTKEVVKDGETGTEASTDKVQIDFELQQWQHMQDILCLKKIYFTHFIDNDMNELCQFIENQVAWLSKSQN

SEQ ID NO: 14455 - protein, 413 aa, Candida albicans
PNYAISVRWAVRTESRMKYIDDIKNHLKQEITEQYSNEIFKQYAFSFEIYSKKVDEYALQLENSLKPASCLAILQQAEKDTDLIPDLENYLTKANDKYFKRQEYWRYLLKDILLNNKPKCEPLTKEEKGEKLNPTYQWDARIISEQYLLGSKLTIPGEKFRALRSAHDQVVKQLKSLPDPPSQFISGHGIVVNGGGNMIGSALTAIANMRERGSQLPVELILDTKQEYDKQICEELLPKKLNGKCVIVEEQVGKEVFDIINEKFSRKIMGLLVSSFDHIIAMDADNLAIKNVDNLLFTEPYLSTKMILWPDLWVKLTSPLYYKIARIEPGEIVDRFGIPNDASFAEYITKDKQLEVHYHDLDNLPSTISVETGQMVFSKREHLKNLLLPLYYNINGKKFYIELLYQGAYCEGE

SEQ ID NO: 14456 - protein, 232 aa, Candida albicans
YRDIPTMYINFLSIPRNRFKAIGVLSVTCILIYVILHSSIITTDFDVSDYGDKFIPSIIFDDNNDNGENLKDPQPELDNDKGNGETDTTTSNSMTTAHTFWKGIFDTFDKYKMDLGQDPENAVSYVDKLKQKQGPLNKEVLLSKAIVSSELMKHLKEKHSGVVEDLPSVMPGSVYNKGSKGVVIIGGGKFSWLAYLALVQLRNVGSKLPVEILRPFRASSAGCNCGKYFVLS

SEQ ID NO: 14457 - protein, 596 aa, Candida albicans
FVKQKIKIWIGVIIVIATYHFIVSSNVRSKDLTDLVDLGSLDKSTTENERPKNNIVTNNRLDNPPNEDIPHAEPDSPPQVPPKSGNKADFSIFFEGLEKFAIKQPGIKDKYTSEKAKEKFSTDDNFLFGKEYLENVLDIPQATFKELKDSHKRYVDEHIPKMLQRVKTFGSLAPSDKEWESYRGSSGYIIVGGGRFTWLSFLVIKQLRATGAKLPVEMFIATESDYEKEFCEKVLPKYNARCNVFDYKLADDLKKRFDIGGYQYKMLALLSSKFENVLYLDSDNFPTRNVDYLFESDLYKENNLLLWPDAWARTTNPKYYEIAGVPVKENKLRYSKYDEKQAGGKDKLKPLSEYTFKDSWYHDFEGTLPDPTSETGMFMINKSSHLKTLLLCLYYNVFGPQYYYPLLTQGSAGEGDKETFIAAAHVMKEPWYQCARQFKWTGYVSKVDNKFTSKALAHYDPVQAQDTTRQDVDIIFMHLSYPKFYPNWLADNHDLVYADTDEHIRMYSSINKNVGYDFDLRVMQFFTEGLCPNYYDSKTGKPIENIPHIDYTNDYMGNHLMYVKDEEQNNIDRCNKVFIPHLKWLKETAEIPTVLF

SEQ ID NO: 14458 - protein, 591 aa, Candida albicans
VTMGSIFKDGRRILVRPKSLIICLCLISIIFTQLIRYQYQLIADEVQPTINEDHSSSQSLKNTKLNSTRCSSPISPPKSLNKLTSQEFWEHIFNISEINKFDDGLKPLIKYTPKEQQLTTKIKTRDWLLSKANIFHKDIIRQYHESVLRNLPSKLPKSVYTPNTYGIVTIGGNFYSWMAYIQLLQLRKLGSNLPVEILIPSIEDYYKEAHFCDHVLPQYNAKCILVPEKLGFNVAKHWKFSSYQFKALALCLSSFQHVLILDSDNVVLLKPEKVFDSPVYRDNGMVLWPDYWERTISPEWYDIIGKPVVGNKQVRTGRFPVNIHNMLTSELEINETRFHDLEGALPDLSTESGQVMFNKKTHGKVMLMTLYYNIFGPEIYYKLFSLGALGEGDKDTFAAAALACGEKYYQVASSIRTLGYFDTTPGGGFHGMAMAQKNPQLDYQLFQKTNQNFKDLHLDWDNEAKDQFSANNKIPIFTMHCNIKKINPAAYMKDEKIANMDEKRMNVRFYSNLKFKLNDDDIYSPDNEKEKNKSEKTDNDPNEIDFELSRWQIVYEILCDQKITFQFLKDDNMDEVCQFVKNTIAWLGKKT

SEQ ID NO: 14459 - protein, 168 aa, Candida albicans
  UNSURE (2): Identity of amino acid sequences at the above locations are unknown.
MXEQKRIQQGYEFFDNIFKIFYQAKPSVSQLNTYPSKKRIYHARFDSLADDDTIFSEKYLSQFLQLSNEELAAMKKSHKYVVENLPEDAPDGLYKKNGIVYVAGGSFNWLTLLSIKSLRAVGCHLPIEVFIPKIEEYESDLCNRILPELDARCIYMKNQLMNPNKDNL

SEQ ID NO: 14460 - protein, 655 aa, Candida albicans
  UNSURE (652): Identity of amino acid sequences at the above locations are unknown.
SSSMSSSSQRQANSYSRRAPFHDDTNNQSSFRNQPNRNEPPLNRGRGYNEHQGRRSDAMPNRGDPRRPDNRNDGYNDRRDDGRGDKNKRFQHPGRSEEQPKYFGRGNRESSQHQSPQSLRHSGREGQGQGQGPDRNRNDQRYDPRRNDGRTGNNPPHYKPNRSNDVPIANRGTKRSNQEHDAGPFKQPRLSDEYTQRSQQQQFSSRKPYNNKPDQKNGSNRKSDSKFSQPKFQKSRSSFQNRGRGNDWDRSGEAYTPSSKRSDNPNFSGQRKFEPQSSLARARTISVAKPKLINEILKEIDRLQNRVQDLQSVQPIEEVKVIDSRWNKVPEGFENLSAARAKLSGLFPLPGYPRPIDFTKLEGTIKNRLNNSDDILNETSRIDPVDSKAARTLIVKNDLSQISHLKLVEFFNDYLKAIDFEKGSSNNIKKQKKAQDNKFMIIEFNNAECATIIYSLNETELLFNAYKEEKVPARQMEKFKLLIARPSEYVVQDLEPVKSDEIEEVVRDNSRKISLTIVPNATPSKVIESLEKNVGALQGIQFLRQKGTKNLLGLVFVEFKDSSNDVIGKLRRLPFITRAFHSCILPNKTPIQKGPIDFHSLKNLVENKNVAPHPLLRVIRLLNAVTESELADDATYSFIVFTSRWQMTVAGXILR

SEQ ID NO: 14461 - protein, 284 aa, Candida albicans
FIFFFFEFLQKRYQHIHNPSQPPRLSIIMSAIQKTLKRMVRKWTTKDGLLGDYDYKYLFTPDIPFITKELKTQPFFGVDSDMPILLGAILGFQHALAMLAGIVTVPIMVASTANLSVEIEQYLVSTSLIVSGVLSLIQITRFHIPKTPYYIGTGLLSVVGTSFATITIVTKAFPMMYADGTCPMASDGVTKLPCPDGYGKILASACCCALLEILLSFMKPSMLQKIFPPLVTGPVVMLIGVHLVESGFTDWVGGAGCQNSDTCTYGTFLHLVMNLGAQGKNIRV

SEQ ID NO: 14462 - protein, 423 aa, Candida albicans
KPRKVNGKHDNQNSNSIDSGSKRSFNNMITNNNNSDNNTSSVDPSINVEELPDSKKQLTEDAIDPTQQQEQQPQLMEIDVETNQIINENGFENHGVASPEVIDMTGDDDYDVDNHNNNNHNHHNNITIEDDDDNVVDDGDDEEDDDDDDDDDDDDDDEIQIINSEPNSNVVAPKKFTRNFPLANDFNALAAKLMKPIEDYPTKEETYYVWEIKDWAQLLKEEKVRSPKFKCGGFEWNILLFPRGNSQNKSLSIYMEPHPPVDENDKPLDENWYVCAQFGLDIWNPAHPDAHLPNQSHHRFTKNETDWGFSSLIELRQLEQVNNPRNQSSMYAILENNKLNITGFVRVIDDSSTGVLWHSFLDYDSKANTGYVGLNNQGATCYLNSLLQSYFTTKLFRKLVYEIPTDLKSAGVPLSLQRIFYLL

SEQ ID NO: 14463 - protein, 621 aa, Candida albicans
  UNSURE (2): Identity of amino acid sequences at the above locations are unknown.
GXIVHLLNWLKQWAKPIKCTNEKLFRLVAVCHRNNHTNRLDAPIGEEFQKSTISNVYSKIFNRKYDEMVFYVEELNKDIKNVVQLVKNKDNGYIERKDFTFAQVFSKIDAVGTDIHPNIEFKNTEEYSNYVTIVIKYFDPVSQEIRGLSHITVAKEDKIDSIIDPIRELLGFNKNITLELYEELSQSKVEKIDSKLTFEKHELNTGDIITVQIVNPGEINKNGKFKDLKDYYKFLLTRLHVNVRPFKAEIDEEDSDFIAHEDDEDEDEENKGGETNNGTGYGGKGNGKDTEKDNKATNDEIQLAKNLSKSFDFWISTNYSYQDLARDIAVKLNCDPLYLKIFILTAQGQRFPLKTSHHLSQLFPKTVSVNQIVEIEYEILNIPLKDYENLKAIKIHWLTTLLQYQVFEVLVPKRGTIGDVITKVLHKVNVSESDLPHLFVWSGRNHKFHEMLKFDRALSTISDDVDLFCGIFPAEVEVLCDHDMYKRFTDKEIDETKLEESIHEEYLESIRWSKKLNLLPAFHFHKNNNYHHGIPFIFIVFPAETLNDTKERLRKKLRLGKQAFDKVRLALADNNNRIKYLEDDSLVLFDEVAIKLYSLAIDNVDRNPKRQALFEKGISIK

SEQ ID NO: 14464 - protein, 155 aa, Candida albicans
RQGSISNGHYYAMIKPNANDDTWLRFDDDKVWKVNKTQVFQENFGATDLTQEQSQQMTRAEQQEHMVRRVTSAYMLVYYRESELDKILPSDDNIVNSAIPEHIPKQIQFEIEEREKLEKARQEALYYTTAKLITSSTFNANLGFDLALDPTNNKF

SEQ ID NO: 14465 - protein, 251 aa, Candida albicans
PDSKKQLTEDAVDLTPQQEQQPQLMEIDVETNQIINENGFENHGVASPEVIDMTGDDDYDVDNHNNNNHNHHNNITIEDDDDNVVDDGDDEEDDDDDDDDDDDDEIQIINSEPNSNVVAPKKFTRNFPLANDFNALAAKLMKPIEDYPTKEETYYVWEIKDWAQLLKEEKVRSPKFKCGGFEWNILLFPRGNSQNNNLSIYMEPHPPVDENDKPLDENWYVCAQFGLDIWNPAHPDGALPYSPRGLYPTDT

SEQ ID NO: 14466 - protein, 200 aa, Candida albicans
LRTFQAVVNTDPVGTLELTKSFGWDSSDAFTQHDVQELNRILMDKLETAMKGSKIEGALNDIFVGKMKSYIKCVNVPYESSRVEHFWDIQLNVKGFQTLKQSFQNYIEIEMLEGENKYQAGEEHGYQDAKKGVVFESFPPVLHLQLKRFEYDFMVDDLVKIDDFYEFPDKIDLKPYLDEDLPEDVKNQNWNYKLHGVLVH

SEQ ID NO: 14467 - protein, 199 aa, Candida albicans
IKRKSNQIITATTLLMIAIKMIPHPLLPLPLPPPPPTQSSIVINFSVEKSINDFFSNEVIKKLENDSKSGYFCEKCNRFTHANKISSIEIAPETLTIHFKRFKFNNNSSSKVKQLINYSKYLDLSKYMVQGTAKYRLTSVIVHEGRSISSGHYVAHCLQPDGYTWCTYDDEYINKIEERVALNDPSAYVLVYTKLTPKV

SEQ ID NO: 14468 - protein, 235 aa, Candida albicans
YEDDRGSNNSGRIYKNWRELANKKPPVGLLNHGVTCYMNSAIQSIIHIPAMQHYLNDVNDNKYSQLKPRSVTHVLAELSKRMWLASNTNNNKKGKSNGGIKYINPKKIIQRLDEINCMMSEWQQEDSHEYYMSLISRLQEDSTPKGKKLNESIIYDIFGGLLNQRITCHKCHNVSITKQEFYDLSLGLNKKKIKSNNNGDNITNDSNKDDTTSTTATSTSTSTSDPIFNSNKFFC

SEQ ID NO: 14469 - protein, 75 aa, Candida albicans
YVKGPAYKALSHFGKLNAPLVRSYIPNLVFWGAAAGGAVATFTEGVPLFQKTFYEKIPFFGQHWIYNPDPEDVPV

SEQ ID NO: 14470 - protein, 266 aa, Candida albicans
SMSRNKEKAQSSLNRFYQSQSSAPINYHYHQRPKNIHSITQLSQAEGWRRSIIGEISKQLTEINDFEISDIKVRELNDQLNELFNEKRRWEYHIRDKLHGNDYIRHNGNTKNDLINTGIRVNNLDKGKYYRYFGRAKDLPEVKLMIEENKKNRQNHKRDDIDDLDQSKRRRKVDQYKSTDNLIDMNYYGFYDEEEDEYLDDSEAQLGDPLVVYEEKRTKELNDAEIQQQDTENLEQIRMSFNDIPTNEVVTKWFFTTRLEATELAS

SEQ ID NO: 14471 - protein, 313 aa, Candida albicans
TRIPFFREKGVIELNTTGMTWLQLYCPRFDTLEKLAHLPRLSTSLKLNFTAEYNAYMTNLISNPLSWITNEKHIDTIQKLACLRISENCGRTAQPEIIRKIVLPNLDQWMKTKTGHLKLREPSLTNDNLGLKTWGSALILSQRLLVLDHTKYLYKSVLELGSGTGLVGMVSSLLGYPTVLTDLPEIVPNLQLNVDLNKLNNVTVLELDWTNPLSFLQTFPDAKYQTIVVSDPVYSSKHPYLVVDMINLFFDKSDPMTRVLVQIPLRPKFENERQVLWDLMEANLYLETEHEIEEGFDDFGEMKFCFKVFKKQN

SEQ ID NO: 14472 - protein, 593 aa, Candida albicans
DQTTNNISEYKHLSPETNYTVGRDENTDIKFWSPKVSRELIELITGPNIDNTQPPSSSSSSSSMGSDKTLLIIRICSRAKTIINGKTYKLLSKDSKPEEIDFTNEFKLKIETIPQIDKQTGQIITQDTPLFIEWIPFKLYISANEKYDQNHYKTIIRDHGIDIQIVDDIMDATHYYYDSDNGNNHIKLEEQKNEFKLAIIKGIPILNSQWLQKVLGHDNEDGYNSVKDWLLDIDYKKYLPKNDDDYLPKSDRLKPLNNVKLVSLEKMHWLETIIIDFKVLIQQQEDVLKSKIGDNQFILIVPTTMATTLNRHNFQTLTEDQLWQSIKKGSILDLPKNSFNQLKRTSTTMLASDDKSVTTQTPEVAAPSGRKRRKYEKVDRLHFFSLGTTTPTTTTTPVPSTRDPSPKVSILDTDNKSTSPELNSQKINTSGDNDSITQEITQLSDPIKKISTIKQNQKVLNSHTQSRKINQEDALNSLGDSNLSSSTDQLARKSKPDSNSQKSSSNFPSIKNEEEEREDEEEFPAIGSKRKNKDETTNDDQKPFKIPKFTPKVSLVDAVLKVPELNKSSNLDLESELKLMKIYKIWQLWKLLI

SEQ ID NO: 14473 - protein, 580 aa, Candida albicans
AASRLMTNPAENDHEPRTKKSRLNGRNNVSQLEANSNYDLLAQQRQHSQPPSLLPSPSPNSDHSHQSQQFMDHRRRKRRQLPQEQQQEQDQQEQPQQAPPPPSQQQQQTRLQDDQNSENAHRNNQEHYIQHGNSNVRNETQLLQEQQKQLQKSKQQPTGTDTVPRNQFRPQQGLSFSHSNSPIMGFGMDKHNLQLQTQYQKSHRHGVNQTNSISGDIQNPSPEQDFRNSLINNNGNNNTVNYSPNQLYKEQRQLLNDDYSSTITKSNDSRGSRAISTNDGTETEVSTNQALLTGRMPEEETKAASELNNIIHPITATDMERFIYMFADRFFHIHQHEYPQTVKVFQEFKLSFFNERIMNNRTPKQLQQQATISQHSQLQQSQLQQPQQLSPSMQPTQQIQQPMIYHHNSSRQQQQQHNRNAMSSQLPALVAATTSLVNNNTPNMSQKNANSTMVLNTHSNTHQRQQQQQQQQQQQHHEHQQPPTLPAPLQKIDNSKNQQLVMSPSPMDTLVQLQLRQQGTQSSLQQQQQQQQQQQQQISNFDDYLRSMNAQTLLNAQSNFTRNNGLNEVNLDRNQRMSKP

SEQ ID NO: 14474 - protein, 583 aa, Candida albicans
LVIVMSDSEDSEDLNEYTIEDYYKIVRPLLAANNINANYLDNHKLLRTLVDFSLSHSLSLKNLQKRELEFRNLIPKKINYVDSLIIETKSASGTQYTGCFRNRCIEFCPHFAIAAYLFSRFHIPDEYGAYEFTSTESIKKVSLEHVMLLKGNSKHQAISYSQQHKSAVNALSVSGLDYKDVNLGKLLATHKNNEALESMGRLSKNSIRALSRPLMLALAGFDSFEDYDIIRNSIEPPQQLLDKIFPFLTDIIDESTRSKELLQIKELFLMLRRSLCQDMVIIKKIYPSNPLSRSEIFNSPEFLNFAQSIDNERLNTIINKSCFIPNEDNIICDDNEGSLRVGSSDNTNSKSASKELKLKTLNKQMNLVLRQQQEINQAIYKFTKSQTEIFQKQNELIQKVNQSLNGVLILLSAQNKTSIPLVQQAAQETQNYLSTVGQSNIERGINNTFELLNVLNSNSGHSQPQSSVPPFTQQPQPLPPSLSNLLHPETLNIPQAPVSEPPRVIPTQQQAMPLQQQLQYPHPQQFYMQPSHSPPTHQSAGMMPMAPYGTAPAMGPVPVPGQPQPSSSTDASQNPERQRVLHR

SEQ ID NO: 14475 - protein, 270 aa, Candida albicans
YYSYFSRSLFNSSRSFNNINMKISNLIPAYLLPFSLFCQVLGAPTNGKRGNVVVVKVKTTVQQTQTDIQTISEATGTTTNYLINTSTETFTRYTATVTSTVYGVPHTYTTVATTPVSAADVIPNSENEVKSSPTESPVEQETSTSSTSVATTTTPVAKNPVSSQETSTPTPVPPETTSTSSSLLSSSQQTTTLAQVSETAINDTTESSGPTITGSVSSQTTDSWIIENISTVTSDGTCFVNYDYYYATETDDAEETTTLTSTITTTVTLN

SEQ ID NO: 14476 - protein, 122 aa, Candida albicans
FTKYSNHFRSSTNYFSSTNHIRGSSYSKYFRSSTKYTNHIRSTKYTNHIRGSSYSKYFRSSTKYTNHFKSTKYTNHLRSTSYTNHFRSTKHSNHLRGSGYSNHLRSSTNHFNSRRCCINFIN

SEQ ID NO: 14477 - protein, 137 aa, Candida albicans
SLTHQHSPSEVLNKCNPVPQLLSIMSSGIQSLLKTEKEAAEIVNEARKYRTTRLKSAKQDAQAEIDNYKKQKEEELKNFEKEHEGLNEKIDKEADAEVEKELTSIKSTFEKKKSAVVKLLVDATVKPTPTLHINASQ

SEQ ID NO: 14478 - protein, 76 aa, Candida albicans
  UNSURE (9): Identity of amino acid sequences at the above locations are unknown.
NQNNRQNNXTCPNLGRKDIGVKIESIFTPRFSKIHSRTIQRIRLLTLLSSAAGKAISENDKSFVQKASDAIFGDSK

SEQ ID NO: 14479 - protein, 189 aa, Candida albicans
LLLTYTQIEYYTLFFKPHLFHHLIIVVDRKKKKHNQTKKKIAIHSYLFIMSTSTSSQQQPQDIITQVSPHQQDSFNTTTTTHTTGTDDQSDVGGGGDYNSIIHLNIRGKEFTITRDDLMSLPESILLCLFPNGVFLDVNGNVINNLTEKDMVYVNFDPQTFQYIINTFYQAQQDLIQMFTSSKNLNSVN

SEQ ID NO: 14480 - protein, 408 aa, Candida albicans
FWCFNCFSKIPVTSGLEWNGNSSASNGSNIIQQQQQQQQQQQPPPPQQQQPQQIQPDRRRTSSSAFFNVAPALHTMTSNQNIPNTHLGPTAAGLRAILQQPENQPQLHDSQLQAHSQLQLQSQLQSKTQPQPPLQPQSQSQLHIQQSQAQQHHQQQQQQQQQPNTQSQIAPQTSNTSSITNEFHAPPNISQQSITSNQNTTSTSTSTPTQQAITSPLDKGSTSSKDVPDLSLLARVPPPANPADQNPPCNTLYVGNLPPDATESELRTLFSPQKGFRRLSFRTKNQSSSNNGTGSGGGSGGGGGHSHGPMCFVEFEDVAHATRALAELYGRALPRPNGGNGKGGIRLSFSKNPLGVRGPGNSRRTSTNPAPNGLSQSQQQQLLQLQLQLQQQGSSGGGNYGYSNYHQK

SEQ ID NO: 14481 - protein, 306 aa, Candida albicans
  UNSURE (9),(10): Identity of amino acid sequences at the above locations are unknown.
KLGLLIRLXXQIIKGWDNVSSKLPICNLATLDAILTHLSRLVSIVGTQDKDLAGGFQRKLSKEFGSLVLRPKTDGLNSSETSYLNDRFQVMLMDDLFENKQSIFNELRRQSSTRSAVASVSPSVSRNSSFTRSESIKSNKGHNAAAIAKSKSRLESRLQSAVKNQTKTLEPQQKTDADEFYDAEASPTPSRLGTQSSSLELKRSTSPKKKKWTVVSKVESIEGNEKSKKIISTPVTYRPSNDIIYDKSPSNQSLNDLSSTPPHKFAPSLGRKSSVKDWAKSFENGSTEDLQEPSSRSRSSSPTKAK

SEQ ID NO: 14482 - protein, 199 aa, Candida albicans
VIMLIQPNHKRKPEFNERYYICRTIENYSTNFSIIVQYNRQISHNLLSNALYSLIKKNSWFVQNFFQIDQRNPATANGHNFEVRILEHVKFNDVVKFHQIDKFDEIIMESLNDHIFSMNNATLPLWKINVFEEMRPNGNQFISVSFDHSNYDGLSGVQLTKDLAKELLTAKDELSYDVLFDYQRDFGHLPAKIYQQWII

SEQ ID NO: 14483 - protein, 302 aa, Candida albicans
SNSPRILMSPPVLSVFDEALDSTPDVIKGLLQTMIDFIQERDKQSSASSSLEDIVDDACPGLVQRYIEKILVLSLSDKGKFAYLPFQFVQVALDLGFANPKICISTVIALEASSQPLIHCSAIAMHQKLFDKHESLVDSSYQESIRKAFDAELTSPIFFSSIYTIIHRSKTSRSKFLTALGRVLVLGDIHFLLFCVERTAAITFKYTDDVLVVLKHLQDEIRTVDVADLDQPQALSVCALIELYRYFTTAYKISEHQINNPDIDSKQTIKVKANHSLDLGWITDSIGGDCLDRCLETIRAFI

SEQ ID NO: 14484 - protein, 499 aa, Candida albicans
LLGFSDLSVKLIDLPTPHVNELTNNNKVHYRGIIIHKLPIIHTDYIKKLSLLFTKPTMFSGGLDGKIIVWDLNELKPIQLIENKANGVLSPSIYSLSNNHSNIISTGVPNNTINIFDQRANNPFIRNLIGHQDNIRCLLMNDQFILSGSSDTTIKLWDLRTFKVYKNFDIHDDSVWSLYSQSTSHDSFKTFYSGDKSGNIIKTDLSRVSIFNTRTSNDDEFGFSNYENNYIDEKLGISTLIAKSTSPILSICHEPEQDTIFATNMESMTRYINPDTCQLSQYQYLRQCLDYSYNTNNGIGVGNDNNDELLLHDGQSNPPTEDLNSDFYDLISHLSMDTHPNNNIDLQSTLSHGNNKQQHHNLFSDNTRPISLDAKASDIFTGDGFGDEQDDENILSREDFDSMFLNVNGGLSSEFINAFKDETNPLMVKLQTSNNDDQNNNRNKTIDLTPIEILLNPIPIEQITLIPFNISPIEKYDLVPKSIVAKKMFNNRRQIRGVN

SEQ ID NO: 14485 - protein, 260 aa, Candida albicans
IETTRSVLRFIIIIILCIYYVYKTTHEIVFFLYSKLIGWPFFFCNTHDLYFGCCFNDLTMPPKKGLTQEEKLSALLNWFQSDHMFYTLKEIESKASKQCKIPPMQMKELVLALVEEGLVEQDRCGTTNLYWSFPYLQHKKQQETHDRLNRTIANLETERDSLICRCKDETGVRNQTHERASKIRFCDQSLERIDSIQSQLQSLKDSESVENLVTSLAFFSDSIDDIICYLSRQTGLTMTTLKTEFELPLEFEEIRPGTTK

SEQ ID NO: 14486 - protein, 380 aa, Candida albicans
SGSVARSTVMRHPKQQEFLKNVGEQICIVKLQGTLFFGSIGGVEKEIRNMFEHDKFKSNPIKYLIIDMKGVISLDFSAAEGFRRILNLANDFKTQFIISSVGEDDDIIQGLRDAGIFDNGANAPIELFSSLNYALEWCENSFLKTYSKLKKSDPVKTRSVPGSSTLTTTRQSFASPSSYGAKIFGKYGEFGTPRTNQVFQAASKTVYDEHKTESKFESQKNSLFQKQPLSLIMLSFQGLSDKDAEFWSNITPYFVKEKIPENYQFYDTKNDEPAFFIVESGLIRSIIKFESEGRELHNSILPLVAFGDLDDASEYRQIIYTTVNDTVVWKLTQAKLKEMLAKLGSKGEELYHELLQVEAKLIRSRFDTMTAKFNNCWLKK

SEQ ID NO: 14487 - protein, 427 aa, Candida albicans
IPQIVQNPGEALQKLSSSFPKSVNFYYSYLCLEGLTISSGVLLQIVALILSHILGRILDGTPRAKWTRWNTLGQPAYSTLYPGFQLLTVIALSYSVIAPLILGFTAIAFILFYFAYIYTMIFVLRPSTVDARGTNYVKSLFQLFTGLFLAQLWITAIFVFSKNWACVALEGVIVVVTIAARLWMKWKFLPLVDAVPISAIKYAAGDPTYSYPIHDQGLKEIKVEGKNYWEGGNQLGLGPDPKDQVLPDRIPGNGPSSYAYDQQQQQNHRGSDSSAVDTKVGHGELLDKPKSPFTDFNNNHDAEKSAGFNPVNKAIAAPTQGVSWLTSFFQPKKDTFDIIKSDMPSSYFNYIEYHSDFIRHAYDDPAVTAEEPHIWIARDPMGLSEIEKNKALKEGVQVSDENATFDDKGALIFTVPPPAYEEPIRVA

SEQ ID NO: 14488 - protein, 269 aa, Candida albicans
GGAHGHGSCQRRGENKNKLGERTKLANKYEGTLNKVLTKAVKLRNKCLKKSKPAPEPQDDIDKYLKDGKKRPTHKLKFLIGKKVDTLDYSPEKLGELNKEITKEQTEYQTYDQLPAVFIEFPSQLEMQKAYQAIPYQPDFKGVKTVINAAPEDIIWENLQLTSMKRRIKSIIANTILTLLIIFWCIPVAVVGAISNINVLTDKVPFLKFILKMPDVIMGVITGLLPVVALAILMSLVPPFIKWMGKISGSLTIQQGGKLLSIMVFCFPS

SEQ ID NO: 14489 - protein, 604 aa, Candida albicans
KQKEHRQNLDEVMTQYLDKHNNLATLLLTTSMNDELYVIYDKYIKPSEDILREYVFLDILKEVLSVFNIDEINLWLRTYLKPALDSAGYFSQFVDKARDLIRKIAINYLQTNDESLNFERGRIGSIVMHQIMEIYLNNNKRLEYLNLEPNDSQSYQERVRFIKFNCLNLLQEYGLKHISNYTKLLDQHLKDPTERLETLNLFLKLVATQSSQVSYIIESDLFSDLLKCLLYDFNDASVFASATVLVMLIPQVSTKLGQHLPDLFAIYLRLVNWHELNKYVTNRYELFMNYMSEDFLSWKIDNTGKEAHATEIIFDWQYYGTLLYGLFVLNFIEFSAAPLKYLQQHKPKLITLVLLEGIEANIEHATKMESFAIAKSKEFLQSLLLHPKMISLDTSQQRELEAPVEWILQQNTGSISSEDIAISCLSLNPHIMADEAFKRNNIPHDLWFSKRDSVSQNESHHLLSRNSSLAGPMYINVKESHTNKLLSQQAINGRKMSIIPTNLMIEDDSNNGVKFKEVKFSDDNISDADISFNGGLSDNIMGNSSLSLRNFQENHKTTDPIPELLSTHEKLYAKQGDNDSSYNDDKKSVNNFINDKGKYELRLS

SEQ ID NO: 14490 - protein, 510 aa, Candida albicans
  UNSURE (491): Identity of amino acid sequences at the above locations are unknown.
SVLPFFIFWLLVNSFNIKMTYSEKQPLLEYSKKIADDHEVSVRSFNFPIFENTLSLFNSINPFQNCLTPLTRKVSDILLNDTDDIDVDSDYNLSDDEDTPLPDLPYESDDFPILLPSSKLSQREKLYELRKLMKEYNIGTYIIPSEDEHQSEYTSLSDKRREYITGFTGSAGIAIVTLTNANTLTGEAILSTDGRYFLQAEKQLNPRLWKLFKQCATGYKPWHEWSVESASKNGFSKVISCDPRVVSLSIGEYFDKQAKFHKSFQFKPLLLVNLVDEIWGAEKPSRPLDPIYVLPLRYSGEHTNDKLTKIRQAMKEKNSTHYVVSELDSIAWLFNLRADKDIPFTPVFFAYALVTLDSIVLYVNNDKLPNDDAQLNEYLSSIENLTIKDYNEFFKDVSKLSELKDKESVVLPTRSATSYALYDTISKSVNKSLLYHESIIANLKIFKNKTELFNAKIAQYKDSLSIHYFFSLGLDYQLVLKKEKNFPNYDXACKIYSIRQKFTQFHRVIL

SEQ ID NO: 14491 - protein, 379 aa, Candida albicans
VFETVQLSSKDTMSTDSTDSPATNNIHDPTIFQINGLLKIKLSQFKYFTFTVIGIALLWPWNCFLSASAYYGERFVNSPSLVKVYSSTMMSVSTITSTAYNFYLSQRQTNVNYNFRVQAGFCITIFVFLFMAVSCVSDWIIDMNDSAFFTTLMFMVLLSAMATCLAQNGTMAIVNVLGGIYANAVMVGQAVAGVLPACALIISILLVGDKVSDQHHRVEKNYGVFVYYITASLVCIISLLLLYLVTYHKNEVGYQRLNQLVEEDDSGAVDEQEVVDPIHTQKKFVPFTVLWGKLNLIVMTIFFTFGITLIFPVFASVVESVHTDSHSRFLNKNIYIPFIYLVWNLGDLLSTVLCGYPTLNMLIKIPKTHLVYPLSRLVF

SEQ ID NO: 14492 - protein, 667 aa, Candida albicans
SFLYLYNKLLLEMAKKGKKAAQAGGDFWDDEDMAQDQPQAEEFGTPAEPESQEASAEDVSGDLLSSIRKNKQKKAEKQENEKANVNNGDAPKLLSKKEKEKLKKEAEKQKKKELAQKKKAQQATKKEQIKEANKQNAGSAVTASSASATPEPEENESLAASEQNEAPKAKPAKKGKKAPAGLAALKKQLELKKQLEEEQRRLEEEEEQRRLEEERLAAEEEAKKEAARAAKKERERLKKEQLKAEGKLLTKKQKEEKKLQERRRQQLLQAGNVSVAGLSKTEEGDAPKPKKVVYTKKKSTKPKTFIQKTVPSKAPVKKDDGEDEALVDDWEKMALDDDAPVADDWEAALADEGDEEVGEAEEEDEEVGEDEDTIVEDEQEKKAKEEAARKAKEESARKAKEEAARKAQEEEKSKQLAAQKKAASPSEKDLRSPICCILGHVDTGKTKLLDKIRQTNVQGGEAGGITQQIGATYFPVDAIKQKTAVMAKYEKQTFDVPGLLIIDTPGHESFTNLRSRGSSLCNIAILVIDIMHGLEQQTLESIRLLRDRKAPFVVALNKIDRLYDWKEIPNNSFRDSFAKQTKSVQAEFENRYEQIKLALAEQGLNSELYFQNKNMSKYVSIVPTSAVTGEGVPDLLWLLLELTQKRMSKQLMDPVSKLLSTMLAETA

SEQ ID NO: 14493 - protein, 296 aa, Candida albicans
SSIPAGARRMSKQLMYLSKVAATILEVKVVEGFGYTIDVVLSNGILREGDRVVLCGLNGPIATNIRALLTPPPSRELRIKSEYVHHKEVKAALGVKIAANDLEKAVAGSRLLVVGEDDDEDELMDEVMDDLTGSSYSVHSSCLCVVVLPSSSCSLDSSLDFSTHLHLPSSSIGLGPLFLRDVTRSSSLTRSIFSPRHFLSYSRSSPLSYLFLTPLLPLLFSFYSLLNPLPLLPLLSSSSPCSSFPFPPSLSSSPPFPLSFLLLSPSFVSLFLPCSSLPLSLSYSLLLPSLLFPPAL

SEQ ID NO: 14494 - protein, 590 aa, Candida albicans
LYMRLKKKNCSLTSAQEKFCTNHLFKISKHVKGITNNMINLQRNLPKIVSLLSGRIITQCHNYSKLSTPTRKPKGEEKISNLLKHFKRTKRRNDLTDPTHPSKITYREINDFIQEYSQSHNLQVQTENIRNSLDIIKNFLPHQRNHDTILDNVKIRAMTSLGEGLAIVHKSMYAHNFTSDPEEILNQYTVLIIPKTAIGDNARVLLKMHHEFYAEGELIEVLNSKSKGSRRNDRLIVCEKFNECNGCQLQMLSYEDQLKYKQSVIQRAYKYFYPQIFNLFKEMDNFGIVNESPLQYSYRTKLTPHFAASNKVNQKLGFQHVNNRGRLDITNCPIATPEINDILQESRDNYIGKSTPLTQLTLRQSLRINQDTGAFKSVALEGQKKVITEKVEDFLFQYDSNCFFQNNNAILPSVLDYIRYHINQSDKTIDNLIDTYCGVGFFGIALSKSFNENTKIFGIELVEQAIKYANHNAKLNGLDPERVQFVSGDASNIFNNENFKKSGISGKNSVVIVDPSRKGSNESFLQQLLDFEPEIVVYVSCNVFSQARDLATFENLQQNTNVKYKVKDVMGFDFFPQTKHVESIAILEKV

SEQ ID NO: 14495 - protein, 317 aa, Candida albicans
YCICSDKTLDELIPAFLSEQLEFAPLTIIDDVINAVNEIMYKGTTAIETYLKEQKQLMKNGIFTKVTEDEIEIGMGKLESLLESTIDKNFDKFELYCLRNIFNIPKDLIPYIQLSHQQGIEFKSDNVEQKREFDQQIKNLQLKIMQELQLRKILKLQLVKVQKLIKVLIAIDNDFKKIDFASGGGGNEESIRILKNLQPIDETLYFLISQIKNLINQIEQLSNKVNTNLKTQKFIPNLRDKFIDGRTFRVLQQTGIWKDLEKNDIKILVQGNDNNNNNNNNNNNTLTDLQNQDDIDMIIPEQDDIDVDAIKNINAQI

SEQ ID NO: 14496 - protein, 341 aa, Candida albicans
TILIDYTFPSSMSSRPKLLSFDAFAKTVEDARIKTTSGGIITLICILITLVLIRNEYVDYTTIITRPELVVDRDINKQLDINLDISFINLPCDLISIDLLDVTGDLSLNIIDSGLKKIRLLKNKQGDVIVNEIEDDEPAFNNDIELSDLAKGLPEGSDENAYCGSCYGALPQDKKQFCCNDCNTVRRAYAEKHWSFYDGENIEQCEKEGYVGRLRERINNNEGCRIKGTTKINRVSGTMDFAPGASFTREGRHFHDLSLYTKYPDKFNFDHIINHLSFGEMPVDGQADELFDSIHPLDDHQFMLHKKAHLVSYYLKVVATRFESLDYKNSIDIFNSRSRSC

SEQ ID NO: 14497 - protein, 213 aa, Candida albicans
  UNSURE (208): Identity of amino acid sequences at the above locations are unknown.
ETILIDYTFPSSMSSRPKLLSFDAFAKTVEDARIKTTSGGIITLICILITLVLIRNEYVDYTTIITRPELVVDRDINKQLDINLDISFINLPCDLISIDLLDVTGDLSLNIIDSGLKKIRLLKNKQGDVIVNEIEDDEPAFNNDIELSDLAKGLPEGSDENAYCGSCYGALPQDKKQFCCNDCNTVRRAYAEKHWSFYDGENIEQCEXESYVG

SEQ ID NO: 14498 - protein, 79 aa, Candida albicans
EGKDEDHQHTLHVRGGIPGVNFNFDISPLKIINRQQYAKTWSGFVLGVISSIAGVLMVGTLLDRSVFAAQQAIKGKKDI

SEQ ID NO: 14499 - protein, 514 aa, Candida albicans
ELKRADVIWLVYSDHYTYERISLHWMPLFRSMGVNLPIILCANKSDLFPKSKSNLKSTNSDEFVPLINEFKEIEAGVRCSAKNNYNVVEAFYLCQRAVTHPISPIFDAKEGNLKPGAIKPLKRIFWLSDTDQDGYLNFEELSELHKKCFGIEASKSDYEEIVNLIDQKILPSYNTTIETQTPPQQQHLATSAGTPNGTTTTTSKGISEDGFILLNKIYAESGRHETVWCILRAYHYTNSLSLSDKFLYPRLDVNPHSSVELSPTGYKFFVDLFIKFDKDNDGGLNEDELNTLFRSTPGIPKLWVESNFPSSIVCNEEGYVTLQGWLAQWNLTTFLSYKTTLEYLAYLGFDEGNSTKALKVTKPRKIRQKNGKTYRNAVNDRNVFNCFIVGAPKAGKSSLLELFLHGSYSDIYSPTIQPRLVVKDIELRGGKQCYLILEELGELEPAILENKSRLDQCDVICYAYDSSDPESFQYLVELREKHGHLLDEVPAVFVALKADFAKQQVLKTRSSYCR

SEQ ID NO: 14500 - protein, 218 aa, Candida albicans
RIFGLDTYTVGESSKVIVILTDIYGHKYNNVLLVADAISKEGYKVLIPDILKGDPIVSFDELQAWLPKHTPEITAPIVNGFLKKVKEELKPTFLGSIGYCYGAKYVIQNLSSSGFLDAGAVAHPSFVSIEEVKEIKRPLIISAAETDSIFPPELRHQTEDELAKLNGVRYQVDLFSGVTHGFAVRGDINNPIVKYAKEKALLDQLTFFDSVQVLKSNL

SEQ ID NO: 14501 - protein, 251 aa, Candida albicans
LLELKVSLLDMASNPPSACCAQTNFHEGTPLGTHQEVFGVDTYIVGESSNILVILTDIFGHRYNNVLLVADAISKSGYKVLIPDILNGDPLKPGDDFQPWLPKHTPEITAPIVDNFLKRVKEELKPTFLGGIGYCFGAKFAVQNLSINGYLDAAAVAHPSFVSMEEVKAIKRPIIIYDAETDQVFAPELRHQTEDELAKLEGVRYQVDLFSDVTHGFAVRGDIKNPIVRYAKEKVLADQLASFKSVQALGH

SEQ ID NO: 14502 - protein, 500 aa, Candida albicans
SLLVTGMMAMVRIPPLAVAWAQNFSGSLGVVRIGFVQDIANCYLQAIGGTPTDILKSRYLSISVQKFVKKFIKRSAMAIAEHSPEFMTHLTKRINVLLDTESIGALDSDLYTTNEKSGESSGKILVLRGIQRVAYLSNIEITDMFMTSIQFLLFFVFVVLICLMAFKAIIEILVRSKIIKEGKFKEYRRQWASIIKGTNYRILMLALPQIGLFCIWEFTVRDSAGIVVVAVFMLAVTVVLLLQAAVRVCLLGTKSVREYKNPAYLLFGDRKFLNRFGFLYFQYRADKYWYIFVSTTYIFLKSLIVAVLQNHGKPQSVIVWAIELIHLVVLIWIRPFMDKRTNVFNIIISIMNFINALFFMFFSDVFGQPSVVSSMMAVVYFILNAVFALFLLLFTVITCVLALLRGNPDSQYQPMRDDRVSFLNRQASRSDVIGKNNPRNGKDLELADLGKTAMMGHENRAREGDTAYQDSNSYDEDSLYFRRRAENEQEGYSNTYGPRN

SEQ ID NO: 14503 - protein, 1402 aa, Candida albicans
VKDMSDIMDRVDNSTRKFKLGDNIHFEISSSANTQGNSHQIPRKQLQLTNSNHQEQSQQVRNQLNQSNTNTTSRKKRKKHKKKSKISTVQAHLNNPEDDYPTSRVIKQAPNGDVIVESLEDEDENHHHHEYEEHEDSCEYHPSSKSNTRKNSSVNESTHNKIWDSASIEEQQRLKEFWESLDESKKLDLVKIDKDSIMRMFKNETRHHLQQQLLLLVLLQPQQQQSQQNVSTSSNNGSSSGINNNFNNNNGNNTNSCACKYCGRRNSIIEEELESIYDNHFDDIIDFIHEVRDINDLNALPGLLFGGFHMLEEERRLQKRQQKYKEKWNHSHHSTSVLPQPESQDNKQLNKSQDQNEMKAISIEDEMDKFKSHLAKMSILNSQLNPNQLSEIHLQLKSEDGNLTGTTESQLFNKLLDPKLFEALENMDLDKMKEMSKMDPKNLNNVNILEKATSLREIVRDLNNADRSSLQKGISHVSNMGKFFSNLATLNNAQNLPEIVASGGLDDQLSKGLSSFAEDLLKNDGNSFIGMMEALSESRTAREELLKETVISQNPQEQKLVSIGQSDQLGDVWVDDDDENNRVDVEIHACDNPHHHHHHHQHSNKQHDHHHCHNHRHRHRRRFEELDDEHDQENEDEELEDDEEDYYDEYDDDEEEDEEEDEDDDDIEEEGASDTESEISEEEKMQEIRRLFLIQVIKLFQERLKNAYKEKLSQDRTQKLIEELEAEENAKKERELKKLKQKEKAKEKKRLQQLAKEEERKRKEEELKAKEEEQRLQKEKLNAEQKKRKEEARLISDEELIWIFEDQKRPEEEHRKKVEAQQKREAEAKKLKEERRRKAEEERKQKEEEKKQKELLKKQKEEEKRQKELLRKQREEEKEKEAARLEEERTKLMVNDDDELARQIEVEKSKLSAAVANNPLLNHLYQPSPGSAPTTPSTANLPALSPLQSASAKLMSQQFEQQHQQQVLQEKLPQTSNIQLPNQQPHPSISSFQFSSEYNPNASVFHNNSSLLSNPSIMNSPRTTSTNLLNGNSPIVPNVTTNISLGATNTSNLSPWSSKSRLNSLSNSTQPFIGGNQFTQTNTASFNGVGNAVQQSGNFSPFNAFSDPLVSDAFKAAGPAGMNSNIWLNSSNVGNNSGNQLGISAPTTTSTNTSSRNNSIWGNTNPNKVTEPSLLNNNNNNNNGLISVESSGLWNSNGGNNQPARSSSVTGISSNLSTINPISSMDIELIQSTTFNCFQILQNSGQLEFGVAPLMKLFQNVKTILNKPSLTINQFLNCCTINSNVYIFSLKYDDFGNVTHVEVAYKNVPRTSPPPPPGNIVQNQHQVSLPSFAAATASSSSLATSNVPLGFINSGGSPTGLFNDININHGGTSFLPPIGELSTNDAGSSNVGNSGFGRRLWN

SEQ ID NO: 14504 - protein, 278 aa, Candida albicans
LMIDDDGCLFNFFFFFGLIYTHTTHFLIFLLSWRLFVLGKIFFTQTAPIKQQTVKPLFFLSFFLSFFPLFIYLITHLVMGFGLYLIVAGTLITGAANSLLTKYQDNQCVDNCHDPNPANHKLFEQPGIQTMQMFLGELSMYLVFVFYKWYNYDNNNNNNRYVQLNGDDDDESDPLSVAKPHETSIFENFKLSIPAICDLSCTTLLNIGLVYTPVSIYQMSRGSVVLFVATLSVLFLKRKITKLEWSSLFLVTLGIGLVGLSGSRIITRDPFFKYYKFH

SEQ ID NO: 14505 - protein, 236 aa, Candida albicans
  UNSURE (220): Identity of amino acid sequences at the above locations are unknown.
TRFQPNGTARLLASVSRDRSCRICDLRTMKDMLVIRDSETDLSCVAWHPIHASMVTTAAYNGSISNFLLDSYIPDSNESVPKRSNNNSNLSTNTNNTIDAVQKIPYAHEKAIHAVEYHPLGHLLCTAGSDKTARFWSRARPNDPMAWKDAVYTDCKAGAWYYSVNNSVDAVMEDPNAVRNEDDEIANNDDPLSNSGLRHGVGASALGGATGSVPVLRSRXETPNNGSYAIPGLRGF

SEQ ID NO: 14506 - protein, 305 aa, Candida albicans
EFPGSFNLWWIYQQPQGNNPKEKQEPTDESSLQTLVLHDISMNDTTNDQTANEILSNFFKRKGETPLNDIEYEGVMALISRSKAGTPISKRVISESILDQHQQPQRKKARNEKISEMAVAPYKQSTLIHDTSNISISTPGYKPTYHTIQNDTFDRSNQSFNNTTSIIPSIKRVYQFSGLPSPYFTRLRPPSTTKKYKKLRNLHNENSKLDNNTSATTTTTTTNNNNNNNNDTTNNSVNATFVDKTREFKSDTAKTLLSILDGNEQEKSTFDFNNDSNPQSSSSSGFKFINPYSKNVFFTTGEDPR

SEQ ID NO: 14507 - protein, 283 aa, Candida albicans
FQALSAIRAKTTKWEDFEIKDSNFYAKDLSLELKDNKVYKLKSSVNKESIVEFEMERLTDGVIFGDDGMSFYGEDPEQPWGSMRHVFWPRCKVNGTITTADNKVIEINNGLTMFVMALQGMKPHHAAKSWNFMNFQSANHSAVQMEFTTPKSYGTTKVNIGIVTDNEKILIASIDNQVVHSDTKFDDVGGWDVPQKIEFNYIDGKDKDKQVASVSGNLSQLVERVDVMAEIPQFVKNIVSGVTGARPYIYQYANEFTIDINNGDGEKVKEDGVGFTEVTFISD

SEQ ID NO: 14508 - protein, 374 aa, Candida albicans
LESSFKKSKRTNDNMNSGIHTPHEIHPVVSQVHVDDMGIASILSNKNITINVDHVIDSDEAMLLAIGYRQELRREFSLWSIFAVSFSVLGLLPSIAACFDYQQLVVGMSPLPWLIAMIFITSVAYSMAEIASAFPCSAGTPYAVSQLAPKKYASFLTWFTCWTNWSCQITAAPSVSYSCACMMLALHSFTDPSFVASNAQIFGLTTGIQVLCAFMACFPTKWVARFSSAGTTCNIVFLVVVFIMILGGNKRDQIKEGISKFNSNSTAWGLDNQAEWPTGLSFLISFMGVIWAMSGYDSPFHLAEECSNAAVAAPRAIVLTSTVGGLIGFMFMIAIAYTLVDLNQISADPEGLGQPFVTYLTQIMDKNLVIGATA

SEQ ID NO: 14509 - protein, 548 aa, Candida albicans
ILINGMVLNDFSGPDPSHCTLLVDEPVYLINDEDNYWRLIRKLTKLERLKRMRLNGQEFQIDIESDEEDGKIGFVPAECLETHGERLARLNCFKNEELEKKSPTPSSLQESTDSFKNQRQTATTKKSVTFENLGDIIDDYSDEEIKSDHENIRQNLDLYNNLEPPTHLQEIKEPEVLSDVYPAETPLIISKNNNNNKDSSNKTATPTFQMSNTFDAVFVQPKQRSSGLFDDASIGSYSPDTPVKAKSPLRVEVQDDDSDEMGRNNSLYSMSSLRRSVILDRLTQMTSDIQEQLQLDGYNEDEDEDEEEQEEDAGEVEEELDEDKHKEDDETEKESTDVEQGSSRDSDHEVHGFSFEESSEQFTSDDDYDDDDDDNVEHHSPSNDGNVESQDYDYQNDDHTPQLIDQHDYSKHQQQTPTNFHSISSAISPKLQRLLSTTLSSVQHRTPPPVSQLTSPNSHRSPPPQSHQQYAVSPLNYNRLPRSTTSIDDETSSTVENNDDNITPLTSMNSLTPIEERRKLKPVHEMFMPILGKFDELAEKLAELDDIL

SEQ ID NO: 14510 - protein, 233 aa, Candida albicans
YKIKFNVISFSLSIAKHTWLTMLEITKLTQEEMDVVIYDSRVGDLETLQEIFDLEKLITPKTLTIIKDDITLSTPLHMAAANGHLPVVKYLILLLEKDDVKQLLEAKNENGNTALHWASYNGHLEVVEYLVEEVNADPFIKNNSGHDCIYEAELGGQTEVENWYLKKFTPEDAFDVQENEAEGTTKITYQPGKESKLADDQARDAVFKSKLDNTSTEGDSLEQKTQALNIDEQ

SEQ ID NO: 14511 - protein, 425 aa, Candida albicans
ISITTTTMASENVKYRLQRIQTLNGDQEIVLKQVWAYYLKFFGYPVDISDSDLAYKQCFVASTSTADFDESQAIPTAGLSKTNTRGSINSTQSNASKKKRGLFGSKKSTASALNNGGTGTAQGSPPANSKRMIQIQTQSSSERYVPVDIASDEYYAIYAHHHKSSYEYSDDYDPSLDNAAGAGGFSNGGGVNYNNGNGGAYYDNDTASVNSLETFVTAETTITDYDYTPATIFKNGNNNKINGNYGGRIGHPNKFQQQQQQQQQQQQQYYQQSNGGSGVSRHQATINTPIHVNAGQTPITALSQYGAKDQHRAILKVPRTDLIDNLVLRFIRARKWDTEKAIEMLSKSLHWRSNDFPADDWAMEADGPSYLNGTNKGFIKNFTTEKSWIKGRDNNNNPIFMFQAKKHLTADSPLEQNQRYAVVTI

SEQ ID NO: 14512 - protein, 609 aa, Candida albicans
LNMSDVKIEIDRSHTDGAFTNYDIIKGNVTLVVTKAITLNWIQVKLEGESTTQLLIPKFNNNKKKKEKDKIIQDIHKVLYDTTIVFPPDNVRQVSQAKEFTLAPGNYSYPFEFKIPLTNSCVKRGGITNMIHINKKTFDIMINNGNFNSDFVKHKAQKYYKDYVAGGQQQQQQRPEMPALPNELPYHVTTQLPPSLSGMGNFANIKYYVKVTCKRSSFFKTNLRAFDPFTFLPLDLDSQYRPIEEQLEQYKEAFVRKEIIFMNKIPSIVGVEVPQKTQLVSQASQASQIQPKKQGFLQRWFSSDLSYNTPNNNTSGHMSRKNQLMKYPKITPVNVPFSFEIRFRHPAFLTPGKLPTFKLYLVSTVNPLQYSLDKYGEPEESNGLGVVYLQNITVSLISTTSISIVENDSGMNEFHMGNNVQTIPICDNSYSNLKFDLMKCRKNKNSLITTTRNSNDACINNKPVTKQLYELEIPQKYFANCILPENLPPSFKTCNISRSYDLIITAKFSPEKITITTTSSSSPTNSASSNMKEVELRCSNIKVLSGLHFAGAPITQRQASVILSLTPPPAPALAPAAGSRSGSAPVADTQDSLGQSSKSESFTNEGDEN

SEQ ID NO: 14513 - protein, 243 aa, Candida albicans
QFYLFILIFVNNYMGADGGTIAKRQDLLSSLTNRTNGDAQRSEDKEGDLIKVCHLSSLPLYNNDPIVSDYKGKLYIEEKLLQYLLDIKTNKHSVKSEFSHIKLLKDICPVTVSWTIINKEPFIECPVTKEVQKSYLYLRSCGCLISKKALNEFSKTKTEKKCPNCNVDFCDFDIVMLDPLNLKKNSDINEENILILRQKGLSHSKLPLKKPKKKKIHDEDEFIRKRKLPDEIASARKRKSTVS

SEQ ID NO: 14514 - protein, 74 aa, Candida albicans
MFKMIGRLAHISFDLVLISGFLAGVKRTTGITPNLDSIENKDVQYYATKYLNLGESVFDNTAAFLGNSQYFTRK

SEQ ID NO: 14515 - protein, 365 aa, Candida albicans
LRGLALVVKTEEATPNSKPSLFGDAFKASDKTESSTTSKPSFSFGFNNATTTPFSLGGGEKKDTTPSSTLFTLGKTDTTKDDAKPTETTSLFGDKSKSGSTTPFTFGQKDDKAAGDSKEEDKLASTTKPPSTGFTFGAPAKTTESNDGSKGESNNDAASSTTATTTSSTPFKFGITNKASTDAEDKKTEEPATKKFNFATPSTDKPSTPFSFPSANSSSTSKPAFSLGGIGTTDNKEKKDTSSSPSITQSTTAPPLTSSTFSFNTKKPDAPATTATTDADAAKSLSNSGFKFAAGVNPPSQTTSNKPPSIFNFGAASQPSATPVFAGFGQPPQPANTSGGAFGGKSSFGQGTNNAFGNTGGIFGN

SEQ ID NO: 14516 - protein, 177 aa, Candida albicans
CIGFVNIFLTRALNKKIFFFTTLSISSLSTAMPRRFNKKTATTFNVVHRAHDDARFYDDEASEHVLVPQSTKKKVVTTTELEKKLANTNIRDNEGLAAQYGITYDDSKYDYMQHLKPMGNPDGVFVGAKQSQPKQLIEDLFKDQLPSKETRKVARDLNQNIPDELQGFNPNLDPSIA

SEQ ID NO: 14517 - protein, 247 aa, Candida albicans
QQLSNYYYYRYGELVRLDIPPPRSDDGEKYAFVEYKDAESCERALELDGKTLPYSIKDGLVVQVARSDPYRVRQQFSGPRGGYRDGGYGGRGGYRDGGYGGRGGYRDGGYGGRGGYGGGRGGGYGGYRDGGRGGYRDGGRGGYGGYRDGGRGGGYGGYRDGGRGGGYRDGGYRDGGYRDGGRGGYGGGRGGYDRDREEGRGGYDREEDRGGYERDEGREPRVEERRYSRSPSRSPPRRDRSRSPERY

SEQ ID NO: 14518 - protein, 110 aa, Candida albicans
AIRKYTTIIIIIVSTIMSLPYTLELNIPFETFNQAAIAKNTLSPDPILRSDELTIDYATDSNNLKVKFSGVSDRVIRVAISNMIDNIRTIIECMDDFDGKKKSLFDLQDY

SEQ ID NO: 14519 - protein, 106 aa, Candida albicans
  UNSURE (32),(60): Identity of amino acid sequences at the above locations are unknown.
NFNQLLISNAYAFIMSSDPARPDLDVSIDLIXSISHQLDIGNPASSTSSSNQNPEVAKAXSEICLACRTGDIEVVDSLLSTPNLDINQVDEYEYSPLILSSWCGAL

SEQ ID NO: 14520 - protein, 166 aa, Candida albicans
KQQKGFEISQCSEICESCTSKFPKHLKFEGESEGTSLWNTTKPYGMHIIIATGKKDWSHDAINEDGKKKDTLKYKIGKWAENNTNSPLGTIKVNVSSMSSDELYINENYKLEKQGDLLILPYFLNIKGITIDEVDTYLNELESLLINSTNNNDSTIIIDEIITKLP

SEQ ID NO: 14521 - protein, 273 aa, Candida albicans
  UNSURE (16): Identity of amino acid sequences at the above locations are unknown.
LSRSPHNNVDPVSLVXEENSGDQFIMNTGSFKLPDQDEFQFTMNNNSDNGFSSSTSSSDLESVPDLTDDNIDELTPETTPIKPVGNFYFNTLFDNEENTDGYYYKLNSQIKIRNELQQQQQQQQQQRLTSSSPSIFEIPEIVYKIISYVDEQNTILPQESTPIRRNPLSYKHALLIHGDKKSAQSALQKTTNQQSQQNQQPSSVISSSPLYNCLLVNKLFYKITSEIISTKFYSHNEQQLKKFIENKSHQQQNSSSPIIIQPKTFILHKLFHT

SEQ ID NO: 14522 - protein, 370 aa, Candida albicans
TRIHNSKNIEYFYIIMKFSSTTLLAVLSSLTATVSAGCSFEGGNYYCSETKKVIYKGIGFSGSYMDVTNMDENTGKCTQQLYSFSGNLSPLDEELSVHFRGPLTLLQFGVYYPSSSGNSKRQIDDQDCNVKHVHHKHKRATEVVQVTQTVFVDGNGNTVTSQALQTSTVESSPAVSSAAAANDNANSGSGSGSSAGSGSGYGSVSALDGEGKAYRSDISTKSAPTSTSAQPSSSETASVDGAWTRDSYYTPGSTDNCVFLNYHGGSGSGVWSAKFGNSLSYANADNSGGSSTPVPLEETTIKSGEEYIIFSGSKCGSSSDCGYYRKGTVAYHGFKGASKIFVFEFEMPSDTNGNGQNQVFTTDVPDPTNP

SEQ ID NO: 14523 - protein, 113 aa, Candida albicans
PPEIMLIGSLVVKILSSGSNKMISHLHDGQGSSQNSNNGGGGSQDYFERPTSGTFKGVVIFEGDEIHILQVDDETEFGSSLDEETVNAWLKEAGSVATIGYYICDTPFFSTFF

SEQ ID NO: 14524 - protein, 238 aa, Candida albicans
HDIMSRFWHFKKFYFTLCYSMQRMRGKIFKNEPLVPMDVTSEHEQVQSISKEESRSLLSNDLNLSADLELQLESEPEIESEQLKNHEDVYEIIRLMVLAADTTLPRLSNNLLTGIYNHWKLNPNDDLPLYNPTKYTPYEFHSQYNQDRSYIITPRLSVTKLLVSSWCELRSFYQVYSGSVRLPSTKAMTQGTKLHSKLEAEVHPEIDTTEIEQFLISNAMSLRELQTTVPAEGRDGGY

SEQ ID NO: 14525 - protein, 409 aa, Candida albicans
GSCKPLSQPKEETVVIDLGEVEQLAVDWAEMLIERLFSLIMGAEAREILLHGYLNLKNRLFVTNKDEIRESSSVLVSGIVDYIKLQNVTNPSDGTLFDDIHGFVDSAFDQVDNVPLVDLSQFLPEAKQILQNYDFRLTFTDVKTRSARQIPRQESVLEAAKFQTFYYRHFFHLLSRDSRFTYFSLIENAERRGHDVDKPLSILTTISLLRKHYHIFFKDFVKLANGEPIGFSPFDDSAKSIPYDFVSMFQSSNEFSLANPNHNHFLEQILEIDGIEYDLILSPLLKVWKTPPTLRYLAARASQLFNVFNENIGDITSVEYRYNKTSELLLEKVYDYNFSEFQAEVESASKFWNGEREVIPTEDLLRCSYCEFQSKCMVAGGKTTEAVEKKTIGPKIRQFLNECESSSKG

SEQ ID NO: 14526 - protein, 179 aa, Candida albicans
TKPTSINQYTPIMGTNNKTVTNKSNKRIQGKRHIKHSPNLTPFNETQNASNFLIKSSTPYISAIKQITKKLNKFSKSKNSHTINKFQNEQYKTIKYIAVKGMGKTIEKVASIGTHFQKDYKVDVLTGSTTVLDEFAPIESNQEPDNENKSDDDDDDDDETMFKKRTVSSIEIRIWIKRD

SEQ ID NO: 14527 - protein, 148 aa, Candida albicans
SLRVVPSSTNKESSVNTTKFGQPAEHAPALQDSLRSQEGPLNIASKINNRHPLESQVTNWEKTQEENRMETYRRIFGAGAPIKRAMELEIVESSSFRPSLLGGVDSMHKDILLNKDSSVDWEDVYPGGFANGDNVKDFHSEMEKQMGI

SEQ ID NO: 14528 - protein, 431 aa, Candida albicans
ISQIIIMGILGWGFRSNIKIHQSGDEGSATLSLKDKGTIKFSQFIKQDLPILDESQKLWLNPLLFNGTLQTLYYTSMDSSNKFLIYYGRELFTYSDGGICSLDWVIPKPEDEQKFETIRKETLPEGFPRLQPRCRYFTNEELAELHQEDSTSEKPIVVIIHGLGGGSHESLIRDFAETIEKKTSGWGVVVINSRGCGTTKLTSGKLFNAGSTNDIREVLQDFKKRWPNRPIYLVGFSFGGALTANFLGEEGEKENSESLVKAACTVGCPWDFVDGAYHLQKSWTGKYLLSPALAKFLAKIVTNNYKELETYAPDIVNKETLKVIKNCKTLWEFDDNVTCKTTPYKDAFEYYQELSPVKKLSQIKTPLLALNSTDDPAVGVKLPILQMKANPYFCLVETDLGGHLGYVQLNGEFWCVELVEQFFQKFEELVK

SEQ ID NO: 14529 - protein, 703 aa, Candida albicans
SFFIFIKAKLFKEMGDFPNLEPDKRIDQNSHSDTNSVNDQASSTNDSVLSTSPSRLVYIPGESSLTRDGPLPLDGEEGSSSQRGFITRSNRQQVDTSLQQVQYNNNKIALDSSINQTIDLISELQDENKERPIFYPTEIEDDASVVLNSAKAHLALVRKNSTLKSISKSKIETDEKELPEFKILKISLKSGHGDNSNTMANLDKKSIANLLEKKLLQQVKYLLNLKDRIDDTTSKVFVTGDLNAGKSTFCNALLRRKILPEDQQPCTAVFCEVIDASKENNSIEEVHAVPIGKEYNIRDESTFEVYPLESLEDLVYDCDRFSLLKIYVLDHRSFQESLLHNGVIDIKLIDAPGLNMDLYQTTQVFSRQEEIDLVVFVVSAENHFTLSAKEFIAAAANEKRYVFIVVNRFDHIKDKEKCKRRILDQIKSLSPDTYKNAKEFVHFVSSSEVLNENGGGDDGDPDDDDNNNNDNNDHPDFDQLEASLRKFLLEKRSISKLLPVKDYLLNILLDLQTLSKINEKIYYDEKVDKLQELNNRVAPKYNDIMTKSVRIGDTINGLIESTCTEVYNETNKEIVTTVNNLGDKPIVKYPGLQYLFEYAKETQLAMIDIVLESVARSEEVAKKVTSNRVDEIIKYGQQTLNEEFLNDKVFNSDLMFTRRRDTIGKSIDDTFEINDFFDPSIESFLVFVGLLLHTRPLEGTTYG

SEQ ID NO: 14530 - protein, 323 aa, Candida albicans
ISLSILTMKVSKFLFTLTLLSSSCLAIIENIDGSIEDTDSLLTKTVDKSSHKLGVQPLEDEDNHPTPKHAKQPLDPYKNGGKLGHESSSSSSSSNQDQELPDTSYNAFIMSISMIIVSEIGDKTFLIAALMAMRNSRIVVFSAAFSSLVVMTVLSGIVGHALPTLISQRLTQFLASALFIIFGVKLLREGLAMSKDVGVDEEMAEVEEEIAMSKLNTQMNDIEGGGVSNTEGVTNSSISNNNTPVYAEIGNQIQNLATFVFTPVWIQVFVMTFLGEWGDRSQIATIAMAAGSEYWFVIFGAIIGHGLCTAAACIGGKYLAKKI

SEQ ID NO: 14531 - protein, 243 aa, Candida albicans
  UNSURE (100): Identity of amino acid sequences at the above locations are unknown.
IPHIMSQTPFHPNSPSVPTTTSLPSTDFSQIPYDVLESIRNRLNQIRHSLTKLADQINNHIRHRQKIKLPSYLYFQNQFQVLITQLMSITNQLYNNEDLXRNTNVYPTPIFPTSAHENMLTTLLRKKVAPEVDEWINGAKLIMENETKNKLDNQQVEIDILKIDQWVQWCLAKIQDLRDEFQFYGFHTVEELDHMETPQGKQEIKEKKDKEFEREQIELKITAGGQKSLHPNQVLKFMCQGQI

SEQ ID NO: 14532 - protein, 126 aa, Candida albicans
DGVFWMVFTAILGWTNSATIGSVVSYKGYWIVIILVFWSLIYEQKNGFLPLIPISCQLIIIQNRKNLYQPLYALEIGVHEEVRESMDSLNSETPFQRMIVPVLYFLINVQYLYSMYILQDNRLIVL

SEQ ID NO: 14533 - protein, 99 aa, Candida albicans
  UNSURE (4),(5): Identity of amino acid sequences at the above locations are unknown.
SHSXXLPCRLKTVLARTLGILVGSILYRYGNTLSLKMFLITSTCFLYLVAAGLFSKGVWNFELQRFIDKCGGLYVSETGHGPWSYDIAISVWHVNCCNG

SEQ ID NO: 14534 - protein, 519 aa, Candida albicans
PLLTIYSIMIKFEDYFSIQIFFIILRETLETAIIISVLLSFINQRSHKQEEESTLSTNNNNNNDNNDNNEIENENENAVHPISISQSRKADMNRKLKFQVWIGAILGLIICFIIGIIFVLIFYFVGQDYWSYTERVWEGLFSILSSIIITIMGIGLLRINKVMKLKWWIKLGDAYNYNGQQDEREDDEEISALTDNDILFDGNNNGEEEDIMNYGGTRSSSESNEIITHNNNNDSNFSFSSSSSSNSNSNFNSNSNPGILNNDNEESIPLTASSNFFTPFKNKHQSTAKNSKQLHRQSFSKKYFLAILPLVTTLREGLEAVVFIGGSAMSSSPHSIPLSVICGISMGSIIGYFLYQGGNKLSLQYFLIFSTCFLYIVSAGLMSRGIWFLELEQYVRQCNGLDVSETGSGPGSYDIVKSVWHVNCCNGLTDGWWMVFNAIFGWTNSATYGSVFSYMIYWTMVIIWLKIKLYEERHGILPLVPLKWQLKRIQKRIRLYELRKNHEQEHQGQQQEEGQQEAS

SEQ ID NO: 14535 - protein, 629 aa, Candida albicans
RAVGNTQPRKMPKSPRLSTSTSSGPSAVPNLLGSPRPSPPQLQHQPSSASTSSTTSTATTGGSISATAPGSTQHYLHHHPSRKTSIVEILSSPPPLPTDPNDPIHQLSLSRHASTSSNKSSSQSIAPGSTAITNHAFSLVDWSEIPLTELTESNKLISIHSSHSVQSAFETLLKNNLTSVPVSISKSDPHDLTNCLTFDYSDLNTYLLLIMNKINYSELNVDDIGDPNISPQERHEFVTQTISKAKRGEEVPVEFIIKLHPKNPFIKFNETDTLFSVMETLGNGVHRIAITNEEGNKITGILSQRRLIKYMWENARRFPSLDFYLTSTLQDLKIGSSNPITIYEDQMLIEALHKMFNERVSSLAVIDRSRTLIGNISIVDVKNVTSSKNSHLLFKSVLNFISYNLSQKGIEEGQDQFPIFHVNNQTSLGRVIAKLVATQSHRLWIVDSSRQASSMSSASASAPNSGMNNGVTVGYPAPVDSSITDKAEEVEASSMSSPQLNAAAAAAAAVATGAPTTATSAQPDFSYTSGTGKLVGVVTLTDILGLFATSKGRRTDPQAARNQRRRSSTSTTRSSIDSALSAEGILPSGSAIIGSSNAANTGRRGSVEVSSDVFRKSYTKAQENAFSKE

SEQ ID NO: 14536 - protein, 457 aa, Candida albicans
FIPSYVRFYCTLLYIFFCQITHSSNFESITILALQVKRKNWNISTTLKAEKKNLHTQIIFSSVSHFLVSNTTRSKNATTTLEMSETDHSETSESTIEPFQFEKVMENLESGAQDALQSKDFLSYSTLLDIYLNDPTKYSNEEKEQLLGHILTILSENKQLTYEIGWDLPQLLILYVDSDYEFNGPIRDSPGVYKILKIFENLAINGNHKELFLKSCELLNDLELSQDEDIELLKRENFFEIKLYCVFELIDACLKKIHTLYPSRFLAMTVSSFNNLMFKLTKQHGSLGNYHFVMKRVYSFCRNYISPPLPTNAKEMPQEELDKIVKDEEYLQRRLLTGFLTQVIYLANINGTEGYSIEHFSWLQQQSKSKIKFVFERDGAFCDRFVELASSFDIDLLKCFQGFITDSHKLLIGIDYKNKNKSEDEIIELLFERVVVDYQKNVLTSIVDSDAKPLRIR

SEQ ID NO: 14537 - protein, 166 aa, Candida albicans
STMSRIIHSEDDDDDDVGSQSSSSLSSPSKSLQQDPIPTKIPLSTSIILEKKLPLEQHQKLSNLTEGSTAGGHVSNNSLDNKIMIRFVPIGSTPSIQPRVFKISATQTVSTLNRFLCKKLKFKGVLNLYIQNSFMPLPDEQIGSLYGLFKTNNELIISYCNTIAFG

SEQ ID NO: 14538 - protein, 283 aa, Candida albicans
TFHMSENQQFSVSDSTENKLNYRHAAFDEENNGLLPLANKNLKPIHTLTSSTTTPNHHQNAKKSSHLAPQDRKAFIILVLLYVLQGVPVGLAFGSIPFILKSKLTYSQVGIFSLAAYPYSLKLIWSPFVDSIYLKKWGRRRSWIIPIQTISGIMLILLGTQINDLMENPKNYLTLITMVFFILILCCATQDIAVDGWALTCLSPESLSYASTAQTIGINTGYFSSFTIFLALSSPDFANKYLRSTPLDVGLFSLGGYLKFWGWMYLIVTGIIVAQQAKAGLMS

SEQ ID NO: 14539 - protein, 302 aa, Candida albicans
KENKSWATRQRFLLETMSQTNDKPALHLVPSFYGVYILKSIPKPRSTYIGSTPDPKRRLRQHNGDLKVGGAYRTKKDGSRPWNMVVLVYGFPSRIAALQFAHSLQHVYQTRHIDNDARITSSSRQSSIHLKLANIRLLTTSFDKMSLKIAIFDEEVYRMWIENKHKIECSVPCTLFKFEEFCDSIKEIDIEDAKNVLLSKQLECMECRVSIDYFQDNTPNISSRQELSNYLSKGNYPLIGICGDHAFHLSCMARQHGPSMVPKFVTCTTCGQKLDWSDIIKVSTRLRHYVVQDSLHLAITQL

SEQ ID NO: 14540 - protein, 345 aa, Candida albicans
  UNSURE (52),(84): Identity of amino acid sequences at the above locations are unknown.
HNKRGTSMSKQNIDKSTEHLAGENALSEKNHTIESNKNNIDSEEDDEEDEDXDPEKKNEAENEGGVSSDEEEDNDQYKDGKTSXIPDYSTIESSTSQVKTRSQRLHEKLLNQSRFIGNFEVDSKTGLVKDQSNIDVNSIFENLKNGSPSIDNLEELNIDSEKTANSQQQQKQQSNIEENELQGPKQIKIQINYTFAGKLITETKYVDENSQEAKAYLNSTSNISSNNSNEDIPYRRSQVKVIRTDPVTNETKELRIKLKRPSLIDRFLSINGNSKKMKLSTLEKSRLDWASFVDKRNINEELKIHNKAGYLDKQDFINRMNSKRDDLYLQAKEKEKIRKQQLLQK

SEQ ID NO: 14541 - protein, 399 aa, Candida albicans
GARFLSATWLNMEVDLFTPCLIFTKLAPNLSFSKLLEIIIIPIFYAVSTGVSDWSSRIVSKALSLNSPETDFVTAMAVFGNSNSLPVSLVLTLSYTLPDLLWDDVEDDNTDKVAGRGILYLLIFQQLGQILRWSWGFNTLLRKRSQLELNTYHTKHGKIVLHENCRLIDGEDEQFLYMDSNQQQEEQQTETTREISLSEDEDNINSKPLTAYICQLPGVKQFLSFMNPPLYAMLVAIIVASIPYLKNLIFDREQNSIVYNTFTKAITTLGGVSIPLILIVLGSNLYPSNDIPPPSKHYNRILFGSLLSRMILPSAVLLPIIALCVKYIKASILDDPIFLIVAFILTVSPPAIQLSQITQLNNVYQKEMSGVLFWGYVVLVVPTTIAIVVCSLKVLEWAK

SEQ ID NO: 14542 - protein, 446 aa, Candida albicans
MGYSLSALVSTNPSALSYFDISFLTFEAVLEVVIICCAGFVAAKTGLLTTQGQKTLSSLNVDLFTPCLIFTKLAPNLSFSKLVEIIIIPIFYAVSTGVSYWSSRIVSKALSLNSPETDFVTAMAVFGNSNSLPVSLVLTLSYTLPDLLWDDVEDDNTDKVAGRGILYLLIFQQLGQILRWSWGFNTLLRKRSQLELNTYHTKHGKIVLHENCRLIDGEDEQFLYMDSNQQQEELQTETTREISLSEDEDNIYSKPLTAYICQLPGVKQFLSFMNPPLYAMLVAIIVASIPYLKNLIFDSEQNSIVYNTFTKAITTLGGVSIPLILIVLGSNLYPSNDIPPPSKHYNRILFGSLLSRMILPSAVLLPIIALCVKYIKASILDDPIFLIVAFILTVSPPAIQLSQITQLNNVYQKEMSGVLFWGYVVLVVPTTIAIVVCSLKVLEWAK

SEQ ID NO: 14543 - protein, 86 aa, Candida albicans
FSKEMLELWLDYEQIINLEARYVKDIDKYEMIQTAWEYELQFGLKHNLDQFYTAREAIKTREIGDLCDALLEKRNKLIKELKAQES

SEQ ID NO: 14544 - protein, 359 aa, Candida albicans
KFLLQINLISYTSIMETLPHSKRIEIVKTTLPPCCLRIHPQDTSKIFIGTYKLEDDGSRHGSLDYYSFLDNKLSLISSTATLGAILDIKFNPSDPQMLVSAHSNGHLLIWKFDNNTLELSHDANVHEDTLITSIFFNPNKDSNGSVILLTFTNGYLGLFDLEKLEIDYFDTCHELECWTGSFGEIGQLSNVVYTGGDDSQLIAHDLRTKQQIWTLRRGHDAGIVSILSPNDNWNKTSPNTLWTGSYDDNLRVWDLRVIDKSNPSLISGYIPKIISQENLGGGVWRLIPSPVDNRLLSCCMYDGARIIDANLDSFTVTRYFKQDHQSMCYGGDWSSDGKFIATCSFYDNVVQVWSPDQCV

SEQ ID NO: 14545 - protein, 441 aa, Candida albicans
MSRNVSLPSTTESTKNKRVVSSQLRLAQLESTEANNITSSSSPAKSESELPKSKIPKTKAINRNSGGERKHKSFNDFNLDFSNTFNLTGEETPSYIPRVATRQRESSKDFTKTQISKEELKKAGELTSIFLDTRKLLNAEYNVIDQKTDISGKTGDGSIASKIKISRGTLIRAEKVKTTLAVKYLYIQRIYEWAENHQDNNEHLGVEGVYNPLQILRNRKLRNKYNEHAQAIISMQTIPLACNVFSKHNAHHKHENSAIPGHRKTHWKMMWAIDLNEFVGDSRWRVNYWHELRDAKGNLWFPNHAQTPEYSEKDKSKLFVLRNHKHHGKHGEIEASHKTTENEEDQDEEEESGIDIAIESRNHNGVPSNEGSSSDSDFHKFRITRSKSPHKRKIRNKMKKFYIGGPGSTGNGNTGDSSSSSNVANEIVPTDTTRSGTVFFT

SEQ ID NO: 14546 - protein, 108 aa, Candida albicans
LFYSPETLMLYAPEGIVVWDAQHSFILVVPRNEDSKEWNEEKSRFSPSEMVGGLKVIPKKHTMFGFDIIDPRNENDCYGFTIVGSRFEIRSVERSGKKFKNHSVDDIL

SEQ ID NO: 14547 - protein, 274 aa, Candida albicans
QQPSTFREVTIPIIILNTHFKDTFSSSSNFHTFDSHPLIMSQPHSQQQKDITDPKQLITIYKKQGKFDNQRRLLLDNFKQSETYNNLILKLKLLIENKVKQDPNILMKNKGKMAALIQGEMTTNNDNNELLNIVDKDIQDKIIDSFEFHNLVKNDLIDIKQELLGISDEEIAKIKDQEKLKLERLRMEAKMKDLKRIQQQQQLLNQEKQHQVEKNYKNNFKIKNLASSSSNHRVNKPPRFNFRDSNNNITDTYDKQTSQPTKEKKKDKISFMMY

SEQ ID NO: 14548 - protein, 241 aa, Candida albicans
DQSTINKLNHLTKNLTEKKVYKPLSNFFNALFIPSFCSPLVVMSDRSVNKTDTSTNLGSSLTKTVSPPLPQPPTSIAQTDSAKLLDTDPKIQKILNSDYTIDVLLNRLKESLNTGEEFSKFIKKKAQIEDDHYNQLKKFAGHVRTNMKNNSRNLKNDSLQFQMDKIIQFDESLYGVGNSYVVALNTMYDELTSLIGTIGRTRKLIKDEHKRKEKDCIDAIITAEKAKTKYNHLCEDLDRLK

SEQ ID NO: 14549 - protein, 169 aa, Candida albicans
TWGGIYRISSNQSQVNKLKESLDANFTNYLTIGKDIDPSNVYESEVFCVASLLKLYFSSLRERLFTSAASKSFIETVKSTDEHFIAKKLHQLVFGLPDGAYFTLRSLMFHLNKVAQHESENRMNAKSLAIIWGPVLFNDSSTSAQDLSYKTKVVEELMAIATDIFELDE

SEQ ID NO: 14550 - protein, 312 aa, Candida albicans
KIILVGKINSWKQQEDELSRKVDTADQEYKLKVATCKKLKDEILVIHRPNNTKKLKNLILEMDIALNLQLQKYATWNENLIMNSGVLISPLQSSKASMKSMASDIDNEKDLYQYLLRNGTTGDNKSLIPVDYHVHHSLVKTKDIGKPFLNTTNTPANLKSAAATNRWNNNNGSTASNIDGHSKTSSISHGAGSSMLGTSTSASGSSTVAPGKSNDTFNGHSSSATYASPPSVTESSAPVLYLSLDPAVSQTSSPSLHIKGPKPLSTFQHPTFGASIEDVIQFAGVDNVPLIVHKCIEVIESYGLNLGGDLSN

SEQ ID NO: 14551 - protein, 244 aa, Candida albicans
TMPAKSQQGWEINFNQSSEPPDSQINYDDAIQYWSNTPASVDGVLGGYGEQTSVPKADIVGSSTFLRKLGTRMTCPEGVPKTTIDMGAGIGRITRDLLWKVSDSVDLLEPVKPFVAQMHNELTEVKKRGKLGKIYDIGMQDWQPEQSYWLIWCQWCVGQLPDDVLVEFWSRCRSALIENGTMIVKENIAPFEDIFDETDSSVTRTDAKFRELFERAGFKLIASDIQKGLPKELYPVRMYCLKSK

SEQ ID NO: 14552 - protein, 322 aa, Candida albicans
RTFIIQQRTPSLMWFSKTNFPVEGKTALIVGASQGIGVNLAERLYEKNCSTILVARTESKLQHQIQNIKEKYPESSAKISYAVADVSNYDECTRLWQTIHPADPDILFCCAGSSIPKLFQDLTKVDIELGIDINYKTVINVVHTGFKHALSNNTDNLEPHNFKKRSVVLFSSVVSFFPFIGYSQYAPMKSAIESLSIILRQELSPYNYRVTCVFPGNFQSEGFEEEQKTKPDITKKIEGPSNPIPGDECARLIIDQLDKGYDSITTDFIGWFLGCSVLGISSPRQWGFFQILVSFIVLLIAPIANWFINRDIKNSFKKTKKE

SEQ ID NO: 14553 - protein, 452 aa, Candida albicans
PIAVPSSPVVKISKTWFTNQINFITLLLIIIITTTTKLIKMFTCNTCNLQFPAAEDQRSHMKSEWHRYNLKRRVAQLPPITEDLFNSKVSTLTNTEETKQKQLTKKEQRRKEKEAILEQKRQILEQAKKAMLAKMQENGGELPSLKEEFSNTDSNKEQQQQQKDEDDKDGDKLEEEEEITPEQHEEKMLAQKLANKLEIPPTTCLFAHPKYNHNFDTIDENIEHMFKQHGLYIPERKYLIDKQGLLEYLGEKIGFGFCIVCNYQGRTAEAAREHMQQKRHMRIPYETEDEKLEISKFYDFSSTYDNNVVVVDGDGEEEDGDWEDLSGEEEDDEDDDEELPPVERDAIYQHGNELHLPSGAVVGHRSMARYYRQNLAPDRELSEGQGTVIAAETRHMLTLKDREELATKKRTWKKEKKMEDLNDRRAAKFINNQPHFRDPFSSTYRGWKIQRY

SEQ ID NO: 14554 - protein, 139 aa, Candida albicans
MSTMLARIFKQSSTLCPLRVGTSSIRFFSPPSKFDFQPGPPRLPKEQQEEFEKLQSIANSQIAIEEYNDQIAQQQAEGSTQEPKAPIVNSEIGSFSSLKLVPDFEGEVNPKTGERGGPKQEPLKHTKDEWSFNGRVIDF

SEQ ID NO: 14555 - protein, 350 aa, Candida albicans
PETLQFLRDNNVISRLLREVYFKKTPISVLNKIERLITVLNGIEEINLLELCLPILKKIRDQGNTVLLSRYLDLVNLLLRYLPEFSPHLYSFTKQEFLKYQDDPLFLILLIQFYVKLVRLKAPVDLSLPLSDILSLYDKFDLLVKNEVVELVAQLSFTQSYTDILFKSQIFKTHNLLEVFEKTENSDIRLLSKANPQVIYELNNSIYPDVLAHLNLFTNNLYFPILLNFMSSTTIFYQLKLHLNNEKLSQLPMDKLFKLLLEMSTHNHSKEHLFNNLPTIMSTNLLETEDLRNNELWNLKLEILQNLLNDDSVPGFEFWHQELTRNYELMTFGRVFRNAAPRVDIIDETA

SEQ ID NO: 14556 - protein, 430 aa, Candida albicans
YLISLCLFCQSSISHQMSDNIHRSFTTSVEQAVSSTISEQKALFVYLVTSTYTENTDTFLPKFIDDQTTAIIKSNFILLKLTQNTVEFGYFSQLFKDLIVPSFYIVNEGKIEAVISNDTTKEEFIKIIGKLTKKVKSSDNVSTRENISNENNVVIENLARNNSQSSSDHDKSVRKYQEKVARMRQERIEEKKRLRALLEADQKERKLKEQENANVESKLSVHSPSSRKTSTSSTNSCVLSIKLFDGSTMKCEFKSQDTLIDVRKWLDSEVEIIPPAKSMPSFATTAYPYPTGYAFHRPALPRVTYLEEQESNTLANLDLTPRSALILKPTYNEVDSDKPDNDVGKTGIFRSLLNVLFSLGTTIYSVFSYGINAPHNQEHRDSSPRYDHRDADNLQSSEDDQSINIHRPPIAGHPGLLMFESTSASSLLLN

SEQ ID NO: 14557 - protein, 60 aa, Candida albicans
RRGSIPLIRFLEKCFNAPAAQIPCGQLSDNAHLKDEKLRIINLFKLRAILTDTFKELGMS

SEQ ID NO: 14558 - protein, 94 aa, Candida albicans
ELYLFQNLRKLNHSLNDTINENVANRSSSYSSSSSSKDTTTNSITGNKLSVEIVHQAEPWLGDHENKVYSILFKNLKNHWNQEPLFIREGDQFL

SEQ ID NO: 14559 - protein, 345 aa, Candida albicans
KLNDDENRTEQEQEQEQEQEQEQELLNGELHKKLSNDDMLIMLQKYVAFKTISKNPQLYLEESRHCAQFLCKLFNNFGAYQTKLLPISNGNPIVFSEFKANSTTNGTGNARRPRLLWYAHYDVVDATKNEAKDWKTDPFILTAKEGNLYARGVSDNKGPTLAAIYSVAELYHRQQLNCDVVFIIEGEEECGSIGFQKVINDNKQLISGGSGGSGGNGTTGIDWIMLSNSYWLDDLTPCLNYGLRGVINASITIKSDKPDRHSGVDGGVSREPTMDMMHLLSTLVDPITRKIQLPGFYNDILPLTSSEKKLYDTIAQYLGIKVYTLMTKWREPSLTIHKIQVSEPN

SEQ ID NO: 14560 - protein, 618 aa, Candida albicans
LVLYQFTREMTLPNNTSSNFNIHESEYLSQDRKPLPLSSTPSTENIILTPRTHTPIRLNSPHINMAELAIHNNQKQQQQQQQQQQQQQQQQRLKQSSPLFFSDTKVSGPGTVATMASITTPHCQHHQPQFSTFSQIPNTSSKPTSQLPPASALSSSPLEMPITTTPSYYNPQDLNDNDNHSINNDNNLPRLVHKWSHTHSILCCLASPKNRLLFCGTQDGKILVYDMNTYTLTHIIGNENNNTNTEDHHPHHQLASILTICLNKDESKLFVAGSDSLVKIYNLQKNPNGSDDDKKYQCTHVIYSLVDIGDIFSIHWCDSTSTIYIGAQNASILWCHISFDNEDLVTNGDNKKQPSNGINHKHKHKQSSQHQNNTNHHQQTHRNINNGCNDTKNILDIERLPHFRYDKFFDSKGPGGSQNTLQTTHNLLKRRYSKTTNESKHHSSIKLIECKSDDIIRFAHNGYVYCLDVITNATISDSSESNFLISGGGDGIINIWSFNHNPTIGVKLIKVASLENDESILSMKIQDSLLYVGLSDCSINVWDLLTLQLIRSFQFGDNNFDEILSLDIYDNCIYKGSSSTGLIKLSILNHQFISDKILMSLEIEDGVINAVKIFPLDE

SEQ ID NO: 14561 - protein, 322 aa, Candida albicans
VNLVSDLKPTFMELLLLLQLTKNTYISRFCAEALSFLIRKLNPESLNEIVQFSLFDQIDIILYNDAYCESLTILYSEAMKNTKGTFHSKANVIFSKLMENTLYKVDAKAQPKLISIISDIILDILNHGTVESCDKFYAMVTKYLNSLLQKNDPSEVELLTTCQILSTLAFAESGKKITNWDIVLETVDLLVEKLNSINITTTTTTTKQELLESYIYLLVIVFRNADIQSLTIRHKKYFDSIYNTPGFLTFTEASLSIAKSKVINFGITKLVQNYINNCSSNDSEKLTYFLEKNDISSKLQIPQSLVTRIANEVNQDIESQSF

SEQ ID NO: 14562 - protein, 595 aa, Candida albicans
  UNSURE (1),(23): Identity of amino acid sequences at the above locations are unknown.
XNNFPNDLDKNLIVNYFFGLLFXKFQPSWTAVYESLPLISSTCTPEIWQVAYKLLTLDYTNDENHEEDEDLVNFPFESTLIDWQPRNSRLLNNFELFENSYLAPYRNISEAIDNSLERNAHFDNMVRSHVLSALKTVPSVAEKNAGKLIPIITHQQPTTDEDDGLQFWSRKDRNELLELFAKFKNLRKIPEGEELYDYLLDYLLTSKYVKVQQLALDVLFTWNNPSINKYRDNLKNLLDDAIFSDEISNFIMTNSSSSSSSSSTTSIIEPQDKPIVMKFVIRILFGRVQGSPKSNSKQGKKFAVISVLPSLTNSEIISFIELGANKIGYEGFFSGQIPKASLGLDQSELKKISGFINLLLEVYHTLGANYSESLQTTIKPLVFSLVSAQNRIESTSLVDSIITEKMAKNIRLNGMRCLTELFKIIGDGFDWNDYISLIYDNLLNPRMDTFADENLQQPSAMLKLISFWIGQSNTLPFLYIDEFAATRAILSLLSKSSEAKEAVTITVLDFTINALERKDNEIDEKYFTLLAFVVDSLLQYLPQTIEMIYNKDVGSRAIKVLLLLISGKYIEDHDTKSSLIKSLTIALEKNNNQID

SEQ ID NO: 14563 - protein, 1232 aa, Candida albicans
  UNSURE (34): Identity of amino acid sequences at the above locations are unknown.
FDENDCEFHEIQPLYEIFSKLLKIFAARNVRDTXVVVINTVGNKFKQIEPIAPIIAGLNAYSDRMSEYDFEKRLEAYRLVNEELYTELTPIQWLPLLYCALFFINDRDELVIRVNAGYILKRFVDCYSSKEEPKEYIRLLKDIVLPNLKIGIRKDNEDVQTEYILVLEHIIEHSKYYTDLDDMRVLVGNTRNAATDDDDDEDGEDNFFQSINHIQLHRRQKVIRKLRDYKDDLKDNSISHYILPIIEGYVTTKEDKLRNIGLEALETIGVLLKSVTWNQYKAIVKRYIANLNKAQDTLKQRVNLIVAVSSALAQSVKENNTNLPDQQELDQFVLYEISPPLLKILQVRDDETIVARAPLAEALTNFMLCITKEKIDGELPSILTSTCQVMRSRSEELRDAVRKTLGKIAVSLGPNYLSFIFKELKTALSRGSQIHVLSFTVHYLLTCVATILKHSDLDDCIEIIIGIVMEDIFGAAGQEKDAEGYTSKMKEVKFKKSFDTAEIVASNVSLNQFGTIIEPIKMLLQEMISHKTQVKLDELLRRLSLGLNHNQEASNIEILHLCYEIYMMSKENDDDDNETNGKPKVSAKEQHFLTTLDRKVKKRVDKSLYKQTMQRLSFELLRTAISRHDNLMSVTNLQGFIPLLEEGVKSENETVITASLKILNIIIRLPFPDQGIFKACARRTLILIKDSPSTNLDICQAALKFLATTIRHNPEVTMKESAISYVLTRIQPDLEEPNKQGLAFNFLKAVVSQHIMIPEIYDLMDNVAKLMTVNHSKEIRDMSRSVYFQFLMEYDQGKGRLEKQFKYLVSNLTYPTEEGRQSIMELIHLIVVKAGKDLLNKLASSFYVALANVLVSDVSSRCREMASSLITTILKKLDDTSSMEKYCLAWIKQSTNSLLKRCGLNIYKLIIMARGFGKNKELDKIALDNILNIIEASRNSKDDDEEERSMPSTSTSGGGGDVEWELVYACLSTFSSIASIFKDRIFEYRKIWNGIINILLFPHSWIRLITCRLVTILLSNNVVSESRKYDLETIATKLIHQLRAPSITEDLGTQITKNLVLIAMKWEKESYEWDEKFANDQLLSKICGIIKLEHVHSIVSKKSCIKLTAMFIQFTNETRIIKISEMIISALYNYTDPTYATPDDELTNLSLEALELVQEKIGTTEYTKLYSNVKVNVNIKRQERKAKRAQMAVSAPEIAAKRKLKKHERVREKRKHEKDINGYYKPKTKKMI

SEQ ID NO: 14564 - protein, 363 aa, Candida albicans
SKKKKNIHTNIQLLLVHHKPIELSNIMNEELLSKDPLNKIISKLKGDSTIRYITFNVNGVKTIFNYHPWNQLKNNKDFNTLFNLLQADIITLQELKLTETSLQQQMSQLVHLSDYKSFISIPVTKKGYSGVGLFIRNPKSNENKKHRKHLTVIKAEEGITGWLPSSSSSSSSSANKIPYRESANNIGGYTDIEKLPGLHLDSEGRCVCVELADNTVIFAVYCPANSQCTYEGELFRLTFIKLLLQRCYNLVKLYPKKKIVIMGDINIAIDMIDHAETIELGIKENLLKPSFRGHNFEVLNYENCVSFRTATEARKLLNKYVIRSIWQDLKNEKNPNQKEREKEEPFLYDTTSLHHGLEDTRLR

SEQ ID NO: 14565 - protein, 332 aa, Candida albicans
KRKDNYGNSQDPTIGTEIKLINDYNPIEASKEPLFSPMVPFLSEVSNPKTTALLKKPPKKYVKSSNLMIMPVKFTFVNKKSDYINHIANLKPLVSSTNLELFSSLDSRIANEIYEIGPKILPQPFSQEFLNLANHKFLPLSILTKKLEFQLSKGQVTNYNIKQSHPAKCPNRPNSQGGLGLFRVVPLKKRPTTKLNYSPTNKNNKHPDNNTNNDNNNNKPELDVKNDRYYSRLNIYELSKILDLHRYSIGLTKLIELNVLEMFGNYCDFQLGYQTWIRDTDKEKRRALIQQLYSYTSTFYPEIDSFKLEVIIRSGPLHLGTDRTRANIKASP

SEQ ID NO: 14566 - protein, 268 aa, Candida albicans
FKFRYPNIIQRTMSSTSTSTSTPSFPEPTEARKQELITNYNNTLQQVQSLNPKVNLVAVSKLKPSSDIMALYSIGVRHFGENYVQELIAKSQELPNDIKWHFIGGLQSGKAKDLSKHVANLYAVETIDSLKKCKQLDNTRVKVEGDDINVFLQINTSGEEQKSGFQNLQDIESTVEFLLSSDCKKLKFLGLMTIGSFNESISNENDKENQDFKKLVEMKQILDSKYNLNLELSMGMSNDFQQAIKQGSTSVRVGTTIFGSRPPRQQQK

SEQ ID NO: 14567 - protein, 160 aa, Candida albicans
FVGNGDVYSHEDWYEHVNTDGIDSVMVARGALIKPWIFEEVEAQQYLDKSSSERLDILGKFAKYAIEHWGSDEYGVGLSRRFMCEFLSFTHRYIPVGIMERLPPKLNERPPKWVGRNDLETLLASTDYKDWIKITEMFLGKATDDFQFTPKHKSNAYENK

SEQ ID NO: 14568 - protein, 475 aa, Candida albicans
SHAEVPRIRNTLTGSFKPTSSFGQSLMQQQETRHQSLSSNLASPVEEKKQVQSLSTGERAVSPQPQQQQKSVNYEALRSVPPPPPPPSQTQPSLQKRDSAPVPGAVSSPNPYTPSSQQPSGERSLSQRAPSSSNDDLLADPAISGQLSQATSDIANVSNQIKSLTSQTTNLHEKKTRAEKELQRILITKSEIENKLKQLRASYDNEVIQVEQVEANLATAKEETEALRSEASIAEAKVNSLSGELHEKQVAMESLQKENSTLKEKLGSLNAEIVELEKQAASKSQETHALSNQVAVKKSQVQVAIVKSEELKSKIAEIEASHKQLQLDLDNAERERLDSENRAKELHAKSVELEQNKPTKPSAGITATIGAAAVGAAAVVGGGVASVVHHLSAGSTESSDSGSRNDPVERSVKEETESDNDVEETNARFPQLQVSEPADNATNTTSSNITDRATDDEETPITSVFTHRGWKEPRL

SEQ ID NO: 14569 - protein, 445 aa, Candida albicans
YILTSQKIATPTFKVGLTPEEKKLYTQLFKSLDPENTGVVTGEKARTTFEKSGLPPSILGEIWQISDLNNLGFLNQFGFCYAMRLIGYTQSGQHPVPGLADVPGPLPKFVNLSLPQQNILQLQSTNSSFMSSQPNASIPQSAASQDSFAAVSPNDYQKFSQLFIKTVGSAQGDLDGSRAKDIFLKAKLPTTTLGQIWSLVDRYNTGKLNVGGFVIAMYLIQGLLSGHIKQLPPFLPESIWKSVEQPQQQLHPAIAAQNTLQSRQVSHSSINSQLTAIRHPTTRDVSSTGEWIVTPAMKQQYESIFNNLDKEKKGRLNPDQVASFLMTSKLNQQDLALIWDLADIQNSGFFSKLEFSVALFLVNRKIAGKPLPNVVPDELLVSLKQETVTSHSSTVGSSSLEFQPQHQQQQRQVSDIQNNSVPVQSQSIAKSKSSINDLVEYFWEF

SEQ ID NO: 14570 - protein, 144 aa, Candida albicans
DEEFAQENDEFGGLSEDFTNSNAPDFSRPEESSTAPLEGNDEWEQLFAGFGNSQPQQEEQSLGDIPASGSARVSEPPSSVSAPLTRDPPRYESPPTAQPTRTSSNEYAIQELVGMGFDENTAIEALKKEDWNLEAATNYLLDTA

SEQ ID NO: 14571 - protein, 242 aa, Candida albicans
LFIMGLKCTNYFENSKYESPNIQIITCKGCSSHLCLSDLILSDNFNGASGPAYLVEDLINIEFNLQSEETPMKTGVYKINKVKCHQCKNQLGWYYKKSYSFAETYKEGKFVIERKFINFTDNLTTTQLLTERALQNKFKRRYSNNSTNSSTSNTSNSSTISNNSISDLEIDESGSPQHESFLTKEKFKLLNRRRSSGTNGNINATLLNHLRIPYHSIRNEGRNGAEEVEDDDDADEDLNSRV

SEQ ID NO: 14572 - protein, 349 aa, Candida albicans
QEVYIMDFRNLSTTPNQMDTVMQRRPSLSSLSSASGYSSSNYGGNPTPNPNNSNTNNNSSGNSNNNTHGNNTPKLSTQRLTNNRNLQSLWINQPSIAPSNVVPWVEQQQQQTLDLLENNTKTDSSNDASATNNNNVNANANVNANVNANANIHAQTHVNTNVNANTTATSINASTISNTTPSINDTNDNAKKINVSMISNNNNNNSNNNNNNTNNSSTGNSNIVNMLPSVSNATTMNNSNSINSTTNNTTINEADDDELIPTAIVIKNIPFAIKKEQLLDVMTKLNLPLPYAFNYHFDNGVFRGLTFANFTSTDETSAVVNQLNGREIGGRKLRVEYKKMLPAQKRKIF

SEQ ID NO: 14573 - protein, 175 aa, Candida albicans
LSWIMTSQSNLSLIAVGVVSFVTGYNVHQMLKHTSPKRFQLKRTSATTTTKSYNSEDNSEDEEEEEEDEGLDINSLALNEIPGEVSMTLVVRQDLKMGKGKAAAQCSHATLALYKKITNPQLESYNPELVNRWELGNGQAEMTLQVPNQEEMDLLYAKAISLGINFFTTGLEGPQ

SEQ ID NO: 14574 - protein, 133 aa, Candida albicans
HFRGCYSLIEKRQAEAARIAQRFKDRVPVICEKVENSDIPEIDKRKYLVPVDLTVGQFVYVIRKRIKLPSEKAIFIFVNDILPPTAALISTIYEEHKDEDGFLYVLYSGENTFGEKLAIDISSLDFSDIPDYV

SEQ ID NO: 14575 - protein, 341 aa, Candida albicans
TGDSNRERKSLSPTVLIPLLPPPPLPTSPTIHNTHKSNGTSNMLSSSSKPKFAFNLTINDLTNVPEINGSCYIELQIRDGTRRSFHTSNINNGSSGSNNSNSNGKNSQKSSTNTSNTNGIKSTPMTTSRTFLNKFDEFASSLGSSGSKGNSSSSSSSSAVSGNISASTSRKKLHNFKCNFNYKLSCNLKFNIKKKGNIIANKYLLLKIFYVNNDSGIVGGGKSNNSTSTYHHHHHTQITELGKVDINLSEYLNFDEPITTKYLLNDSKVNSILGVTIGLNELSPTFDFHTQLQIQDSNSSISGGSTSISNNTNSMLSRPTSTTTSSRRNNFNVPQFEPKQY

SEQ ID NO: 14576 - protein, 200 aa, Candida albicans
VSFTPSKMMKSILGSGLINNIAKSSLNKSVLRPSYTPIRFNSNNANLDQLKSIFNQLNEKSTTTNDSQTKSTLNIDDLLSNSILETRERPQSNSFGVYDKFGFEQTRQPTPREVAKNIREFGVNAGRTVDVSYNNISRSFAQVKRVVNDNKIRYLQRIQSRFIRPAKYRKQLKREWWRRRFSQGFKELLHDVNDARRRGY

SEQ ID NO: 14577 - protein, 175 aa, Candida albicans
TFWSCQLSKCDYQKNFGCGSLHTNKKSISIQTSKGCYLHTLEMFRSLVRKTTPLLAFGVGIAAFPKDWRKGQFGDKKLLVINDSVLEQIRSTDRYKQLVNDPNLKHYNSSHAFPDQHHKNYVNTGLLFGPDLMEIDPIVFLDEKNGELTSFYHLGDKLISQDGQIHNGIVSTILD

SEQ ID NO: 14578 - protein, 660 aa, Candida albicans
LKLFLIHPFNQLIIMMPQVLPKKRSEKSDERRISTSSSTNSSNNHNHTPNRPTPTSNRIMANRKVLNRIMSARHVSRSIAEDADTSNSFDDGIGFNENKHTIMSNFEEWIKMATDNKITVKNSWNFDLIDYFHDLNVIKDGESINFQRASATLDGCVKIYSNRVESAATETGKLLSGLSKKDDGHHGNQEAGNGDDDENGENGDDDRDGNDEDSRKKRKFNRIVESTLVEFDAIKVKKLEQELAIDPLFKKALAEFDEGGAKSLLLNTLNIDVSGRVVFDATSNPIQETEDANQIETDSQQVQELQTSDTKQSDISSLKLFLFKDNENFDDLTLCPSLVEFQSALADVNKAKSILNDFNSKITNAAQEPLAFKESEENNDFDLGDFNDFGGNDDFNDDINTHDNSSHNDPYNNIDNTIMKALFNDKTDSSIYSRTQSTAIMDQDLMAYFDDRMKSNWRGPDNWKVAAFKKANNIDQKQSDSSVKQESSAQTSTARRKPENIIIDFFNDDDDVDEDILFEPPKSLNSILKKGNFKLSDYILPDDIKYNSARLTNLFTKPQIAIMYYGNKRLLGIDGQLLTDQNYLAEQYGRREEDDRDRLANSFHQAECEDFDNDFGDNHDFGGVDFNDALEADVPEVATSETQSVMGKRRPEYVNFFRVA

SEQ ID NO: 14579 - protein, 480 aa, Candida albicans
KFEREKKKNGSTFIVKPFFNHTTVMLEEESQKTIGIVGAGLVGCLAALAFAKKGYDVTLFEYRPDPRTVDSSKRNLRSINLAVSSRGIRALQYVDPAMADRILEHVIPMKGRMIHDITGTKQESQVYGLNGESINSIDRSFLNNCLLDELDKSNVKILFKHKLVKLDTLNACRMTFIDGHNDAKTSTFDFVVGCDGAHSQFRYHLQKTMRMDYSQKYIDMQYLELYIPPSEDANNKFSIDANHLHIWPRHNFMLIALANKDGSFTSTFFSPWSVIEGISSSQEFVEFFRHNFPDAVGLIGEDALSSAFKSNPRGSLMQVSCYPYSNGKGIILGDAAHSMVPFYGQGMNCGFEDVRILMELIDTNNGDIEEAFKQYSAARKNDLDAICKLALDNYYEMSSKVVDIGYLIKKKLDYTLGKIFKNKWLPLYTMISFRDDIPYAKAIEIEKRQNRIMNNVGLGVLGTAAVYGLVKLGQYWNRRQ

SEQ ID NO: 14580 - protein, 253 aa, Candida albicans
KMWLSSVIKFNVLERIIYVSKNLSREYDYDSEDPYCIHPVSKENKVRERVVSLYELKTKAKQSSGGHLEAYKQEVMKCPENNLLFSCYEVENDNNNGNGNKNVKQKNKDQPMIATPLDINVSLPFLTTMSDSLIMTSAIEEEGSDLPHTSRRGSAVSMTDNNTTPSINNNPLFPFLGAVETNGASINEIGDHTLFPDSNFRHIEIKHRLQVTFRISKPDLDNKMHHYEVVIDTPIVLLSSKCQEDSPPPYSSV

SEQ ID NO: 14581 - protein, 70 aa, Candida albicans
KHINEVGDHTLFPDSNFRHIEIKHRLQVTFRISKPDLDNKMHHYEVVIDTPIVLLSSKCQEDSPPPYSSV

SEQ ID NO: 14582 - protein, 572 aa, Candida albicans
FFFSLILLQGTTTHQTLSRDSVITPMTGTITRALNWDNVYEQQFIAVTPMGDEVLLYQTNHEDPGIESNSMLKLYSRSGFENIQCSSYSDINKGIVGVGSINGNISIFDIYSPNSSILSLRPKQNRPCNSVSFGNQNLVVAGFDKGRQDNSLQIWNIETYSSSGNNGSSLKRPLATYLPNEAILSTVFYPDQNSNIICGSYKFLREIDLRLDQPVFQMATKCTLGLQIDYFQNHLFQSFSEDGSLAIWDRRKLTSTKHRSTGTNNVITETPILQFTKLLSDASSRKVQHPCVRYSTVRRGEFASVFNGDLIRRWQTDIVPESNDMCDSFKAKDSSTLQRLKQQAVQLYNPREESVFMSLVLDTKTDYEKVVSFDYSPDIASHTSTNFVCMRQSGTVFRMPVVESIEALDFNPINEFSIAGPEGTVTNFLNKQFLETDQSTNSQVPGPRDRNGSSFMKLGDLTLNDNLKNRHTETATTSTVDDESLAQLNIPEDKRYSYDNVFEEDIPLNKFWDSSDIVGNDICVTIRKRAQMGYSVDCDKNILFWRNYIWLILLCFKRNLGNWLALPKKSLD

SEQ ID NO: 14583 - protein, 446 aa, Candida albicans
RQVRLLFASLAKTTETLGYRPTKDYSDCAVQHANKNAKLLDISGRVLGSLNASSTFLPTSLLQIEPPEPISVIKMSNVGFGAIGYKSGRLVVCDITRGPAVILNLENIKEHLVSVQGNCYPTSIEFSIQEYGNDGYSSIVLLVGTNCGGNLVTFRITPMGNGGFEVVFADKTAHLNYRTTDASGAEGSCISQIIPINSVTGESAVANMSTFNKLSQGIVIPAYVIATSDREIRVLKLPKQKLSHKVVEDFCLKCSVVNYHNKGIVLAILVKSGFVKLCSLPSLSDIANVKLPKEVYAQVKESLESGMATQSDLLRSGELFVRYSKTESVYITTNEKTRHKDDTNTDRLFNENAIIPPRPTASTLLWAKGQISYVSVDDLAMLVAGPNRKPPKNTESQLAYNISPEANPQSNYGGYNPQKGRDSDKGKSSTPYDQPSYRRAGESTLA

SEQ ID NO: 14584 - protein, 195 aa, Candida albicans
AHDDEIENPDVVQVDLARAVGRVANVEVTDMSVSGSTGEYSVGLKSGEVVVFRWGSNGNFGHEEPPGTNAGAGKLTRITHRADPGLKQGMLPLILLNMQQGPVTAVKHSHVGFVAAGFQNGSFVIMDLRGPAVIHTAQVSDFAKTSKRGSFLKHRATESTAPEWPTSIEFGVLTLEGEGKIYPLELWVQADTDRL

SEQ ID NO: 14585 - protein, 184 aa, Candida albicans
IEAMPTNQPTKFEVPVDLLTPESCISSSRIRAFLKRSRNLTDDTIRPHLNEIEKSKCSQYFEEEIVPQWRVRGEIIDYCSKYSQELRDHTSQGKTVTATKLSYDLPNAEEMTDKFDLRTDPYAYKTYQRRIDEQYAQCDALDNWTQNEKTVEQIIRQQTVEVLNDKCFYQDWMQAFKRASNPKK

SEQ ID NO: 14586 - protein, 130 aa, Candida albicans
TQVRSFHARGEKHHYWNVGFLKYWTPNNIPNFILVLPVLIFNIYSLGYMYQELPKNRKLLPLIVINGLIVVGGTFFWNIQILNRITSFSPLIYWTLAYNLKKPWAKYAIGYCIVWNFVQTGLFAAFLPPA

SEQ ID NO: 14587 - protein, 242 aa, Candida albicans
FLIYLLRYISLQGKRRKDNMVHIGFQKRESLMITGVDLIRRDEFSASYWDNAGGARWAFFAIFVILIIIVLLGTLRVNKKRARQGLQPVYGTRWMTPPSYGQSQHQYDQPDHRRDPDLPSAYVPTYTATANEYDMGYYDANGVFHANPNAKSPIPQPPKVHQRSESTTVTDENSHNTPGGAPIASNLPHDLTGNNQHVDDNDSIGDFYRPPQGPPPNKSLTSTSPEKYQYKCKYRDKPKSYF

SEQ ID NO: 14588 - protein, 201 aa, Candida albicans
SRTNYAMELRGLGNHREASYQLQIAANEPYNYPRAMFLYAMALKFGQGVKQNYRHSIKWLTKCILLSSLHITLANISVVLEKLNALTIEDLIKLIMKNLTNTVDKDPHKNGQDPLILYPIFKALTKNQIAKVINISKIKGDVVAASYHELGNYLINGWGVTNKDETNGINCLSKAGSMGYIDSMVQLGEISVSSNAEEHQS

SEQ ID NO: 14589 - protein, 187 aa, Candida albicans
CATLNCFLIFHPFLLNRYIQIYIQLHLFPTSMIQYIKGDLFTHAIPAGKKVILAHACNTHGSWGGGIAAVFRKKFPKSNNEYSQYCHKNSNLLGTSFIIESDQPNILIACLFTSDFNQTPEQIVHFTKQSIADLARKVSDYKEVEKCDGKVAINMPKINAGIFGVPWEDTELALQEFDNLHFNVYVI

SEQ ID NO: 14590 - protein, 267 aa, Candida albicans
  UNSURE (19),(47),(90): Identity of amino acid sequences at the above locations are unknown.
KMKILCSPTNLCTTVHTNXNTQQRSLRKKNTRIFFTKSYLISFKSNXKYIELIDYNMAPKKKGVVEKPVLLGRPGNNLNSGIVGLANVGXSTFFQAITRCPLGNPANYPFATIDPEEARVIVPSPRFDKLCELYKPKSEVPAFLTVYDIAGLTKGAHAGEGLGNNFLANIRAVDSIFQMVRCFDDADIIHINDEVNPIADLDIIKDELRLKDIEFANTYLEGVEKIAKRGGQSLEVKQKKEEAEFVKKVIQMLEDGKRIFTTEWKEP

SEQ ID NO: 14591 - protein, 408 aa, Candida albicans
TLLSRSAQLGICYSMSSTLSSKVEPLKNWLNKNSFWREDLIIKESPYGGIGVFSQGPIDIEEDPLLLRIPKANLLAPKNSYIYNLLVDYEPENPDIILSEGMFGLVLTVIYELQCHDSSPWFEYLQTIDFNNSQIPVCLWDTVDKDNSKNTQLDLLNFLDPQELIDFYVEAIRFAHKNLDTLPIPSILNIDNPDLSPKLLSEKHNDKLIEFGKVIQSVISRAFLIDNYYQLALVPAADLFNHLSPKTKDGKVIDRENIHFVCDGTVCEVCGEQECDHEEEGEVVDDDDDDVDNIEQEPRKSSDDSESITSISMDYIYEMEQDELSDADTDVDPEEASTLSMEEEIAVNGADHDLANELSDSSKCCDVVLIREPQEQHEFEIFNSYGNELSNAQLLQKYGFIDMDDNPQ

SEQ ID NO: 14592 - protein, 198 aa, Candida albicans
SNYLFVSLEYIFFTPLSILFINSIMSLTITKDNIFPKGYRGRLTEGVTYDERNNTLLWVDIIQGEVHRVFVDNTNINTNSSSSSHETLKWDSSNESIGAICLTNDPNKLIICSKYGLAYGDFSSSTIEYFFKYPHTTNPDEKLRLRSNDGIIDPWGNLWIGVMNDFPIGAKEGIQPEGKLYRTGSSPRDWTDPPLMLA

SEQ ID NO: 14593 - protein, 194 aa, Candida albicans
IFSNIYPDEHNITPTPQRERGRQHETLSSLIDSFLHRSDRESTTFMLSASNEEAIASALRQLSESEGSTLAQSLMDLLGEQKTSKGVTDEYLDTLERIPVKQITDKDASCPICTNRFKDDKHPLIVRLPCGHGVNHIFDLECVGPWLQMNSTCPMCRTNILEVQANRRKIIDEEIKKAQEEDSEEEEQGWDIYG

SEQ ID NO: 14594 - protein, 308 aa, Candida albicans
LFFLYMSTDIFSICAKCLGDESRIKMIKQVNGDECRQCTRPYTIYRWGNRKQGNKTIICITCARARHCCQSCLLDITYGIPTDLRDTALEMAGLEPLTKSANPTNREVKAIMADKLETKFKEQQERSNDILSKLAEKLNKPEEKKTEVAIDVAKLAKKLPFGNLLDVQKYPDMTTFFVFGFLSDFPQAIFSRYAEQYGKVESVVFSSVSGCGFIRFEKVSSAVGFAKSIAENGLNKNKSIAGLLILENTPMRVCFGKQKPLPRTAADQRKLNTVVTKVMKQLASKSKVGVVVKTKPNVYKALLEDYEE

SEQ ID NO: 14595 - protein, 276 aa, Candida albicans
DQPMLEEEVHDTSSEASEVFTNQPNAFVRGVRSIFGYRKTSLTLFVILTIVVTAGLSFYDNSLELTIELPTSQLEKEILESSWLDLQNIARYPHTYGSRANDQVHDYLEEIIQDMEYDNDGEKIMFELGKGVVSYYESNNLLVRVNGSDGTLPALLLCAHYDSVPSSFGVTDDGMGVASLLGVLRFVAHNQPRRTIIFNFNNNEEFGLFGAHAFVKHPWFKQVGYFLNLEGTGAGGKAVLFRGTDYGIVKNFGGVRYPYATSIFQVLAPRGLEDPR

SEQ ID NO: 14596 - protein, 208 aa, Candida albicans
CESQIVMSNAIDFGVVDDSEEPAVYTTFLPRPISALARVNLVLHEHPVVVKYKTITRVRSGDEPLLSGEEERYGTEDERDTEKPLVEHNYDWSLQYLLIVPISSLVVYNSGWLVLEGVNKTVQESLASEHLIYWIVVVFSQFLVLPVVPFITKFNRYIVLGLLVVAVVGVSMSMAVHPFNHRIPMKLRFIEKISHNDMVDVYGRQWSV

SEQ ID NO: 14597 - protein, 186 aa, Candida albicans
TGVDWGNTWSDQRLVTMIEVSFVYWVVLVYVTWSGGDHTGEFGVTVLFFVQASTSLLGLIGWTFTRVRGGDEPLLSGEEERYGTEDERDTEKPLVEHNYDWSLQYLLIVPVSSLVVYNSGWLVLEGVNKTVQESLASEHLIYWIVVVFSPVTWCCLLCHLLPSLTGILSWGCWWWWWLGCFLTPPG

SEQ ID NO: 14598 - protein, 101 aa, Candida albicans
CLSCTRTNSHGYSGEKGNYIYKDRNGISQLELYKLDWNKEYLVGFEWLPDIDDEGGMQVEVECYWGVMVPAYQEVVHYSPNWVTWANKERGLVGVVKHVDV

SEQ ID NO: 14599 - protein, 214 aa, Candida albicans
  UNSURE (15),(19): Identity of amino acid sequences at the above locations are unknown.
RPSSPWGSIMEGWPXGLVXIYGRQRFVEDVLLDLPLVKQTQAKLECEALPDGLEVCKYKSGLTPGNLTVEVTTEPRAESYGLISGAITIAAPENRMCTVHFPPDRVKAVVVGKFGNNFKAIPDGFSTEKGNYIYKDRNGISQLELYKLDWNKDYHVGFEWLPDIDDEGGMRVEVECFWGDMVPAYQEVVHYSPNWVTWANKERGLVGVVKHVDV

SEQ ID NO: 14600 - protein, 385 aa, Candida albicans
LPPPPPLIMAPPHKNHNFRPENVLKRAEDLIAVGQKEAALDTLYELITSKRIRYLQVQDLEPIASLLIELAVELRKGKLAKDALHQYKKNIQLLENGLESVQTIVRKFIDLAEKKLDAAQTKADIKIDEEENAAAAAAAATSSGGAGAGGDAGGAGAGGDDDLETAQTPESILLSAVSNTDSADRTERELVTPWLRFLWEAFRAVLDILRNNSKLEITYSAIVNQAFKFCLNFNRKAEFRRLCELLRTHMQSVTTQTTTKTSGHNAIDLSDAETVQRYLDQRFAQLNIAVKLELWQESFRSVDDVHSLITACTKAPKLNKMANLYENWQKIFAVSDNTLYHAAAWNKFSILYSQSLLATDEKIEKICFSLGFIHFINPTKSGSRC

SEQ ID NO: 14601 - protein, 306 aa, Candida albicans
LLMKKLKRYASVWVLSTLSIPQRVVQDVDEHKSKNSKLSSLLNLTHVPTREGLIKSILSRSILKYVDEPIQQLFELLEGGDFHPLSIKQEISQLFQIIESDKEFKKYIPTLTEVILIRIFQQVSQVYDAVKLDFLISLGIFPDLEYSLSELQVEDLIVNAVKDDLVSLTIDHESGVVSFKSNPFDEIDQEFANAGTTTTNTLTTTTTIGTSRLQISPAELVRIQISNLAATLSDSIYLIDPNYEVCQQQVKQQALQRCIKDMVNEQQRIADRSKILKDRKVAAEKRKREEEERQAPVFTTRWKIRV

SEQ ID NO: 14602 - protein, 249 aa, Candida albicans
RKMKNVKLLKEINAKGIIKIDLNNLKELDTTKLQLMQIEQLNKDKKELETKLQATAKKADHLERAYRRYELNLLEADLEIQLDLEKKDYEFLKQSKINKAKKDHDNAIELKKRLQRILPDYSKFKSEIDAKNEVKLKQLQKEAQIKFEKAKQERIESVKKHRIEELKIRKERERKAAAEEAARQAKAAEMAKLKEELRIQKEKDEALARKRAELEAAAAAAAAPSSSPPPKKTMTFAERMRLKREGKLP

SEQ ID NO: 14603 - protein, 259 aa, Candida albicans
LRMSFRPVGEDDDAYELRDEINKEEKLWILKPSMSDKGQGIRIFKTLDQLQEIFNSFEENDENEEDEEGVDEEDNGIILSQLRHFIVQEYKSNPLLLSKYDHKKFHLRTYVVCVGDLKVFVYKNVLTLFAGEPYKLPGDEDEVVSLAGHLTNTCLQENEDPLVVPFWKLQGLADNDKNIVFEQICDITKELFKAATSVDKMNFQPINNAIEIFGVDFLVNSDFSVNLLEVNSYPDFKQTGDDLKEIIYELFDRVATGIS

SEQ ID NO: 14604 - protein, 260 aa, Candida albicans
FSFILFLKFSALFSQTTPLLSITTMFTKTLKYIILAFLISTHKTLPFAYVIRFYYQAFRGFFAHRFHYNATKKNSFGYDSPKDLFTWVTLNSYVTPLEIDMYMHKLNSTYFLDLDIARTKLLTRLFQTYWWSCYDNENGKFKKSHTLANVPYVPVGTVQCQFKRELKPFEKYKISSRILAWDRKWLFVISKFVTAENKVNAIAITKYVFKVGRLTIAPEEYLRHCNFLNEENERINEKNFQLVKYLVDTEDIEKIAEAVT

SEQ ID NO: 14605 - protein, 140 aa, Candida albicans
ITTEGLFGISSFIRNFQPGYAKLKKLQGLKLINFDNKNNKYQLRILSLISSILSNGLDDSLKAQFKEAKLPHYLASVLNEDSNTSLVDKSLNIVSQLNQLNYEFSLEEKYEINRGIQVVEGLSEKLNIDDLNNAKQATSS

SEQ ID NO: 14606 - protein, 615 aa, Candida albicans
LLRDIIETEELITRDIKDNINQNQKNILQLTKDLKETQEELIELRGTTKELYEVLGYFKESAQRRLELEFEPETQKELHLPQKSNQLGIPSNKKKDRSSIMVLKKMWDSQLQSLFKHVDGASKFVQPLPNRHIVAESGRWFEVNVGNWKPSYPTHLFIFNDLILIAVKKSSSSSQEPTTGGSNGGSKSRLQAVQCWPLTQVSLQQIKSPKKDDDKMYFINLKSKSLSYVYLTDRYDHFVKVTEAFNKGRNEMIQSERLLDSRLSSPSNNNGDSKEEKRQLRESLRNSGNYKEGVTDDAGGAATGGGRKSAGTPNRNSTDYVLHDISARVHSRNRSQDLGNNFKLANNGKSQFFNEIKTLEDRLDDVDVEISHNQYAEAVELISIIESKLRNIENALTNQRNGGKNVNIPDELLLLDVSKLKIKNRKENVSNGLIFDLQHNIAKLKQDDIDNILTLFDNLEQLDRGVQGYLDSMSAYLSSTVSKLIVGLQGSTKIDVVNYLSNLMVINVSIVKRTIQTYEQIIAPILKRHGDVDSSGLINWCIDEFTKLCKQIKKHLYGTLLISSGINMETDEPIYKVKERKLYDNFLKIMQPQLEELKLVGLNVDYIFDSILNLE

SEQ ID NO: 14607 - protein, 475 aa, Candida albicans
SQSQPSSSQSLQQQEDSQQLPDAEDIESTNNLIDSLTTQQQQEQLFNKLQQLHQLRNQDFVSDDEITQSHITDNSTYYGPLHDKFFFHSQSQPQHHQHHHQRYQTLSQQQNKLLLSEDGSNGIDSEQNTLCPVIHNGSSTFNLAPENADQEHKHDIELQLHLKQQQQQQEKEAEEEKRRRQQQQERELSLNNQVRKGYSLDYFDQFNNVHNGINNYQASVFDNRYLQPNSLFIGEQQSGKASFHIKVEFKTVDLFNSMITGFLQINGLTDKDSEITTYFKGEIINNPLNHFILRNNNIEGDSDVGVNSFENPSIQKYSFVTENKQWGSFAKNDYEHWKKLTQSTTFLSDEELIKRLEKVQRGEQDDQYIYMRWKEEFLLPDSRIKQITGASFEGFYYIVLNIGGGGNNNNGRFGKGRSLSTSSSASSSSSSSSLCDGLLPGGISGLYYHKSSEKFQSLSLRHVDDKVDVGTFDFV

SEQ ID NO: 14608 - protein, 198 aa, Candida albicans
  UNSURE (31): Identity of amino acid sequences at the above locations are unknown.
HSPSPKAMNPAVSNIVIMLVLMQVANKLDFXDPIILFYTRAAYLGCQALTFLIYFLVRYKINAKNDLTTLKYVEPANPMSGQTEPRAVVTTVKEYDLQQVNQQIKGIFTGLAMMSFMHLYMKYTNPLFMQSISSLKSALESNIVKIHLFGVPASGDLKRPFKSAPGFLEALTGAGGVQTDKASVESAETAGAGGIKQD

SEQ ID NO: 14609 - protein, 74 aa, Candida albicans
CGSFQPPWVKKYPQKPIIINITLLNGHNLFQTATINGTILDNDKWVNRKINTVIIFEKSSFYIGQKLRNNMKSL

SEQ ID NO: 14610 - protein, 250 aa, Candida albicans
GFFSPFELIGEFPSTKLPIPLIRIFSSQPWPCIDVEITPRGGIEAYPSASTQGQASKRGGDSSKKLVEWLKLDLYKLKLQNVHALEIGCLSPYNAISTSSIFDDVVRIDLNSQNSLILEQNFMDRPLPQKESEKFNLISCSLVINFVPSPKERGEMLLRITKFLKKPKHAMSALFLVLPLPCVSNSRYFDNEKLIEIMTALGFTQTFSYEGNKVVYWLFDWNGKVNLKKKIPKKELHSGSNRNNFCITLA

SEQ ID NO: 14611 - protein, 339 aa, Candida albicans
IILLIAFTMIAPPPAPIVLDSQSVSGITGSISIACWIIVFAPQIYENFKRKSLEGLSLTFIVLWLAGDVFNVLGAVLQGVLPTMIILAVYYTLADIVLLWQCLAYGDGKNPDLIHLSPANPLNEDVLETAMSNEERHNRRRNQGNTTEDLESSTTSVDSSISKSSSSQFQSFLINTLMVTLVIASGVIGWYISYIKESKHHSKHPGKHNPEELIFDPLAQIFGWLCAFFYLGSRIPQIVLNYERKSCDGISFMFFLFACLGNLTYVISILSIDMSWNYLWVNSSWLAGSLGTLGLDFTIFIQFFLYNENKDDEFSEYESSSETELESLLTSSDRSYGTA

SEQ ID NO: 14612 - protein, 355 aa, Candida albicans
NKDKVIKQKKMLSIVYNMLTTAGSPITTIQPSTWRTQISGVMGSTSLACWIVLLMPQLIEQWRLKSAEGIAIGFITIWFMGDIFNLIGALWAKLLPEVIFLAVWFCIADFLMIFSYVYYTKIYPKHHHQHHHHEHGQGDNEENHHHHHHHHHNKRKSRGNDNESSPLLNTTRSRSSSTGHGDSTHKRTRRRSSTLTDIALEPEYHSIFIKYILPILFVIGCGTLGFFISGTSGENNSPDDNTPPSPPPSDDIIAIGPQVMGYCSALLYLGARIPQIIQNHQRKSVHGLSLLFFLFSTLGNLTYAGQILFYRNDSQYILLNLSWLLGSLGTIFEDSLIFLQFYMYRDNNKDEATVE

SEQ ID NO: 14613 - protein, 98 aa, Candida albicans
RKLVCRAFYNPPLDISQLAGYYCSPIENKILYVDPESLSENLSQRFKELFELDKSWNYDEFIPFIKKFVPAGKKVDSIILKYGKKKKVGRDRFIVCPR

SEQ ID NO: 14614 - protein, 166 aa, Candida albicans
HLIPLSKMSEYSVYQQLNEDTNATKYTYKLLQLPSKILNQLESKSTNLYIKSDINSLALCTDSETFKLRQMNHSNTVLLLNKEPDNKLIGFQKTSYEYELTEIKGSIDTSDIPIFNGQTAQQPIDLIALEDNSICSHQEFLSNWYELGGCEIDNGAYIMSADIITE

SEQ ID NO: 14615 - protein, 289 aa, Candida albicans
ILLIYNFTIMAPTEIKGFYVLPLKLTGTKSIHYIYFKKHELKGTANDNRSLFICNLPISTDLSTIKKFFQKVAIGSTIELFINSLLTDYPEDIWINLTKLTSDLDLVDAVDEQASKLPKNCGIVAFIDKASFTLAFNSLKKLSSSLTECEWPIQQFTSNYYLKQYQKQILDPNSLTEEVSQALIDFDKAEQQSIEELQLQRNLVDEDGFTLVVGSHRKTKAGILGKQKLASTVGVVKAQSKMKSKEKQDFYRFQLRQRKKEEMNELLNKFKLDQEKVRMMKEKKRFRPY

SEQ ID NO: 14616 - protein, 469 aa, Candida albicans
LHKMPLFSDHAYTSITIKINQLADPKRNDEIDDSIELYLSDLIELIKVQSNSGAVEAARAIRKKIKYGDSRAEQLRALQILELLVLNGGPSIGPIIARDDKLLDVLKGIINGTARTGVGVEYDCKVQKRVVAMAIGWKTELDGLDGYKYMQSLYKAIPRRKRVSSSHLGHRDRDVHDNDSDENSEDVLDPYADDAQLDSHASNRNVSSPRTPRSPPPPRPSTKSPYASGKKNDDKDKKKNKKKKKKKRGLVYADEEFEIPQINYKVEAPKIRELIANCYTHTTALNNLLLQLPADESPLDNDKTLEEFAKCKKIRRKVLSYLQYVGAGSPEAKSSEVAALDEEFLGSLIGANEQLVESFKRFDFRAGYSKDNPAPNYDDESDSDESYYTSEESEEEPDDVEEQDENLISARLQNATLQSKLPPPPRPSKPSNLQSSFQPRPKLDKVETSESIEGNPFGDRNAVTKSVYD

SEQ ID NO: 14617 - protein, 376 aa, Candida albicans
FFFFLQQRTPGTMTGLQDPQDNGKSGIHIHYPNNKKPTYEISKEHLLEMTSHLEALPQFQTLEDESLAHHIIYQSMVDKYASNNQNFKTNPRLADPRTRNNLLELMKDVYGRKSILFALDVEAWELDTNIVTEIGIAIYDPRGQADSLIPATIQLHIRIKEHLARTNGKYVPHHAHNFNGNTSYIMSEREAATLTQSLINFYFISAESKGTGCYLVGHDLKGDVKWMNSLGVTFPSQFKSLDTNYLFRISHGKENISLKRALAFVHIPFAYLHNAGNDAYYTLLLAMKLCDPHSRVRYRLDVLINVETYPTLTKEEKKERKNRRRQEKLEAIARGEHVEQKPPAPKQTTKKSNRKKLTCESIELESAIEVFDAMFK

SEQ ID NO: 14618 - protein, 314 aa, Candida albicans
TLSMLGQFFNSVISFSILVTYTNKDLKNLREKKIITNISSFLSPTMFKSSPFKTFVRTKVEYVKNTKFKPVKYSKFIPKTYTFHPYEPAKKVEITSSLQQLKNQVKSGDEITKEQYLNSPHFKFQEGKEGNSLAYLRQCISLINSGKPLIAMDCESYERNHLQVTEIGVAIMTYRKLTVPQIKTIHVVVKEHFKKRNTLYVPDKKDQFMGGSSFVMTENKTRIFLQKLLDKYVDEMDGVFVGHQVSSELKYFKSIGVNCKADVHTIDTMKLMQLSKSGGNSLWATLRELEIPYGHLHNAGNACLLYIVSSVVVM

SEQ ID NO: 14619 - protein, 391 aa, Candida albicans
  UNSURE (1): Identity of amino acid sequences at the above locations are unknown.
XKNTKICYFLLTNTCSKHTHPNIMGVYIPPPNDKDYGYKKKQDTNSNTNQPTPPSSSSPSGSTTIYIPNPASLIPRNPKVGLIWGPLTPASDNLPALYSMIGLQFVIGCGFFKYARTLSRLRPIGGFQQQPHAHMAPKLVRTGPIWKIALSVITGSALSFGSGLELCRVTLPYDPWYDEAQHYRRMAVKNGDKPSSWFGAYRYYKPMDFKTWIDKVGDWIENVEKEIKIDDPANFANLSLELGKNSNVINVQRQPQTSGGILNKLNNKGKYLEIYTKLNENNTKRWEKLLHEDLNEVTELNKAPRLDLILEGKSDLINPEFTKSAIILGNHTMDDDDQFEMVWLNFEPWDELKLDTEYDIRLVPSYAGATEEIENEDQESPLTDNVVAKQT

SEQ ID NO: 14620 - protein, 178 aa, Candida albicans
TMPSTHNRDKPWDTPDIDKWALEEFKPEHNASGLHFAEESSFMTLFPKYREQYLRSIWSDVTKALDKHFIKCELDLVEGSMTVKTTTKTFDPAMIIKARDLIKLLARSVPFPQAVKILQDDIACDVIKIGNFVANKDRFIKRRQRLVGPNGNTLKALELLTKCHILVQSNTVSAMGPF

SEQ ID NO: 14621 - protein, 94 aa, Candida albicans
SRGWEISLYLKNNIMAGVYVDDILISAETVENINEIKSFLEKNFKMKDLKEVKKFLGMNINQTTIMTILCLHITQYHEKKIQRPKFVSFNCDHY

SEQ ID NO: 14622 - protein, 196 aa, Candida albicans
FLLERATTPGRSLPSNNSNEAPPPVETCDNFSTTPYFLATVAVSPPPMITMLPFSADLTAASNKDLVPLANFSNSKTPGGPFQTMVLALATACWNNSTDFGPQSKPIQLSGIPSASVAEEVLASLSNLSAVTKSTGKINSTLFFLAFSTKCSTFLAPASSKRESPIGILFKIFLKVKAIPPPTINISTLSNKLSIN

SEQ ID NO: 14623 - protein, 257 aa, Candida albicans
SWVDTMKSFVSKSSLTQIMRHSRPTLVISDWDETITEEDTIKYVAQVPYIKQRQQRVLPPFEKFVESYNQNYTNLKNSFNFPNTTTTSIECSDYLSQQIKFQDELSTVENQSIELIEQSKIFEGLTKKDFQDYVNINHNKIKLRPGFSQFVKRCQNLNIPIIIVSANWTSIFIKQCLANHGLAVDDIITNELSFHSDDEEAKTKMTTTGLWDKSKYTIRTSQDKLDIVKQIQEEKDGLIIHIGDSGISSPTGLEDPR

SEQ ID NO: 14624 - protein, 368 aa, Candida albicans
  UNSURE (10): Identity of amino acid sequences at the above locations are unknown.
IIIYVVKNSXKIKFSSCKIFKQTLTIITILLALSISIFIKRYPSEPFKPYNEESQSFTAGIWCVHFGLDNDMWSSETRMRDLIRDAEIDIIGLLESDTQRLIGGNRDFTQTIAEDLGMYVDYGPGPNKHTWGAALLSKFPIIESTHHLLPSPVGELAPAIHATLDIYGELVDVVVFHSGQEEDVEDRRLQSLGIQEIMGNSSRPLILLSYLVTEPLQGNYNTYVSEKSRVYDIDNTDWDRWCEYILFRDLRKVAYARISRSTITDTELQIAKFKLLNEDEKNDDDLEFYYGNHFVNEDEIDENLRMPQLFRGDGVRGHRYHVFDEPRYFAQHKWQRYNEQEQEQEQQQQEEHQEEEEENGQNEEGDEY

SEQ ID NO: 14625 - protein, 273 aa, Candida albicans
  UNSURE (211): Identity of amino acid sequences at the above locations are unknown.
TETETEVNVEIETEVIPGPFDSQFSDIDVIVNLINSFIYWTVVTSLFLCVWYFPLWHMGISGYEAAVLSFFLAPLLLIIPVSRNLFVTYPSIARSLTVILGVGAYKVPDPEQRLLTITAGTVFAVISVLSEFSIFATNPKKLNSYISTFTLGLLATSIFKYLCFSNNPIWPIMHKENGGYNAIGIFLGLLAAFFTPKQKQLSPKATNNEVXGANGSLLLAALGFGGYYFSLSSYLSDSGTLALWTWERVPIKGTTPITGALYHFIAIMTAINY

SEQ ID NO: 14626 - protein, 308 aa, Candida albicans
  UNSURE (29),(48): Identity of amino acid sequences at the above locations are unknown.
ARISHERLFNLENLVDFDKIEHMMGWPLXGLGLKGNINDLYTELSDNXDKLDSKVTSHYHIYKVEDIPPEFQFGGEITAHKYNYRLAPIWILPDVGYSITTHKQMEDNGFQYKPKGVHGYNNTHLLMRAIFLGTGPYFRNKNLKVEPFANTEVYNLICDTLDIVPAPNNGSLPHEIWSQKLPDEWKDDLTFPNLPFQVEHIVRTNATYDLLWRKGDEAKIDPAPAPTNKHPVESMKSEESTITSLETESLPKPSDFISSSTGTTMETLTTTKAHEGFGKIVGDIIGGIEDGFDAIGGVVHDFIDDIFN

SEQ ID NO: 14627 - protein, 392 aa, Candida albicans
FIYPDDIYGLDFFFPTCLMRFVDEHQTLKYKQSPNSKNQTFSMAELKQVTFSPEVLARIAPDVSLQRHLALGVRPNLRNFTEFKPVEVSNSTQFQDNNDNVFSSSVVKSGSTTIINTITLGIVENFNSNESEYATIYPCVEILRGRLGAPTDEEMILSQDLFETLYHNKIIPSTSLKINNLGISIKDDQTTTTSQTNSTIYYPDLNPGQWEYINLTSHHHKSYSFVLLSNIKVYSKSTSTCSLFDLCYLSMLEALKSLKLPRCYVSESFTTKVAMKSRRSNTRGLVDTNKASINIDLNKSLYEKIDLNIKSGTIASNFGVISHEGNTILLADLEGEAEESSVLSRLSIMTNNDSINKISLVNGDPQSEITLEMLNNAIEISKQRSIEQVQQI

SEQ ID NO: 14628 - protein, 117 aa, Candida albicans
ISHLFFLYTIILLYSHLIGSIHDMKILYSFLMLFVVAFASLGDNLPEFQSCLYQCDCHVIPQSIFWSCPANCNYYCQQLITDQLESLNVPMVQFYGKWPFKRVLGVQEFFAMIFSIR

SEQ ID NO: 14629 - protein, 238 aa, Candida albicans
PNDSVPSNLNIQFTNIFVVQIVTMCAWLFSTIFHVRDYILTERLDYYFAGLTVLTQFHALGARYFNLYKHSRVVYRWLFSLACILAYVYHVHRLYTDWSYTYNMQANICVGLLQNVFYCLVCFGLYVKYYNLEQTENKVILNHLNYVDSQRIILSSFFTRSSKLFSLYPLLLCFIVVCGMALEVFDFPPVFFDLVDAHSLWHLVTIVPVYMGWYDWLVWDVYENVWSNIQEEDKKKKE

SEQ ID NO: 14630 - protein, 238 aa, Candida albicans
QRYLPTIKMVSNIWIAAADNQRQIVEQYINSNEYTPNSKEPNGYTAIHAAASYGHLNLLQYLIEKGGDINIQDNEGDTPLHHVEDLKTAKYMVEKLGASYKIKNNDGLTAQQYIEEEDEFPEVAQYLKTLAHDKPIASEEEIKANEFIESLPAPGNIDGHQIRYSLENEAAQDGEEKLSPEELEERRKKIQAILESDNPEEALRDLVKNAVHEGMSQYKQEQHTTGNEEEPSSKRRKE

SEQ ID NO: 14631 - protein, 517 aa, Candida albicans
GYSLVLIRRGLSIFPAGRLLQNNEFRFFQSASRNKKRNLQLKRYFHRTHPDILLMTDIDIDTIINRSLHALENSEYSEFDLLLNQLSYLIKQSVNSNNKTASKEQITRILDYTPNNFNQVESLRLYRGLLILVRNFAPLLDIDLFPIVANSFEKFLKALNQTSEWTDRIIEVYWQILANFQRNEFTEVANEFFGQWESKYKWKDIPVSVMLPVIHFLFRQFNTQDPHITNENLLSLLKLFETNHVMNAVYEIFTMIDFADTNNIGHDNKMFIHLLYDIITHESFQKWIEQQNEEETITKWLSLTSVIVQTKTDWNNYELIALLSWNGSLFMKYAPLINSNRNTTVNGEDDLGYVEDDILAIIAIFAELSQFNATKQYFEHYEDLLPKLIFVFKWIHDNIEPITIKSSKIEEVGRYSSVKTNIITILSYLSYDSFQFQEKIRELGGLLLVLSNCIIDNNNPFIKEQAIVCLKYLLQKNPKNQQFVADLEAKKVVDDQVLLEVGYQVEVIDGKVAVKRK

SEQ ID NO: 14632 - protein, 136 aa, Candida albicans
RAPEPVIEKIEVTPTNEKQSKQATPIEQHDDVHQELKDPTIDWIQSDPIVDRGSTFIAYVRQVNTLQDAQEYLDDLLTDKKIAKATHNISSWRIKMENGVTFQDCDDDGETAAGGRLLHLLQVCINNEILLLLINF

SEQ ID NO: 14633 - protein, 121 aa, Candida albicans
  UNSURE (110): Identity of amino acid sequences at the above locations are unknown.
KWRMELHSKIVMMMEKLPLEVDYYICYKYVSIMKYYYFLLISSEFVYTNFFFVLFYLKMMDVWNVIVVVSRWFGGTHLGPDRFKHINSAAREAIIKGNFIVDANDNTNGXTKTTNAKKKKK

SEQ ID NO: 14634 - protein, 215 aa, Candida albicans
  UNSURE (14),(15),(18),(29): Identity of amino acid sequences at the above locations are unknown.
VTQGTRILHFLVSXXIMXNKLVPRERYSXDNYNTTTYFTVESAHRPALYLHIAVGLFSVYVFYPISLIFNNLNMGKSYMTMLLIHSSCIVFSLLNYSIFINSIPDLYPGNAYNSMVIMLFVTTILQLIFAFIKNIEPGESDGNKYFQLNNQHMRANSSDEESLQSMISPPSTDDVIPSEKPSSFKMSNFYDKVMKFRTWVAQTKFHKISKIGFNL

SEQ ID NO: 14635 - protein, 295 aa, Candida albicans
IKGGVFFAYGLLSLSRYCGGFTNKGWAWNHKFIDRTKKQSFWFSLQNKGLWTMEMIESSLILFYGSTNIFLEHLANAGGEWSPKDLQHASIAFIFIGCGLCGVITELKLQDWRYEQAMADMEKYQYQGEEQNQQELQSNTNNNNTIIKASPGFSPNPFPIVTIYWTGILMSKHQQASSLSTEVHVQWGNMFVLGCAFRFITYLMLMLNAKVPKDLLRPSRPFTELVVSFSLLCGGLIFMELTDPVILSFEYYGLTSMFTLNISLGFTTLFMGWQMLLFAFKDWLKSKYNKQQDMV

SEQ ID NO: 14636 - protein, 145 aa, Candida albicans
GYYQSIHIQFIFIYLSKKHLIIMRPSSILSKIHIKTPKPEFQLFQFPKLSEISYKELPNNGFGINNYYIPKTKFNHWPVYIKIQNTKITTEIKRVEGDLLKLRQDLLNFNPNYKLTINSTAGIINIKGDVVEEIKSYLDKNSSST

SEQ ID NO: 14637 - protein, 345 aa, Candida albicans
KSLSHLGHSSSRIIRLYKEDKYSVNLLQVKESQIFNFSIFDGHGGDQCSTYLAENLSLALEDLDQLVENDNDRQELFKKYAKNVGGYWKRWYKHRDNTVANWEKERIKLKNFLSDDLATRVPLAFLNADYNFFSKEQKSGSTCTSALIETIYSKPGTFQPFFENYYFNRHTISKLSIGHLGDTRAIVADKNGLAHTLTTDHHPLNPIEDKRLRKYAANFFMTDSFGEERFVALANTRAFGDVDYKEVGVTAEPDFNQYIIGDLDAIKQFLTPDEIEKYTIGGLGGDESFLILCSDGVTNILTDQEIADIVLTHVNLKGQTVATPQYCAEQVIKFVEFVGGDDNAT

SEQ ID NO: 14638 - protein, 257 aa, Candida albicans
NLFIFYFFFFVVFFFLFVISPLNYQHIHTNTIMAPKKQATVVTEQDISNSDNEQLVELINNLVNTKQDELFAKYKAKVESQLENDHQLIEDLQAELKAKDDRIDALLEELSLLKQDPGMEFASPIRKKASGRLNQDELAKERENICFTLDMIELLTGVKVINFENTSDEYIFDIKQSSSVKLGLTMHYQLVLASQPSPEINYIPTFLDALEGEEVEDYENAKILQKILPDYLCENLSFPFDTLAQFYGKVNRALNKK

SEQ ID NO: 14639 - protein, 203 aa, Candida albicans
FNITIIQNVRDGKKNGLLIQAYFSVFEYINNHHRNTTMVKFLLKASAELSNVTGLEPSDTPEHPYEYTFQIECTKCRTTHDKDIQINQYEKHEISGSRGEASFVFRCKECKHEHSASILRTNEKLSTTEDSVNDKASATILEIDARGIDFLKFIPIGEFLAVGSETNTKFADIDLSEGEWYDVDEKSNDEVSIVDVSWEISRS

SEQ ID NO: 14640 - protein, 160 aa, Candida albicans
QFGTAHHLTIIKKVTSTIMNFLRKRRSSEDEDDDDILNNDPTSSIHKSRKPPNTAFRQQRLKAWQPILTPKSVIPLLILIAIIFTPLGIAIIYTTYNVQDLIVDYSKCNEASNSYENIPNKYTRYHFRGHSANPNFQWRFENNNTVVKTIQSCSGLERSQ

SEQ ID NO: 14641 - protein, 267 aa, Candida albicans
NNSILLRTGEVPVNLYYKLTNFYQNLRKYVESYDLEQLRGEALSSDDVTDNCKLLRHRVYNGEEKLIYPCGLIANSYFNDTISNPVLLNTRNGDNNETYIFSDKGISWPLDRSHKFKKTQYSPDEVVPPPNWDEMYPNGYTKDNMPDLQTWEHLQNWMRTAALPSFYKLYGQNTTQSMSSGIYQISIKMNYPVEIFGGSKSIVITTNTIFGGRNMSLGVIYIIVAVVALVLGIAFLLQYLIKPRKMGDHDYLQDSNGGDITTYRDQL

SEQ ID NO: 14642 - protein, 429 aa, Candida albicans
SSTMLVPPENFGTVESGIYRSTKLESENFPFLQTLNLRSMVILDTEKPPRSLNNFLEANPSLQFFNLGGMKISNHQHTGIVSKGDQDDVDMARGTSLSLNTPKNFFSSISLNRKDQWMLIEKNIVMKAFEIMFNKKNYPLLIIDSSATLIGVLRRIQKWNFNSILNEYRIYSGMSTKNNYYAETFLELVQVELIAYEHHSTSRRNSRGNNSMCMRSNSIDTDNGDLSETSDVNNFDDDYDAIEDEDDEDLDDLDDELLSASPQIPANLLKLVEQGNNSNREPKKRLSSVEGKKISHPRSNSYSNSPSFSGDHFLSARSNRRRSSTQENSFNVYKNLKFRNSHAKSPSGDYISTSPTLRRKESRNNSQVEFSELTDFMYYKNLQKYPKTFEHVHVLKIKLPAEYKLPDWFIVCRNAWEREFQRLNSEEKY

SEQ ID NO: 14643 - protein, 277 aa, Candida albicans
QIKSIQFNSIQFNSIQFNSIQSSLVLPSHLVANTLSLMSDLNIFITSNLTSSERRISPQWNLKYLKQKLESITGISPQNQILHYYPNNYSNEYKLIPPINGSTTTDDDDDDEQILLSSLNLQLYSRIHVIDSDPNSDVNKLQQQHQQHQEEEEEKSEIEEGDVAGFTEFQLLEEDYKTRQNSVLNWKKINKLGRFDPQFQSLQEKLHHETEMKLKTMSIGSRCRLINIENNERRGIIRFIGKIMPLDNGENDWVGIEFDEPVGKNNGSIDGVKIFEC

SEQ ID NO: 14644 - protein, 267 aa, Candida albicans
RLSLDWLPPSVTNIEDPFKFASSTYHSEIPQSILQNKTEPIVLGVDEAGRGPVLGPMVYGIAYSLESFLSKLQKEYGFADSKVLTDVKREELFKQIEDPDHELHKHIGWATTTMTARDISSGMLQSVNGKGAYNLNEQAHDTTINLIKQVLAKGVKISKIFVDTVGPPVTYQAKLKRFFPEIDVTVTKKADSIYPIVSTASVVAKVTRDTNIKFYNENLPLLQGQKLGSGYPSDPNTSKWLHSNVESMFGWVAMALINFPGKTGKRN

SEQ ID NO: 14645 - protein, 409 aa, Candida albicans
SGGFYGLRKESKLIFHAKCRGSNGQLDMDFLRTGLLGFTFNGKVYVLGLYEDRIRQRVSWIDQALYQKLHRDLVIGNGSRYHYSSHLLATLASEVKQIYDCTIFDIFIGNEYLPVAIVEAEVIRKQVADETAGAEGGNAKASESVHVSGVPLNEPVLNAIAQKCFDTLYKRHFLRLYCVVVVDCDTLPKLLRSGGREIANMLCKKKFLEGSLKADFVKFFIRKSISMIPHGEDVIGGIWSPYVSELRSKALANFPDQYSTIDYREKSINDKTGAPLTDFKTIVDILKFRVAKSGDSIAFQNVDNNSKSKPLTWKKLENRAYAVCQYLIEKANIKAGQYVILMYSLSEEFVIAVYACLMCGIIAVPMLPFDSNRIGEDFPAFVGVIRDFDISEILVNDEVGEIFEKWAYS

SEQ ID NO: 14646 - protein, 285 aa, Candida albicans
LMMKSEKFLKNGPIADSLKKITHKRVKSLKIKNTVKLTKVSNMASLNSKIASYQAEVNFRDENTTALVWLNFTSDHYRVGATLSNKNIIGVCKVFKETCNLSSQSAIIGCVRHTSGIGFLQACLLGVFLGTTTYLSSPVNYAENPLSFFLLLARHKVKDVFVTEQMLKYAAIKFTPKGFNLSNLKNMMISTENRVEIDLFRKIAKVFLSTKLNATSMSTVYNHYFNPMISSRSYMTAAPVDLYIHPIALRQGYVSVVNQAEVPNALHIHDAGMVPVCSEIVIVNP

SEQ ID NO: 14647 - protein, 316 aa, Candida albicans
SLYGLLKYFQDFLSFFFYITCQTNSLMSHSNNNINLKVPGNSLSGSNSNHGSSSSDRHNNRHRSVSAASLNPTTGTLITGELNETDPSTNITPDIGGTSGVGGDIPPDMAILLQKLDEDFLVNKVIDQWTFINRREEIMQSINRLHQKQNDDLLNLDPLKLQMPLNPRMSTGDFLKISPDNLIDILTYRANTYKSELAFIVLDAKGKEVSSISWEKLYLKAVKVAYEIQHKLTMKNSDSVVLLYKDGEVTEFVVALFGCFMAGVTAIPIHQDISLTEVLNIINLTSTKLLLYSDTVATELDRLSVQNLRINGHRNY

SEQ ID NO: 14648 - protein, 499 aa, Candida albicans
LIHNERFYITMSIPGFGSAEKVNHTASSVTLTIPQSYEWRIEVPFNRILKFKVLTGIVEINGTELANNTEIQLSGTKTYLYSPVTDAVIEYVLVENKDDLSLVSASDEGFVEYLSDESNMDSILNLHMYLESKRQYTKDYNFSSSIDQQQSGPKVLIIGSKYSGKTTVLKILSAYANKMNNTPVLVNLQPRDGVFALPGSLTATPISDSFDVESCNGYGLTTTSGTLVHNPKQPIVKNFGMADFNDNVDFYKLLIEKLGIAVLSRLDQDLNIKNSGVIIDTPALTLKNFDIVESMVSNFLIDNIIVIGNERLAIELTKKFAYKSTQLNIIKLNKLSGCIEVEDRFIRLQQEQTIKEYFNGNFKTRLSPFKTDIELLGLKIYKNVLTKDLLSQMAFLPGGDDFEKDETNPEEDPEKKQLEKYYQAIEDPNSSNLENSIVAITHLPNNDKKLGKDLLNTSVLGYIHVSKFDDQKKRLKVLFPFPGVFPKNVLISTNIGYNE

SEQ ID NO: 14649 - protein, 497 aa, Candida albicans
YDLILYTLFIRRIHTTHCIVKVVYRDKEREREKKLLPYKIIYLFSPPSHLIASSILFHLIQRLYITGSKMVLFEVKGWDLKNNNKIKVGGLPEKKNRNKNKNKNKREPKQIDNGSNITNNETNAKPSKSDKDNSNPKKDKKRKHENEEQQPAEDQHKLSNKQSKKQKKTNRTDSNEIKNQSSDQSLTNSFISSNKKLTPLQQKMMAKLSGSRFRWINEQLYTISSEEALKLVKDTPSLFDEYHQGFNQQVASWPENPVDVFVDQIKTRGKNRPVNAPGGLPGLQNKQVVIADMGCGEAQLSLDVTNFVNNYNKPQKKNKKYFKGLDIKVHSFDLKKQNDRITVADIKNVPLPDESCSIVIFCLSLMGTNFLDFIKEAWRILIPRGEIWIAEIKSRFSESSEIRNQNEELIGEEFVNSLKAFGLFHKLTDNSNKMFTRFEFFKPPPDILRERQLKLEKKKKKFIEDDDDRTDIEKLESKRSEKAEGEWLLKPCIYKRR

SEQ ID NO: 14650 - protein, 278 aa, Candida albicans
IGFLKVAYYSKMNSSYTAIEPDEPLDSPPSYSANDHNTTTNTTTNNPLTQPHVNQPQADQPQQPGTSSLSEPRTLLQRLKESSHPIALLFYIFFRVSPIVTYIFGTIVIHQFTSKNTFILHFIVLILLVDGDFWNLKNISGRLLVGLRWWNETTLIESENGNGNGNASGQVGESAKDFENVWVFETADPNRYINPIDSKVFWLLLYGQPVAWVVLGVLAVLKLQFLYLLFIIVATSLSMTNAMAFTKCDKFGKANNFANDVFTRAAGSMFNNFNPFGR

SEQ ID NO: 14651 - protein, 290 aa, Candida albicans
NQEYIKFLFYTPTTIMSQTSSFVKKLASNDKPTRDSALESLKNFLGSKKDLSLLDLKKIWKGLYFSMWYCDRSKAQERLAENLGKLYSETVSVLLFPQFVLAFFDIISIEWPNIDQWRVDKYYLLIRRILRHNFKFLKQNNWDEELVENWVNVLHQSVLSGEKNVSMGLPYHLCDIFIDELELVMFEDIQEEIDDLDNDASLEDKTKLLGKKIDIVSEVPVLKLLEPFQKLNKLAQLKTLREKCAEELLNDERLKDWGVIEADDSDDSDNEGSGDDDDDDDEDEDEWKGF

SEQ ID NO: 14652 - protein, 517 aa, Candida albicans
IPQLRYTHIYTSYSYLLMKFGDNLPHLSIPQWKSYNLDYNNLKYQIRSITKSKNPTKKDLFSLKQSFIENFDYINLFIETKYGELTRKFICLENQFKFINNNSSGNENGNDSIDTILIQLDELFYQTIELSIELKNLSKFIIIQKIAIKKIFKKFLKYYPHKQQGKEFVLNLKQYYLDHSKIKNLNALTLKLTNLINIIKYERKSQQVQYQQSHQNQRENLRRNNSLFSISSTIMTSSDYQNSILPPRNTGTTNGIATLNNLPIQQTPTSNESWYDLSLLLKKNFHIHCLIHEDAINDLKINFNLYYQLKPINTGTDDDSWVSCTYLTRDYLLDDHPAYIITHKNNDNSMIVAPIGGLRQFSYCILPNNIVQTLIYHLNDRSNDNYRQELLEFFQKLSSPSLLTKKTIDFIVSNDFKPSLKLFCKRSRYLIETNDEDGEGSVIDSEFTDGKNTNNNNSKSGDDSIDNDYLITLDSDIMTTNRSQYVNELTFPNEKKLNQLNVFPSWDTLTFPPNDIN

SEQ ID NO: 14653 - protein, 225 aa, Candida albicans
STEKQQREAMETEEAKLEQEIKKSDDNGDELTGDKIELPSTEEIKDQLNLLPEADMNMLGNPETNPALKGDVVLTIFDLCIPALLESIPKYSTAIKPDDKVFEIVEKFLALFDKFPDLNRDYLYLHVLNYIQREYANDLRTLLTDITLPIRAVTVNSDNLAEALQLAVNKFIAYKRKLQDGAERDMLTNMFINQLNTQFFNDKEHPSQKIDALLKAIIKKCRTVN

SEQ ID NO: 14654 - protein, 177 aa, Candida albicans
VAIMTISVIMMTDKPELGSSSSSSSSVGIFMVLMASMLSGLRWSFTQILLKKNPYTPNSISTIFYISPGMCIILFSLGLIFEGWTNFINLEIWITKGLFTTIILLIIPGVLAFMMTLCEFKLLTVAQVITLSVAGIFKELLTIILSSIIFGDKLSLINIFGLSSPYGAGQSGAYCAE

SEQ ID NO: 14655 - protein, 175 aa, Candida albicans
LTNSKQSVNQKVVSFIKKLLDTIPYEENCLKSFPTKATMIREINEESSHFTEGNKDQSGSDSSDQMPVHKIVQAQVDDLKISTDQLKPIPLYHPQFQNPSVILNQLYSFEEENKKKHKNQAILCAIGIPITLPFALVPILPNVPGFYLAYRLYCNIKALLGLQHLYYLWASSTRC

SEQ ID NO: 14656 - protein, 155 aa, Candida albicans
IVIYLIILPVSIQFHHTGMSTIKITNESVKEVVASVVPMNIQYSGPANTEDYFAPSKTQETQPDGTLLDVAYFRGCKLVGKTLELDKYDVKGYVINKSEHLVSDKETGEVKTAVTYIPVGNFQKLTVYGHDTLPSRTNQWSLIPEYLSISNIVNE

SEQ ID NO: 14657 - protein, 232 aa, Candida albicans
PPLRTGLVLSLANPQHPQIKQSMFFSKITNHNLITFYIQHYKSKFCYSSIAFDSNFKMITQSRISNLAKPILAFLFILTLYSILFRKSDDGADKILEPHGYAVDNEEDPLFLKQQFMQHGLSNNNNNKKAGGKDANTNKLQPDKAIVIDKTFLDQMDKKTHKCPDYVVYSQKRHPPFSIGRFKYPYMRPAPKCRTFVSTAVESVIEDLKSKIEDPDLARLLENCLPNTLDTT

SEQ ID NO: 14658 - protein, 434 aa, Candida albicans
TRRIIALNQFIGQRWIFHAGMVKEIPARQLFSISTLWVDLILKLKELIFGAINTQAYYIINSPYCNAFHPPPGSGVKRGDTAFDQVHPKPDWKQVFECKYELDSLASFLTLTNEYYENSKGDTSFINSSWLKAFEKVLIILHRESVPSFDQETGQMLPFYYSFQRNTNIGSETLPLGGVGNPVNYGTGLIRSAFRPSDDATILQFFIPANIHMLTELKRARNTYLTNENIARDTMLVETTDTFINALSTGIEKYGIVNHPIYGKVYAYEVDGYGSATFMDDANIPSLLSIPDLGYTKIDDEIYQNTRKMILSKQGNPYYLKGHFFEGIGGPHIGIRNAWPMSLLMRIRTTDDDDEIILSLEMIMRTTANLGLMHESVNVNSRQGRDYTRSWFAWCNSEFGTTILHLAKNKPHLIFKKEWQNVPYDIESVLSQFI

SEQ ID NO: 14659 - protein, 265 aa, Candida albicans
  UNSURE (248): Identity of amino acid sequences at the above locations are unknown.
GNNAVRLVRSEDEGGDNPIIGEIAFHRFIAVSIGIMWALTMATWFLPNSARVRLKNGLSALWLRLGVIWNSDPLEFNPDTKQLVGFKAEEGTNKLLAECETLLKQAPVEFRLKGAFPSHIYSRLIKDTSAIIDAFQNLDLLIKVDPTLSPSEEFVFKYIEIEREEVEQRIFLVFYMLASAMKLGFPIPSKPASIEHAKDRMLYKLSNIRQQHEEELVLKNADLILLYSYILVATTNAEQLDRIMVQLXKLLGDIQKISFNWYEET

SEQ ID NO: 14660 - protein, 136 aa, Candida albicans
ISHDITHINGVVFICSLFFSSLYPPTYTNFPNMTTFSKTNFKSLNYNSFRPHYPPSFYKILADYVTKVELPLPINLPIDKTIDLGCGTGVATYPLLNISTNVIGVDLSLKMIETANSLIEKIYNVGVIIIYSEPEN

SEQ ID NO: 14661 - protein, 124 aa, Candida albicans
MGPFYQQPGHDYLRSLMKEIEVPTNKFYDIVRHEYISNIHGAPKENEDPYLTKTPLFIKKTITMKWFLDYVKSWSAYHTWMTHHGDKYDIAEKFVAELKQKMNWNDDTEIDVIWDTVYTFARKK

SEQ ID NO: 14662 - protein, 153 aa, Candida albicans
  UNSURE (10): Identity of amino acid sequences at the above locations are unknown.
KDMNIYFIIXEIPPGNSSSTSNGSNYSVTFFHLGHKLTGHKGIIHGGLLATLLDELTCRLAFLNFENQRGVTANLNIDYKQPTIANQFIMIKCIVLEKSGRKCWVKGEVYKLNNQEEEDEVDDDYDLIIDKPENLLTSCKVLVIEPKWVDKLT

SEQ ID NO: 14663 - protein, 219 aa, Candida albicans
YPIQLKSPLLVSLAMTVLPLIDSSSVSSSSSSSSFESQLNSHPQYINIINQYQNFIKTNNETSKIIERIMPNLTGETLKGDDKINLRTKTLYFINDEYLLHHQEIPPGSSNSTSSNGSNYSVTFFHLGHKLTGHKGIIHGGLLATLLDELTCRLAFLNFENQRGVTANLNIDYKQPTIANQFIMIKCIVLEKSGRKCWVKGEVYKLNNQHQKKGQCTRR

SEQ ID NO: 14664 - protein, 324 aa, Candida albicans
GEKKVEENNTILQKRTNSLVLYLNLIYLTNHFYMFCRSKTIPVKRLQFFRSFATRSSFDSPFDHLPKLNNRSWFNWKTTTAFFLLGSYLAYNETLFNYYEKYTEIDEKDPNIKILPMQLEYKLKNLPIYQQLAHPKNSHQWYKLQSWENLDRNILDNQTQVKKQDEYQEPTLTNQTLNKPGGILIKPVIFHNIETDEGVHIVHAGYRLCGYPFIIHGGIIATLLNETFKRNASLSKYTTSNLKDDFKVENLTINYRRPTLANQFLIVKTKKKESPENDNRTIVLESVIEDSKGKVLVKSEALLHDTGRATNRIKENEKSKKSWW

SEQ ID NO: 14665 - protein, 139 aa, Candida albicans
KCSPGEAIKFDQKINVDLIPANYELIPYVFIAQDSLIKVIPCRGQLATIVDAAVSFFDPRLIFLELVLLITFAGLIYVGYEIWGKQYFKGVAPVKAKKVSAAKASSPVASGPSTTSATGYDTNWIPESHLKQKKTKKVN

SEQ ID NO: 14666 - protein, 160 aa, Candida albicans
FKNPINNDIVTNLTTGKVGPIAVPPGEAIKFDQKINVDLIPANYELIPHVFIAQDSLIKVIPCRGQLATIVDAAVSFFDPRLIFLELVLLITFAGLIYVGYEIWGKQYFKGVAPVKAKKVSAAKASSPVASGPSTTSATGYDTNWIPESHLKQKKTKKVN

SEQ ID NO: 14667 - protein, 135 aa, Candida albicans
PIVVIKDKHSLMSTTKPTATDEQKSQVLQQEYNRYQELIAELDSQLNTISSQLQEHLIVDQSLTSIAPEKREGRKCFKMIGGVLVEKSIDEVIKILNDEITQLKTEREKLNKELTENRKKLESWITTNKIKIVKG

SEQ ID NO: 14668 - protein, 271 aa, Candida albicans
AMSNSSIVPTYNGYIHNTRDALAVIQQVLDKQLEPVSRRPHERERGVLIVSGSVFVFIEQLSGIKRWTDGISWSPSRIQGRFLVYGELDKKNLIDKDKKKKKKRKFGPDDEYDHNVNEPDYTGGYGNHLHNDNRSHLNKNSRSGPMLLATGTGSITHTVIENKPSSSASMIHSNVIPASSSFLTDYRTSLGNGPMVSAAILQNGLVKKTITLTTTTKELHMEGKAEKQTIHLISYYSKQDIDSGKLQGPSESDLKHVQISPALWNMVQENS

SEQ ID NO: 14669 - protein, 251 aa, Candida albicans
QQQQQQQQSHNNNQEDIKMGACCSCLGNRGGDGSHTQLLLAENEREAISALLQYLENRSDVDFVSNGPLRALSTLVYSENIDLQRSAALAFAEITEKDVREVNRDVLEPILILLQLADSEVQRAACGALGNLAVNTENKILIVEMGGLEPLIRQMMSTNIEVQCNAVGCITNLATQDDNKSKIAKSGALIPLTKLAKSKDIRVQRNATGALLNMTHSGENRQELVNAGAVPVFRLCCRIKMTMCNNNCPTT

SEQ ID NO: 14670 - protein, 287 aa, Candida albicans
PTNFFISFYISPIMTEFLNYKVDLTLKDGTKSTGLISQVDSQQIRLSNAIQSIQPKQTIPYLDIKSSEIADLKVIQLPPDFKQQQKKKQKPRNGELIDDAIVFASKPGTPRVHTPKLKTQKPHAVSAGSEQPDWDTSSDVQDIKSSNEFDFQANLAMFDKKSVFADFQKRDHTNIGDRLVGHNKIENVNKLKKEKYDNDEMVLDQNRTDNWDNIGTATTSKTGTPVVNQNGYKDSQHQHLKLINANNLGNVALASPVQMLEIERLATDSFGITQAMMFSTGVAIRFA

SEQ ID NO: 14671 - protein, 431 aa, Candida albicans
IKCKSSYNCLDFSLLFNIPRVRYPYNQMSINYNAQPHAVDVPVTDMDDPEDDIIFAEQASTQQNRTRSSFLDNLDFENNNARSESGGILNKFRSFFESRLRQDDDYEMVLRFDVDSTNESDDLDNQPPIDIRERRLQLLEKQVKNRTVVGSIFLLTVGILTFVLFFNKNSVTLLLNSGPSRKIYSNSTHEFHQTTILISLDGFHPHYINPLDTPTMHNIMKNDYGAPYMTPSFPSLTFPNHWTLITGLYPSEHGIVGNTFYDPVLKKQFINTNPKVGGLDPDFWRGGEPIWKTAKRQNVRSAVHMWPGSEVPHIGPTEDFDRYNGSELLSSKVDRVMGWIDRESIETRPELILTYVPTIDQFGHKYGISGQNLTEALTYVDNFIDLMQQEIHNRNLDEIVNMIMVSDHGMAPTSNDRMLYLDDLVNWDKNE

SEQ ID NO: 14672 - protein, 413 aa, Candida albicans
VVQDYLLDNSRGSFTARIIAGMIELLGLVNSGLEDMAPLAWRIYTSWEYAGQPVIHSENKTLTMAKEFKKSFSRTDVRVHFMGLWDSVNSVGILWDRMFPYTIKTANVDHTRHAISIDERRSKYKQQLFSPIESSDVGSKGSNTYSSPISYGLFTSVRSLVDILKQFVERFNRRKLRPLPAINDLIEVYFPGNHGDIGGGWKASLDNQVLSSVSLRWMLAHAIKYGVRFQPQSISQWSSDHPPISSFLSPNHDILSFSSKSPDSRSDIVLPEFPIKLFAGRGEESFLYVLFWWILELIPFLRITEIQEDGYWKRAFVPNLGKHRVLPSTSLFHWSVFYRLHYAADYNPKNLHNLSLGEKFIELLMQFKIFKFNEIYSYSENLTVKKIKNDWTPRFWKKVPDELSEYLEKDANL

SEQ ID NO: 14673 - protein, 146 aa, Candida albicans
AMSLVEEPMIVNNGKNHPTHHNASKSIQKTNHSKSIVLCFDGTENEFGPKPFTNVLKLFQMLDRNNSSQICYYQPGIGSKFNADINNVFEKNFTSTVLSKITNRADSLVAFTLEKHVIAAYSFLTSVYKTNDKIYLFGFRYVLKST

SEQ ID NO: 14674 - protein, 387 aa, Candida albicans
KFFIFLISIFFDYNKSYSTDNIIIHQSTLQLPPLSYYIMKSVLSIQSHVSHGYVGGRAAIFPLQTQGWEVDNINTVNFSNHTGYGSFKGTLLTSNELNDLLNQLINKLHISYRAIITGYIPNASLIKTTNEYISLIKQKQQQQKHEEEKVIYLLDPVMGDNNYLYVDKSCIVEYQSILHNKLVDIITPNQFELELLTNSKIINKFGLVEAINKLHNDYDIPYVVVTSITSGSIFKSEEEDKYIHCVISTKDQSIIKVFDIPMIKSYFTGVGDLFSALLLDKFYKNKHDAIINGIHDSMTILSRSVNQVLTIMAKTLKLTHKLGIQQAIAATRKDVNHNNNDDKNNFISGKINDGDTMKYFELKIIQAKEYYDYDGDGEFIEKVLELN

SEQ ID NO: 14675 - protein, 216 aa, Candida albicans
KMPANGSFEKMSRPATAFQKVLDKVGSVFSSTETSRLQHDSQLDDKATNIFSVSSQKLYLKLSKMLKIETRSKNLKMELCNDFGVWGQSIPNLESSAFVKEFSALLNTQTNNQTILQEKMERLKLSLSFVNEREKKQKGLITAKLKLEKQLKEAKAKFGPNASNTILLNEKAEEVDCNLQVVEQQYIRSIINDLKDALIDYAYSMSAAASKVFTTP

SEQ ID NO: 14676 - protein, 85 aa, Candida albicans
GGGRGSSSLVVKTFDTPTYNSIMSPPSLKPTMKYCDITGLPTNYKCPSNQLRFYNSEIYQEVIKNMPAGVDQEYLQLRGANVILK

SEQ ID NO: 14677 - protein, 152 aa, Candida albicans
RHHLKLTMSNTPGRSMSSTPITTTTTTQVNLHELLEITTKPHSFKQNPNRKQQSNRRYKPSRQLISDELKYLQSKQSNLKFDTPTYNSIMSPPSLKPTMKYCDITGLPTNYKCPSNQLRFYNSEIYQEVIKNMPAGVDQEYLQLRGANVILK

SEQ ID NO: 14678 - protein, 554 aa, Candida albicans
FLLQFILYKKKKKLSSVITLVRFFKRYLLIIGISIILVYCNQSLYTFASSFMSKILSSIPGNMSKSIAKYDTIVIGSGLAGLTTTYQLLKAGQKVALLEKSEKLGGNSIKASSGINGVPTKYQKQPLTDSIESFVQDTLKTGKNLNDKKMVDILTKNSRDAIYWLSDEINVDLSNVVLLGGHSHARTHKGDKLPPGFAIVSALTKKLDGFQAENPDQLTILKSSTLTKILTEGNKVKGIEFTDSEKQPQEMYADNVVLATGGFSADFDSPTSLLQKYRPDLLGFPLSNGAQTTGDGQKIAERDVNAELIHMDKVQVHPTGFMKVSNPNENWKFLCGELMRGIGGILLSPVTGWRFVDELQPRDVVTDAVLKHSQIGQNNEIGLKSDNGDGYGSVIVISGNDYQKATTHIEFYKSQGLLQEGSIEDLYYLLIKLNPKLPLTLDQLKDKFSGCDAIIEGTQQDSLGRTKFGGRFGDLKKLYFGVTTPVVHFTMGGIKVNPSNAKVVTKSGDTISNLFAIGEVSAGVHGNNRLGGSSLLECVVFGRFVSENILSGKN

SEQ ID NO: 14679 - protein, 366 aa, Candida albicans
FGENFSFQVDEIGKLRVNEACFKLLFDVLEAKENTQGQEKLFEGDGEFQEGDGDEEDEEEDEEAEEAEDNNENDSSSDIDSDSDNDSDNVSELDNNEDTITEIDKQTNLKLAQALGIPTKESGEVKFDELDDLSSDDDYESDSMDDEQMMAMDDQLSKIFKQRQDTITNLATGNKRKLEVLEAKENMIFFKNRVLDLLETFNKVAVNLHFNLAFIEPLINLMNLTLDKNLGVKAHKLLKNKISKTKIDSEELKKYYNDDPLEYYHQLINLIEELQTKANTTQPSNQSVVQSYNQSCIIIAKNLLNLDESNMQAIVDIYCNSLKQWCLQSESKLQPSLFFDFINWVNSKKSNASHNQNQNQKQKHKS

SEQ ID NO: 14680 - protein, 244 aa, Candida albicans
NNVNPFINILLENFTIKLQTQTTLDDTSNNNKNSNDNILKWYLDKIVSLIKHNNNNRHKLSDTVLESILTKLLQYSFFDTNDIKISKFLQSICKEKFNSILSEIITLKLSHRNYKTWSTFCYRIINKLSRDPENKCLVEFDDEISIVKQETEELLSTIIELNTKSSDKLYIFELMFSMCLIQLYMEDEETIQVINELKLVFENQFTTANKYDNEEDDNKVDDNLVLTEIVLSFISRKSTLFKKF

SEQ ID NO: 14681 - protein, 316 aa, Candida albicans
  UNSURE (286): Identity of amino acid sequences at the above locations are unknown.
NEHFYSVGYLVLQVLFNSQFIILKSEPEDMLQLFEILMELSNFKNWIRETGIFTLIQFIKLLDNSNVEYSKKIYIKILNMVNNLGLNLSTEGLAIYLSIPQSAQLSQNVSNMKANWKNGDPFYKGNLPILAKVLKDVEVISDEETGDDQKKKNQQKSSWNSRLPFVWDLIVAKFNQVADDSNVEDEMQDLLVTSKKRKKTTSPKHNNKRAKIEPEYISLKEFWKVVVDETLFSEKSSNERKYWGFEIFTKFVTSLETTSLVQYLFTPNIMRCLINQHASSTRMLYXIAQQTLKTFVKPIRETKPELVPIVLTVFIR

SEQ ID NO: 14682 - protein, 209 aa, Candida albicans
RSGGKWGSWLFPEARVQWGITFPSSVFPDQAFRAGGIYKQFKWEFSTNFFFIPQPLTMSVTIRPIEEKDKPEWLHLWTGKGGYIEFYNSLDKITPEISDTTFARFLDANEPVYSVVAVDDSGKIIGFANYLTHRNTWTVEDALYLNDLFVSSESRLHGVGRKLIEYIYGEADRLKCKKCYWSTQFENHRAQLLYTKVGVKSGFLLYRRP

SEQ ID NO: 14683 - protein, 321 aa, Candida albicans
LRQKLRHNTTSYVEEEIVTIYTTLSTRILFLVSYFPVSPCSTHCSKMSFEVLALSYSWVHKDSVSSRFENLKHLINASYNKPRYRFGIIQSPRIKNNDTVLSDLAIDAYDEICIYLLLGKQEKFDDLANEGYKRDLTKVATTFNQVFANDIPERYYSIFNLEDINTAKITFADSDFEFSDEILNRCIASVGLRSFHGKAKPATKDFELTAFTSFMRNTAPVFLDFIINQCLLDSERFEKISFQGSLNDFQTIIIHADVIKEHGLVEYYTKKCSFTKSSQEDILIKVDNGQKVDDGVLEKGILASKDFHLSFLERIIHIEPK

SEQ ID NO: 14684 - protein, 179 aa, Candida albicans
WDKSLTLTQNYKRLGIRAKLGRSAGGDERKVESLSELQAKREKYQKNQLKHVPTVSEIENLDDPSRIPEGEARLIRDPETNEVIKVIYGTMKVDDNDESEEEIENPSVIKQLEEYAEKNSKIKKERHQSERENDWIKSLYEKYGDDYDKMKWDKKLNIYQQSAGDLKRRIIKWKKANGI

SEQ ID NO: 14685 - protein, 249 aa, Candida albicans
KPPSDMSITKSLSSKEVISILSKFTPCDVSDSLNKHGIANGGFIPNLTNQSPVLNTASSVGKAYTVLYAPKSDPIPAVKQAYIDQVPEDSIVVIGLPLELQTVNAPYVKVNNALYGGLMSTRAQYRKANGSVILGRIRDLDEHNELGYPVWSYGVGTSAPGPLVKVVGINVPLEVKVASLDKDSEVLTINAGDYIIADKNGVVKLEDNEQLDSVLDYIPKRVDADIKVSEDIKNGKPAAESQKLWRSKI

SEQ ID NO: 14686 - protein, 252 aa, Candida albicans
LNFQKESYLKVLGDASYSTHRACQAWDFAKLVRMLKKAGYAVIQVGDLNSKPDSLPYKLFTVEGGLTDSWNVLNKDNVVPNDQIATLSLEDQISLAGVTCNSRLNTWRESRPLWEACRLDYALIDASNITPVSAQVKFVDKLPPPLSCSYSDHFAYSVDLVIRPKEERVGLADEMSNNEEKVSVYRELLAEISQYRRLTIPFQILWRKLHFIISLVIVVGMHIAVVFVANVAAWVSVILFVFNNIICTDRWN

SEQ ID NO: 14687 - protein, 184 aa, Candida albicans
RMSLDDLGGSKVASEPKKQYIKLLTFNTWGLKFISKHRKERLRAIADALANPKSPDEDYDIVALQEIWCEEDWQYLDLVCRPRYPYRRVFKAGIVSGPGLAVLSKIYIAETFLYRFPINGRPSAFFRGDFYVGKSIAVTMFQPHHPDILPIALLNSHMHAPYGSGDASYSTHRACPKALFLGGG

SEQ ID NO: 14688 - protein, 94 aa, Candida albicans
NLFGHFIVGLEKHMNLVLSDTEESRITKKSYSQLKKHTPNVELVYDKRNLGLIILRGDQVVSFTIESNAPLTDVKSRLDRPIKKPVSRMKKIIA

SEQ ID NO: 14689 - protein, 196 aa, Candida albicans
IETKTTFMKNRQQFSSYSVHKSNCYSPQIMSDESKPIEEPPIESKPQEEQDTEKESLTNSEESKKRAVEPSTDKKKKRRRRNYDEEDKELEKEEAKEKNAKTENNEEGDDDEDDEDDDYEQGKLEDEEEEEDELLEIDESNIITTGRRTRGKVIDFTKAAEELDKERGVVAEEDEEEEEEEEKENEDDDFKEQVQN

SEQ ID NO: 14690 - protein, 149 aa, Candida albicans
SMNSQIDPKNDNYPQSTSNNKYSNNNNNNYPQPTSYNNYPQPNSYSNYKNLFDVSNSDTTDDEKTEVESDMESTIRSLQSTTLATTVNHSVAYNHKDEHQSKMARANSYDQTKSTFTSLRSNIKNKLKFRTHRSSSEQLGMYYYFLFIN

SEQ ID NO: 14691 - protein, 159 aa, Candida albicans
LSMNSRIDPKNDNYPQPTSNNYSNNNYPQPTNYSNYPQPTSYNNYPQPNSYSNYKNLFDVSNSDTTDDEKTEVESDMESTIRSLQSTTLATTVNHSVAYNHKDEHQSKMARANSYDQTKSTFTSLRSNIKNKLKFRIHRSSSEQLGMYYYYFLFINWLT

SEQ ID NO: 14692 - protein, 165 aa, Candida albicans
KKKKKNNPRKLTLFYTIFLYLYINQNTMLGYFESIIPYTNGGKLPYWLLFISVVSIFNSVQTYQNINLTKRVYEKNPNQVSPLSARTFGTWTLITSIVRFYGAYYLQNKQIYELTQFTFAIAAWHFLSEWLYFGTCKLGKGLSGPLIVSSVSLVWMYLQKDFYVN

SEQ ID NO: 14693 - protein, 481 aa, Candida albicans
ISGSIVSYTQSFLCIMFLRKKPPQISTLDELQQTYNDCCNLTIKNLTLEEENNVEDALKGWKSLHTSLLYKLDIFDKMSSKLNPEEKTILGELKGIRDENIKHLIRVQLRLDEVNRRKHREANHGAPPPPPPPRSTVSNSTSNINVPLTLRNSSSQSTSAGGAASRPMMKSLRPHSNGHSASSSSSLSKTHARLKPKSVQEASTAASASWTKPITSQQKYQISKSNLKSKKDDLFQDFDQDTYTPNRNDSGNWEKFANSRSSSGLSEYSNEEDGGDYNLIDLDDYNGNGSLSHSMDDLTIKPVISPKDASSSSAYTSIPAQQHHTPVQSKSLAGNANKSNGLLRPSQQMEHISKSTSDIRTKPKIPYVYTKPKPMNIQRLMRQLASQSKSSPSSSSPSNKPVTTSKVAATTAGKTAKPKLKSNITYNFVRAPAPGKLKAANSTPSTTSRPGTNGTSAGTVNTQGSKQPSTSVRRPNQASRR

SEQ ID NO: 14694 - protein, 102 aa, Candida albicans
ESGEFGGYELCMAGKDEEEEGEDDDDDDPAIYKVSDHNDDSLLFTNQCKWNSLTLMVRDPSVLKFIKYVSINAKGSRWDISCQWNVKTDDDEEDDEEEGNEN

SEQ ID NO: 14695 - protein, 473 aa, Candida albicans
TLLSTREDIHSFFNQQIWDTKFQDDLKTTITESQPYRWGTIKGLMDDTLLRQVRKEVLSEIAFTKKETDIYKVFQLGDLANLLGLDWDDLLRLPSLYKLRAGIYSQEFRDVISKVTGCGKLSGIKTDMSINTYRKGCHLLTHDDVIGSRRVSFILYLPEPDKTWKENYGGALRLFPAIVPNVPKTDFSAKLVPQFNQIAFFTVQPGLSFHDVEEVRVDKHRLSIQGWFHIPQPGEDGYIPGEQEETEARSTLQQLQSKELQEFDFPKPIRNDFDEQQIDILGKTIDNKLDDKDWEYLSEFINPVYLKPETLEQLNKTFVEESVIEINEILKKEYADNLRTIMRDPFNWEINTPAPQLASEVKHPWKVAVPPHKQRFLYIDGKSPIELTEAGINLANRIGPQELPNFKLLAETETNEVDQKLTKLGSFLKSMAFKKWLKLVTSLINISDQILITRFRPVSRFYIGKYYGDRIGT

SEQ ID NO: 14696 - protein, 296 aa, Candida albicans
SKTGDIYLLLFFFLLLNYIIESPHHPSIAMPINSESCPLCKVHSNTIKKEDEDEEDNKTSWIQCSKCKVWYHVHCLDLPTDEIDQIVIYHCPECVPKYGESTYKRKSKRARVSIDYQSLNEGDTFAIDKSSHFHLHNFLNFKGETNINVIDKLTKTYALNTQMEKPILIPQADLSKNGMQLPIEKNEITIDYITDCCGEDTPLEVMDVISQQGISPPWKLKQWREYFKTNEEKRDRIRNVISVEISDVAKLGVDFTPTQVCSRTGMYGIRCGLNRKNLQRSRVAPIRVLGSGEEFL

SEQ ID NO: 14697 - protein, 273 aa, Candida albicans
  UNSURE (254),(255),(263),(269): Identity of amino acid sequences at the above locations are unknown.
AMEHNKKLGVTHAIREKLNFHDERLWKRFSARRLELIDTLDLSSRKASEQELEIRRVSEMLRLEFDYPASYTSDFNKLVRAAIQSVRRNRKRSSKKHTSPEEPSLKRNKLDDSDLNGNVNGSNSNSFLSEIVRNEDDVYDVNYNREKRFTSDDQAKDTIDNMTKPRLPPLTNLSMNETINIPLAAAAKKNILNKIEKSRSCNESVNSKLENLQFLGKSVMSTCIGYIFEKSFLHVNPQSMLYLRNKLSRELSLXXIGPKATRXKDPAPXRNQD

SEQ ID NO: 14698 - protein, 95 aa, Candida albicans
KRLANERTFLSWLSVGMLIGGVATALLNYGSNSTLTASIGFFIAALFIIGYSTYKYLWRVLMIREKKAVAYGDKFGPNMICGVIFLAIFINYLVL

SEQ ID NO: 14699 - protein, 188 aa, Candida albicans
GALKVLQNQYDSVTFRDPNNNKPIDIQKLTTQQIKYSSPISKLIFKNLMQVKKLSGRQINRNLALALLGTDGKQLQDSYYICENVKELLKIDNDIERAMYLCQISDKNCSIVGSNEILQWLLSKGKINQALKLFSKRKSSGIPTNLQTYVILFHGIAKAIPWGDDNQQKQQGSTIVNESSPRAGRTAI

SEQ ID NO: 14700 - protein, 210 aa, Candida albicans
ETENYFIDFEGSTIKPFILTSYPKFVAYQGAKIYNLEEDVPGYKEMEELEKQQYEFMYYKTRNERMWEFELNKYRHDLIAIASPHIKVLKSPYLQALDVKNGKDYLYVEGSIVQLQAMWEAYVANELVNSKDTKFPIEYTAEYLDQHQQELSDYQLETVSSPFSATGGWIPQDMFDTLKAQGILVETKDGNYKVETEKVLENPPAQPEEK

SEQ ID NO: 14701 - protein, 210 aa, Candida albicans
  UNSURE (186),(192),(199): Identity of amino acid sequences at the above locations are unknown.
ENFSSKNCLQQFAFFLHNYYHQQLTYLYYSKMLSRVARCSRTLNQVTRNGQSGLFSAVLRTSIRQNSTDSPASNNANEIYTKLSDTKDPQRNQFFQYTWGSWLTNDKSKKKQRETTFSIEGLTLFIDRINQLESKLAQPKSLEGAFVLANNKELLGSTKDKVIVRSIASIHEVDIPCTQITLNTVXKSLKIXLRSIRSXLFSRHTAWNRV

SEQ ID NO: 14702 - protein, 543 aa, Candida albicans
CQALNLTKTTKKYSSKMALTGKMGSHERAGTAQYERAGLYKKSKRHTKDKKLNSKLQRIDRQYKEAIQSAAGTDLLLQEEQGFLEAENDMEKTFKFKQDEIADAVDSSTANKKFELKLPEFGPYTIDYSRTGRDLLLGGKKGHVASIDWRKGKLGCELHLNETVHAVKYLHNDQYFAVAQKKYTFIYDNQGTELHRLKQHIEATLLDFLPYHFLLVTAGHTGFLKYHDVSTGQLVSELRTKLGPTQAMKHNPWNAVTCLGHGNGTVSMWAPNMPEPLVKLQVARGPIRDLAIDREGKYMAVAAADKTLKIWDIRKFKEVDNYYSQTPASSLDISDTGLLSVGWGPHVTIWKDILKGKHQSEPYMNHLIPGSKIEKAKFVPFEDILGVGHEEGFNSIIVPGSGEANYDALELNPYESVKQRQQQEVRSLLDKLPADTIALDPNVIGTVDKRASTVRLKPGEITELADKTQQSKDKMEIKAEVKGKNSALRRHMRKKTQNVIDQRKLRIEKNLKMEKEARQRRRNLEQGIPEEKDLLGPALARFK

SEQ ID NO: 14703 - protein, 315 aa, Candida albicans
SVQYIGLQFLKSTNHHNMSEPVVDTAELSAEEKKRLLRERRQAKMSKGKATARLNDILSQGSSVKTSGVKSVLDQEKEATPSHDEDPEIQDITEITTPPPRTPPIGEDAPQDIDKIFQSMLQQQGQGADTAGDPFAQIMKMFNQVEGGDSPPSESATSTQDPAELKYRQELLEYNTYNQKLWKFRFLLVRVSVTLFNFFYHYINLSNFHASNYAYVRDLSSEKYPVRDFFTWFATTEVVLVAAYYSIFHSLGLFHAANQNSFVLKAMSMGSMVLPQLEHYKPLVARFLGYYELLGIVLGDLSLVIVLFGLLSFAN

SEQ ID NO: 14704 - protein, 826 aa, Candida albicans
  UNSURE (826): Identity of amino acid sequences at the above locations are unknown.
RLQEISFLISTLLKNFNGIIAYLINDFTSIKNLLMNLQKKNTKVRESILDLLLDALMIQSFPWLKNSPIGDSIMRYNELFNDGYQFKFEFKPIDDEFSKNILHHHQGLLTLILMENGIWKHLTQIIEENRGIDIPSRSIEHKRATMLLTNLYAMANNYLPAELIGEKLLLPDLSLCASFEIFNETRHEFRPTPEYNQHVKSSIKQLNIQAKYNIDDNTFKTMVSNSKILAVKEFEDWNWQLLLTLIQGPLGNPKRFDEVLEKVPKFFKRLLSFYRPFKYRFSTVSLTKDKNSFKYINIGCQLIELFLSLDNGIKYLSKSKLLPQISEIVAQIDPFSGITSKDPILSEKRLETTASVGYLRFIGVLSSHSLGIRMLEQWQFFTLFLNIISSSTESETNNLFILTIFKYADFSIDSPFRNTLEMAIRVSNFKIRNYILKHVLPRLIKTEECRLFIIRFLVENLYCIGPSENGNGDGEIVTKSIEILYHYYQEDNFSNLDTLIQYQPLIEVLQKYRLGKKLLNNFLRFPEGFKYLERLGYLEEKFNKLTQALDFKYLYKINSIIQYQFYPHVFHANNNLNNADNDNNDADDQLSIYFLKNLLSTEEGLNFFQFGKGKEFLHSILLSTEIIFQQISQDAKFHDIENQDDEEVKFLINAVKQNLWLIGNLALGEFGIQLLDPMYNNSLNANNNSIINIIIDNFKTCSIWQIRGICFYVLGMIASTIEGIEILDEFNWVSCVDQYGNCKRLSYPKVENLVEIFSIEMSNPYRDTRYYHIFNSIPVEVTEANSNTINNDTGDNIEELVISDNTDKPLVDENGGGGETEDDQFX

SEQ ID NO: 14705 - protein, 305 aa, Candida albicans
GTLKLNKKSPLSHLKNLPIIATITTTTKTRIHYLPKMLNLISWIYIFYLFITSILAFDFGLGPTYYKHGDKVDLLVNKIESDTTQLPFAYHSLPFVCRPINGAKPVHLSLGELLKGDRIWQSGYQLEFGVDVPCNRLCDMVLSTHAIKRASDLIKDGYVVHWTVDGLPGATTFESTNHRNKYYAAGFPLGFVSPSDDEQLSYIYNHVMLVIRYHREKETASKNGGDPKYTIVGFEVYPKSVNDEHCPGSLKNYQNLPLFYSVDDKNQLIESKTTIAYTYSVYWREDNSIDLSPRAAGNPPYCVGQ

SEQ ID NO: 14706 - protein, 266 aa, Candida albicans
LGLSTMPQNEYIEQHIKKHGRRLDYEERKRKKEAREGHRVAKDAQTLKGWRAKQFAKKRYAEKVAMKKKIKAHQESKVKGPSTPKAEDGEALPTYLLDRQTNNTAKAISSSIKQKRLEKADKFQVPLPKVKGISEEEMFKVIKTGKSKSKSWKRMITKHTFVGEGFTRRPVKMERIIRPAALRQKKANVTHPELGVTVFLPILGVKKNPQSPMYTQLGVLTKGTIIEVNVSELGLVTAGGKVVWGKYAQITNAPDRDGCVNAVLLV

SEQ ID NO: 14707 - protein, 99 aa, Candida albicans
QFISPELGVTVQLPILGVKKNPQNPLYTQLGVLTKGTIIEVNVSELGLVTTSGKVVWGKYAQITNTPENDGTVNAYVTFHQCISQDRVMLIFVRRVLLV

SEQ ID NO: 14708 - protein, 418 aa, Candida albicans
SRRGDEIGLAYFFSSTSTQIFSFLSHKSMEHKTNHLDSSMSLFEKKKKEPHLHYTHVIQTLNFKPRVSTMSKVDTVLKEIISSTKSTEASVKELIAFVKDSSSQHPELVRNLLAKSNLLLEGVSLLGLKNESLVSYINNIVLVVLSHLERLESDLETGSSAVERSIIQRVTLEKGVKPLEKKLSYQLDKMIRAYGRMEQDEIKAEQKLNDRGSGENDENDENDSEEDSEEDSEDDSEDDELAYRPDASSFAKLTSAKTKLKPTSSAVSTSNEKYRPPKISAMAPPTAVKSHDLDANTTSSKNRKLQSMEEYLQEQSDMPMVEASVGSTIVEHGRGGVKTQHDRKKEREIQTYEEDNFVRLPTSQTKKSFKEKQRDIRNQFAGEDWSMFNNNKDVTRQGTSRKRKATTVWDKVKKKKNT

SEQ ID NO: 14709 - protein, 207 aa, Candida albicans
YLLVIDNCIMSKPPQQPPFPNKYHVKLVASPDSKACLICYKPATTVLLADGNGDFFYTCPQHLLDDQFANAIHPQEYTELLDKKQTLTDKKSKLEKDVESEKPYIWNTVAGYWKQKDKDKDKGKDKDKDKSTESKYEKLKQELVDVTKELEETSKKILEFKFKLYQLNQDIYKNRLMSYQKKKYSQQRAVKIQEEGFFPSVPKHSLE

SEQ ID NO: 14710 - protein, 125 aa, Candida albicans
YLLVIDDCIMSKPPQQPPFPNKYHVKLVASLDSKACLICYKPATTVLLADGNGDFFYTCPQHLLDNQFANAIHPQEYTELLDKKQTLTDKKSKLEKDVESEKPYIWNTVAGYSKSSPPMGLTREG

SEQ ID NO: 14711 - protein, 551 aa, Candida albicans
GTSYWLDVEVCKDFHNIMSTLIPTASACYSLQLPPTEKDDRLNLNVRTGSAYTLYNSLIFVHGGLTIGLELLNYTIPELNEIFYNRINISASKYKTVEKYLSGELFYLSLIERNWSRVVLEELEIRPKPRLLHQICAFNNCLYLFGGLALLQENDEDPTLVPCNDLWEFDLVLKKWTLLDDGSNYELDDAVPSPRFNHKLTVISSLSFANRKDHFGLFIAGGKDKQSNEIYDNSIFDLVEKRYVGSQPFRLVATTGDDTKDKETGLNEFVSNPEHFLNVDQTRNAILSITDDADTPNRKQNKNPSNHHESIVVYGPTRQTGDCQNSLVSFKVGKREIKGGKVLRLHKNSRVAKLKQLIIPYNLRYPTAGLFGQNVVLTGFLPDEYEISIFVYNRPTGKWSRLNIFCSHEYGSHRFWGGFAWQSHHKVILIGNSMTSRTTSSVRFFSIMLTVSLPITNILVSSELSKGRSNNRTSSFVSHGEQRHHRNKSQNDSLLKAELSLESTTEDLTDSSSEKNAESVLDAPVPLANLKKKTFSSLGSEKITTAVKFNE

SEQ ID NO: 14712 - protein, 185 aa, Candida albicans
LLSVVTLRDIMTLARYPKAVVFDLDYTLWPCWCDTHIMTPLKSVSPTTVVDRYDFQLSFYKDVESIIRELVENDVKIIAASRTATPHIAKQLLSMLHIQGRPAIEYFHSLQWGTGSKTKHIKAAAKNLKMTTELTDGEFILFDDEWRNRDVESINCHFAHVPDESVGLTRHIFVQELRQWNKRNL

SEQ ID NO: 14713 - protein, 151 aa, Candida albicans
LITMSILELLKEIDKLAKIINEKNKELETLQKNYDSKLHTINKYIESISPSTTGTVPEEQLINAISKPIECPHCHQKLWDNQEKSTFLLIPKQKIDTKFDTTVAVRDEQPQQLTTSTTSNKQKKKTNIVCSYCKMTGHTRAKCRKRLNTPV

SEQ ID NO: 14714 - protein, 299 aa, Candida albicans
FSESWFFFFFLFLYNYTMELLTIERFLPFLEPFEGKELLTPSECSKLSLIIVEVLVDRYVDFKLLKFLSRFLTQELYDELIEVRNIEHACGYIKCNRSPKSLLRRWSMNSNGITQAGSESDPVASTKYQIYNRRPTMILPNTYLSQYCCKEHYQASIFYRNQLSNEALFSRKNIFTTPPFSSDKFNWYENSITCLEEVIAKHKELKQYGKSISEVIAMMNGLTVSDLNNNSELNDETNQLIKLIEDFEIVENNEPNMNGDLEEVDEEGYTQDNEENIHNITNNVEGYVTSNKSFGGYVV

SEQ ID NO: 14715 - protein, 687 aa, Candida albicans
QFVNYWTPNSNNSVKRNCDTTLPSNSSNTHRNRHSNTSYHMRRKRSNGGHSSRSNSRGRTKRTDLIVNNEIEEPFPQVRGKSKTTTKDQLKPCKSSDQAQLRSRANSVFSFIFDKISVHQPRKDGSKGFSLYKLLLLELNLNSNDTLTLEKSTDSMNDNHFEELQNMIKIPFCLEKFMIFGLLVCLNSFLSLFTLAPLKVLIISSQSAYQFLTKQQTFQFCRFRLIKKDVITLSIIILSIVVLSNRKLDISRMYHDVRGQTDIKLYVMFGVLECAEKLCSSIGQDILNVLYESSPNRNIYRFVSFYLLSTFYLSFHAYILIYQTVSLNVAANSYSNALMTLLLSNQFAELKSSVFKKFEREGLFQITMADLTERFQLSLMLGIIALKNLLQLSVTGGLIPNSWKSWNRWVGAVFGPSVVVIGSEIFVDWIKHCFIAKFNKIRPKVYKNFLYVLCLDFLEVFKTNTKSGKSSHEFTDYIVLTRRIGLPLLASVVCFLRMILADLKHIFVFPVAGSNFYAIITSGSLIVLTFFTLLLIRVILCMLIFKIANVLVTQHKQHQEKLRKKLNDSRSVAATRDYLLEGTPSPPDNRTNDTSIDINDSAVGTYLSSPLGLSFLPGSPNTEPSTINPTTRAQLYDADEKIPPTIEEKRNKQLLQGVLNEDSWCSDSGDEGLSQVMRYKMSSKRIW

SEQ ID NO: 14716 - protein, 80 aa, Candida albicans
DPTVLPIEIGDSKIELPCSFHVVETSVGILFGLDMLRRHRCTIDLERDVLVIGKHIEAKFLSESEVPRKSLGGNIFQREN

SEQ ID NO: 14717 - protein, 218 aa, Candida albicans
PRTWCFQRLLKTTSFPIPVIVGLIAGIVVGALLYYFGSSMSMQIFLIISTCILYLIAAGLFSRGIWYFETNTYNKKTGGDASENGSGPGTYDISKSVWHVNCCNPETDNGWDIFNAILGWQNSATYGSVISYNIYWLFIICVLLLMVYEEKHGHLPFTKNLTLVQLNPMYHIKGKKKLELNKAEKDELFTKLQQQNFGQAAEVDETSSNKLIESKENK

SEQ ID NO: 14718 - protein, 250 aa, Candida albicans
  UNSURE (243): Identity of amino acid sequences at the above locations are unknown.
TSLFRAKMVDLFNVQVFFVVFREALEAVIVVSVLLAFVKQSMGSSANGPELKKKLYRQIWLGAGLGVLICIIIGGAFIGTFYGLGKDIWGKSEDLWEGIFCIIATVLITAMGIPMLRINKMKEKWRVKLAQALIKSPENKKNRFKLGYLGKKYALFILPFITCLREGLEAVVFVGGVGITSPASSFPIPVIVGIICGLAVGALLYYFGSNMSMQIFLIISTCILYLIAAGLFSRGVWFFESYXFNKKNWW

SEQ ID NO: 14719 - protein, 122 aa, Candida albicans
TLTMVDVFNVQIFFIVFRESLEAIIVVSVLLAFVKQSMGGSSDPQLKKRLYRQIWLGAGLGVLVCLIIGCAFIGAFYGLGKDIWGNSEDLWEGIFCIIATVLITAMGIPMLRINKMKEKWRV

SEQ ID NO: 14720 - protein, 70 aa, Candida albicans
EEKHGHLPLTKNLTLFQLNPMYHIKGKKKLELNKAEKEELFTKLQKQKFGDVQEIDETSSNKLVETQENK

SEQ ID NO: 14721 - protein, 389 aa, Candida albicans
VLDSDYFCYDTDPNNQHPLHYGTDSGNLDVREVIAQWVNKKFGAQVSDPNCINLTAGVSYGVGNILTSVTSPKITQRVFVVTPTYFLINSCFVDVGLDDRLTAIEETHNGKYSIDLVYLEQQLQKYSQDLEPVHDDINVFPDPVRGTRKYYRFVMYLVPTFSNPGGLNYTLETRQKLVEIARKYDLLLISDDVYEFLDYTDSKPLPRLNQLDKAGATKYGNTISNATFSKIIAPGLRVGWQETATPKLVDQLSITGSNRSGGTPNQLSTLVVADLIKTGTIDEIIAKFKNVYKERVAVLKESIAKYLPQDTQVYGGDGGYFVWVVTPSANCFDVVAKLAKQNVVLAGGEHFEVTGDKRNWGQHCVRLSISYLTTEEIQQGIKIWGELLE

SEQ ID NO: 14722 - protein, 289 aa, Candida albicans
TFYSMINFFKGHPSRELLPVNEIADSYKRVLLDSDYLSYDTDPNNQHPLQYGTDPGNLDVREVIAQWVNKKFGAQVSDPNCINLTAGASYGVGNILTSVTSPKITQRVSVVTPTYFLINSCFVDVGLDDRLTAIEETHNGKYSIDLAYLEQQLQKYSQNLEPVHDNINVFPDPGRGTRKYYRFVMYLVPTFSNPGGLNYTLETRQKLVEIARKYDLLLISDDVYEFLDYTDSKPLPRLNQLDKAGATKYGNTISNATFSKIIAQGLRIGWQETATPKLVDQLSITGSNR

SEQ ID NO: 14723 - protein, 69 aa, Candida albicans
CSDFSAPLEIFSFDVPLGIPQELRGLRDQELSEKSGIDGCIFIHAAGFIGGANTKEAVLELARLSLNTK

SEQ ID NO: 14724 - protein, 370 aa, Candida albicans
SIKYGVLFQPVLDETQERLIFRVQNYVDNKLMHFKPSALYLKIGDTLKRSSGAEDKINPLDVDYAENLFPDLYLPLGKSLTLLSNIYELINSMVFDDLAHNIVHACIELLKGGFLPIAIGHMGPIDGQLVYLNNLVILRNQINNFDIQYTRTDYTIDFTSGLSDIWQLIKDRKFGFNNGGILDLASRAAPKIINNMIDANYEIEFELRNAVTQFIDECSRTICYPLLVHDSESGNLVAVTSAFKDNLISNIPVYYGRIKLVIKDPVVTQFLMSNLSSLLVATYEDYYNKIDEKLETMDVLLKDQLNDIMDVDTTYAFITDMITQLGDDSESKSKANTPEFNEEILSSLQLDEPISTSKPASPKTELADPQ

SEQ ID NO: 14725 - protein, 177 aa, Candida albicans
RIMNLPNQFSKLVDVDSEDEEIDLPAGVTKPDQWIKNMGPIKIEPKVWLANERTFNRWLHVTTLLSSLTFIIYSSTSGSNFEGLSTYLAYFYFALTLFSGLWAYYIFMERRKIILERSDKHLDNSFGPLIIALGLTIALIFNFIFGWKNLNLDPNDEFYNNNPTQKKVHEFMVNMVN

SEQ ID NO: 14726 - protein, 352 aa, Candida albicans
RSELGRSMAVLSFNYYVESISDSKTFIENCNKKEGLMLYDGRDKCKIVTIIPELFAQIENWRKECLHLTPQEILKTNYIYTATTVLIWIRQELNTNLSIMYEFYVCLHIVPFLLELIYLREVCQLGNIDPITVLKKVSQIPYTTDYLENVISMLEHYAEKELNLVQTLVMGEFTETVYFKNLFKLTRTQRERVFNLSNKLLNHKHAEIRVSAAETLSGLIHISPVEEVEGLVEKYSDLYSKQLDKVRKKYRKTGYKNMENDDIIKLHGATLGLAALVHAFAFSSPPPKWVPKILTTLANKSTGIPGIVGKTAKESLGKFKKNRQDSWHIDSKVFTEEQIQDLEGVLWKSYFI

SEQ ID NO: 14727 - protein, 178 aa, Candida albicans
KNSLLPVDSTPFYKLDLNSSDLETIKTFSEFINKDWVSRIVKLWVTDAEVNSSFQVMDVFVIASLVVLVSNAYTKHFTFHDLLSIIDEIYVPDEKSAHIITGQLIIGILFGSKAMSPEFWEERDEYVSKYLKRILNEDLSPDNQGIWHVFAAFLPGHVDVRRFPKVIDVFTTRLEDPK

SEQ ID NO: 14728 - protein, 822 aa, Candida albicans
  UNSURE (591),(594): Identity of amino acid sequences at the above locations are unknown.
FRDDFFEFVFNNTYHTIATTVSEICGGIIKRDPKSFKKNARILIEKIKDEIHENEAGGYKGGVDIVPRDQALFWYITILNEMVGNAGNQIIDMSSEIYELSYFLMEKVKSPLVFPAAYLVNQVLQTVTKIKVNECRLISPAYEKEHGIDEKCWGGFWNQSIRFSKENTTFDWFIPSERDVTFAVDFFNAHVSKSLENVMRLMHQYEKEKNSGLKSSSGVVDDIRLMLLFLAYLLSGVSFLLDPSFEENIPKINHDSESIQQRLLLLKQIRELARVSNQKEDSIDEATPEYMEKIINDLTNEDLDILSEFDQGDNELRDNKKQEEESRGREKDDESIPSKPASPTQNPLARFEVKSFPLSRSESVAPAYDESGRATPQINGVHMSSMNPAITFREKSLYTSNYFFGTGLENRRFADLYSKVHKTRELVGKSLHVLFKFLMENFPDNTKIFKDFLFVISIWFSDMGRERALDPSHSKINYGYVSYLQTINRVRKPFTRIAIGARLELYHLFRVALHATSRTETSLDKLLLEDVVRLSVSTYSSISANAQSILVDAMKRLNGSYSLIIKSAFKHLSKALKINDHQKIESGLSIXAIXKIRTRMQTDFYNIYRYLEIMHRCLNVDNQNVYSSAYVLYTSVRKGITPPSSVCILNESAIDCIRPPDQFIDLEIKAVKLAKENKRKIYFEKLEKLQEKILADESNNGHWKITVLNLELLLNLQSYLEIPTRLDILLLFHKEAAVDHPLISRQALQGISRVVNKLCTLTKYDYDIRLMYDLNFVAPHFTTVDIRPDHGVSYKAKWQEELPNTEYPNYYIDYKPSVGWLF

SEQ ID NO: 14729 - protein, 258 aa, Candida albicans
GRGFSSPVGEQKLVASIIISQKEFKLSRNVVKEFVSILLPIVKIGIQSKKEKVGSDYISALQLLAFLEPEYVLENTLLDMYESIEGVISTHRVSTALSTIETLSRFIVSTPVYRVHATRILLLALPGIDSNDLEKTMQSLEVFTSMANYAPFYDLTKGEGDSMLALEFTQGHIDYLKRKIYDGNIESFQVDTDLEVQALKSSTSAFKDLIKSFTQRLTLLLENLPDPEISMGLESALAVSLPKFLYIMFESISDDLFK

SEQ ID NO: 14730 - protein, 410 aa, Candida albicans
CGSSGRGERLPSLWPYKIESPKEQAKFLSHIVSHLYIAIKTLDIQGSLSVSAKDLAALKDAISDVDLALETNLFEMNNDPTCDESNDEAVSDEFEISDDEEEEEEEEEEGEDEEDEGDRDATTQHKKSPKSAAVVGVKTWSHELMVWLKMKYDMPVTLRVNLARVYYAICLCRGQHVNLKTYIRIFELLTKDQLLLYSHGLRLPWEDLCRELELHFAPIDAGLTIFEKKDHKQLIKLASRANYFFARDCLPKIYEKMGSYFAVNSSALVMSSLSLFPTVFTPNGVEDENDIRHYIQSFFYMWEKLNKTNGFDVQISSRLGIIAMSTLSMINDDIETRKFLKLGEFGIFTADQMQYMMNTLINSLSIMMDKYSSMKIKYFHGFASTIVFFNDWRLSFSGLFTAGLEGQRPT

SEQ ID NO: 14731 - protein, 357 aa, Candida albicans
SIMSYDPIHDTYTASTSSQQQQQQQHQQHQQSSPPPSKSTHLHVTGSSPPSINQLISPNIEPSRSDVNQHQNQFADQEQTIPSLILPQPDEPKSTVNTLGGGALSISNLVSSSANEAPSLSAIPPITSTHTSLQKMNSISSLINSPPDHNDDTGDDDYDETDVNSSVVGDDEDYVATPPPQQQHSSTTTPGKSHKSSPSKKKKKNNIANAKLSLKRADGEAFWRRDIQYDFLKELFDDKTACFTNTFSESNIANCNNNLKITFGELYIRTLAESNKSSRVLKEKLIRDVELGKAVAKVCILVNVGRMNTTINFVPEMKSTLRTYHSIPSLQTCREGGTVKQLQDTPRLKSILEKQLC

SEQ ID NO: 14732 - protein, 155 aa, Candida albicans
SLPRHIMMLPQGYTFRKLKLTDYDNQYLETLKVLTTVGEISKEDFTELYNHWSSLPSIYHPYVITNASGIVVATGMLFVEKKLIHECGKVGHIEDISVAKSEQGKKLGYYLVTSLTKVAQENDCYKVILDCSPENVGFYEKCGYKDGGVEMVCRF

SEQ ID NO: 14733 - protein, 755 aa, Candida albicans
LDMAAAPPPPAKNQGKAKQHVTGARFRQRKISVKQPLTIYKQRDLPTLDSNELEPSQVHHLNSNASSSSTQQPRDLHAVETGVDKNEEEEVHLQQVINAAQKALLGSKKEEKSSDMYIPTPDASRIWPEAHKYYKDQKFKQPETYIKFSATVEDTVGVEYNMDEVDEKFYRETLCKYYPKKKNKSDENNRKCTELEFETICDKLEKTIEARQPFLSMDPSNILSYEELSSYIVDQFKSAVKTSNPYIVTNGGNLEYISTTALKERLSKEIKYEPFVTIFDKNQMSTSAVRPIPKLFELFGRPVYDHWKERKIERKGKTIQPTLKFEDPNSNEKENDNDPYICFRRREFRQARKTRRADTIGAERIRLMQKSLHRARDLIMSVSEREILKLDNFQAEHELFKARCATKACKRELNIKGDEYLFFPHKKKKIVRTEDEEREKKREKKKQDQELALKQQQALQQQQQQPPQPPQQAPSKQDGTSTSQPYVKLPPAKVPDMDLVTVSLVLKEKNETIKRAVLEKLRKRKEHDKGFINLTDDPYQPFFDISTNRAEELSHIPYSSIAATHYHQFNTSNYMNDQLKKLLEEKKPLPGVKTFLGSNGELVPSKAFPHLLSLLEEKYKATSGYIERLLQSVETQDFSSYTNGFKDVEPKETNEPVMAFPQRIRRRVGRAGRVFLDHQQEYPQPNFQQDTDRVGGIPDVYCKEDAIKRLQSKWKFDTEYKTTEPFSLDPSKLNGISPSTQSIRFGSMLLNRTRK

SEQ ID NO: 14734 - protein, 295 aa, Candida albicans
TMSVVTSEISYQPSSSMDIDFLGESLYRSNEDNLPLNDHIKNLKVKTIYNTITKTKTKTNDKRQVLKLLSDLARSTDGLINNELRCKIWPILLGIEDDNNNNNNNNNIGSTDVASQSDKVPTTSILSNNKYSTDLFLQDLQCVELPPHKDEDQVKLDIQRSITILNHIQSLLYSGSSSYTTILTTNEIDHLKGKLSNLIIKLLRKYPSLNYYQGFHDIASIILLVCYIPNDKLDDYNINGTSYISNNNNNNSSSSSSNTINGSNNTYEDSNDYQIDEELASKMLEHLAIYGQPAG

SEQ ID NO: 14735 - protein, 357 aa, Candida albicans
YFCRRPPFLFFNYFIHIYPRSPSLGLFKNIYIYIYFEQCQSLLQRYPINHSSSMDIDFLGESLYRSNEDNLPLNDHIKNLKVKTIYNTITKTKTKTNDKRQVLKLLSDLARSTDGLINNELRCKIWPILLGIEDDNNNNNNIGSTDVTSQSDKVPTTSILSNNKYSTDLFLQDLQCVELPPHKDEDQVKLDIQRSITILNHIQSLLYSGSSSYTTILTTNEIDHLKGKLSNLIIKLLRKYPSLNYYQGFHDIASIILLVCYVPNDKLDDYNINGTSYISNNNNNNNNNSSSSNTINGSNNTYEDSNDYQIDEELAFKMLENLAIYHLRDYLISDTNLSINHLWTRPHEEEFCVQSKT

SEQ ID NO: 14736 - protein, 756 aa, Candida albicans
  UNSURE (29): Identity of amino acid sequences at the above locations are unknown.
RQYLTWIIITKKGELEFNSKSGKDLFYDXNNQFGYTKIDTEEQVNKYAALDQKTDFLFFPRGETQRNNAKYHKDDIFLEQGDSDYDEDDEIDSGKTLTETKKMLTDSQKFAYIGIAKLITVEMATDLAKVQFGTSSKIAKQMSGSQKNFSNWIEYVMSKLYDHLTVEGAEKEMIENLSKHGVEVNDLAKSLMEVGTKAVISGGNKSFISEDFDLRWVIICDMFLMLLSDGYYDARSRSLLLRFGASVDITNLELFQFERRLIECLDMETKEKSIENKDEKLGDKLFVQQQIKKNKNKRIAYIGLATLAGSLAIGLSAGLLAPVIGAGIAAGFTTIGISGTGGVLAGVGGSALITTSGVAIGAKVGSKAGSRRVGDVHTFEFKPLHNNKRTNLIVTVSGWMNGAMDDVRLPFSTVDPVMGDMFSLLWEPEMLQSMGQTIGILASEALSTSIQQILGATILAALMSAIQIPMALSKLSYLLDNPWNVSLDRAWKAGKILAETIISGNLGVRPITLVGFSLGSRLIYSCLIEMARRGGYGLIENVIILGSPITVDIDQMSEARSVVSGRFVNGYSKKDWILGYLFRATGGGIRAVAGLSPLDNVHGVENIDCTDLVEGHMAYRKAIPKIMKTIGWEVLSEEFAEIEEPDPEQGERQRQLINEFDEARAKMEKEKNENIEPKGWRKWFKPKKKDWWDIYGQPEGTEKNDKGEYVDEKLEGNAVFDVDALVKEVNEIEHMVDENAKKATDPEVKNNKNEEK

SEQ ID NO: 14737 - protein, 314 aa, Candida albicans
LMSFLNTIRGLGRGSKKNKKDLEPSNNAIYSHSNLSGNGLRRTQSPTKFSPSKLSSKGAQGSAAYTSSPTKRSRTGQSLQHQDLQLLLQYQQQLGSVLPLKRSSIQTTKSTTVNADPPLFLCEPYVKTALVKGSFKTIVQLPKYVDYCEWLALNIFELFNHLNRFYGVIQEYATPEAYPTMNAGPNTNYLWVNSSGQAVNLPACQYIEYVITWVTNKLNDQSVFPTKNGGAFPPNFIKDCKNISRQMFRIFAHIYHNHFDKIIHLSLEAHWNSFFAHFISFVKEFNLIDRTEMEPLLPLIENFEQQGKITQASK

SEQ ID NO: 14738 - protein, 337 aa, Candida albicans
NYQTMRLKLKSTNGVSTITLDDSKKLFKDFLIDIQQDTQLHQDTSESVSTIKLGFPPKPIDLSYGLETTLSDKNIKDGDQLLIEFTSFKRKSVSEPPLSPQPSEKKPNLRDDIPSTFIESLNKYLILRNIPDDNSCLFNSISYAISGYDSFKNISPPEELRKVVVNYIEKDPELYSDLILGRPREEYCRWIIKKDSWGGAIELGILADWFNVRIVCIDIELGNFIRFENEKDHPEKFIILVYSGIHYDVLATNDELSTENKDTDVAQWSTGDVQQEEDILAASQKLCKLLQSKDYATNTTTFRVRCLDCYLVLVGEMGASKHAEETGHLNFGEVKKS

SEQ ID NO: 14739 - protein, 164 aa, Candida albicans
SGFSEKQTEVTVNVVYAAINDGIYSITNNLVKKESLSSIAYQQKVNFAKLKGELQTMDKSEFTSLKKEQEKLRTDLTNLKNRLKEEITKNQASVRLDLNLEKGRIREESSQHELRIEDTYSRIDEEVSNMKMQIKTVKTQVLQWLMGVSTGTLALLLTFVRFYF

SEQ ID NO: 14740 - protein, 603 aa, Candida albicans
  UNSURE (589),(596): Identity of amino acid sequences at the above locations are unknown.
KICRLLLSIPNLLKFFSLFLVSCLKTRQPTTTAIQHSHTELSTKNQISHQQTKYTSYTYTQSIYTNISSMSTNSTSDRFPNLYWSIDYVTGLNNLKSQSFKSLKQLHELRKLVFNYMTYYHANSEFLNKSSIDLFPVESTFLPFEYNPRSVSNTPTTSPYRKRIVSNETTVSKQETTTPKHETTMTTAYSEYIDYMSQESTILLNLTSIIDRDVLQDITMYLKYHEPKIHQQFTRLDEVYNNYLKSYKNIERLKSRHIEQLRLKEFSQSQVEQTKSSPEETVEDQLQHSSSFEESYADEDLEDEEIDNTFDLSFPLHIGTVVVSSAEELQLIMNQLITKVPITMRKIPLPGYKNEIFNSESISKVLLTIPIKGFKPSRLNIEKFGQGLLDLKLMTSSNFFNKKFKSEGMWFEWSDLAVYFAQFKSSLAASSVKDTSSIGSNTTSTTNKSSAISSPKNGRSKFISDMAETTTRFNAMFNNVRSSILKTSHAEILEDIEDSYNEEILDLQEFKYLLENGLFDLSQYLEKFEKMKIEIIYKSLSRLLEILLKFQKEQTTKLEAFSNNFIRNINKSENYLHDFNKTMEHFSTXEIYSPRXNNNRTPK

SEQ ID NO: 14741 - protein, 908 aa, Candida albicans
HAKKKNSLISYKTFFIVKQHITSHHTLYIMSFAESFWTPDYELGFQQLFLQLNQGILENNDFVRLIERRMELEVVYGNSLETITTDCKPLNKRQLNEDFVSTIKNAYTKMNETFYKQGEYHLNIADNIETIVLQPFSKWCTEHEQRVKFSEFTLQDKLKALKNAQYLVEKLQKKYFNKCRMLEEFKSHYTEKELQEELSNLSFQKDRAAKTNTDGSKEEDDNDTADEEIYEFTHAKYDTKQMKALLKAMLTEVPMGPHKVAILGTYQNVSTGSNITKWLLENMPEFNKNLDKAEVFGQDLVRNDFIRIVGSMGKSFINSSQFYYQWKPIAFTISGVENEYVITDTSLAKSFTFKFDDVKEAIGVNTVDFNDKSQLSKLINEVNQLDTQYYAQVVELDKLRCEYEELAMDHLTFMQKCELDRLKAIKKVTFDFLSSFANKISSLKTISDDLVLLEETINPVNDLKFLIENYGTGRFKPKVVLYDNYYDSNINQTFGVDLSVKSRLDKKVVPYIIQCILSQLDSVYPDLKNDEERINLWTQPVHLSNVHKLRSQLNGVQDPNEIMSILKESHPLLITNILKLYFMELPDSIIPYNNYDVIKLLYTNYHDESQTKSRVNGLQNVLSELPKCNLATLDAILTHLSRLVSIVGTQDKDLAGGFQRKLSKEFGSLVLRPKTDGLNSSESSYLNDRFQVTLMDDLFENKQSIFNELRRQSSTRSAVASVSPSVSRNSSLTRSESIKSNKGHNAAAIAKSKSRLESRLQSAVKNQTKTLEPQQKTDADEFYDAEASPTPSRLGTQSSSLGLKRSTSPKKKKWTVVSKEESKEGNEKSKKITSTPVTYRPSNDIIYDKSPSNQSLNDLSSTPPPKFAPILGRKSSVKDLAKSFENGSTEDLQEPSSRSRSSSPTKAK

SEQ ID NO: 14742 - protein, 232 aa, Candida albicans
EFIMSKYGFIKISRDVQQAIPNPKKPSIQLNTELPLDSPLTKFVYDYSKKRLPNETFNHSLRVYFYSVAIIKDQFADWTLDPEIVFVTSLLHDIGTSHENMHATKMSFETWGGILSRDLVLEQTKGNKDYADAVCEAIVRHQDLGESGYITTLGLILQISTILDNVGLNSHLIHEDTLDAVNKKYSRKGWLNCFAGAIDKENELKPWGHTSALGVDKFKDDVLANKLRYEKL

SEQ ID NO: 14743 - protein, 92 aa, Candida albicans
FFFYLSFFFQASHHKYLFFTFIGYPATQYYIMAPRQSKTAKRNKTQNKTRTVDSEVFSDSAAKNLLADQPKLTPKSKVKKIQNWHLKNSKQK

SEQ ID NO: 14744 - protein, 69 aa, Candida albicans
KWKGILREAPLNIPTLNKAIVPGVKAKRGKKGKKFVDDNDTLTMNRLVKSINDKYDQVNESKLEKSRRL

SEQ ID NO: 14745 - protein, 127 aa, Candida albicans
NLRMSQQRENQRGIVSQTTTTTASPILKLRAQERQARDVSWDANVVDNEHLNKKKTKICCIFHPSDRNCDEEDSSSSSDSSSDSSDNEEDDKNTKIAPKSNNNKKKSKPNAYEVQPHYKNQSKVPGK

SEQ ID NO: 14746 - protein, 167 aa, Candida albicans
VALSRWLVSLCGEDVETEDDVATEKSKDVEQAVSSTTKETTKPEVLETEKPKPAVADDDDLDDLDISPEEIRKHLESQPVYIFTSLAGGMQVILRSNNLAAILQGNGIKFEYRDLGTDEEAKKIWKRQANGKTLPGVVRGDDYIGNWQEIEDANEEYRLRELLYETL

SEQ ID NO: 14747 - protein, 901 aa, Candida albicans
FFFKNMDIEERLEKAEQSDSPSLVGSSIRSADDSTHKNYIHPEKYKSSKDINKLKRYSKLNSAITASLDDLINEGALLGSEADFDKFLDQDGSVKTDAQYTPEKKVALEETDDVTSTKGDEVEVLKTQKEDKKAQVAESSPQKSSSDEKSSETESSVIESEPEISSTEDTATDNVGGKTAASSFYKQEDYSTPNLSEFQLEHDIKDHKELIDHVQSYDLQKLPNSNSSFNSKFRKDEEVVSATSSQPTLLSPAQQQRLEGGLHTPFFHTERPRSRSRSANPTSTTRDRSSSRNSTGSRKPHWARGDSYKSTHEEEPSKYELPADLAQEVDEAKEEEEPDERRSRQSKPTMGESIAAAEAKAEALGKAADPAFEADTPLTRDPSLVTTGDYTNFEVDTPKKEIPLSDNFYTARSASATNYLRSISRSRSAARNTNSVVGKDEKNDSSTDALVREGALISDDPYSTIEQLDTMVEEVLHIGDNTLTLDTKSTDTKDSEKEKFVAEPKSVDKTKELETKTSEKSEESKELGVEKLKEVDTEKEIPVEESKKVDDNDETDLKESKETKVEKASDKPITHEELIDEDIEKAKHQSNEKDDANTDVLAEEGALVNEDDYDLVDKKELEKEGITTEEEAPLNIKEKKSEKTVQEDVLESSVKKDDEKPILDVESKEAKKAADDEEKAASEQPPLDIVEKSSKETEEKETDETTKEELPVGTKVEDSEKDTTTLKSEVEELEKSEEQPLDIKKKEVVETKDDVATEKSKDVEQAVSSTTKETTKPEVLETEKPKPAVADDDDLDDLDISPEEIRKHLESQPVYIFTSLAGGMQVILRSNNLAAILQGNGIKFEYRDLGTDEEAKKIWKRQANGKTLPGVVRGDDYIGNWQEIEDANEEYRLRELLYETL

SEQ ID NO: 14748 - protein, 454 aa, Candida albicans
LNTRMVTINDLSFNPDYSSISVSTSDGFKIFNCEPFGEFYSSQESPLRKSISNSLEDSAGCQNPTHSKTDSQDTPARFPTAFLKMLFSTSLTIVVPQTQDNLGNRLLKIYNLKQNLKICELNFPSSIIDIKLNRKRLLVVLDTGPLYIYDLSCVRLLKILQLLFNEHDGDQKFIGDLSADDSSWLIIPVQSTNNQTDLLNAETGSQPFTPKLTPSDSVINTGSYSQYLEFTRNSSLSNLKKKNKLITLEDIKKDSEGWVVVYDTINLAPVVIFEAHHSTIARICISHRDNKVATASIKGTIIRIFDLKEFEGKVKVHKVKNLRRGHNLVKVNSLSFHNDNHILGCGSESNTIHLFKIHEEESDICTNENSEDRTNHNSDYEDSDGDTSKSSEDLNENLANLLISKPLDPVPMETEDKLSSSWFVKTKKLINNQYTSSIIKKLPYKDYFENLIWD

SEQ ID NO: 14749 - protein, 378 aa, Candida albicans
LQLVSRIPVTTEKHYPRLLFGPHVLKQMGGSNSTQNNISSVSNTPNRVGDVIIFNLTSLQPISVIEAHKSTIASMAFSNNGLYLATASDKGTIVRIFEVATGTKLYQFRRGTYPTKIYSLRFSADDKYVLATSSSLTVHIFRLGEEEALETKHKKKKIPAVATILEEETEGSQSNEQTKSIKRNSEEFEDIRDDGDDSDVDDEDGDIDDESLEVIPAKQRKLSQGSTNSYTSVNSEDVQSNSPKTEPLIDQNRLSMARIIRRSSQTLGRKAAQKMGDFLPSRFSSILEPTRNFASLKINAHSKDTKSVAVMNNVLQQDLIPQTYLASDNASAKQDFMEVSLFHIYVVTTEGMLYTYGLDPERGGDCILLNLHCILDEY

SEQ ID NO: 14750 - protein, 163 aa, Candida albicans
PIMLQTLSSSATASLQQQLSKQYANSFSNDGSSFSSKNNQQYSEIVNYISFNQDASCITIGLKNGYKIFNCQPNFGRSFQFKNDESTGIVEMLYCTSLLATVAQGEEIGSSPRKLKIINTKTKSTICDLIFPLTILQVKLTNTRLIVVLEDQIYLYDITTMKL

SEQ ID NO: 14751 - protein, 263 aa, Candida albicans
DDKMGSINSQKAQKIQSILALPPNFKKITCSTCDMTYNPHISQDKLLHNKYHTNFINGIPWNYKTDNDVLIIENFTLVETPKLNSTGKSLKLTKTRHTFKGSIICINKSNKRHIQKVELLLSMVNQELNASQDSGQWKKPEFDKSKAFVIIIDNKAIGLCTTDTIQPDQGRWMIHKTQSIVPNQINRNVVIGISRIWISRKWRQYGLGKKLLNVVLKNSIYSVQLLKNQVAFSQPSFSGGMLAKSFNGVKHKSGEMLLPVYIE

SEQ ID NO: 14752 - protein, 263 aa, Candida albicans
YDKMGSINSQKAQKIQSILALPSNFKKITCSTCDMTYNPHISQDKLLHNKYHTNFINGIPWNYKTDNDVLIIENFTLVETPKLNSTGKSLKLTKTRQTFKGSIICINKSNKRHIQKVELLLNMVNQELNASQDSGQWKKPEFDRSKAFVIIIDSKAIGLCTTDTIQPDQGRWMIHKTQSIVPNQINKNVVIGISRIWISRKWRQYGLGKKLLNVVLKNSIYSVQLLKNQVAFSQPSFSGGMLAKSFNGVKHKSGEMLLPVYIE

SEQ ID NO: 14753 - protein, 788 aa, Candida albicans
  UNSURE (25): Identity of amino acid sequences at the above locations are unknown.
FNGLFSFFLFLVLWRSLQVLRTWFXILGYNGSVILDISGQSLGCLTSESIVNELNMPRICPTCQLQNVSILAPVKPLRDLYNIISNQQSQTSLERRRPSSSKKSIKAILDENYKPKTGDETAGNTEPMSLLSLFYKFAKEEQFERTDLKEVPHSYQQQLQQMKDNQVPIQNMLQKQQLNYSDISKTLPIDISSKKTNVDLTRSYPSSVLMNSTSISPQNNRAFVEPAVSGIARTNTETDFNNSTDNNIIPSSFEKNLLESLSENKEFNFAKCFPFHRKLSTFPTQQLKLNLSSIVPFKLSNYSIKRATSTSIHSYLDYNSSMEITRFVLISNKRWEVYEYIVPMGDTGNLLIKPQLICCGKLTGEYGENLNSLSLPESDSDEPKEIIVRNDFGAKDNTNCTNDLDIKKRLSSWDQMYCKLTRNYLVISGTKGVMRIFNLNKMSPYKFGQPMYTFVTNFPIRCISIAPNDSLIACGITAKERISGKEQPFVILHRLMMLEYGSLESVDPLTITIPYRDPIKIMNFNASSTHLIIATSWETRYLIIRLTNNRQNDNYRKPRLVWSEIVYKSNRRFKSDFDDENLAGAIYEERAEAENDLMLSKEGITDVKFGTMNSNLIIVTSCSLRSRPPLVIKLEGSQIDSTKNVVNNNDMKSLNSADESEKYSSVESAETFMRINEIGSLIHRIAVSPRGDGIVFLDKDGKLFLVASANFYPGRRISSTDSKNKKIVVQLGDVANAERFSESASVVFSADGGKVFALDRKGVFSVFDFTKGIPGEDPDVIKCKIISL

SEQ ID NO: 14754 - protein, 288 aa, Candida albicans
PRRIKPSMDIILILLQRVNVLIPSYTIHFIISGIHIPLGIAYAEFKTPEHIESVIKEFDGHVLKNKKIAVKKHMAYDPNNRRFSFKRKSSIKNGKRNQTGTLSSEMPVLVAKESLLHDDETVSIKQPKKTHSGKKELSMDTIMIQRVYGKVTDESLRDFFKEYNPSQIYIFKSRKPKLNPMNFTGSHVSVLAKLDASKIKLEDIIFNLKSRKLNGKHINMKPAYKSKVLEVEKAIAQLKSLENTEGCGDTSCNDSVVVNEKTSIANKDGKNNDGENLAISLIGTVSNC

SEQ ID NO: 14755 - protein, 492 aa, Candida albicans
  UNSURE (486),(488): Identity of amino acid sequences at the above locations are unknown.
TRTHQQTMSTSTTYEKLPLQPLFDTIEELKPKFIERLQKAIAIPSVSSDESLRPKVVEMANFLVDELKTLGFTDIQLKELGTQPPPVQDANLQLPPIVLGRFGNDPAKKTVLVYGHYDVQPALKDDGWKTEPFTMHYDKEKEILYGRGSTDDKGPVVGWLNVIEAHNKLGWELPVNLVVCFEGMEESGSLGLDELVAKEAQNYFKKVDQVTISDNYWLGTTKPVLTYGLRGCNYYQIIIEGPGADLHSGIFGGIIAEPMTDLIKVMSTLVDGSGKILIPGVYDMVAPLTDKEDQLYDSIDFSVEELNAASGSQTSLHDNKKDILKHRWRFPSLSLHGIEGAFSGAGAKTVIPAKVVGKFSIRTVPDIESKKLDDLVFQHITSEFKKLNSPNKFKVELIHDGNYWVSDPFNDSFTAAAKATQDVWNVVPDFTREGGSIPITLTFEKELGVDVLLLPMGRGDDGAHSINEKLDVSNYINGCKTLGGYXHXYGKA

SEQ ID NO: 14756 - protein, 168 aa, Candida albicans
SCGRMSGNSRNTGISSLNNNRPTAKRSPSILVTDARSDKVKGARAPFAGQSYKKQQQQLQQQQKHSNYSFQQLQHLNALQLRFKNKYTDISVDKLLSKSSDIPSGLSRLPPRLSRQRYGSSSSSLNSYSSPHHSIQGSYGAEPRRNIRSIPKLCSVIDHQEHQKHPRI

SEQ ID NO: 14757 - protein, 121 aa, Candida albicans
FQDFLKNLPFQEKIEIDHVKLVKKKGKLLKIRVDINLSSSILDTPEFFWSMEPALHPLYYVVREYLELDQRVQVLNDRIQVFLEFIEYVDEKNSSRITWMIIAIITLSLLVSLFELSLNFL

SEQ ID NO: 14758 - protein, 231 aa, Candida albicans
  UNSURE (220): Identity of amino acid sequences at the above locations are unknown.
SVFILFYFILFVFFSFFFGCLNYYIFGIFFFGIKLATFSNSINFFFNWKRSQPKKYHISTMTDSDDEPITLSLHALAALQEFRNEEKERLEKFESLYQQSEDKFDEQKKQEQQKITIDDFKEDWQLSQFWYSDETAKTLGKALLEGADENTVVVIASAPSVYAAIKQFPPEEIPTEHIYLLEFDPRFKVLAGSEHFSVYDYNKPNDIPEHLRNTCHRLFXHTRPWTVRDWY

SEQ ID NO: 14759 - protein, 102 aa, Candida albicans
QHLLINLHNIFTMSANDILDVLNIQRDESNQPPKKKQKSSSTHTLPDGKQLTGMARELYNLVGPNTPPINLNSNSYTANKEKMKKFKPSPWIFTYGLTGPNI

SEQ ID NO: 14760 - protein, 88 aa, Candida albicans
NFPFPVFENDLYAYLWEWIHDDWSLELEYQKSKAHDGWVYFDSNWGNGIVRDGFSIYTRSRKWTIRATLIIDNIETVYHEYDQMYTQL

SEQ ID NO: 14761 - protein, 327 aa, Candida albicans
RKRGSFQPPWSKTQLTLPSLTMTAGDNSIEYVNPYSLSQTINSDLISILDPNGSTTSIIKPQLNYQIPIFKSIDVSNLIDLNNTKIQTQTNETRINKAKDSSDDHQNNPLSKDYDTSGENIVGGIDDIVEDIKLYVSIDKLKPENFQNQLTTIIINQFPTNLKSNLIEQLLKMLMNLKKFVWSFINHELIDLKLIFIKFDQLKDLKWFLLTYCDHISQLIPNVTIITNDKVNEYLNNNKDSSLAKVEPSKITDNLKAKINLIINNPINYTKGKKNSGTEDLDQVLDSYSNYKVDNNDLIDIPNNMKENIIKDIIRFRSRMVLIETES

SEQ ID NO: 14762 - protein, 190 aa, Candida albicans
KFFFLFFFPNPPLTHTLSLRVNLIHSRPLCYHHHGHHYHHISSEMIHQHFQPPWVAPFDESVKAELSVTKNDPPFTSFQLATIDSETGYPQNRTLVYRGWLFDNKDSSVLTFATDKRMSKYKELLHNDKCEAVFYFSRIKKQFRLRARARVIDEQNPPLDLINVLNLEVETERQISTDISLHQPAGRTCE

SEQ ID NO: 14763 - protein, 395 aa, Candida albicans
HFEPMFRVNFLNKGYVKLVIRAPSATIYNVLWVLINCRANIFKKVIASLGLKMLPLAHLFTSTGTRVNSKSFLQLNGNGKPNNHRGSFGSYTASSYPIDYSPPEYEKSFVDANNNGIESSPSNTVFATQNSKTTSFINIGNGTSLLLQQQYQQPISLSLVPQESLDRSRSFNRSNSLQNIPQPDNTPSSPYSQQPKILHQRLLLMQHHPSIFLVSNSFNNGLSNASNGFSFRSNPPLGRSNSISLSNNDDDHIPVQYFTHNANVQASPQETHSATTPTSRFSFNSRLSSQQFIQQQQQQQQLLLQQQQGHGYYYTESSSSAIVDDDDYPAAKNEFMFEEDFIPGSLSDVILTPQELKRRDSRSQSGNLNVRPSLNNLFESQTQPTHDNGNVFLMD

SEQ ID NO: 14764 - protein, 292 aa, Candida albicans
SLQHQQKLKQLFFSTCILVSYSLAMANSKYEYVKLFEKENYLLPDTYIIIRVDGKGFHKFSQFYEFEKPNDLKALQVMNLAAEKLMSKYSDVMLAYGDSDEYSFLLRKNCQLYERREMKLTTLFSSLMSTYYMYFWLQYFPDKPLHIDHLPNFDARAVLYPDFKHIRNYFSWRQVDCHINNLYNTTFWNLVLKLKMTPQQAEQRLMGTVASDKNEILFKECGVNYNNESEMYKKGTIIVREFENYETEDEAELSKRQVQRLEKKRKKAELKIYHVDIINDDSWWKSRPWLKD

SEQ ID NO: 14765 - protein, 263 aa, Candida albicans
SMSSTSETATVNGTNGSAGETSTKATTPISNDDPLIYKKRKLVRSPSKTNPLKYKVWLAGHISMLVFGSISFIFQILWLPNYYYINSISYRLGLIGSIAALTATFSHKFGLHNLPNIGTLLSHQNFQYLVLAIVWIFSFKSVFKILPYFLLALLHIGNLKKILFITKELDFLASVIAYDELLLVVYLLLRTLFFRNTSGYQLTIFLVFYWLRILYNKETTNLFQTIIERLDGKVCNVKNPKVQHYWYKIKTFVNEKQQQEQQD

SEQ ID NO: 14766 - protein, 135 aa, Candida albicans
RNINIPISKMWMPSWPEVEPNQYIRQFLLTNVNKGQRHEHVTSKVPLDIVGNAITKGIIASWPYDLNISRWTSPSLFIRGTESKYIPDDAIPEIAKYFPDFELRDINSGHWVISEKPNEFMDVLSEFIERREDEL

SEQ ID NO: 14767 - protein, 164 aa, Candida albicans
HVLFYLLVVEQQDFRISCIINIIRLFLQSGDIRTFIKAVKLIEYNEQAQKALNIQLGQRLKAYGIVSADKWVRNRPVQSVKTKRKDGKDHLIMKFQVESDNGKYGVVSLEQIDNSMWNTEFEYISLDVPGFNRIYIIEPPKNQLIPKIGGGSGFLGLNWGPKKD

SEQ ID NO: 14768 - protein, 249 aa, Candida albicans
FIYQKFAAFSYLILFVICYLLFVVCYSFAFLSMMLDYNPVPFDHTYILYDPNDIIAKICVQFSLLPIYLMVFYTSWFLITREIEPVIIVGGHLINELINKIIKVSIKSPRPDFHKNFGRDGGSYGMTYGFPSAHSQFMGFFAGYYICVILLKVPMPKSSKKPICLFAAISMMGVAFSRVYLLYHSNVQVIAGLITGVTLGIIYFIITSVARDVGLVEWILNWPIIKYFYVKDTYYHIYQTFAEEYEVYL

SEQ ID NO: 14769 - protein, 224 aa, Candida albicans
  UNSURE (40),(50),(54): Identity of amino acid sequences at the above locations are unknown.
LIMTDVSPNSKIEHLTPDNITVTAPSEPPFSSSSSTSASXSTPTPIAEEXLFTXIPTPLPSHRRGSSIGSSTSLSSSTRNRSNSNSANALTPTPSHHQPAHSITRQRRSSSLIQHLEPDTLDTKIDQALNPNVNANWVHQKGAWVIHVVIIILVKMIFNFISVLNNDWKWTLTNLTYNIGSYIMFHQVKGTPFEFNSGAYDNFTMWALIDNAVLTTDWKVNACV

SEQ ID NO: 14770 - protein, 300 aa, Candida albicans
  UNSURE (2): Identity of amino acid sequences at the above locations are unknown.
TXIDEDPHTCWFFCLSLFQTMITKCYVQVFRYRRVCHNTKYSFNSVVLIKWLHSAGSSLSQANSSKTSQSSLTSSGFLYYEDPHRYNGSDVSANASETTSTSTAKPVIHLATPYSDKYYQPIISQGAKGFDKLIIPVGFCADNQTVSLEEDKESPIQQDQLQEIVNSFDAPIDVSIGYGSGILPQDGYDKDKSTPNNTANDSKQLDFMFLVKDCGKFHQENLKQNRDHYSIKSLRLIKKVQGTNGMYFNPFIKINEKLVKYGVISSKSALMDLSEWHSLYFAGRLQKPFSPGRCQSTLML

SEQ ID NO: 14771 - protein, 480 aa, Candida albicans
INQVLNIKSMILKLLYKLSKYHQVEILVLHFSSQEKSGKPANVSIYNIRNFNQPICFKNFFKAEKCQLKWNSLGTALLALASTDHDTTNKSYYGETNLYLLGIAGSYDSRIDLKREGPIHDITWSPTAREFAVSYGYMPSENTFFDSRGNAIHSLPTAPRNTILYSPHAKFVLVAGFGNLQGTVDVYDRQNKFSKVVTFEASNTSVCEWSPCGRFILTATTSPRLRVDNGCKIWHASGKLIYLKEFPELFSIGWKPQPLDCFPPIRNLEPAPEAHESTKEYLEKRQALASAAAKKPAGAYRPPHARGGGAGSGSGVASSLYQKELQNNLRSNGSTPSPPPGLSRAAGNIPRVRTVVGAPPPVEKESKAAAKNRKKREAKKQAQEKNNSPAPEATTSASPVPAQAQAPASTPAPTPATAGVIGGVASLEEKKIRSLLKKLRAIEQLKMKQASGETLEDTQVIKISKEDEIRSELQTLGWNE

SEQ ID NO: 14772 - protein, 377 aa, Candida albicans
LGVDEKPSRPRETDSRSNFPYVVHRRWKKVCEHVLVLPPRTDLSCCRRLFFLNEVCKTGQYRDHLVDDIVGPCYVIFLTRYQKGDLPEGVIPESAPWFICEFRYNENTHVFNRIRTWKACLPDEVREDPEQPLIPLKETRKLIKYESPIKGLLAPDAYKGMEIPDAIPGTANSPPVSGSVYIGAPLPNDDLGQYISSQNVDAVPEHDETKSGRRAFLFTPISQLKGGGGSTNTVYATGPAVPHGTISHVPAKPIADIPGLTPLVARNTNILINHEEKHQLPGSYKLLQEQIQENQAKKQQEQQLQQLQQQQHQQLYKKTSTPTPTSIAPTGTTYHTSMSTYSNLLVGGTLAYGLNESIGELGQFVNKKRKLVIMKTR

SEQ ID NO: 14773 - protein, 426 aa, Candida albicans
TMSEREKKKLLTKLQSLFNGIYKIEDNGYLIHPTFQTLPLRSGTDYYKVVQNPLSLHAVGRKLKNLKYADAQEFINDLALISWNARFYNHSKSVIYRQAQILKQYITDVVIPKLKNDKAVPNGHSLIYPHIGDLPDDRDNDELLGFSFEKGESTPGPSGASNAGSRRDEFEMSATPQADSMVALSKPLVSTGYTRLSFTTPSRPTRQKHKDNQIESGIRRGRPPIIDKPFETRIKLILKGFKKLRDNNGHPLTKHFEKLPDIKTHGDYYERIAAPISLNEIRIKVRSRKYSSVELFINDLDLMFANAQLYYENDPYSEEFLDSQQFKKEAHLVIQTELSKSDKEIILATSSSSDGVLRFPLEVLEVDGYTYKIGNWVLMKNPADPERPIVGQIFRMWSTEDGKRYVNMCWYYRPEQTCHAVDVCFS

SEQ ID NO: 14774 - protein, 272 aa, Candida albicans
PPMTNYMVCLAHFCELHGPSVIACTQIIDERSVKENLLLANSRLASCLSCQFILPDSTANLVTKLTKDNEKKPANLHKSASPIPTLTPTSTPTPTDLILEKVSISTHYPSSQKRYSALTKLVMKSLSVETMSDLSKPMFYGDAINGYCINQIFKVEDLNARGGERKYSLMVISDNESELLMRWEIVSIYFNVVIELIQKKVAKANQVKQSESNNSSNNFGDGDSSTNKMFDNERYLRRSLIKPKSLTELTNDNEIFVRIHLCVTEMLKDILG

SEQ ID NO: 14775 - protein, 346 aa, Candida albicans
  UNSURE (2),(6),(14),(15),(19),(21),(23),(25),(26),(27): Identity of amino acid sequences at the above locations are unknown.
SXTPKXTKTKNKIXXIHKXPXTXSXXXPLPPPSFTKSKFFGKGSISHTFRKQAAGALGPELSRKLAILIKMEKNLMRSIEITSRERKDVAKQLSLWGEANEDDISDITDKLGVLIYEVGELEDQFIDRYDQYRITLKSIRDIEGSVQPSRERKQKITDQIAYLKYKDPQSPKINVLEQELVRAEAESLVAEAQLSNITREKLKTAFNYQFDSIREHAEKIALIAGYGKALLELLDESPVTPGETRPAYDGYEASKQIIIDAENALASWTFDSAVVRPTLSLAAHDEEAEEDLEGAYEDDELANEAENLRIAEKDFDEVEAKIAASNFQKIYYMWSTSGLERSNGCG

SEQ ID NO: 14776 - protein, 311 aa, Candida albicans
LIIMHRTYSLRSSKAPTASQLQSPPPPPSSTKNKFFGSGGLSSTIRKAAAGATGPELSRKLSQFIKMEKNFMRAVEVTSRERKDVAKQLSAWGEDNEDDISDVTDKLGVLIYEIGELEDQYIDKYDQYRITLKSIRDIEGSVQPSRDRKQKITDEIAHLKYKDPQSPKIPVLEQELVRAEAESLVAEAQLSNITREQLKAAFNYQFDATRELAEKYALIAGYCKALLELLDDSAVTPGETRPAYDGYEASKQIIIDAENALASWTLDSAAVKPTLSLHQEYDGDELEHEHGEIDDAAQEEFNKHDENVEHQ

SEQ ID NO: 14777 - protein, 176 aa, Candida albicans
NMAKRKLEENDISTIEDDEFKSFSDRDEQIDELSNGHAKHRENNAQESDDHSASEDDDDEDDEEEGEKSVQPPNKKQKKQLSAQDVQVARETAELFKSNIFKLQIDELMKEVKVKKAHEEKIEKVLHRLHDLIKQVPPVENLTLQQAEQHFNPKKLVIPFPDPKRLHHAAGRTANC

SEQ ID NO: 14778 - protein, 361 aa, Candida albicans
QYKKTINEPHGQSIEVALTMPKELFQPKDYLNYRALYKKSFYLAYLGENLIHLSKKNNLPIKVSYQFFNDDVLNPVLKIESIQTENPEDLTFTKTKIAINLIVAFPFGVFDSKKLLPDKNCIRVQSDTETLPPTPLYNSSVLSQTSYDYYLKYLYTTKKSTEAFKDACVLGKLWLQQRGFNSSLNNGGFGHFEFAILMSALLNGGGLNGNKILLHGFSSYQLFKGTIKYLATMDLNGGYLSFSSLIGENIASKYKSDGFNVPTIFDKNTKLNILWKMTKSSYKSLQLQAQQTLELLNDVVKDRFDAILLQKSDFDPMRYDIVFKLSAPEELYDFFVPLEKIAYITLDNISRADYLQFSQKH

SEQ ID NO: 14779 - protein, 579 aa, Candida albicans
  UNSURE (565): Identity of amino acid sequences at the above locations are unknown.
YFQSRLFAIFTKALGERIELIVIKNEHLSHTFAFHKRKPSHTSSTFVIGLQLNPEECDKLVTKGPNNEDKDAGIKFRSFWGNKASLRRFKDGSIQHCVVWNIKDQEPVVMNIIKYALDTHLQSEISQHLASLISYFDKKLPVPLLPSATNQVITSLSSFTALRNSFENLSKVLTNLELPLSVKTVLPASSGLRYTSVLQPVPFAASNPDFWNYCVLQFETSTRWPDELSALEKTKTAFLLKISEELAETEYNSFISKDESVPFNENITLLNILTPEGYGFRIRAFTERDELLYLRAVSNADKQKALVQDVYLKFNEKYMGSVKHTRSVTQLAQHFHFYSPTVRFFKQWLDSQLLLQHFSEELVELIALKPFVDPAPYSIPHSVENGFLQILNFLASWNWKEDPLVLDLVKSSADDDIKLSDKLTIQAHRIIEQNFEKIRKTDPSGIKTQYFIGSKDDPSGILWSHNLTLPISTRLTALSRAAIQLLRKEGITETNLDLIFTPALQDYDFTIKVKANNVTTSSGILPPNTFKNLIQPLTSFPDDITTKYDLVQGYVDELNKKFGNXIIPSYSDKGLEVPR

SEQ ID NO: 14780 - protein, 502 aa, Candida albicans
INQPTTLMSDKVKFLILNPSPDNLIKILEKSNTQYTKNGPFEATILLGDVLPQGYELPNVKPLGVTYFSRGANGIFEVIQAKESSTQSSIDLATNFTFVKPPFSVIRTTSGITIMIVSKLDTNNESEEKPLDLPEVKIDILITYEWPQVIGRLCKLTTVGNDKINELVTKLKPRYHFAVGNEIGKFFELEPFAWSTGEITRFISLAQEGGSKEKWFYAFSIGLEQDKNTNVIENPFTATNKRSRDGDTNKDEEKELSNAREVKKPKVVAPEQCFFCLSNPNTETHMIVSIGTCSYLTIAKGPLTRSNKNLQFSGHGILIPIEHTPTIKQESLVSEELLKYQNSLVTAFDEQKPNLKLVFWGINRDTNIHYHKQFLPVEESLLNKFSKSLDMRVKLNNEKFKKNQNLHFTKFTDMANPELTKILDTSNYIMFTVCKNKTDRDYYIAPLIPEKSIDIQFPRRVLAHVLNLPDRIHWDKCQQPKLKEMADCENFKSFYQKFDFTL

SEQ ID NO: 14781 - protein, 137 aa, Candida albicans
SDSSFRACEDLNALINCCYFALIDANIAMNYSFASIVIIIDHQGNLLIPIDGNDLHQQQQQEEDYESIHLCCYSIIAKKVDKLLLLESQGDFNESQLFNVLEKSIYKVEKFHNEIHRQFINDKIKNDYIWKQEREDE

SEQ ID NO: 14782 - protein, 328 aa, Candida albicans
PMFPFTKLTSNICLKNHFFSNGNLLSLSLKNMRQQKVLSFRSNIQLLQSNFIPIRGYIRETVYQQTRNSPLRRSSTWKQYNLFYNRSNWDKLKKPLLFTIAFCVGTTLVTPYLFTYTPLSYFKRNPQSLLWSLIGINGAVFLMWRIPRLQWFTMKYGILFKDNLQSPWTLLGSAFSHQSFAHFFINMLAFQSFGSTLVAFLGVSNFTIMYLNSAVISSFASLAIPMFLGSSLSVASLGASGAIFSVFGVFSFLFPASPVGLFFIPIPGGAWMLFLGTTLWNAAGTVLRWGTFDYAAHLGGSIVGIAYGYWYNRKRKQQIRRRRHTLDF

SEQ ID NO: 14783 - protein, 166 aa, Candida albicans
NMKSILRSTTRNLITSSRRFENLKTTEEIRNFLAESTWSINELLKLPTGSSQPEVSPEIVKKMLKLSGLNDLKDDQSVTKALNLQMMFINHLYDNDHETVTPSPKRNENNGIFRLLASDHLPQRPLELNNLLKQINELKPDPSKGEVDFTISDLQRDSFVINKRKE

SEQ ID NO: 14784 - protein, 578 aa, Candida albicans
LSLCSDSIKPNKHKMARIKKRGTTGNAKNFITRTQAIKKLQISLADFRRLCIFKGIYPREPRNKKKANKGSTAPVTFYYSKDIQYLLHEPVLDKFRQHKTFAKKLQKALGRGEVSDAYKLDQHRPKYTLNHIIKERYPTFADALRDLDDPLNMLFLFANMPATDKVSAKVVSEAEKLCNQWLAYVAKERCLKKVFVSIKGVYYQATVKGQEIRWLIPYKFPTNIPTDVDFRIMLTFLEFYSTLVHFVLYKLYNEAGLIYPPIIEKSIGLSGYVLQDKDAPLKKKEEKNDEEGKNLSKKELNKAIKADQEQQENDEQDNNNGESVEDIELDEFTSTKEDSLLQPSKYASLTAELFSKFIFYIGREVPLDILEFCILSCGGKIISEIAIDDLKINDPEAYKKLNLSNITHQIIDRPKILQKVPGRTYVQPQWVFDSINKQELINVNEYAAGETLPPHLSPWGDAGGYDPNKEVEKEDGEAVEDTDEEEEEVEIEDGDEDQEDEEEEEDEDLKAQKELELEAAGVKFSEINEENKKSHSKKSKGTSNKEADEEKVLKKIMMSNKQKILFKKMQYGIEKIED

SEQ ID NO: 14785 - protein, 300 aa, Candida albicans
ILLFCIFSFDLYIIKKLHMSTETVTSTTTTSPSTSKRQKVSEFNDGRKTPSYPWLQSATDWFKQSLKPSYADEQVERRLLSYLPFFPESDGLRRASVINTDIGNGNYIHELFIENLEKDTSKDASSTKEIVLVHGYAASLGLFIDNFDSLSRIPGIKIHAIDLLGFGLSFRPKFPQFPSKTKQDIYKVEDWFIDSLETWRKKRNIGKFILMGHSFGGYLSCAYALKYNKKIIERGISLNLIEKLILISPVGVERSQYSLLKKETNLTPQVSPEQELLVNQEDIVHGNEIAQDPRTRSSPR

SEQ ID NO: 14786 - protein, 400 aa, Candida albicans
  UNSURE (65): Identity of amino acid sequences at the above locations are unknown.
DDGNFIHEFYLENIMECTFGNRRQRPHIVIIHGYMAAMGYFIKNVEDVIKIPGVRLHLIDLPGFXNSSRHKFPKEFILEPNSLSAKINQILQIENWFIDKIENWRIKSNINQFKLIGHSMGAYLSCCYLMKYNLSTSGNENEKLVSDVILVSPMGTESNEFSLINDKRFQFNLHNKIDPFQELHFENENENENENENENQLVPNDDDDDDDIIINEEITKIWSKLGKPKFPKNWLLKKLWSSNKSPFEFLQNFGPFYSKILSYWSFQRFKNFENNQNTIDLILKLHNYSYSIFNQFQGSGEIAITKLITPEILAKLPLADRGLIDFLVENNINNMWIYGDNDWMNKNGGEYIYQQIKTKNEKITQFKVVEKAGHHIYLDNPQTFNQIVIDFLKLNQLDFL

SEQ ID NO: 14787 - protein, 471 aa, Candida albicans
RLYDSRVFMLILKRLLTTSCTLLDTSPKNYYKIIAPSTFETKKCESYNEKHSSTTTEITATSTATVADTVEDELTITHKTKRKFISTYKRSTHPTSVPLSKIFSNNFPLSINESFEDYKYRNNPLKFQHDLLSILPFYPTPDLQVKTKEGRSSEVLKVEIDDKGNYINEFVIYPENYNPQVMPDDEYHHLIMVHGYGAGLGFFLKNFDEISNFQPNNTQNNKYIVHAIDLLGYGCSSRPNFYPQNLDQVENWFHDSFITWLQKRNIPSDKTIVMAHSMGAYLMATLAINRNLKFCSKLLMVSPGAIIRHQTPVQVPRYFVKLWERNISPFTIVRKLGPLGSKIVSGWSSRRFDKLTRQEKKLLHKYSYGIFQSKGSGEYMLNYLLAPGADARHPLVDRGIDRITCDVSWWYGKEDWMDKKGGQICSAIINNKGEFKSDVKIIEDSGHHIYLDNIKKFNSMVLEEMNQLINK

SEQ ID NO: 14788 - protein, 173 aa, Candida albicans
FSPTNTAMPSSTASPDQEQLELVHLTDQELIDFTRLQNAQAWKGALSIKEYVLREQVLGKSKMATTPRNKLLIFMLRNKTDKAPLCSIELLIRKSRKYTLNKHENVVEQEDILSGCIGGVYTYPQHRGNGYARIMVDKLVVEAKELVGPLGFVFLYSGPGEYFFHRHDGHICP

SEQ ID NO: 14789 - protein, 258 aa, Candida albicans
PPELDPSVIADFEYRRFKCRGRFDYDQEMFLGPRLKDGELGYLVVTPFIRKNGGDPILIERGWILKDKVVPSSRSSGYLSHLARPQGEIEIEALFRVMPKKSFLQLEHEQGSRLFHVPDVPAMAKQSGSLPIYCQMIYDLHDHIDWRKDENGQQQKPSVISSLLFSKKKDSDAAFIATNANKDETLQFQEFEFVNEGVPIAAKPFIKFSNNHLQYLITWFGLSIGSTVLLLFSIYKSKQFATAEQLLAAKRKDMQKKA

SEQ ID NO: 14790 - protein, 270 aa, Candida albicans
REFPYPTSIIQTDFKNFDSDSHEIDLFLYKNYRFSSIDSIIKELTELSTNLNQNLLDLVNDDYHDFIDLGKSINDGLDLINAIVEDLKNFEIELVNYYKKFLDLDNRLYQILQNRKFLNNLKTCIKLNLILHDQITEFDNCMNNQIQEENNIQGLNQLKTLTSLYLSINNIEIFLNKFIQLGNIDDVNNSIDNNDNDNNNGNHRVNSPFHDNYINNKIASIKLEFKSYLDQLIRKELQKKTRNSQIMIELLNIYKLIGEEKSVMSIISSK

SEQ ID NO: 14791 - protein, 280 aa, Candida albicans
  UNSURE (262): Identity of amino acid sequences at the above locations are unknown.
RQDENEEDLEQQQQEQHHREEESQDHQHSLSESSLLMPNSPRNNYFSQADALESEIGSPSVNSFGRRSHSGSNPSVNSLPQPSPSSLSLSSKDNIPEKQPSKLHSYLVKPIRYIPGVFLGTLLNILDGLSYGMIMFPISESIFASLAPAGLSMFYMSCIISQLIYSLGGSAFKAGIVSEMIEVTPFFHTMAGAIAKQITNESNGNNNINNDAIIATTITSYAVSSIVTGLVFFLLGKLKLGVLVGCSPRHIWVGCIGGVGYXLIATGIEVSSRIRRWYIL

SEQ ID NO: 14792 - protein, 87 aa, Candida albicans
  UNSURE (10): Identity of amino acid sequences at the above locations are unknown.
TRIFQPRGQXLQHKYHNSLLVPLYFIAVFIIFHLSVAVAPNWNLNNARINGWIFPMVEDNEPWYSFYSLYKFNLVDWVCIVRQIPTM

SEQ ID NO: 14793 - protein, 134 aa, Candida albicans
  UNSURE (110): Identity of amino acid sequences at the above locations are unknown.
ALTFFGILHVPINVPALAVSVGMDQVDVDRELVAHGYSNAISGLVGSIQNYLVYTNSVLFIRAGADDRVAGVMLAIATAAVMMVCPVVIGYIPVCVVGALIYLLGYELLXEAIYDTWGRLRDIEYITIIIIVVT

SEQ ID NO: 14794 - protein, 109 aa, Candida albicans
IKKQTTKYLKMCIAIATTNHPEYPFILLSNRDEFFKRPTMPAHFRDVGNGVKLLSPLDLARQEHGTWIGVTTNGKIAVLVNYRENDQRGMSNCQSLLNCFFVTNKLFSV

SEQ ID NO: 14795 - protein, 183 aa, Candida albicans
VCEEHQKKPSKDNANGEINLSSDTDDEGDDIPHKTTFGLSNSLYNKPWDKVKLGESLLSKLIDESIINNYSQDQLIEKCFQLLSHDTYNSKILYSDDFEKKFAELKYSIFIPPIVRNNYYETDSVAVGKYYGTRTQTIILLDKYGNLNYYEKNIHNSDDIDLKDVDITSHYKFNIFNDQKNGC

SEQ ID NO: 14796 - protein, 476 aa, Candida albicans
RNRGSFQPRGEDRSLYQYANKAIETLLITNFKITNTVSVDGIINDEEITSIVAPAPDRVLIGNSNMIYLINVKFASLLSSFKSSSSSSHPIPDKVFLNQVVPVKGNSTNSYISMAVYLNLKNKDNNVYLNVIDINVGMNKLSECLGKSLNKQKPGFHEIPELFNIQDALPSSDEIQEVYLYLKDAKEAQDLNKWESILIPYLKNKKTWAEIKSLLRASKKDKVYEFKEFDVDNDRVIDIGFIDSVLQLIFTEDPLAFANEQFVPEYTLMYLLTNPLFPIRFTLGLIELFSVTGNTTLLRQAINTCPNIPCRDLLDQLVNEENKETLLDLINRIIGEFSRKEITNTFKQLIQGNAVDVVELISKLIGLPGNNNWYLVEILVDVNGLFNWDMGDIKALDEIISQKVEALTVNSYNLTLSHQVLLHNKRLSKKAKEKGSTSHLDNLLTLTSHSTSAKFDDTPEEANLKVPVYSVERVNF

SEQ ID NO: 14797 - protein, 824 aa, Candida albicans
KTIGSQDLAIAVLFKSYIEEQSADDIPIESIKFDISTILFTILSKIHVLLNADDELELRYVNNDENHYMANLHIWTPNEIIASNDYNLRLLYSITCVVISAMYKLFIPKSGDYNLTTNPYLHYFLKLWKCHTNIIILGLAIDRRIEFLNLENGENKETPYIIQQTLKGSSSIRCVLAWILNKNPSSAPVLDDDLSIHSEQSSDIKNETVFNFIQPLARSNSNGGAILLDMRLVSIALLMLYSGTSFTAGAHQVNEKPSINQEHASRRLNQSTKISEVGDILIDLEYADRFDEDIKYMLECELYDDAEDDKYNEANSKKLFKAELRRGAKGEDVSIIPSEITESLIVPELEFDDLGRDWRDITRGGNNEFNDLFLAKLKEFEALPHQSDSDDFSALWDEFYQALEFLSTNSIEGNSQAECKIGQVIINTIAKSILDNKEKRDSSITPMKIYQFWTSLASMEAIRITQEDNNKMIAPIFSVTKFELFFHNNPLLARAAMDEMLMCEGHRKLLIWFLTHVMNLSISLVDYVYELVSGLRGTKDITFPYKFSRKGGKVHLSEIEQLMVLHEFLGNSADYLSATDGIDVHDGYRVFLAESIAKKLLSVLCLMINHLIQMGIIDLSGNKSDHLHDYTNELQVLLINWIGKVPEARRLFFKIKNGNTENKKATNSFDTTVSKEDEINLFEKYEKATTEEISTDIAKNLKNKRIIESFAKRIECHLEAVLSQSGEAPKLEEINDDFRYFLTNFNTLCKVDYLAETLFGKFEPVISSGSISKLDATTEIDEGFDAEFNTEFLNGEGRFEKKETAKPQNGSKKKSKKKKKSKKK

SEQ ID NO: 14798 - protein, 414 aa, Candida albicans
  UNSURE (170): Identity of amino acid sequences at the above locations are unknown.
VGANSCIQNTLDDESREIKIENILHNPLFYKDYPPIVSPPNDTQKTLKPGEIPDYVIKYAPLVHLYSEERYFPYDVKKFVTNFHVTWRNGSIYPGTEKNMNLDKLANLPNSTDLFLTANSDFDSDPEWITGLKNKPSLINGEIKDAPATLIVVDKGNGWVDAFWFYFYSXNLEPYVMVQGPYGNHVGDWEHSLVRYYKGEPVIVWMSAHSGGGGYYYDNLEKYSLDPNHPIIFSARGTHANYPSVGQHPHDLPYTILSDFTDRGPLWNPSLNYLCYSFDGKHVYPGNNSNPKHVGREWDYGNWLSFSGHWGDDTLSRKDSRQVYSFIGGYKYIEGPTGPLSKNLMRLKPCESAQWWNFWKVCNVRNDIEWGVGVESEGFNCARLTNNIRPIWLKKSIQSIMWGGGICFIANLLD

SEQ ID NO: 14799 - protein, 756 aa, Candida albicans
TTFLLDMVLKSTTAGNVSVYQVSGTNVSRSLPDWIDKKRKRALKHDLEYQNRIELIQDFEFSEASNKIKVTNDGQYCMATGTYKPQIHVYEFANLSLKFDRHTNVENIDFLILSNDWTKSVHLQCDRSIEFQTAGGVHYRTRIPKFGRCLTYNPINCDLIVGSSSDELYRLNLDQGRFLSPLKLDMTDGGNIDSGCNAVDINSMHGLISAGLDDGTVEFWDPRSKQRAGKLFVSDQLINSTNNTEQSSCGITSLAFRPQDALNFACGTSNGQTLLYDLRASEPYQIKDQGYGYDIKKIIWCQDSLKPEMILTSDKRIVKIWDHTNGKSFASMEPTVDINDICHIPQSGMFFMANEGMPMHTYYIPNLGSAPNWCSFLDNVTEELEEKPSNSIYPTFKFITRDEMVKLNLTHLIGIKVLRSYMHGFFINTELYDKVNLISNPNSIYDQRKREIANKINEERKSRILTSSNGNDLPTKIKVNKDLVNKLQTKFAENGTPDGNANGATDYVESIVNDDRFREMFENPDFEIDEESHEYKQLNPVKSTKDITTTNTGTTNSRGRGLTAAEESDEERLNMKDSHHTGLDSDESDEESDSESEEQSEDEAKSAETRERVGKELNKIRQSKQKQQQQDSKKFQNEMKILSQQSSSSSSSLANTEKASVSFGSQVNKLNKISKQNKNNNSISNAKDARLRRHARGEAELTFVPQKSKSKSTKLKFNNNHSDDEKLDSGKTKDSGRTKQRFEGRRIASKNKFRGM

SEQ ID NO: 14800 - protein, 113 aa, Candida albicans
QFFYQVLTMTPCPIWFKYKHACGAFVVFIFLWASYNGATYYIDVFGKRLEKEVDKLKKEVINLQQENEKIKNSPVQRPVNGSVDDVGALDEDLNSELKEKEQVESTDDKGVTP

SEQ ID NO: 14801 - protein, 247 aa, Candida albicans
STHIYHINIEKNPPPSSHNMSSLSRSNSTGSVPYLDMSKLMFANDFDFGLNLNEMKTKTKQKLHTKNLELDKLQEIINQRLQNFDKRVHKQLESSATEKAFYATSVFLIFCAGFIIGKYPIYFPYFHTALFVVLMPIRFYTYFKLSFQYYLADLCYYVNLLLMLFIWVFPESPTLFVSVFSLSLGTLSWAVITWRNSLVLHSIDKTTSSFIHVMPPVTMFVMVHEITRRIFQAALTLVLVAIENWEL

SEQ ID NO: 14802 - protein, 578 aa, Candida albicans
IKLEVYLGYLNEVFINYSLKIPPKNLKNLIPMIENMYNKAEMSIPHPIYYMFVRSLTLGDKISDSQMQLINKYFQEISKQTDLKIDHYETMILAYVKNNHMEKIDGILAQMKKKNIEILKMIYTSIVRGYIFYQKDHQRALDTFDSMKFLSQKTQPDEKVYTDVIVSCVMHREIERALDLYYELKDKGMNVNQNLLSTLAKGCSRLKQFKTQAWNFLFQVYDHGWVPNLQTYEHMLYIAARDGDVELTRVLFYKMLQTNSVTIRAFRYLILSYSKYVPPHKKKEKHLILLNHKGQLFRRNILQDVDFSKPVHGFPFLLSSHIPDSKLFLAESSVFWAHTVMNNPSFLRQQTLVASYVSIALELGDFTEFKDRFDSASYLNTDGIPKVREIEIIEPRQDEPTEKATTTEEQNALSETDNNSLIRSPILNQLQQNINDNQFKAPRDSYLYNLAIKAAGKFKNYGFAQEILHERGQFRKSNSFKLLSPKQQNQDDFQFAGYLVECWTNMNLLEDAYAVVLLSVDRFPWSWRELGVLNNAAMKLGSLELAEAVRKVAQVTQVKHHGKIKRQDFKTYVMKRGY

SEQ ID NO: 14803 - protein, 227 aa, Candida albicans
SYTILYPGSLLPNTTRIPDHSPISPPSANNSNSSNNSSVSGFPFSSTVISPRNSITSFSNPTKQLRANSINSDNGNNSNGRRTSNSNYSITSTPTTNNRYSFSEYSNEQIIDLMEREQDAIVLKLMKEIEFLKQENKMLRLTPGGNSATSGTCSPSNSMSSPSTPPVRRSSSLSSRRSSITTNNLNSTSFGAGINESSRMGNCGSGANNTAMSAPVFNYPFRDCSST

SEQ ID NO: 14804 - protein, 383 aa, Candida albicans
KFDKFTVPTKMEATLIPNPKDNNATILLMGLRRSGKSSICKVVFHNMQPYDTLYLESTSKPITEQFSSLIDLSVMELPGQLNYFEPNYDSERLFSSVGALVYVIDSQDEYLNAITNLLMIIDYAYKVNPKINIEVLIHKIDGLSEDYRIDAQRDIMQRTGDELLDLGVEGVELSFYLTSIFNHSIYEAFSRIVQKLVPEVSSLENMLDNLVEHSSIDKVFLFDVNSKIYVATDSSPVDIQTYEVCAEFIDITIDLDDLYVENDKNKNNENGGIGGKQKEVKSISHLSNGSVLYLKQMIRGLALVALIRNDDNKEIQQDDDNAIGIAGQNIQNADGSVVDSNQEKSLTVIDYNVNLFKKSLMKIWKNSKLTNTNVNVSQQQSIE

SEQ ID NO: 14805 - protein, 171 aa, Candida albicans
QYIMVVGKSNIILQSRHLSSTSICLRFNKRATMDKTVLLNEAKQFFGPTNVKGEHCKNKFFYPPQNNRPNYIVNDGRPLVGDQFPTKRPGRNSNNRERNPTVHPFPNNIYTKTAYLIPENIKDKIVEDATTNGLHPQEIAHKYSINLLRVEAILKLRDIESKFVPDVCINI

SEQ ID NO: 14806 - protein, 215 aa, Candida albicans
  UNSURE (193): Identity of amino acid sequences at the above locations are unknown.
SDNKNFFLPTPMKGQSKNGHRRSNSRFANDDKRLVYLTSKAMGKKCIATITDGSRYQGLLVGSDLSPLSVVLLKPQLVGSSLLNEKNNLDKLPENLIIQAKDLIDLEVDVDLSEPVKPPHEFKTDADISGKMQIKERELERWVPDDEVELTLEDDGSEWDQFKVNQEKFGVESSYDEHLYTTRIDTSAPDYHXRVAKAERIAKEIEVFTTGENPR

SEQ ID NO: 14807 - protein, 526 aa, Candida albicans
NKTYYYKSRVATESRQDSKTSTMYKQILTFLILFLRYILSEFPDDPYEDDDTSDDNNSDYEGQKCNPYRDKACLVNDEALGKKIFESFAEGTKYFTITSSTRGVRFGSEGLALTIQDEFDNPALVSSFYIMYGKVEAEIKGAAGKGIISSFYLQSDDLDEIDVVEIFGSDPYEFQTNFFIKGNTTTYDRGRYHEMHPSPLSEFHKYGIEWSPDLITWYLDDKPVRMLGRRNKHGLPCSPMFLKFILWSVEDDDEGTIAWAGGAASFSEGPFTMHIKNLKVQDYSKALTYSYGNLRDGNWLDLRADGGYLYEGHKYCLPPKMLDKLKPTPKQETDDDQVLTSSKLQRVATTISEDKNTVSYYPPSATNSHTTWDRLLEWETEQDETGTDDTENSDNEEEESITAIPISKLRKGSTRRLDISTQLPPLSQNESKIAEIKNITTTKHIHNTTTSLQISKIKSKKVGVTTTIYSSSTPQSTSKSRMPYNIFFNYPGKENSRFKSGVSSILATSFSSVVIAEILVIVVLLL

SEQ ID NO: 14808 - protein, 462 aa, Candida albicans
KNDTHHILIMKFTTLATIASTLLFAANANADTCNPLKSSDCSPVPALGSSFLEKFDNGLGPHFESLKKQGTIDSGSNGLSLTMKKRFDNPSFKSNFYIMFGRVEVVLKGAEGKGIVSSFYLQSDDLDEIDIEMFGGDPYQWQSNYFIKGNTATYDRGGYHDIANPLKDYHTYVIDWTKDAVTWSVDGSVIRTIPKDNAQGFPQSPMAIYAGIWAGGDPSNQPGTIDWAGGITDYSQAPFTMGIKSVLVADYSSGKQYSYSDQSGSWESIKADGGKVNGRYDQAQDDIKKLESGQSVDSNDSSSSPSASSSDSSSTSSASSSSSSSSPSSTTSSSSSSSSSSSSSSSSSSEKSNAVPSASVIVFIGTKGGDKTTVTSSSGVSVPTSASVSTAAGTTSGPANSAPASAASSTASTVFISTGDAAPSSSASEKPSVLTTENNGAVSVAKTTSFFGFVALIGFLFV

SEQ ID NO: 14809 - protein, 392 aa, Candida albicans
HKMYSFTFTITFIYIYKLFTFFEGYFTFIFYVNNPPPSPAMTDYSNSKSLFLGFDLSTQQLKIIITDENLTPLDTYNVEFDSQFKSKYTKINKGVITGDDGEVISPVAMWLDAINYVFDEMQKSKFPFDKVVGISGSGQQHGSVYWSGEANELLNDLIPCKELSSQLQDAFSWGYSPNWQDHSTVKEAEDFHKAIGKEHLAEISGSRAHLRFTGLQIRKFITRSHSKEYESTSRISLVSSFVTSILLGEIAPLEESDACGMNLYDIQKSQYDEELLALAAGVHTEIDNVSKEDPKYKKSIDQLKQKLGEISPITYKSSGKISKYFVDTYGFNSDCKIYSFTGDNLATILSLPLQPNDCLISLGTSTTVLIITSNYEPSSQYHLHHGAGRSAS

SEQ ID NO: 14810 - protein, 214 aa, Candida albicans
EFISPWGEIIPQAPAQTIRAVLEDNGEITPCELDSHGFTVDDDASAIVDSQTLSCRLRAGPMLSKSSTTKNGKTNSSEELQQLYDNLVDKFGELSTDGKKQSFESLTARPNRCYYVGGASNNTSIITKMGSIFGPTNGNYKVEIPNACALGGAYKASWSYKCELENKMIGYDEYIGKLFDTNDELESFKVDDKWEEYFTGVGMLAKMEETLLKQ

SEQ ID NO: 14811 - protein, 353 aa, Candida albicans
  UNSURE (11),(16),(17),(20),(54): Identity of amino acid sequences at the above locations are unknown.
VSDKCSIVPSXIDPSXXAKXNNPHHNINGKDELQFFDAPKLLIANDADSISDLXKKQSRTGSIIGGVGGSRVEKLKRLSTTISSKEGPISRRGSLLYNSVQQKIRKSDSKNSVNKSFAADTSESPQQHLEDENLHFNQHKLQTYPEEQQISKPLKPEYIKDPPRHQHDNLIERKILQQVWLWTARVFLKVGLIDECEQCIVEAETIYEPNFKTYTALGFLTSKSRKFLSLQEFERSLEILTKKDNSLASHNKFNSKYDYGLTLLGLLKLFLIDDDPKNSLFISTKDLNSGIIRLKNLLEDYSLTWPYGYNNPEIWFYLSKIYEFIDDKILLTKSLWRCTELEVFTTPWAIHVE

SEQ ID NO: 14812 - protein, 298 aa, Candida albicans
LKVQLTTMTSLEITQEAIFIGANKQNFVSDYNPTNNIIAFGAANIVALWNPLSKSHNGVYHTLKKHESEVTGVKFIPNSPYLVSIGEDHIVNVWRENGKLYEFVQSLQDHTHSVTCIAVINENIFITGGSDHNIIIWVFNEAKQEFEYGNKFQVKSNYFPLALALQDIDTDNYLVAVGGTNNNIYIYTFEVKDGKVSALEKKAELTGHEDWVKCLQFVTEEPHKNYILASGSQDRYVRLWRLKLNDLIDDSDEDPTKLVLLSNKQYKFELANGSRAAFSFEALIMGHDDWISGSSATG

SEQ ID NO: 14813 - protein, 304 aa, Candida albicans
  UNSURE (236): Identity of amino acid sequences at the above locations are unknown.
QLPITASLPVLGLSNKAENQIEQGDQQDVDNEDNTPEAAEDVLASLDLPPVEEYLQRYTLFPELEKLYGHGYEISCCATSPDGKLIASACRSNNAKHAVIRVFNVAQDYQQSQQVLLGHNLTISSLEFSPDGKYLLAVSRDRQFSLWEVINEQSGSFKLVELNPKAHARILWDCSWFPVGDSFTTVSRDKQIKLWKVSNDKVEMVVSTKLNDAITSVSVYKGGLFNNQAIVAVGLXDGGISIFAVDVANPEFRLISIVDKELTPSNRIEKLSFSNKLHNGKLLLGVGSKDTSARLYSIDLTIFT

SEQ ID NO: 14814 - protein, 208 aa, Candida albicans
LGNEFKYQVMIKGAFNGIGDRSKDKYHTLIESPIDIIIFEGWFNGFYSLDPTILQLKYLTSSPSPSPTPTPENNNNHISLQSFKLYDLQEINKNLQNYESLIWSFFRISIIFQTDQINNVYPWRLQQEHELIATLQPQQQQHKSVEGTCDQVGMINDDEIIKFIDRYMPIYLLYYENLCDYGIKHCKNLIISIDFNRRVIKNRVLNNV

SEQ ID NO: 14815 - protein, 156 aa, Candida albicans
TEVFLRKLAAQNYIKYDLGTEFIDTIDDLPDDPDLKPLDDKLRNRIENIRDLVLYRFGSTGVVQLLQAAADLLNLVPVYPVRNIHNFSGNSGDYVFRDCLLVKKGTSVTAVARKIMGDVTIAAVEGVGGIKISEDDTIDKGKNDILSFKIVPGSHN

SEQ ID NO: 14816 - protein, 345 aa, Candida albicans
IVHNISQMSEEGAHIDKKAKIEDTDMSEESNQQVFSTVGEQAQEVDNAIKQTGAADAEGHPVQEVESLCMNCHKNGVTRMLLTRIPYFREVIIMSFECPHCGFKNSEIQPAAQIAEKGARYVLKVENKKDFNRQIVKSETATVKFTELDIEIPPKRGQLINVEGILQEMIDDLESDQPQRQKVQPEVYEKIDQVISKIKLFINCDPNTVPLTVTVDDPAGNSWIEYVPGEPTHKWAMYEYNRTAEQNVFLGLISADDVAQHRQAELANKKQATDSNISSNLNKEQSQSQSQSQEEHSNPHTTGFKSDASEIENFSNEVQTFAATCSSCYKPCETHMSSPGVKNTS

SEQ ID NO: 14817 - protein, 108 aa, Candida albicans
IDRTTAMSVLKVLPSKARLAEVRKTSFKIFDQFWNPNAKRNPNKILRAPLKGPEYVKYYGDNNAVPTFKDFKKWFPQLKLVDPREAHRVFIVADRKRRNKGAPKKKKQ

SEQ ID NO: 14818 - protein, 242 aa, Candida albicans
KRNFIVNSHTTSSRSNHSNGSNSNNNHRNNSTGSNGSVSSLGSNNETTLGYKSTHKSASGSGSGSGSGIGHISMLHRTNYLALIGGGENPKFPINKLIIWDDLKRKTSLLLEFDTPVLNVLLSRVRIIVVLIDQIIVYGFAAPPKKFQTFNTINNPLGIADLSVNSQQSNVHLYNNYSLNLAQAQVLGTTTTTHYDFSKRKSLSPTNSSNSSSTSLKENGTNLTTYPSPIINNFSFSFRRIQ

SEQ ID NO: 14819 - protein, 251 aa, Candida albicans
SMEMGSSYQNISIPGRSMGQIQIVDVGNNHHSGTNIKPTINIIKAHKLNIRCLCLNRTGTLIASASITGTIIRIHSTRTTALLYEFRRGIDRAIITSMKFSHDDSKLAVLSDKHTLHVYNIDETQYPNDGGSGGTKDGGGGGRGLKNRHHLLNGLLPYLPNYFQSTWSFCSVNTNKYHTSDLEDNLQQQQQQWVANGTGGGGVDEGVIGWSGNDSIIIIWKLKKIWEKYVIVETENHQYDLIRSSWKRLDS

SEQ ID NO: 14820 - protein, 150 aa, Candida albicans
VIHTNLALTTMSNANQSNKFAIHDAIKEGNTLLAKKLIDEQPASKLYISDDDERTPLHWAVSFNNPDLVQYILLKTPNDLDIDEYVDGSGWTPLHIAASLGNSTIFNQLLRRANSSSTTTSNNSTQPELDVNLQTNSGTTCLHFAISNDT

SEQ ID NO: 14821 - protein, 147 aa, Candida albicans
SRRLLKIWTADLNTQTLAFKNELTTIKSEINSLIYEPVLPNLIYILTLTLTGSIFVRQRNIGIRFITPILFGGLSLKYFMPRTFEAISEKYDNVEKENLPQLYEQRQELQITLKNWGNDVDQGLEQAQVGVYQAVHDFRKLVKEKWE

SEQ ID NO: 14822 - protein, 212 aa, Candida albicans
YSSTMVKRSFYEDDEYIINKPGTTTAITPELAEQESVHGQATFIDGMVIRSTPILEKYANSIRHYLHDKLSIWTAELDTQTLAFKNELTTINSEINSLIYEPVLPNLIYILTLTLTGSIFVRQRNIGIRFITPILFGGLSLKYFMPRTFEAISEKYDNVEKENLPQLYEQRQELQRTLKNWGNDVDQGLEQAQVGVYQAVHDFRKLVKEKWE

SEQ ID NO: 14823 - protein, 213 aa, Candida albicans
LTATNITTPISDIKDNQAPPPSSSSSSSRRKSLVGLTDEELMALDPQFQTTKSKNHDLNKFKFDNQKTYYLSPSTRKGSTTDNTMGNVGAGIKRPDYPTSNENNYKSISLTVRYGETTHNDYTRTLLTIISGRRHTWHSLDWLFHIKQDLQNQPTLLADGDYLVIAGLIPIKFIKDYNNNNNNSTNKKRKLAVEDYLYQKCSNLLNYLMEYIS

SEQ ID NO: 14824 - protein, 656 aa, Candida albicans
FMALFKLGGKLKKKDHQLDPDTTVSSSSSTNSANRKSTSRFSSILHSSAAPMPLISNQPAHTSRPPPHANLSVTTPWNRFKLFDSPFPRYRHAAASIASEKNELFLMGGLKDGSVFGDTWKIVPQINHEGDIINYVAENIEVVNNNNPPARVGHAAVLCGNAFIVYGGDTVDTDTNGFPDNNFYLFNINNHKYTIPNHILNKPNGRYGHTIGVISLNNTSSRLYLFGGQLENDVFNDLYYFELNSFKSPKATWQLVEPLNDVKPPPLTNHSMSVYKNKVYVFGGVYNNEKVSNDLWVFDAINDTWTQVTTTGDIPPPVNEHSSCVADDRMYVYGGNDFQGIIYSSLYVLDLQTLEWSLLQSSAEKSGPGPRCGHSMTLLPKFNKILIMGGDKNDYVDSDPHNFETYESFNGEEVGTMVYELDLNIIDHFLAASAPVNAPTIIPPVASYEELPKPKKPAASARNDLQGYDRHARSFSGGPEDFATPQASARGSPSPERTQGGGDNFVEVDLPSTTISQVDDDPPYDTTSLNQPQEVTNGHVDDEPFRRRSLDPKFDDHSGAPEVAPVAVPVTEPVSAPVTAPVAEPVVAPAVAPDASGKVKKIISELTNELVQLKATTKEQMQKATEKIEQLERQNSLLHQSQQRDAESHTFFILRN

SEQ ID NO: 14825 - protein, 178 aa, Candida albicans
SNILEFTTMAKKRRAAILPTNIILLQNVVRRDPESYHEEFLQQFSHYESLRDLYLINPTGVDANSTTEIIDLIGFMSAVCNCYPKETANFPNELKEILLNNHRDLTPELREKIIQCLTMLRNKDIISAEMLIQTIFPLLITSNAGQQVKQMRKQIYSTLIALLKSVNTGTKNRTWNRS

SEQ ID NO: 14826 - protein, 216 aa, Candida albicans
GNHMRCWPSRGEDLGQNKNFEKGKAKIGKAEDNEDEVSDLELSSDDDDEDSEENKDGKAVADSEEPPTKKQKIRNENADINAEQAMNELLSSRILTPADFAKLEELRTEAGVSKIMGISNEEAVDSTSLVGKVKYKQLREERIAHAKEGKEDREKFGSRKGKRDTPHSTTNKEKARKKNFVMMIHKKAVQGKQKLSLRDRQRVLRAHITKQKKKGL

SEQ ID NO: 14827 - protein, 257 aa, Candida albicans
FSSRLVEYVFLGADKEREDNFEESSDEDGFDMNELRHKMQINKKTSKRGKKLEQAVKAMKKKNNSKHSATYLNFSAIHLLRDPQGFAEQMFDNHLSSKNSNKFDLDQKILFMNLISRLIGTHKLIVLGVYTFFLKYLTPKQRNVTQIMAAAAQASHDLVPPESIQIVVRKIADEFVSDGVAAEVASAGINTIREILARAPLAIDAPLLQDLTEYKGSKSKAVMMAARSLISLYREVTPEMLLKKDRGKVASIKMQKG

SEQ ID NO: 14828 - protein, 247 aa, Candida albicans
ELGVALWLCPKRNTPTYDKLITVMSSLNTLFPGLPPKFEPHITITTNISLDLADQSKTKDDVDRILSASAVAMNSLPKNHESLVKLGNVNSQRKFFKKLYFEVEKDPNLVSFARIIRELFVIVPQDIEKENIKQNPQLYTKDNNGNTIRRKPLKKKSKTTEVKEFDTSFIRQAAAYKAAEWSVQEFDPHISLVYSDLWPLHSALWRNINTRILDIDWDIEWEFGVLKLVLCEGDVNDWVVLGSVDIH

SEQ ID NO: 14829 - protein, 166 aa, Candida albicans
MIHYCQLSSNSTSHPILIMSRRSEIRQKQELQARFQLAMSANNQKALNWLKPLKSTASTTSTSSETPNANNPTSDDSFMDLQIIPQGASLSKLDNLQKIGDFINSKDITKMKQSTTTTTTTTASNLTSNRVTKSKPMLALMNKMRDSNRKNVRQNRHHHQQQRHST

SEQ ID NO: 14830 - protein, 367 aa, Candida albicans
FILEELSVLYQKENTIEYMAEENISFSQRMISACSGSLVTSLVVTPFDVIRIRIQQQSILPQGQPCCQLHFPEHNFPKQKVPVEMAPELFWIHDKYCQSAESCTRIYSTFQGFSTVAKHEGVRTLWRGLSLTLLMAVPSNIIYFTGYEYIRDHSPISNHPLNPLFCGSLARTLLATFVAPAELIKTRLQSIPTDLKSASHILFNLLRDLSAAVKKDGVRTMFKGLGITLWRDVPFSGIYWSSYEYFKAFFARTLKTDFNNPTRGGIDDWKVFATSFLSGSISGTIAAFFTNPFDVGKTRIQITMQENEKISHPNMFKYLYKIYKNEGMGALYAGFGPRVMKIAPACAIMISSYEVGKKFFKNGNNSN

SEQ ID NO: 14831 - protein, 218 aa, Candida albicans
RAFCHIFLFNVLELVLFHEFLIKVLKTTGILFIMLSFKGWKVLLSIPIKLLAVLLKYPFAGGVNKKFKYDLLNSLKLILYRTALHMPVRESALLSIMSNHFIINKLIKNLYPTLTKLPSYGKKYDKQSYWLVKNRDRKPNDPILIFLHGGGYFFETMPCQIESLLSIYHVLDAPKRSSLSILVLDYKLASRGYKIPYQLTQLIETYTNLVTDGNTNMT

SEQ ID NO: 14832 - protein, 373 aa, Candida albicans
FYFILFHFISLPIMLTFKGLLLILLLPSRLLSFIIKYPFIKGIPGKYQHNFSKSLFIKLCRLIQLLPVSDKGTLNFILTNFLLNKIMKLYHTRHFLGELNNFGKKFDDQSYWIHESPNRNRNKNKSDDPIIVYLHGGSYYFDNSLNQMESLIGIYQLLQNTTTTINDDRTSVERKKNLSILVLDYKLASKGYKMPYQLNQLISTYKNLIYQGNTNLILMGDSAGGNLAITFLQHLRLTNNNNNNNSPANLPYPKSLILISPWCKIVPEISDYTKGHSMYDNNQYDIIEWKAVKKLIDNTSPLIRDDLSPQNLIISPGNLPYNIDDWIDIDTLQKSNYSTFVIMGEYETLRDDILNWCQYAVNSTLSLPIKHTQ

SEQ ID NO: 14833 - protein, 383 aa, Candida albicans
FSSQIILITIMGHLEYKLIEICLQFQYQLIKTSIEFIKTLLTLFIMISLRAVIALILLPLNLLFVLIKYPFFGGVNPIYKNDLVNSLKLTVYQALINFPLDDVHIFSIISAEFVINKAVGKLYPGLTSKLPNYGKKFDKQSFWLVEKPNRKPDDPVLIYLHGGGYFLGLVPQQIESLVTTYHLLDPVKRENLSILVLDYNLTCQGYPIPHQLSQLVETYTNLVKEGGKNFLLMGDSAGGNLAITFTQYLRLSNSSNLPYPKSSILISPWVKLIAETYQNTPGHSYYNYSSGDVTQYDTLSGAEVYQHILGTETKLNSLTVSPGNCPYDSKYWQDIPTYYPPGHSVFVTPGENKIFRDDILEWSKYALNYPLDELEFPIFPWGN

SEQ ID NO: 14834 - protein, 428 aa, Candida albicans
WIIKSSFIYTRSILLFIMISLRAIFAIISLPIKLLFVLIKYPFFGGINSMYKDDLSNSLKMILYRTLIDFPKDDVHIFALMSTGFVMNSVVGKLDSSLTSKLPNYGKKFDKQSYWIVEKPNRKPDDPVLIYLHGGGYFLGIVPQQIESMVTTYYLLDASKRENLSILVLDYNLTCQGYPIPHQLSQLVETYSNLVKNGAENLLLMGDSAGGNLAVTFTQYLRLSNSVNLPYPKSCVLISPWVKLIAETYQNTPGHSYYNYSKVDMLHFDTFSSADLYKHILGDTKLNSLTVSPGNCPYDPKDWDDISIYKQPGHSVFVLAGEHETFRDDILEWSKCVLDYPIDKLDFKDSNGEFDPKAHRYIRNDANSAYVDVTIVPWGPHDYLYFDHSLIGKLKLEPTLKLNSINKRKYFATISVVNFLNTVLPGKN

SEQ ID NO: 14835 - protein, 417 aa, Candida albicans
KMISIQGLVILLSIPIKLLIVLLKYPFVGGINPKFRNSLIGSFKMTIYKTALTIPVRDSGLFSIMSNYFIINKLIKTLYPTLTSLPNYGKKYDKQSYWLVESKDRKPSDPVLIFLHGGGYFVQTMPSQIESLLSIYHLLEEPQKSKLSILVLDYKLACHGYKVPYQLTELIDTYTNLVKDGSKNILLMGDSAGGNLALIFLQSLKIDKLSLPYPSSVLLISPWVKLAPDNFQNTPGNSYYDNAAHDMLPFNLHSSELLESLLGDSRVYSLTISPGNCPYNETDWKDIPSLNHPGYSVFVITGEHECFRDDILEWANHSLQCPLTPQKGDSQGRFNPKIHQYIRDTPDTAYAEVLIEPCGVHDSVLYFENSIISILKNNPRLNAKSLDKVEYFGITKVVDFLNKTLSSEEKKGVKPLL

SEQ ID NO: 14836 - protein, 356 aa, Candida albicans
ILHVKRTPIFAIPPTANMINKRICKTIPNMTKLPHFGEEYDKQNYWLVESKNRKPNDPVLIYLHGGGYFLDVAPQQIETLLSIYHLLEPAKKLRFSILVLNYNLTSKGFPVPHQLAQLVDTYTSLVRGGSENLLLMGDSAGGNLAITFTQYLRLNKPNLPYPRSVILVSPWVKLIPEVYQNTPGHSYYNYSANDVIQYDRFSSAEVYQGTLGNTKLKSLTVSPGNCPYDPKDWEEIDTYRKPGYSVFVLAGEHESFRDDILEWSKYALDYPIPPNLGNSDGVYNPKIHKYIRNNKDSAHVDVNIEPLGVHDVCFFENLLLSKLENDANLTIDGVDAKQFFAIVNIVKFLDTVLPGK

SEQ ID NO: 14837 - protein, 320 aa, Candida albicans
IFFILLLLLPLLLLLLFLYTTMPSSTNPTQGNNNDNWFNPIPIDDYYKINEQSRQNVPTSPPNDETLGNYTISCGPILRLAGTWENNNDTTEDPNYRGSILLVIKKDTDSTTANETGPAITYKIGPSSPSTTVALAKFSTGEFPGTKFYQENDYSFYRYSIELTLTGNEQKVEYFIDNHFKPNFQFYLPNKTQSMNVISYSCNGFSLGSDANEYKSSLWLDVLTKHSQQHYHVMLGGGDQIYCDAIKLHSERLKQWTEISNPIKKKSFPVDDEIIDEFKNFYLNHYLGWFGKGFWKGTNSTVLESLFPLNAAQNPLCQNL

SEQ ID NO: 14838 - protein, 217 aa, Candida albicans
VAMILHPAVKTSHAHAHAHKFLHNVEGDHQLTEKLNKDVIETPEYDPRLIFNITSSAIVNAPPPDAMATLLNKRSGIHHFNRDTDEDIVPLFIKNLDGSNRDNKQFLNERNWSDLILAKQSILYKDQFTNDDDDDENPIRKFPQPVLDNKGEDLLKDQTVDSRHVKYPLYSDSLVTTLRFEKDKSDLSSPSVGYEVLIPKLFGKYKLDPAPVKHVDQ

SEQ ID NO: 14839 - protein, 131 aa, Candida albicans
RSNITSFLFKLGYPYFNNIGSNMTNNKDFDLPPSYDEAVHSSSSSNSNRPNHSSQPPAPPARPQTNRPPPPPPPPSHPPTSSSSSSNANLYTNNLNLPFTYKRGYYCSKCKNSGYNKNGDFCLKCWANTFI

SEQ ID NO: 14840 - protein, 288 aa, Candida albicans
  UNSURE (248),(277),(284): Identity of amino acid sequences at the above locations are unknown.
NELATRHGEELINMEMSQAMRYPAEDLNCEFIWDPHVKAYLLIQAYMSRVELPIADYAQDTISVLDQALRILQAYIDAAAELGYFKVVMSFIQLMQCIKQRYWYDDDPVSALPGLKLISEGKTNQTLKQLGSMKPGQLFGLAKKLGVKGENIENKETNYDYGDGDGDEMAKKQFVKIASHLPTGNLEIKQQEQDLIKVVLTHDNYPLNNDFKVYCPHFPKPQRESWFVILHDGEELHLLKRASPRLSXKIGIVACDLDIPDELFGKELYLECVNDGXDIAYSKXDSLL

SEQ ID NO: 14841 - protein, 336 aa, Candida albicans
IPQSVRPVPLQMYIDGFPENLAFCPLMKTMNKPAFMAIKQHSPNKPVLIFVASRRQTRLTALDLIHLCGMESNPRRFLKISDDELQDILENVKDDTLRLSLQFGMGLHHAGLVESDRQISHKLFEQGKIQILIATSTLAWGVNLPAHLVIIKGTQFFDAKIEAYRDMDLTDILQMMGRAGRPAYDTSGIAIVYTKESKKVFYKHFLNLGFPVESSLHKVLDNHIGAEISAGTITTRQEAMDFLTWTFLYRRAHNNPTYYGIEDISQYGISQYLAKLIDLTIENLVESKCVYTGGSDELHATPFLEISSYYYLSHLTMRNFVNNVTPDFEFRDCLRV

SEQ ID NO: 14842 - protein, 270 aa, Candida albicans
LTPIDKILDKFANVTIDSLKHIGNKSSGADVVIHEIEDACNKISKQRGLEKLEIYTLVKSLLLQSPTDEELQSSLFDILGFDEFDLISKIIQNKRAFATRESLGLMSSEERAQQVIDNHQRAKNQTLLPKSTHQKYPNVFKNPDVGNIISITGKKFALPQGTTRDSYATHEELVIPYPENKPNKWISEKNLVKISDLDFLCQGTFKNYKNLNKMQSLVYPVAYNTNENMLVCAPTGAGKTDVALLTILHTINQFVTETVTEDGDVSVDID

SEQ ID NO: 14843 - protein, 936 aa, Candida albicans
NVIGSWDFSVNLIMRNLNVQCCPLKALAAEIVEKYSKKLKWLGINVRELTGDMQLTRQEIINTQIIVTTPEKWDVVTRKLTGDSELVAKVKLLIIDEVHLLHEDRGSVIETLVARTLRQVESTQLMIRVVGLSATLPNYMDVADFLGVNRSVGMFYFDQSFRPVPLQQQILGVRGKAGSKLARENIDKVSYEKLADYINQGLQVMVFVHSRKDTVNTARTFIRMAVEYGELEIFNCSEADSYEKYKREASNKNRSKELKELFVHGFGVHHAGMLRSDRNLTEKMFESGAIKVLCCTATLAWGVNLPAAVVIVKGTQVYDSKAGGFVDLGISDVIQIFGRAGRPQYEKFGTGILCTTSDKLDHYVSLLTQQHPIESKFGDKLIDNLNAEISLGTVTNVEEAVQWLGYTYMMVRMKQNPFAYGIDWKELQEDPSLTNRRREMVFTCAKRLHHLQMIIFDENSEAFTPKDLGRIASDFYLLSNSVEIFNQMMNPLATEADILSMISMSSEFDSIKFREEESKELKQLVEEDAPCQVAGDVDSPQGKTNILLQAFVSQAHIKDSALISDSNYVAQNSARICRSLFLIAMNRRWGKLMNIMLSLCKSIDKRIWAFEHPMTQFELPQPVLRNIKAKNPSMLALRDMEAGELGDLVHNFKMGSILYKLIGKFPFIDIESEIFPITTNVMRVHVDLQPDFVWDDKYHGSAQFFWLTVEESDRSEILHVEKFILHKKQLHSPHEMDFMIPLSDPLPAQVVVRVVSDLWIGSETVHAVSFQHLIRPSNETIKTDLLRLQPLPVTALHNPDVEQIYSSKFKYFNPMQTMVFHSLYNTNSSVFVGSPTGSGKTVVAELAIWHAFNEFPLSKVVYIAPMKALVRERVDDWRERICKNTSHRLVELTGDSLPTIQEVKEAHIHIPTPEKFDGISRNWATRKLVQQVSLGD

SEQ ID NO: 14844 - protein, 78 aa, Candida albicans
FIMPKTVKNPKNNKSRSRGAPIQVAESIGSGSAKIKKKIRDIERLIKKNPNLPADKKIEYDRALKGLKVELQNSQVQN

SEQ ID NO: 14845 - protein, 158 aa, Candida albicans
VLALKYQMVRCGERKKAVRKLKNLRKEFERISQTGIRKDIKKARKQLRHGEIDLAYVILFPKTEKYISLYPSPNDEDQTDPNVIKGLKITEERRREFRKYIEKLMEEGKLPFSIDDALQGKNIRLDNDKTQKAVLTEEIDAPEQKQDEQQEEQDDFFE

SEQ ID NO: 14846 - protein, 447 aa, Candida albicans
YKKTKTSKRNTMKSEIEIELGADDPLSKSTARLSICQADMEEETEGNQNPRLQVRELLQREKESIQRRDSAVSLNSFLEEDEENDQQQLQLQQQHLLPKKKSRSKKAAEKRRRSSAHSFSIAQQQPPLKREKVHKRKLKKRLQPPNIELLLDKSEENLNKDSELKRFPFRNLRLLILKVFNVPGTNNLKWCNIENSEKIPTVCVCLVPGLQLEENLAETADNGLQSSKEKLKQQCAISNLKRIDQLSFIFDNFTNFIKLSSPGSKDSIFLSLQTLLNVPLTKNEKNSLLRKLKATKITIKDLLLTEQQLKTYNYPTTLVDSTWKATKDLYNTDSNNNEKSDSETRKSRIYALDCEFCKAGAKQVLTRISLLDFEAKVVMDELVKPKEEITDYVTKYSGITEELLRDVTTTIEDIQNLFVNTVSQQDILIGHSLESDLNVMKIKHDNM

SEQ ID NO: 14847 - protein, 334 aa, Candida albicans
PFPSIHSSFLTLQMLNPVIFIKDPIKYDYSQFIISLLPKFINCNRIDLVILCQITESNQLNEILCFYYQLIRNHKNNGDTDGDTDSLPMFDYRFEINILFNLSTKKLNQLCLNNWNHGYIAEGDNDNSTNLSSLPLSITQISNIEIPTIQSRANSSSYNDEDDKITTSRQYQQFKTTAVGGTFDHLHDGHKILLSMAIFLTSNKLIIGITGSNLLINKKFKSQLQTFNQRQNLVIQFINLLLLSETSVIFFEIYEINDVCGPTGYINDIDNLIISQETKSGGEFVNKFRKDHGFKLLDITIIKVIGGNVEENSWKGKLSSTDIREQEYNRLLNQ

SEQ ID NO: 14848 - protein, 411 aa, Candida albicans
CSIRSETAQAQAPVQVTKPTAAAPVVVTSEQVYTSVVTSATAAPAAAATASSDSDDYSAEGLFGFLFGGGSDGGKASAAASASGSVSLNPIDGSGLGSGSGSGNSAGNSGSSSGTTLGIGYQGGSPGKNTASINTATATAVNGGSAAGATATAGSLGITYSPYTKSDGCKSASQIAQDIAKLSNYEVIRLYSTDCSGIENVLSAMGSNQKLFLGVWNIDSPQGELQDIVSAIKQSSSGWNVVHTIAIGNERVNAGAASVAQVQQAVDISKKYLKSQGYNGPIVTVDTLVAYVGNPQLCEMSDYLAVNSHPYWDGGVQPENSGQWLLQQIAHLQSVCGSSKDVLITETGWPTQGDSYGQCVPSVQNQVAAVKSIVKSLSDKVIMFTMFNDYWKDPGAYNVEQHWGLYGDPSS

SEQ ID NO: 14849 - protein, 62 aa, Candida albicans
ANIGKLFYNYNWSNDTSRFGHQYLPKMGWQQGIGLGLVSHALTNHVKVSIKEHNLGLGTQLH

SEQ ID NO: 14850 - protein, 315 aa, Candida albicans
FKLYQLTMSYRGPNQFGNQPPHHGIPSQPQPHIGPISSSKSPLEQFEDVAKKVEDWIDDYFKVLKPYVPAIGRAFLVATFYEDTLRIFTQWNEQVYYLHNYRHYWRWLTVLFLINNMVVMTVASTLVIARKKNNIATIALIVVVIIQGIGYGLLFDAQFVLRNLSVVGGLVLAFSDSIVRDKRSLNMPGLPMLNNQDNKKYFLLAGRILLVLLFLGFVFSSDWSLGRVFIIIIGLTSCASIVVGYKTKFSAAIMLIVLFLYNVFTNQFWAYASQDARRDFLRYEFFQVLSIVGGLLLVVNARAGEFSIDEKKKIY

SEQ ID NO: 14851 - protein, 233 aa, Candida albicans
ILQHHSFFLATTISGFSTLPCLQKMITRLIGIAKSGIYRTYLTASFYELFPKNFPHGGPPQDSFIVNDKSLRREYRSLQSESHPDISSDTIKSSNINRAYTTLKNPYTRIAHFIHLKLPNHVNITDDAVAKKLIKNYQQKSMEASMNYKEMLMQVMEAHEQLELAELENELETLEAENKERIKTTEERINQSLKNTPIDWEELMMDAIRLKYWVNIQNGIKDWEPGKPVHLTH

SEQ ID NO: 14852 - protein, 124 aa, Candida albicans
YAKWTKLNRQPDKLSADLQKLNQDIQQQKSSIDEASNALILVLTTLPIWIARVFYRKTHLFYIRQGIFPKYVEWVLALPFLPNGAVGLTIWMFAVNSVVSNFSFLVSFPFAKRVSKPVRDTKVE

SEQ ID NO: 14853 - protein, 330 aa, Candida albicans
QVQQQGQPTTVEQTFQTNEQVQQTTEQNDITTQSPSTTSIDYTSSTSSTSTFSPSPSSSTGSSGDIPAPTAIVYSPYANDRSCKSADTIRSDIQLINSKGIKQIRSYGTDCGSLTTVLETCRELGITVNQGVWISAAGVDSIDDQVSDVIKYGQSNGWDVFNLLTIGNEAIIAGYVSPSELVSKIKSVKSQLQSAGYNGKVTTSEPPATYLKYPSFCTDADIDVVGINPHSYFNANIEPKDAGSYIVHQQQQVAEICGGKSVLITETGYPSKGSTLGVNVPSPENQEIAISSIIKETGGDCTILTTYNDFWKDPGPYGIEQYFGVIQLFQ

SEQ ID NO: 14854 - protein, 177 aa, Candida albicans
ISKFGEYFFLWLKGDHLQKYFFFLQIIFFFLFFIYTVIELVKMSSSSNLQYEEIPKKYIDPLAPKDKGEGSRVNGKDWKIKKDAFRVKTLGVVSKTKKDSFKQRELKRLEEEQYKARLKELKDEKESAKNQRIADLKRRREIKAEKERYERMATKMHAKKVERMRKREKRNKLLKER

SEQ ID NO: 14855 - protein, 626 aa, Candida albicans
TIPLMRRAVSKILPTPKLFNDSAHFHSNFRLEYNSVDDFYVQLDNPHKVWLPGEEISGQVVLISKKNLANIVITLSLVGFIKINASSHLKLRPLKHTLFDYTIKIYGKDEEEQTDSAEFSNGLLKGEHVFPFIVKLPNKRVYTSIDFGKGSINYILKAAIGNSSSYVIPASPDNASTSSLTKKKILQNPSHTSEKVISLVNPIDVSLLPRPKPKRLILKDPRTSSNKKLSRTQTSTSTINTMSSNEHDHSLPEGATPEDSDHKSLKSIPVPTIKAILEVPQRGYLRGELIPIKLSINHLRKIQDFNGIIITFVRVCRLDNGPDGVVESFRKDLQQLILPLYVDPVTFQSEINSSLRVPADAFPTILGCPLVSFQYFVEVLNNLSGKSIALDSDVDARGKANPQATKSSLDKFKFNFDSTQTERSTYINTDSYKRLKKFLQLTTEIYIGTHRLSTQEEQAPQAEEVASRRSSSMASNSNSSPAVFSTSSPHSPVEHQYAGAINSIPESVAVSNFTPPYENVVPLYVPPEFVSHLQNQSELSEKERMRQHESSLLPSAPPDDEQPSPVNMTSNQQPFSFFTYQNTNTSPPVPLDDDLYQEPVDSAPNYLNVNNDRLIVPQDNNSNSET

SEQ ID NO: 14856 - protein, 286 aa, Candida albicans
SVPSSRVVKILCKIPLIKRNKVFYWEISSNSPDNLDASPKGTIDEYCLPIIDTINSHRDMVTTSSCSGRVSIFLEGVKTNNSTSVVAKGHEGRWLFVTHEPKDLNNWYDSIDFNYDTSKFPENASARSILYKFEPLILHVKCRNESMAQKLYVLAMNNGFRESGIGNNFNVAIRINIKLDIPIGFQNVDEEDLNCFVTKEYLKYITDISHERFNENFKKLEQLHRAIERMIEDETKGIETTKKKHKESKEERRQRMIKEGLQRQQELRELKEKQQQEQNETLHVDK

SEQ ID NO: 14857 - protein, 136 aa, Candida albicans
INNNRLFILAVVTNAINLFSQVFFTIMYSDLECDYINPIELCNKLNPWFIPEAGLHGFITVLFLINGYWFCFLLNLPLFAYNANKFYNKNHLLDATEIFRTLSKHKKESFLKLGFHLLLFFFYLYRMIMALVNDEQ

SEQ ID NO: 14858 - protein, 237 aa, Candida albicans
KVFWVWFALYQQQIINSKNLQLEISYIPKVLLTTFFQCLLFIVIKSEGKPNFKYMLLTLLTKLLTLSPDTGYEFIKDSLNNCPYESEYPSLIGVYKQLLLNEKWDVNSIELEKLNISSSSSNTPPKLPPRNGIKRKHFSLTNESLNDLVDLINNSLKNAFVEDNSKIDPSKLSTIAAYLNLLVAIKKDPVIVENKEKLTTLISSIENKIKSVKKSSQNQFELNAAGMLEITIERFNE

SEQ ID NO: 14859 - protein, 506 aa, Candida albicans
RPRPIHIYQNRKSPPLNSQFTKYISDCYPDKSYLSQNIAYKICNSCQRPIGTKSLSLHYTKCVAMKQKRQQEQQENAALSNNNNNNTNNSQKKKRGRGSALADVDASSVDSSRNATPAPNGNGNGIGAGAGNDNSGKPATKPKKKYKKSQAQKEKEAAAAAAAAAAASSGEKPPKKKKAAASSSSGTTTTTTAGVNTQPQSAPKPKPVAKPKGPVDVEKQCGVALPSGGLCARSLTCKTHSMGAKRAVPGRSAPYDVLLQQYHKRNQANIAKSHAMMLQRRENAAFNDQLESGANATKVLHPDEETEYVLAGVSKNSTIPLERKVIMPVRYRHRFLRAREFYANALIISAHHNNNNNNNQSQNQSQNQSQNQSPNNSNNEQQTLANQAISGSIGGLQGRCALINIDAKPTDINSPTQTFSAILGEMYQVRAPSKTIVMTAQHNNMQQQAFQQQLMKYQQQQQQQQQQMLWRQRQQQQQKQQQQQQQQQISTSGQHVTNPTEIKKET

SEQ ID NO: 14860 - protein, 179 aa, Candida albicans
NWYNDNKNHDKNLRAKGKPIFLFMGLLDESVGLNLQSLKFAADTKEETYLDHQGRYQGIAYYAVDLSSAKELTENLINFVNDSINKLHDNPNGTLDSNGIFFTHSRKHYLGFEQKEASLYSQGAMLFSWLNTNKFCPGCGEPTIPIYAGGKLFCTNEKKHSEEDDDRYIFTHRAWKEQH

SEQ ID NO: 14861 - protein, 106 aa, Candida albicans
HSCNFYFNLFFSFFLSFALLFMIRSITRIMSHSIHSSVKDIQKDMYFGTEVLNRVSFLREDPEFIQSSLFHPSTRFIFYYKQQPLIHKNLPHKLCVINKGRGRSAS

SEQ ID NO: 14862 - protein, 164 aa, Candida albicans
IHIFSSLLLYNLFLHLTYIQLFIYIYIYTFTHLLSYLSTFLPSFLPSMSSFKKFTDFLFSKQSLRYVCTTHFWGPVSNFGIPIAAILDLKKDPDLISGPMTGSLILYSLVFMRYSMAVTPQNYLLFGCHFVNELAQLSQGFRWVKHHYDTSSNDGEDTKKITQN

SEQ ID NO: 14863 - protein, 409 aa, Candida albicans
FGDSSFGLSIFVNGSGYHTGIIPRWDVFYNFTLLRMLSYNLDYIARERKLGNNDGQLNLNIREHIYGADNPPTLLNLDDRQRLSAPLPLDDYNVSNYIAYISYTPLFIAGPIITFNDYVYQSNYQQSSTTQNYQRIFMYAIRFLFCLLVMEFLLHFMYVVAVSKTKAWDGDTPFQISMLGMFNLNLIWLKLLIPWRLFRLWALLDGIDPPENMIRCMDNNFSALAFWRAWHRSYNRWVIRYIYIPMGGSGTGKYRIINSLLVFSFVAIWHDIELKLLMWGWLVVIFLIPEILATLIFSKYNKNWWYRYLCGIGAVINIWMMMIANLVGFCLGTDGMWKLLHDLFQTFEGGRFFIISSICLFVGAQIMFELRESELRRAIDVRCYKEIMVQLMNEYQKKKNKINYYYYTL

SEQ ID NO: 14864 - protein, 201 aa, Candida albicans
IMNYVSQLGKLFSLETLDTRLNPTTNPIKRQSIIKKANRTSRWSTLEFKIYLTILIIVVPLMIKAGMESYNETNPNYPRFQHLLSDGWILGRKADNSDQQYRFFRNNFPLLCGLIFIHVTLRKLINTLIIIPYGRYNYNFKRTYFDLIFGIIFLIGSHGINVFIILFHLLINYFIGKYISNYKLSIWCTWIYGIFSLFFNE

SEQ ID NO: 14865 - protein, 246 aa, Candida albicans
ITTKAIYSSFSMPPIPAEPTENISIFHPKVLLLSAGVTTSLFFGYKFYKRYIKRIRTYLDLTPSIIENNTKLYGYVTRVGDGDNFRFYHTPGGWFFGWGWLRKIPTTRKDLKDETLMIRLCGVDAPEGAHFGKPAQPYSKEALYWLREYVDGKYVTITPYSIDQYKRVVARAQIWKWTGRKDVSAEMLKVGYAIVYEGKAEAEFGDNEDWYRKLESRAKLLRKGVWSLGKNLTTPGEFKRIHYRGE

SEQ ID NO: 14866 - protein, 636 aa, Candida albicans
  UNSURE (596): Identity of amino acid sequences at the above locations are unknown.
YALILRSRGEHLGEDIENEAMELTQTIPMKIINSHEDTDSISKPSPIVDDLPDESLSQPMELTQIDSKITTGKEESDLGDASQPMDLTQTISNISHDEINTSGIEERVTTTTIPLAEITQDDINQEEDEGGEERKEEEKETVVGEEEEDEVSSEDDSFDEDDPNYISVSLSKFLSDIRVQFYDDLELDLNSIPRLSITNSIELPTIHDYIKAKPNLELLELYEFCCNELNKKIIQGRELYNEYEKTVLVNNPILFKKYYSMDDKTKLLINLKIQLIRDFARLKSKKTWYDWRNQLTENLIDKLDEEINSLTIDKQEIIKDINRLNELYDKTRIYLKGLNHKFNELIRLKNEINEIPPNELNKLQLDVRKRKQDIVEINKEIEIKLSELSTIKKNLDTSNNKKLTLQTQLNDLENQFNQIRKYDNLEIKLILQKYQFLQHLTNLKYLKTIESGQKISFLFDDSIICEFDFINNNILYTVKQNNFKNKSLIEIYEQFVIDGDKQDHTITDKFQMFHRNWQWLKKIDSDFYYISLKFPIELKIVHHQDNDNDDDTKKSLEFTIKYYNFRHDYKVLICGKIDINKFLIHQLCNTHNNIEXTGEIIYQRSEINNKSFRDQISNDLKVFDKQILNNLIIVNK

SEQ ID NO: 14867 - protein, 687 aa, Candida albicans
NHTMENSNKISLHPEQKKWKAPKGPKPIHHKNKNLIGLGRTIANQRSKENSIQYLPDGEMRFTTDKKEANWVKLRSVTQENALDEFLSTAELADTDFTADKNQQVKIIKVGNTSIVNSNGLLSTDEMLAMRQKHMMFENKLTIPKRPKWNKNQSKIEIDRQENLAFLSWRRELAQLTENNDLLLTPFERNLEVWKQLWRVVERCDLIVQIVDARNPLFFRSIDLDKYVTSLSDPDNNKAKNNLLLVNKADMLTRDQRIAWAEYFKLKKINYVFFSAAKANELLEKEREELENIQNSTGSSSSSSRNTNNNAAAAAVDAEQEEGEANDSIRILKIEELEKLFMDSAPKFEVDPEFPDRKLQIGLVGYPNVGKSSTINALVGSKKVSVSSTPGKTKHFQTIHLSPDVLLCDCPGLVFPNFAYTNAELVCNGVLPIDQLREHIPPVSLVCQRIPKFFLEAVYGIHIPIQKVEDGGNGEYPTARELLNAYARARGYMTQGFGSADEPRAARYILKDYVNGKLLYVNPPPKEATNKNEWILPNLQESRIFNRELYTLNHLPESRQHQIVSAMQHKHIPVDEFNLEKDLTKLNFSQHIAAITGSGDSKDEDNKLRDNNQLQSEAKTLFYGGKQAALESAGDELDREFFAMNNISGKFATPFHKKNNSNTEKNLNKKHNKKNKKQDKKVRVVGY

SEQ ID NO: 14868 - protein, 298 aa, Candida albicans
MTRNLDSFRYTGNGNDENNNKPHRITKIIPKAKAKRRANSKLHSNNQKSSVDLPDLQPSLNDHLQVLFVGFNPGTESSIQQHHYAHHSNLFWKLFNQSQLLHKVISKNKNSPHEPVPETPNEVNKSEDQFLNHLLENGCNATHDFKLIKYNIGFSDLVLRSTARADQLTMHEKLNNVPRLLLEFKLSHVETIVIVGKGIWEIIIKYFMNELSISSKNFKLASGNRKSGDGDGGAPHKNFKWGLLQKGSDSTYNLIIDSIYKHIDESSKIYIFPNTSGLVASLSFDEKLKLWQDMVNDL

SEQ ID NO: 14869 - protein, 234 aa, Candida albicans
TNSLLLPTLIGFFLFRALYIYTIFFFFLCPLFFLLICFVLISNYSSSLPCKFFFFGYHFYSMINFLRKRNILDILIKTHIGLTRLGSRSFHYSTRIMNSIKDLSENVWQPQDALPKHIKDLLTPGTQPVNYMFAFLQIIRSLKFQKRTGWLDHGIPAEATESIADHMYRMGVISMLVPKEVDSNKCVKIAIVHDITECLVGDITPYAGITKAEKHRIELATINYLSDLIKPYNE

SEQ ID NO: 14870 - protein, 456 aa, Candida albicans
ANMNDTEDTIYIPIPHYPPFKLRSSLIDKDPVIWVHLLEAYIHLMTVLLDPETPKLNVKSQQQLQLFLKIFLFETCEEETKIFSLGAINPDIKKNTSILKAYVFQLIKKYSFVKLNLTGEAIWNFTKIHAPKNISTVRGLIDGTFKSEFNDNKKSGNISSISPVQKHLDLIVTNGKFTKTEDLVILSMLLGQNTTRTSTFSMGSNKSINKKRNRSLPFAENFVNVQWIELLEKGYANGKSVNADIIKDIMIISIISLSAEKLATLTMNLGITSIAAFNVCPLFSSIIISEPYKELIPNLEKKLPFLRNIDIDDDNGYEDDDLDGYEDNIEGISILVDLWPNMTERKAKIILKQHNGDVEHVTNLLLENPELIDKIEMPKKTNNGTASTSNNTKTFTGSYKIFSGKKKGSLNNNTKLNAPSADLKKKTLESALRLMYQSDEDEPDDTYDDQEKTTGV

SEQ ID NO: 14871 - protein, 407 aa, Candida albicans
IMKVIVSADDTGSAKEVICNEGTDTSKQNATQPISIDNCLLEPSSSVKSRIIHFLSFNYQYLIGARLGGQVSVYELSDEESEEKFKLLHNFELPVDAQDKPVALLRVEILDSILVAFESSKVFLIHINDSFDFKPLELVLPEYKPISAFAINPQAENIVALGGKEHDLQILQLFNKNINSTVFKKNNYENEFKPQIIFKAKNVRNDHLELRVPIWITNILFAKAAKGYKLVTSTRYGQIRLYDTAEGRKPRKDYKVTEKPIVTLTFANDEQTEIIVTDTHSLIAKYSLTQVDEKAFKTISASAGEIVKPVPKLLGKFTGGNTGATFGVHAYERIVAFAGLDRYLRVFDLESREILAKVYLGVEVSALLILDDEDTEDEETKKRKRKEEEDDEELWNQLDTKKKTHTI

SEQ ID NO: 14872 - protein, 398 aa, Candida albicans
  UNSURE (395): Identity of amino acid sequences at the above locations are unknown.
YMSILALISNSNDSSNLDCFQNINYFCNETINLRQCHLIELECELQAKGTSADEIPERTNENIPSSDSQKHFGVIFPLPNHIYGFFKLENVEITSIQVLLGNENIRHDIENNWLDIMSSNDLISRCENLHLDSENINTGKRKESLSSDIEFSMKPPAQIPRLSSFMSSSSLSSSLTIKDDESKNTTLSNDYQMEKKIPSEEEEGKDQVLPQVIIENPIDFLTTRYYSTLYSLNNPLSYFPKTALPRFKNLISTFKSNLDIEENSKYNDEHTNSSSSNIIEGLREFWLNVDAFDRRHNQRYGVFGDVNDGSDTDMNNQVNDELSNIELIEQQKFKSNHGFDLNQPTTLSEHQENSETMDIDDKGNENGNQIHGITMEKLSQLSLDLQIREAPLQIXNNI

SEQ ID NO: 14873 - protein, 455 aa, Candida albicans
TILAPLSFLFCFLLLTSWLLFYKMTIETISNNEGIRQRSASESTHTHTYLDQLDIPQITLRSTIVGLLIGSLVLISNFQFGLQTGWVSMMSLPAALLAFSIFKLLPISIAKNFTDVENVFVQSIAVAVGTGPLCYGFIGIIPAMEKFMTSEESGLGRPLTFGLGQLMIWSLGLGLFGVFFAIPLRKQVIVKEKLPFPSGSATATLISVLHGSDIYQDKEEISEKLDIEEEEGRETGSIATELESLTQQSSKSQLITTTNIQDDYDSNMRSLIITFIISATYTILSFFLPILKKIPIFGNHLSVNYLWNFQPSPAYIGQGIIMGLPTVSYMLFGAILGWGILAPLAKHMEWAPGRIDDWINGGQGWILWISLTVMISDSLVSFVVVSIKSINNALDNFRQRRDLDQFLELRQSQQSEYLLQDQEETRSLTSSNENPENSTYDGKILHPQGLEGSAL

SEQ ID NO: 14874 - protein, 115 aa, Candida albicans
LGTGQGLPPQIREFAWVLGVIFGIISLLKNTVPPTSLYHKYLVYLPSGVAVGVGIHNTPNFTLARFIGGLICYNWQNIGPNGKIGMIIFSSGLVLGEGLFSGFTMLLTSLGVKHW

SEQ ID NO: 14875 - protein, 642 aa, Candida albicans
QIYIFTSIVSDYNITAHRSSWLPLSQNTTILVEKKKKETAKIKEHAHTPSNDKIKIERRAISSENSLEVQLHICLVYMSFPKTLNVPDKSSLLVPQTTKASATGPTTAVSYETASLEIRSIRGSPYLPSSPVDSQQFDGRSIISTSGMSEYIADLNDLPSIRHDINPTSIKTGGTGSRSFKFLNCFQTLDSELSNMDFFTKYISILKGDDKAQFNNKLKHFFIFSSAGKPIYSMNGSDDIVIGYMGILTTIVSSFQENFNQELQVLELGQGLKIVAVNKSPIILISISKLLFETVESVHLQLDTLYCYLIGILSKSVIDKHFNNRLNYDLRRILSPLDFENLDELCLNLTYGIPNTSDRTQDSTFGLYTSQVLLPLSRESVKIRHTLRSKLNSIVNTNNEDVLFTILLSGNGKILNYLHLKQHNLPNKDLNMLLFIIHSLLKNQSQQDEDLWLPLCMPTFNDHGFLYVFVRQWQDLVLMLISGSKNSFDALKLSANEICTKLNNKQELAVKLINELSIPLSIEVPFVFKHFIYKDIRLNQFVMSELPTHEFSSFQFLKCYNELKVSQAKIIKHDNNLNYKKLTYLQDRDITGFMLMDKYYEFYCIIERSSEQETITSKKLIQISSQIIRWCKKNHARLFVTI

SEQ ID NO: 14876 - protein, 352 aa, Candida albicans
IFIQMLRATNILRERIAAAAAASSSSFSFLTTNTAARSFTTTSINLAVVRQKEGKKKQVLRKRIDPNKQKQKKTTGLTHLPFRDAVRNLNLEQTAPTLIAETLSNKELKAGTVTKYEKSIEKSLTVLNAFKKYQHHEMFQTPISLVTSNTIKINEEFVEKLDGESKSNRIYIDGIKGSGKSTLINQAISLAQEKFNNEAIVLYLNSGEVIGNGTSDYVKNSKLGVYQQPMLTKRWIHKILSANANIFKKLKLTKDIKFAKDKLETLLKANTATLYDFLSQNRDMGKVHPTYAFQFFIEQLVEHSQNVPIIVSVDEFNALADYPWTKYKHPEFTPIHVNDFDIGSILMKFSNW

SEQ ID NO: 14877 - protein, 271 aa, Candida albicans
GRILPASVGEDNNQNQESMANIVDAKNYNFQIQWFYRPRDISKTTSDSRLLFASMHTDSCPISSFRGLVEVRHKQDIEDEFNRAQAKENKRSANGKKNTSPSTAPTALEVYVQKPNQFYFDKLFDRYMIKFYDVLLTANLLQYAEVENSKSRNFLIALNKRYEFIFVESQRTKSLINSFSSNTCNCESCGQWCENSNSIQCVVCEKYFHMFCLDPPMLKKPSRGFSWSCAPCAKKNEQENHQIKLVHVARKQVVKLRTVSKGIKCFEFNRQ

SEQ ID NO: 14878 - protein, 499 aa, Candida albicans
ALCPKYEMLAIEFLKKDKSISFAQRRIKEEWCMRYLGQHARLEDGVDVDDRSPYPRASTRIGTKHQATYIPECDGHPLVYYDVDKPQKKKNGNGSSSSSRRSKSKSVEDQDLKQVKLAVPQEYADVDPKEYPAWLQPRPKGYIERGVDDGDGETCTLLWKSSEKDIADNFTTLDHYVGKCSPIAESIGLSPNSPNFVDAILYSYMQHKGNVDEAFKEAKTLTKKSLKEPIFSKEEIKRFEAGVREFGSELYPVYKKVKTQPVSMIVRFYYLWKKTKNGREIWGNFEGRIQKKVQNIIKEETKSAVKEEAKNSTNTEDDSSYEESTDPDDDKKFICKHCNTLESTQWFKITGHDAKKKNSDNYIISLCFRCARLWRRYAVVWEDPNEVLKKYNGSSKSAGGWKKKVEIELLEDAERIIEHNQAISSGLITQEQPNSSGSRETKKRPLPSPSTTSPAKKKPKIKQEELKEKEKEKIVHIKTSTTSLTPTLSNLQNEEKFFP

SEQ ID NO: 14879 - protein, 282 aa, Candida albicans
CQLSTLIKYSLNNHRLQCEICQSKNGALIKCELCDDNLNYHVTCAQDTPNFKLGFKLVDTGKPDINFVTLVDGDACGKLKPILVCPKHDQSKKTILSLRTYGKRMNSKLNELDYRPLVELYLQDLINDKNNKRGKFSKLMNYIENYKQFFHRQVDNGENTAIQELSQTVNECSRCSSTNSPIWWTVNSTKLCQSCYHSGGHDTNETKKLEFKSESESVKDGVFTMLNGENYGIKNELDKLDSIYKPNITELQESDDETNKIEKSHRVESVSRSKISLGDILS

SEQ ID NO: 14880 - protein, 80 aa, Candida albicans
RPIHSAIYSCTCCLANESNYELSILGSPFVRPEFLKPIGNGRWCHLLCAIFNHDYVYFEKALEGGHSLVSIVNIDKIFLK

SEQ ID NO: 14881 - protein, 247 aa, Candida albicans
RRDSIALDIKEKEIFTQSGEKLIDEEGSFMVPLAKLSNLQRKCIEEFPDPLMTGLDWRYYDKPEDITKLISWLNPWGKRESLLRKELSLVKEAIISSMEARRKALWIDQTPPEELEISDNIKKLKTKLFGGSGDDNENENHLKDKTDAAEEDDDVILTSSAKRARRSTGSRKRQKVVTVQDALEFGEPEDINKMIKELEKELIEKKDNREINRVLEWVNSRALDLFEKSLYEGGDKQKSNKSKQKKK

SEQ ID NO: 14882 - protein, 393 aa, Candida albicans
INGHKEDCWLDIYIMIWNTYKYIPLRRQGRQYLITTNYHLQQLRFKSFRTIDLTFGSHNHNNIPNKRNEKIFFYNYDNTSKIKALDRQFKILNKSQTKILELGFIPSNWLIYIRDTMAKLHNISDPGKIHQKCHILGFDILFGSPPIGVSSIQGNIFSKLAHKNIINHFKEISWTQLRDKRQLELDIDPKSYFSREQDESMIIDKQIERIEAGLKNITMSDIKRQQLLDKRDSLLPDYRIDLILSDLSKPGYQQSGFYDLTETNPYHRYNNNKGLNHSILQPGKSNFEFLDAALLLSCDLLRPGGKFVARLNEIDPYDPEMYLLHEKLEKVFNDVLEIRNFGHTTATTTTTTITTNNNDNDMSFLVQPPIEKYYICNDKKNDDEYDLYDIFKY

SEQ ID NO: 14883 - protein, 348 aa, Candida albicans
IALFTIIMLSSVFFSILTLLLSCFVSTTEARRKLSATSLVTCMDNSQISPSYFNVTFNPDDRSLRYALDLTTSISAYITAHVQVYAYGFLIIEKDINVCSLGWKQFCPIFPGALQIDSVQYISSEYTKQIPGIAYQVPDIDAVVKLVVKERDSGDTLSCLQANFSNGKTISQTGVKWATACIAGLGLIVAAMLSTFGNSNAASHISANSLSLFLYFQSVVVVSMQAVERVPPIASAWSENLAWSMGLIRIQFMQNIFRWYIQLTGGSPTTYFISSTKQVLVQKHKRSLDYVAGVAKRSLEYALRSHSNLYVLRGIKRIGYNSKIEPTSIVATGHTWFVYLHHALEDPH

SEQ ID NO: 14884 - protein, 128 aa, Candida albicans
LHNKRHQSDLSLHVIQHLGKAIFITLIWIPIHGSLACEPPLHLNKPSMEEIRHYRDQSDQFYDAPELFLQTHLGKDLPKTEQLVVFEPLEPLMNDYLGREYYECQRFYNSFFHWDSRRDGDIIVYCRN

SEQ ID NO: 14885 - protein, 72 aa, Candida albicans
FTPKFVLLGILLNICIGLFSTNVHERGVFDLTKYLATQQTPSVGFITPCHSTPWQSYFHNPNLDTNSWFLGV

SEQ ID NO: 14886 - protein, 750 aa, Candida albicans
IMLESSLETEISKIPLVMTKEQLDNIEHKILYRQVKSVKAGDIERFKIHFTPHAEGDEVIIPPTLWVKIRNTEPVSKRAIYLAGPYILYVDCRLLDYDPNVKYFVTADQPVFEPQLLAGQSFYIQLSCHTLKKDYSWIVDVVPQIIFNNTISIDFEIMIGTSKQILHEASFPEKSVPLSDKIGCFNELLHVYNWDTLDLWNLPVMSPDKPKHLVILTHGLHSNASSDMLYLKEQIDRIAELRNDNEEIVVKGYFGNIGKTERGIKYLGSRVAEFIIDLVTENELFNNGKVKKISFVGHSLGGCVQTFAIAYLKVNFPWFFDVIKPINFITLASPLLGVVNENPLVVKWVLLAGFVGNTGQELGLKYLENGAKPLLLLLPAGPTHEVLKKFIRRTVYANAINDGIVPLRTSSLMFLDYKGLAEIINSEELAQSDETGKIPESVELANKFLAVQTFLSYLMPQKQTSQEYRRFQTQDDKVVEDHKSDGKAIPNSTFHDSAASLILPPLPSMKYIVDPSTRENVIIHDKVYYEKDLPERDLDVELDSFEWLEEEIAREYHKNMGWRKVVVKIKPDAHNNIIVRRRFANAYGWPVIQHLVENHFGPNRTVDSKMIDSAIVDLVSTNSLDEENGLTRIISRDLISRQNKEIDDNVSEEQRPEEYPHEWINSEHNGDSVFAVGVTGLLGEVADMVGGFRDQITKYSLNPPSLPIIGEIPFPAALMAPTDTNNGNTKSEEELNKDLKLSNGIMNDFI

SEQ ID NO: 14887 - protein, 376 aa, Candida albicans
TPFSKAILVNHFSKIYLPCLKLRFCEMKVISDQAVTEFLNKTLSKESILDAFQPTLLKSLTTYSQDSDHIVPPRTVQPSNNPNSDTTHIYMPCISPDEVGLKVISGGPGNNSKGLGFQGCVLIMDEITGQLKAVINANNLTAFRTALASSLGLTKLIAPSNANILPELSAFGVGLQAYWHIKLALLLYEGKIKEVNILNRTLKNAETLADRLSKEFKNVKFNSFLYQDELLGFIPHVQNSSIIFGCTPATSPIIKKEYLNTNPEVPKFISLIGSYKPHMIELDLNLCKELKQKAISIIVDSKEHTLHEAGELIQAEFDETQLIEIHELCADFDATVTDEITGITVQKIVGLSIMDLSIGKMISNEIGNNAVVVDDF

SEQ ID NO: 14888 - protein, 176 aa, Candida albicans
RHELYGFVWITGTLIFLMFVSSTGSNLLNQWLRGDDTSKPYSYDFSLLIKSISLFYGYNFIVPFLLWAITTYYNKFPHPIDLVKTVSIYGYTNVLWVPITIINLLIVFINSDILKWVFVGVFGAITGFSNLNKISPIVKKNCLILNESGKLYYIILGLLAVVHLSFTVVVKISFFS

SEQ ID NO: 14889 - protein, 194 aa, Candida albicans
RIEDFNDGRYHDDEDDKENKPGEMVIDLNSVQLMFFTASGKLLRLEERSSPVLIIKILKNGVEEWIALGELNQGEFDDDEDEDEDSQDEDTKKPVNKINAKLIKNSSLSLLEYLIRLCRLQEIECKSILEIPDEILSFYLHDKVNDLSDSGYLPKSLSQRQKDELKKMNKENTMTMDSNINRLKNLDIKEPKKN

SEQ ID NO: 14890 - protein, 852 aa, Candida albicans
KRRSFSSLGSDKSPTAVSFSDYVHYAAPKTTYTTIRSVFPPEAITLGRNAFNRIGDLIADIELVSCNGDRIPVSSAVLMERWGQHFILLLAKGYINAVDKFETDQALGLDENQRLRSKSSNSESSSSDIPKLKLSLSESLLSSSSGEHDKKEKMGLSSAHKPQKDVPQFRLPFQDSSESVNREEGSDCSKDRKTGGSSVSTAIDPHHVMPRKNSTSSFQSNSSSLLTSHLQDIPPQLPLPDEQIPAVPAAPVSYRSASRKNSQDHSSPRSSLIHTLTVLRNIPVSKSPRESPFSSPRPSMSGPSGGSADLFSSPFPSLKANYGKPPSNLRKKSYDMNDGTIESSLDSFSSGKSSMAKVSSVPGENPDSDESSIGFQEFNKNPISMFDNALLNFDNIDSENFRMEPSLIPRKLYIPFMTLTVKAFCEYLYTGQIGNKWLLAPTLMDNLLISKFYRVPLLYDLISEILFGVIGKKEAYIIGEARKLKARYFKLLRGANIPIDSNYEFPMDEYDGFLDTVDDGYLDITLLKKASKIHADSVAMSLKKKSVTSNNLRNASIRKEGSTTAESVLEEGEKQEEIVSKDDEDESRTGSTSEEDEVDKEYGLVYLEAKDKSLPTIGPRSKSIFDRQGLAAIEKLEEEQNDHQVHMIVEGEDHENLITLDELVASDAPSDYAIDLIFETATLVTDMKMLLRTSNLKAMTAKFRKCKADIEKEMADIEYQLTQMPSGSRNLAMKSANQLKELQLQLKLSPIIPTVSTVTPSPLPSISGVPSPRLPQQQLPEAQLPKLTKSTSSLSRIASHTSFKALRSMTDVTPMEKLTSEKSFRGKLQQTMQSRTPTNGRPDQILISDGTD

SEQ ID NO: 14891 - protein, 232 aa, Candida albicans
  UNSURE (1): Identity of amino acid sequences at the above locations are unknown.
XPRGEDRGAEKLGIKHVVTGHNADDVAETVLMNLLRGDVARLESSTNIMTTSAGSPIKRSKPFKYTYQKEIVLYAHYKKLDYFSTECTYAPEAFRGTARELLKSLESIRPSCIMDIIYSGEHLVLAPKKQKRKTVAYKNKNKNKKKSNSEQEEQEKQEQEVNPDGSISLNQNGIKKDGNTCEKCGYLSSNKICKACMLLNGLEINRAKVTIDNNSAIDGAAKLTKKLEQLSF

SEQ ID NO: 14892 - protein, 265 aa, Candida albicans
TWQTRQFSVLDMAPFHSNFKNQKIFFFDIDNCLYPRSTSIFEMMQVKIHDYFKKSLSLNDEDAHNLHMNYYKTYGLAIEGLVRNHQVDALDYNSKVDDALDLHSVLRYDSDLRKTLIAIKESSKFDYFWLVTNAYKNHALRVISFLGIGDLFDGLTYCDYSKDPIICKPMPEYFYNCFELTQLDYQNSAVLSEQYFIDDSELNVKEAKRLGVGHVIHYVELSSDVEKLKAKPDFEEFYGTGDNLDPNKIWILNKIQNLPNLIGCT

SEQ ID NO: 14893 - protein, 199 aa, Candida albicans
LWPTKKLHGPTLVFNPKPTKPNTMNAYSEILKPRIIPISSSKNDVPPPPGYSESVFSTATKSLTSSGKKTKHDDADLNALKSKKIWELAIGPAKSIPMNLFMSYMTGNSLQVISVTMTLMLLWNPIKAIFNETNPTFSKLSTKNNGSEIILAKIVFIICQVLNMGIGVYKLYKMGLIPHQEADWLAWKEPKKIIDRLYY

SEQ ID NO: 14894 - protein, 287 aa, Candida albicans
FFSITFPISSHPLKLIILAMGKRKAADSNNPPKKKFKNVSKLLDPNTSGIYVSCARRKEANCRQELLNLLSEKVPEYFDLENVEDDEDETQIDKKELSIEDKIKQELQELEESKNSKKELLQPVDVDLECLVFIKTKKPIDPEVLVEKLCKECYESGQKTTRYTQKLVPIMDSCSSTGDDPLEKVRQLARKVLARHFHQEKDQKPVKFAVQVSRRNFNVLKSDVIIKTIAECVGNSHGHSVDLKNYDKLIIVECYKNNIGMGVANNFLKYSKYNLQQIFDKHQEDNN

SEQ ID NO: 14895 - protein, 100 aa, Candida albicans
VIMIPLCTGKKANLNTFESLDMYKLPQNFTYDNSGSLKISHEVCTILNIVQPTTIGQAQSLQGITPTAINELKKVAKFVPSESLLKLRNEKNSIKSAMFG

SEQ ID NO: 14896 - protein, 76 aa, Candida albicans
DYDDGWEDMDDIGVPNFEKLKSYINDDEKHEADEGLKNLLTQFFRECTAKNLGDFQRYYEELSDDEKKVITENLIF

SEQ ID NO: 14897 - protein, 235 aa, Candida albicans
LATTMSSLIDLVLNQTSSDNEIRKNAELQFSQIVKQDPSNATQTILELALDTSLPLDVRQACLLHLKRLVPQYWSMGFESFIGPPVNQEPKQLIRSKLLQLATSAPESKIRSGAAYAIVQIASVDYPDEWPELINELYNATTQFQNETALLGGLQVLTDLFDDLITEEQFWEGGVGKEIVGHLNNILSQSLAAEVKTQAIKSYESVLAYLRSPKRLQPTKENNWFLMKLHLQFKF

SEQ ID NO: 14898 - protein, 676 aa, Candida albicans
SQDPGNKVIRKCVGLFKKPKAFTTDERKQLVLNEITSTIQVLIQLLSQRELNLVDLHLRSFIYKILAAIISQFHSKLALEVKRTILTLAIQDLHYLAPVYSKVALNGNHGFDVSSELEVSTVFNNLLDELFQTINSIQHDIPINNDQFVQDLIVCAVLPNDKLEEYDLDLNAFVSDATGLNVNPTVRDSIYDLLTELNPSDAATWFKSISSHLNDDNWRKLEAQLAILEGLLGNDEELEDPGLSVFTRFITNHNTVITSRCFLLLPKYFEKFSNPNAKRVIVDMITFAARSVPRIKVASLISFTYYKHVMELTTLDKSIQPQLFKIVYSLIEECEEDGLPVLLEAIGDTITINPSYASAVSISQGVNVIDLIFKIAFKDPGNVQLITDSSECLTALLENTSVQDYMIACEKSLPFIFNIMQSSNGDYTPELYLSLELLSIIIKSCPGGELPAQIFLYAFPILQKILLDSFDNQILQSGGEVSNELIKKGSKSFLDYKDPETKESGIDCMLKIVSKFLSPELSDSAANKCGSIVISLIDQFQNYLLSDFLTQILESAANRLVIAKETATIENLVMVFCQLVLKSPAEMIDFLSNMQLQGQSGLAVVLPIWFDSYEVTRGYEQIKQNSLALGKIFSLGDARVENLVVNGDIIPYNGDLIITRSMTQTMPDKFTQISAS

SEQ ID NO: 14899 - protein, 208 aa, Candida albicans
RSSFSTANFSLFKSYTSFFFLFFFLKNTLPSNMTDTPTEGASYSEQILESARRNNTELLLSIKVELNNDQEKLAELINTTKEVITDNTPLHLACQLGNWEFIDIVLDIEGVEIDPQNRDGETPLHLAVKYTNNEEPEHGYFIVDNMLDAGSDPRIKDKHNLKPKDYVSSDHEKLIELLESAEYAISMEPTEAEQLAEFEDEGSASDSD

SEQ ID NO: 14900 - protein, 190 aa, Candida albicans
LELWLEKTENRRRKKKVGVNIIHVFIMSNELGNAIASTVIDTFNGLSIKSGKPVVRSNGVQQWTVLASVVAITNNNIMPITLATGVKTLPDKVRSYSNGLMVHDMHAEILALRLFNYYLLEKDCPLVEHSGLKHDVKLALFISEPPCGDASMSYISPIPIHTINPGTPQKKSLTPEKKIWANQNLPQTPP

SEQ ID NO: 14901 - protein, 233 aa, Candida albicans
YDYMKRCEYVGYKFETIATIPKPWSQVSRSQIENRNKKVVNNYEQYLSVIRTGIGNVKLVLAGEIDCCWDYLPDEQNKKLNHYVELKTSRIIENNSQVVSFEQKLFKAWCQCFLMGVTKIIYGFRDNNLILKNVELFNTEEIPILIKNNPLTNAATEKKINCTNALKWYGAVVDWLNTTVDKKDETKSYRLKYDPVRKSFTLSETDSETNEKLRNGQLLTPEFTEWRQSLKKY

SEQ ID NO: 14902 - protein, 341 aa, Candida albicans
FDDTTGLNTVGVSYTRQSTTRTQHKSYASSVGRPKIIGSDLTQGFSDFKPESLKDIYLLNDIFKSIQYLIQNKNFTPQDFKIVTARRHLQKLMTIPIHKQEVQFNVIYWKGMIFFAYDWKSESTTKVEDPYNKLIQYTGFKFEEVVSEGTRDLNFYTVVQHCVDNIPVIYTAEVDCSIDKETGLENYIELKTHTKLADDKISTINKLNKKLLSTFIQTKFIDCQHSIIGFRSTDLKIASIKKYTQRELAGEINSFPVILSDKCSINTKLIFQWYKLIMNWIILKEITDHNTPQIFRLSFKRDQELMNSYLKLEKILQEDDNDTIFNDLVPEWFQSFIMNLF

SEQ ID NO: 14903 - protein, 310 aa, Candida albicans
TNMIGEEYSNISLSGIAVESTPIKRKPQQASFTEYVTVNETTVNNNSTILPTNEKVQNQQQQSSKDSDELDSIIDTHPELKIASRENGEFNPVNVAYTMFTPQKQQNPEIILTPLNKPLQQQESKDKDLTTTSTQQVQNILLNPMTPYTLTLYFQLFSNMIMASIVIYMAYLAYTTIRQDINFKIQRMTLDLLDEISQCLKQYTLNKCHLSTRPPAIEQECNYLDKCQNQDPSLISRSNLTSEILAEITNSFFNKLNYKSISIVLIFLVINLVSNYYIIGNFQYNEINRLKKLEFNSNPESKLDTKIDLD

SEQ ID NO: 14904 - protein, 407 aa, Candida albicans
LHTLSIMLLILAVVLFSGCYASFPHRNLTWNDINFVHTTDTHGWYSGHINQPLYHANWGDFISFTTHLRRIAHSRNQDLLLIDSGDRHDGNGLSDITSPNGLKSTPIFIKQDYDLLTIGNHELYLWENSKQEYETVVNHFQDKYVCSNVDIRLDNGLFVPLGLKYKYFTTPIRGIRVLAFGFLFDFKRFNSGTRVTPMAETIHEPWFQEALKHEVDLIIIVGHTPISHNWGEFYQVHQYLRQFFPDTIIQYFGGHSHIRDFTVFDSLSTGLQSGRYCETVGWTSVNLDKADLNLPVRQRFSRSYIDFNTDSFKYHTNLDKEFDTAKGKLVSKLIRETRKELKLDTLIGYVKTNYYVDYVPIDHPKSIFNLLALKILKTLPKSKHEERITIINTGSIHVRLVQGAIYY

SEQ ID NO: 14905 - protein, 195 aa, Candida albicans
KFSKHYRNPNMKSELQLSILAQSTYDLYKGPYTIDSKFIVSPFENIWVNITVPKSVATKVAAKLNDADYISASRLKPPHQYDLQVQDLSTSPHQAHFEMQEKLPKGYVTHDDFGADGDDTLHRAVVNFPVPNVIQSVEINDEVDSPVNLVFYSFITPNIIWALKELNFSTEQVPTPYSDIYLGTLLNEFVANNKI

SEQ ID NO: 14906 - protein, 203 aa, Candida albicans
KALNSSAGTFDSLNGGALCVQEQQEHLWKIGYEKCIRVYPTKPVEYREFLFMMGTYNINNLDSNVFLTQSHLDHNCASNTSVETELNRTAGLKVIAGRDIKSGEELTTTYVNPSHTVHQRQRELRVNWGFICACAKCKDDLKQNERRKSSHNQQQNANNIRDMLKETKDAVGEEGIELEIPTEFNGERRKSVRFDEKVVAVKE

SEQ ID NO: 14907 - protein, 184 aa, Candida albicans
NRNMATYSEMTFNSQHYDDSRPNYPQPFYKELIKYHTKKGDTKLAIDIGCGSGFVAFQLVNYFDSVIGTDPSSTMIEQCNSNIPPEWLRNSPKKISFMKGTAEHHPVSIKENSVDLITGAECCHWVNHKQFFDESYRVLKSNGTLAYWFYKDPVFIGYPEANKVYTNYIYNSSFDESPDEEFER

SEQ ID NO: 14908 - protein, 205 aa, Candida albicans
PTLGINNPTLTLRIKFITGSVEEFVKQQQQNKDHSVASTLEPNSIDLITAAQCIHWFQDYNSFFQNCHQLLKNDTGVLAYFFYNDPKIVEFLGPAREDIPKEEILKLSYQVYNKYVYDDDNYIGQYWEQPGRNILKHFCQQVNEKIPRDLYTDIVINTFKPSIEKNNSGNTSIANEEIDLDLKKIGISIQDYIDNISTYNGFHNL

SEQ ID NO: 14909 - protein, 136 aa, Candida albicans
TIFKTFTTSKQEFFRDLTPNDLSFKFVFTFNWVHFTNNSTILTSTTRLLFVCVIECRRNSDGFTVGNLRFTSDTVNTIFTFDSFNINFQMQFTHTGNNSFFGFGIIMYSKCRIFLLETVHGFGKCTVIFCLWGDRQ

SEQ ID NO: 14910 - protein, 386 aa, Candida albicans
SISNPDHQFLPTTMTSLDVLINKATDPTLTSDNWQYILDVCDRISADPETETKRTITILKTKLTSKDANVVLRSLSLLISIDENCGSRVKQEIATKSFLQDALVKRLSDKKLHATVKYKICEVLTQLYNAFKGDPSLKPMTDAYNKARLEHPRYFSKQTQGPSKPAKKERTQQDKDREEDELQRALKLSLQEFEQQKTGKKEPDVNKPLPEIQPEPESPPVETVATVSKVRALYDLVSYEPDELSFRKGDVITVIESVYRDWWRGSLPSGKIGIFPLNYVTPIVNKSPQDIAKEIEIENKLITEEQRKIERLLAILSSQQIETINEDEVTHLYNEIIPLRIQLGNSIDKYGARQEELKVLNQLLNSEIKLYNESLDKLISSRTKHN

SEQ ID NO: 14911 - protein, 404 aa, Candida albicans
  UNSURE (251): Identity of amino acid sequences at the above locations are unknown.
IPIKIMNFKTENSTTPNGDWSQSKAFTNSGSSFPVLNGTCELDQENLALSNSGQPESIFTQDSGLHGIDVAAPLDITDLNNQSGYQYNNNLAHDLYFTGSMEMPTTQHPYITNTNNHLSYSNSSEEFSPIGNNMSPDSTGGANSNNFTSGNKRKASNESFSPLSGHHYGTESGNNNNNNGTSRSSQYSSHKSRKKLLDEKDAALIARDDSELTEEELQMKRKAQNRAAQRAFRERKESKLKELEAKLLASXEERQKLLDELEQIKKQNISIATENEILKHNGMGNINNDVQIGNLSSYGRLQVDKFNFPKTQKDFIEHVLQGTNHQLKDENKDKVYNDNQGHKLLALGAVWDYLQIKAEEADLDFNSIDFNDVMEKLKGNEKCHGYGPAYPLELVNEAIESSLN

SEQ ID NO: 14912 - protein, 415 aa, Candida albicans
KIQFTCPFSFCLPIKIMNFKTENSTTPNGDWSQSKAFTNSGSSFPALNGTCELDQENLALSNSGQPESIFTQDSGLHGIDVAAPLDITDLNNQSGYQYNNNLAHDLYFTGSMEMPTTQHPYITNTNNHLSYSNSSEEFSPIGNNMSPDSTGGPNSNNFTSGNKRKASNESFSPLSGHHYGTESGNNNNNNGTSRSSQSSSHKSRKKLLDEKDAALIARDDSELTEEELQMKRKAQNRAAQRAFRERKESKLKELEAKLLASEEERQKLLDELEQIKKQNISIATENEILKHNGMGNINNDVQIGNLSSYGRLQVDKFNFPKTQKDFIEHVLQGTNHQLKDENKDKVYNDNQGHKLLALGAVWDYLQIKAEEADLDFNSIDFNDVMEKLKGNEKCHGYGPAYPLELVNEAIESSLN

SEQ ID NO: 14913 - protein, 492 aa, Candida albicans
KQQNSNIISMATHLIPMEPETCHVVYVKTVQVMNSHKDNSVVDSMIPFLLQDPFTSAAASSGESGSSSSSSGVSTNNHNNNYHLIELPTCPVCLERMDATVTGLLTIPCQHTFHCQCLTKWKDDTCPVCRYSHNIANERVRRSTNRLRQLSIRDTSIDTPLSRSPEQQQQQKHAQMPSLLKSEFNDDDDIDDDDAGEICMECDETENLWICLICGNIGCSRYAPEQHSLKHFVDTGHCFAMEIATSRVWDYAGDKYVHRLVTNESDGKLVELPDKDDKLNGGSSNRNDPTFDKVDEVGFEYSQLLISQLASQREYYESLLEQQQTAPKSRRGSSNNTKNNNHITNSSSGSNTNKINQEMLTELEIKVEDLNSKLSDLTNSLIPQLKEKIQSKDEKLNKVMRELNISNSLNEALSKKVEHLTKVGEDYKTTIEKLTGENKALNEQVTDLMFFLDSQEKFKNESQEVKDGTIVIQQPPPPPPSLVSRKNRRKKK

SEQ ID NO: 14914 - protein, 117 aa, Candida albicans
LYIMIGTDSYHIIIDIQESLPTTIQIIELDSKMPLQPIEPLRAKLIGNGVIRLYREFENEIPITGETSLNQITNNPGDDTMVAILAVPTYFTATDLLGFIGEEECIQKYITFENIEK

SEQ ID NO: 14915 - protein, 340 aa, Candida albicans
KIFSSLISQKLILQVFSMSENEQQPTVTTREELLQRHKKESKDLIATITGLKKQATKKTRKSVLNKCQELQDNLDQKHKQELKEFDNPNGGQDEEEEVTPEQLLAQLSLEKESPAAEISNTESLEEGINSGSGGNAGDSIKPRKKRNRQRERLNRRQAEIDKIKQEAAIEASNTVDYRQIEIESMDKLLSLNNLQSFEIKPDGHCLFASIQDQLKVRHQDVEHLDHNGPEDVPLIDQLRKLAGDYIKSNQEDFIPFLIDENTGELRDLDDYINELTTTAMWGSDMEILALSKVFNCPISIYMAGASTLTINEHGQLPELKLGYYKHSFGLGEHYNSLRDL

SEQ ID NO: 14916 - protein, 263 aa, Candida albicans
TCIVLDSPIKRHSFPPEKKKLYHLSFPTMLRQPLRQIRFHSKLALAGYNSKEVTVTINGRTCTFNNVFLRDACQSPDSVDPISSQKLFTTADAATGLQINAPPVVEDSSLKIQWSNNGKLTNSVYPVSFLENYSTNKRLGKFFDKDRKLWDKQELENNFASLNMDYDDILTNDNSFFQTLYNLNRYGLTFVNNIPTPQISDMTEDNATQWPVYKIAEKFGYIKKTFYGTLFDVKNKKEKATNIAYTNTFLPLHMDLLYYASPP

SEQ ID NO: 14917 - protein, 420 aa, Candida albicans
  UNSURE (241): Identity of amino acid sequences at the above locations are unknown.
IDKVASNAFFFVLFFCTFCLSFLSSMSLNLPNPSLIGILLVISTHSGPQLIYKYPFDLSNDPSRDESKYALDDNEDDELYDHEESEDENEVNENEMYGVNSRNWDSKHIDYYMGTKSDLLKFLDEQDSRRRKITTTSPSEEKHTKEKHGLTKTISKSSTMASLSTTSPPESSIQGEIFGTDAAYICEMLAPPKQMCNTRFEMTIQDKLFLGLPVHRLDNGQWRSIGHNNEHDEEETHTAKXSLNMFHLVFVMNPPVIESNYRVDEMFHYVISRLSLVLRYEQQKHDYVSQQVKNILALRELLEGNESLLTEKSSLSRVIRDCFEGISTSTIANLSINGKLRSFQIPIKTEFHSLPDPSVPFLPASYLSSTVELLGDTSFINVGETSRYGHAFNSVQDEENSAEKIIVYFALLLLDVFTTG

SEQ ID NO: 14918 - protein, 568 aa, Candida albicans
YCFARTKRKYYQFIDSMKLEALSCSSNSSESSTSDLIESFPPLETTVSPKENINSLYSNNQWHDKIDSASSTLSSSNSGKLKEKFTTKLAIDSVAGMTASNKASELNSAYVRGRPSACVFVASLCSNMSDDALCVSVTDHFKQWGTLATVKVLRDTCNRPYAFVQYTTDSDSKLAIEKGHNSVLDGRNIRCEAAKVNRTLFVSSKSFLSKSIIKDRLSNFGEIEELLPSTSKGELYNSGVDTRGYKNWFCKFTYRDDAIRAYANLTEEGIYKVDWTQNIDKSNAPRNVNEPEQESLKVKFDKYSIFVGQLSPEVSEDQLSQRFERHGEILDLNLIKRTNNTFAFIKFKRESSAAGAVERENHSMFCGKTMHVQYRETHIHAPIRTRSNYNNGIPLAPPPINLNKKSFPKNDYVKSKSMIEMSKPKFNSYPSNSFNKGFTKLKQFKSFRPGSYEKKFGNTKTESTWHASQLNLKSEVSESSQVEKKASGDIRVPSAPNESRGSGASSRNNSSTSFPPPPPTTTTPGFPLFYYVPADNVNFANSSSANPPPSYNVYPQYYLATAAAAAAA

SEQ ID NO: 14919 - protein, 372 aa, Candida albicans
ILNCGSVQPRGEDDSQGLNQRRNQSEVQKDQQSFKVNKTTLPKTGGTIEERVSYFIYCLRKLIPELSQYFHEEQILTKFGCLDDEWLIWWLKFCGTKVWSKYDRGRIWDFMLGWRLKNPKRDFNYYYEKLNYVNRNTLEKLGPDIFWSVGNEEEDISGDNNVDANANEINNTEKTETGKLVKREGDIKRSSFKDLVNELSNELHISKRVSTDEVATSTSSPATTKMASSSSTSSTLTPNVSIPFSRVDPHVALIFISLSLLKSKENILVELDQHEIRQFLSRLPSKSYKYNQKRSTRQKRTSYASNASSTSNSPMGQLPVDRDEDSIFPTSRIVISNDSKDQKHKVNFIDNIILEAGELWRKWLWLEMVEDN

SEQ ID NO: 14920 - protein, 373 aa, Candida albicans
KKDLMLQTSKGSNSSSTSSSRSASISTATPNTIVEDEELLCDPKSELTPPAVANPLRPVSKSNTSVEDDSKPSFTYDLDVFNLCKEYLNTRNHHGLALIARQKGIPPILRFKVWPILLKSHPFVISPFIQPDSELLNESTSSRSNSSSSSTGSNTPLLTAPGSIKDAAIIDGDANDNDNDSNSNSNDDDNDRDDNDANTKEKEEDERNNKIREKIKRDLAKYIQRLKYSQSKYTVSETEHEILSILENAIMKFTLKWGKIIKYDLSLTWIALNLAEWFPPIPKTPWVLVGKEYSSSHQSLIVNFLDDYSNYIDNIPDLREYLERLIYHDEKISTISFREVYERLVLVLLHCPQPVSRRKKSDLHQPAGGTTSW

SEQ ID NO: 14921 - protein, 139 aa, Candida albicans
LPKRGFATPVVKTQPDINNQLFEFVFDRLVKIFQSQFIENTWRSKLETTEIFKKVLTEIEDSGKQVNANLLISTWEFLKQKCLTVDSIENVKIQFIRLSKQLNLYLNKVHQTLTIIDALEEFSRTENSNVVLTELRKTT

SEQ ID NO: 14922 - protein, 453 aa, Candida albicans
TDIYKLYKELIDNSLHEMQMLVLANSSFRLNSFFSLCCKTKILPLFLLLPKTRKNNQNFSLLMSSQELALVNKVELRIALAENDKQFENALNIYLAPVLLKLASPHIEVRQAVLKIIQHIVPRITAARTIKLPVEALIQQIKTPNVETDPTSVRLYSALFVSRGVDRLNEEEKKQLIPTIIEGLHNYPNSISARIFNIICKLLQNWKMPMKGTDEYDNMRRFLQLDKNPIDEQYLSLLISKFLLLLPESTNKATPGLSVQDNAFFTTDAAVTYKTRDDIFQVKNNLLEFLKSGFIPEQIALPLLIASADPSSSINEPSEIAFRKLGVDFDLIIVYDNISFIDYIILLFLGTNAPAVDSNLQCKILQVLIKSHKVHSQDKIASAALGSDNSRLRLLAIQFIRKLGQSPVPEENLEKFNEDIAHQLRNSIIAEGWPCVEVSMGSSPRGWKDPRYK

SEQ ID NO: 14923 - protein, 297 aa, Candida albicans
  UNSURE (5),(13),(17),(291),(295): Identity of amino acid sequences at the above locations are unknown.
SSLLXRFKDIFRXKWKXIDERSVIAFGYLTLTGKTGLDSESLSDDEQIIFNTHVSKQVEYLFTSGEALVVAAAGWNSKLLSKQLDIPDATVEYIPHDTSRVAALLNNILAACRNTQPSLRKAGCIWLLSLVQYCNNLDAVRSKAAEIHVAFMRFLADRDELVQESASRGLGLVYEMGDFDLKETLVKSLLKSFTQSNTSSFTSGSVEHDTELFEPDLLRTNEGSVSTYKDVLNLAQDVGDPSLVYKFMSLAKSSSLWSSRKGIAFGLESILAQSSLDKLLLTTGWKEPRSXAAPXST

SEQ ID NO: 14924 - protein, 226 aa, Candida albicans
PSMSSSTFSQTRSQALSLEKQTEQLLSKFSQFQQQQQQNQSQSLDITPEETIIRQQIEEIFQKRNAVILKLNRISEVEPNLSTSKLQQLTRHKEKLNDDNLSFTKIINNIEDERNKNNLLFNVHRDINHHKQQRNIDGNAYILEESERVNNVNSIADRLLQGAFATRDELLNQRQYLNNAQLQVLSTMQNIPGLNVLISKINTRRKRDTLILASVIAICILFLFFV

SEQ ID NO: 14925 - protein, 585 aa, Candida albicans
  UNSURE (26): Identity of amino acid sequences at the above locations are unknown.
IQFYQVMTKIELINKLLKWAELNGAXISPDVEFKEISKNYIGAIYKGNKVPDSPFCPISIPSKLIITPQTAFKEFSKLLKNTDINDNSILKLHLCHERLNGNSFFYPYLNLLPSLSEIDSPYTWSANDKSYLQGTNLGNSLKENLVTLVEEWWKAINALHDDLPKPEQHYINMKFYYEYKFYTDDDLNKYLNDENIENWTSFPNYLWASLILKSRSFPAYLIDKNNKQDSAMLLPVVDLLNHNSKSKVHWDVSDNYFKFSSESIVPGKEIFNNYGLKGNEELLLAYGFCIENNLQDSVALKIKMPEEKIKAIEEYGIKLPTIDDYTNSVVANDAPSTAETKHQDGVLFFINNENIPSNLIETFQFLVQNEWETGITLRMKLSGLNHLRAALETKKNLLKLDVPQDSQKHKYILWYIESQFKIFTSAIKSIKRMEKEILKDEKTHLTTLKNVFKKDCKFQQSMLFLGFADYDAVLESQFQDQCWLLWLIRCYNRDQYTNDSECLPMWIHDLFVKLRKNTDISAQEVLNYKPIYENLIPDLSVQIPEIYGKGQWTLSEFIIAAKLLDLVGFVRGKEQECILVEQTYS

SEQ ID NO: 14926 - protein, 302 aa, Candida albicans
AIIPEEINDPFVTRANTKTTATTTTTTINKPTPQEAELPSLDECYDKKTEQIKHNNFISNTMKSPTSFSKYMIPPPQRLFPLSRNPEKRRRKKILILDLDETLIHSLSRGSPRSFNPATASKMIEIKLNSISSLYYVYKRPYCDYFLQETSQWFELQIFTASVKEYADPIIDWLETEILDRQNKRSSNGSATTKSTTKTTTNQTKIFTKRYYRNDCTYRSGVGYIKDLSKFIKDEDLKHVMILDNSPISYALHEENAISIEGWINDQSDKDLLNLLPLLKSLSLAIDVRYILGLKNGEKFIE

SEQ ID NO: 14927 - protein, 359 aa, Candida albicans
NLFLIPLSYKIMPEYLKFRSKPSGRHEGKQHIIIVGAGIVGVCTAYYIVKHPKFDPEKFHITLIESKRVAGGASGKAGGLLALWAFPEQIVSLSFNLHQQLSNEYNGEKEWGYRRLTTVSLEGDISHLSNKKHNEHGDDEDEDEDEDEDENSEGQYEFDDISFKRTTTHDSDSSSSITDRPPKKTSRNTRSSSTVQLGSLKSTLPPTLNWITSSLIESCSKLGGTDTTAQVHPYKFTNFILKKAVEESKGALEMILGKVNQITYSEESGSATGVEYQPTSVKEDKHQDEIINVEADQIVLTVGPWTSKILPDCPISGLRAHSITIAPFKDQPVSPYAIFTEFKTGPYSYISPEIYARQD

SEQ ID NO: 14928 - protein, 308 aa, Candida albicans
SPTWIFQVWCKTKNEEFIVYLTLLDNNDIKYIESNPISDGINYLNFNFNCNESKKNNNMDDHILTFNQILKTPIIPFPNAQPHYLNLKSVVFAPSLHFPIGPVENIAISSWIKLNDRILTYLKLFSSGLIQLIRSQNSKLILLTPTILSGLYMPYYCPETLFQQNLKSIFTILTRELNYQNINVTQIRLGNLYLLNQKLNSNARIESLVNSEIRAWTSEMKQLYSENFTKLQFKANPLKSSGGKGTHLVHLYHLLFDLIYNNDNDNDNDNDNANGKLNPAVVYCGRGARIYDWISKILPESWIQWLLK

SEQ ID NO: 14929 - protein, 325 aa, Candida albicans
KRKKSTQKIFFWMIHESSLVMSLVEEQESITLHPKPGFVIKTKILESKDLSRTLTKVFINVCHSPDVPKPDVDFEPEIVFPLIIDNEWEIPIILSKEKKSKDKKGFPSFVYDCCINSECFQWCQISTDLKSILIEWCIESVELVYSLTLEREYSMPKMLAKGELSNTVVTKKELLGSGLKDRLKELQQNETLGLIKEMELEEEEELPDLMNINKTPAKPLIEEINYQLKPSPKLKPPKPVKELTYTVLFKNVADPNFNLAVIVTYDEEIDNNFSITYSSESSSLLVKSSGLKFASGNSLEIPVSPDIIVTNTKCFAVHNTMYIFI

SEQ ID NO: 14930 - protein, 369 aa, Candida albicans
NRENSKVISLLLSFFRFSLTINGLFLMPSHVTNVYNDIDDGMLLLSLSLNERSNDRRGLEIEEVYDSSFDDPMDIDDTGELSNHMDIDDTTFEIDHVASDNYANKREDDNDTNNEEERREDGLFSLLSPTLMGAKLAIKKPLLLMPPPTVSEQSDSKTESASSVDYEYDTSSFKPMKSNGLITRKTNSSTFQPSNIDSFLFHSDGISLGQLLGGYQDLHSNYQQPVTIHNHHHHYYYYNKDESVPSPPSNNNLQSLEHEQRNLQMQQYKQQLEEHQLYLQEYKRNNQILLPSPWQHNISPIERVPYLLMSYLQMLINFIASLYGVYLVYCLFRTINTDIKTKIEEQQTNLIISIESVRRLHHALRSDPP

SEQ ID NO: 14931 - protein, 340 aa, Candida albicans
YMLLVLCLPDDIVLTIFKHLSPDECSEIITNIEDIHIAQPFVDKLYQRLLSGKLLITNDQPNHRYIADYQLTLEKFQNKFLDTSVEALMFRLTRPNYMEFNFTRQHCDYMNFIYNLKQFHELLKDPNCQEYFRKVLQVNMYLDANLVLIENPDNLTAIVIKLVLELSDHPELACKVKHLTIKAGDIGNMCVPQWSLLLPKFTSLVSLNMLQNLLKSNYGQYLDVWGRQEKFPNGLKLLNLNYNMLTYVSKQFLSCLPHTLEELLMNQNDIELVENCDLGLLLPNLRRWELNYTKLSVINPQMIISCKTGFTLELMSTYLPQPDINELQRIAHEKSLHIIV

SEQ ID NO: 14932 - protein, 276 aa, Candida albicans
IVKLAKNVFKRTRNQSQASGNKRYKRNEEDNTDIRITAVKKIFLNDPNISIKRENTLIVLIPIGMSRSNTNKTGFDKKLNSFVWTIEWIMLNEQGEQVTKFISYRLKESLVLQDSVPMNIINNKFTKPVEKCYLKFYLHDVIHKGKMIRLNGGDKISDVLKDKIVLEYPTIYVAANDECLQDRIIDSLQLAEEEEDDTTDSSEDDSSDSESDDDDSDSGSETSSIGDGSGEDNDSDSAPEETSLKLPPFSQKFFEASAEPKPIIEEIGSNKTVEEP

SEQ ID NO: 14933 - protein, 472 aa, Candida albicans
KEDPPPPPKNFFFHFISQPRQLIMTQDALVIICGLLALMYLGIYSLHYFQDVPDLYLQEQSIREPTRLTNESPIYHSNKSSNLRVGLDIRYDSYKLRSGNLNDIWEIAIQFAKKTDRGINIDNNLITIGYINYCIENLQLGSHKVISIPKDYKIDSKWLVVLFVGFVKQLTVEFYIDKPIADDAIDISKISLPSPPQGSYKFINNYTPEKDRGIAIRLHNQISQGIKSIVDFTQLNIVSGVASTIKHLPNSDTYRNSKMVIVSNNSTNEDITNLIVKLLTGLILNCNITICDKFSEVDSNAAIISVPELKLPFVSNKSDTITERLQRYLLTKSVFPFRGTKKLIYISTSINKKSALSLYDLNTIRIQHQARVVKELCYYNIVGPIILTDYYDYRQFNIKVNKVGCIAQSLEIKLINLQDEWGNLLVRGYTIGKTLNVVNDQQEKLQPKDDDGFMPISIVKGKWGNDGCLYVL

SEQ ID NO: 14934 - protein, 150 aa, Candida albicans
IQLKLNINHLKKNENYITNFKIFLVDEAILNIMPNTLGKVFYSKGSSNDKIHIPIKVTCNTTGSQTNGKQLSIVTLTNQLNKVLNNTYYLPPIGNNITIKIGKLKFDNNDLIANINDVVKNLDLDTIKSIHVKTSTSPAIPLFYTKSLSQ

SEQ ID NO: 14935 - protein, 186 aa, Candida albicans
NNIPFYSIPFPISHCLLPITVNSNTNNSLAQVPILFIMSYDLNIPWPVNNYDKSPTLQQLTNLRNIIITNYSLGITHQAINFQISIESVKIPTTTTATTKINPIPINQLLNELLPKFPKLKLFSRLTLIVNDSSKLPQLNKLQNQFDIIAIQPLNEKVLQLSILNLDIDLISIKSHHGSGASALMI

SEQ ID NO: 14936 - protein, 272 aa, Candida albicans
  UNSURE (6),(16): Identity of amino acid sequences at the above locations are unknown.
GRLLWXKPKVPSAHEXAKIHFKQLKLAAEDFIGNNIEGVVLTVPTDFTEVQRQEIARIAEDAGLKVLQLINEPSAALLAHLSNDEDRLSQDKIYVVADFGGIRTDGAVIAVRGGVLTILATAHEYGLGGDNLDAALSEYFAKEFEKKYKANPRNNARSLAKLKAESIVVKKTLSNVQTSTCSIESLADGFDFHTSINRLRYELTARDPLSKMTAFVEKVIAKADLDPLDIDEVLLVGGAAHTPKLASNISFLFPETTNIISPSLDSKALNPS

SEQ ID NO: 14937 - protein, 182 aa, Candida albicans
GGWSLCLRRLVKTVRVSDDSVLVSIWRDFIFQSEEVLKESRTLTYTNELYSPVENYKLAENVSSNGPSFHVSSIDLLKYSMLTYNLHKIHIDANYCRSIENLPNMIVHGPLQVTLLLYWFAITYPDVKPVNFKYRTYAPMFVNDDTSILIESKSNNSFVLEIYNQESKKLYLRGDLTTTSST

SEQ ID NO: 14938 - protein, 271 aa, Candida albicans
  UNSURE (1): Identity of amino acid sequences at the above locations are unknown.
XQQGRTQSASATATAAANSIVTPGELITEDPTWMKGHGTYFINDKTYSSVAGSISRVNRLLSVIPLRGRYSPETGDHVIGRITDVGNKRWKVDIGAKQDAILMLGSVNLPGGVLRRKSESDELQMRNFLKEGDLLNCEVQTIFNNGIASLHTRSLKYGKLRNGIFLKIPSPLIVKTKNHAFDLPGNVSIVLGTNGYIWLYKTPKINKSLENNTPGITRLEEESSWEIYSDKNEFIDVQTRNNIAKYYNIIKSLAEKEQKINNDVLVEAFDY

SEQ ID NO: 14939 - protein, 309 aa, Candida albicans
LFSFYYTMQSPTSPISYKETSVPSFSKESTTTETSKSLPHANLLTPPTLSPPTITSDLPTSTLSPNHHNYYTHYLNKAQFNSILVNCSINLLKILYKNQKFDEKSIKLFIIEILRRSKTSIQSLQLSCFYIYKLIVAKQKITFDAKKLFLGLIIISSKFNQDYNYSFKSWCKICGLNENSNVKQLVHIESTILQWLNYDLCLIGSKYENWCNLLLIFGYDFIQYQLIFDNRTEIVWNQEIKDKINSWQSFFNQLNLDNLNIINVNFNNYFNNQLNKKVFVVKDEQPTLLSKKRSSTSLFDTEQPVAKKG

SEQ ID NO: 14940 - protein, 715 aa, Candida albicans
QMGKYITVATCNLNQWALDFEGNRDRIFESIKEAKRQGAKLRVGPELEVCGYGCLDHFAENDLYRHSWEVYGEILSNPETHGILLDIGIPIIHKSIKYNCRIISYNGKILLIRPKIYLANDGNYREMRYFTGWNRPKYHEEYQLPKFISKITGQARVPFGDCIVQTLETRLGCETCEELFTPESPHIAMALDGVEIFTNSSGSHHELRKLDTRLKLITEATKKCGGIYLYANQKGCDGDRLYYDGCASIIVNGNVLAQASQFSLKDVEVISATVDLDDVRAYRNQKSASVQAVNQLEKFKVIYTDVELSPSDYVFDHSIIPSKPQPIKYHTPEEEIALGPACWLWDYLRRSKCGGYFLPLSGGIDSCATAVIVHLMCRLVVEAIPNDEQVLKDIQAITHDEGFVPKTPQDIAQRIFYTSFMGTENSSKETRSRSKELASKIGSYHVDLNMDNLVTSVVSLFEVATGKKPIFKIFGGSNTENLALQNIQARLRMVLSYLFAQLLPWTRGKNVPGLLVLGSANVDECLRGYLTKYDCSSADINPIGGISKTDLKRFIAWAEKNFDLPILHEFLTATPTAELEPITKDYVQSDEIDMGMTYDELSRFGTLRKVDKCGPLAMFIKLYHEWSQPPYNLSAKQIAEKVKRLWFFYAINRHKMTTMTPAYHAEQYSPDDNRFDLRPFLINPKFPHASKKIDELVEEIEKRLHEIDSSNKSVD

SEQ ID NO: 14941 - protein, 368 aa, Candida albicans
YCTSFYARMSELHKAFLRRIKEQETALGLSGLVDEDDIPEPAVMPPTGNSSSTANTEDETILRDYKQFKETNFIQEFYENELGHKFKTYYKPSKKPGSILFCHHGAGSSSMTFGNLVNHIEDESVGIFLFDTRGHGESVATSDFSLDTLVQDVSFVLEQFSSKHQQTSIFLLGHSLGGAVLAKYSTLYPSDILKGLILLDIVEEAAVQSLNAMPLFIARRPLLFPSLSKAILWHMNFLLFNEKSARLSVPDLFTDKLTWITDLNATQPYWQTWFSGLSENFLGFKGPKLLMLSTHESLDKQLMIGQMQGKYQLVLFKNNEKSGHFVHEDLPNHVAVCLTDYIKRAVAPEIFMKEDLGVVPKWGGKINK

SEQ ID NO: 14942 - protein, 223 aa, Candida albicans
EFDRKPDMILQPIRRELCASLRRQFESGTESNPKQLLSLAFKEVLSSPQVEIGGTTACLGVLTSDLKLHVANLGDSWCGLFRDSKLINETNFQTHNFNTPFQLAKIPEEIVRQAKLQGRRYIIDSPEAADEYTWDLKSGDVVMFATDGVTDNVIPQDIELFLKDHEETNQLDDVANKFVKEVVKVSKDSNFPSAFAQELSRLTGQKYLGGKEDDITVVLVKVK

SEQ ID NO: 14943 - protein, 739 aa, Candida albicans
LNMPDLTPLDNDEEDAWSYSFPPSTESLPILQQSQSKRSTTQPSNSTFRTWQNGDTSLTNLQMKLLIDTTTTSSKSSLPFPSTIQKSIPLDPLTTKEDANSVISKDSKGNALNEASQTDDKPKFMKDLEEYGSTRNISNSPLSQQSTNGTNLLPSPKFISYRKSKRTVSEGTFDSMLDKSPMSPPASRYDPKLYVDEFYKTSKFRYATIKRNIDFHNNFHSLDLTDRLVDDFACALSREILLQGRIYLSESYICFNSNLLGWVTNLVIQLEEVVKIEKRSTAGLFPNAISIETVDGTLHTFASFLSRDQTYELMLTLWKGKTGKSNNDLTLTSEDELENNAIDSPNKNIESYILSLDGDDEEDNDVQSLDNSGEDEEEEESELDIEEVLSTKLIKLKSESPYTNNGPDAHAPTTANYEKLEAEIELVDEVIDAPMGIVFAILFGPYTKFQTNFLETHDGSEISEISDFRPSEEDPAVLERKYIYRRALGYSIGPKSTKCEVTETIEHLNFADYIVVVSTTVTPDVPLGGVFSVKTRYVFSWANENHTNLLIYHHVEWTGRSWMKSVIEKLSLSGLTATTKELIKELKEEIVKQTYFIDGPPAIKQPAKKKVKKVEPEVKNEPKAEIKASTVDVSSYLQQNITTAFFILFTIVTIILFMQIRLYGLLRKSNSIAETQLLLTLQLTDLQQKPQVEVQDNVFWNLIHSKLGRKLTSLEKLQFLTYQLQAIHMEISPALEIHV

SEQ ID NO: 14944 - protein, 216 aa, Candida albicans
IHNISPPKMEYIENLKLYINSLSQSISAYESALSPLQNKQLSDMILNINTTSSTTSTTSTSEEQQIQILNNFAYILISTLFSYLKSLGIDTDSHPIKMELSRIKSSMNRLKNIKNEINGDTNKQEEEEEEKEKLKKLKEYLSRTLGVRDVGLSVDVKSMGTSAISKQNFQGKHIKFDDHDNADEKKDDGNKNDLKKSKNKKPNSTVLHHGAGRIRA

SEQ ID NO: 14945 - protein, 285 aa, Candida albicans
THLINTLFNLVYHSHTNYLQKQTMASKRKRKEKQKDFAKAKLKVGKTAQKPDNYTDTSFKSKTISLPNQSIASSSNYGASSGASRSSLSTGPSLAVLTHQLSLTKHHSSNTRKEVLNYLQTQLPENPSYYKNIMTSILPLILDEDKEVRKALMSLLSAIFAKQPGLIDLHLRSTILFILSAMSHIIPNIRTTSTHFLRIIVENSHGNLINSYFVKIMRNWFVLMGWSLNEQDSKQLSMAVTTLSITAMNANSKQARIGHLQNLNKFLLKTLQHDQDKDKNKDMKL

SEQ ID NO: 14946 - protein, 133 aa, Candida albicans
TIKQRNKKTHNTMAKTSPHKLFYKGAENDFVIFIDDADLLAKYKKEFSTKGSSTIPIIDLVSIFKVFINRQRGAEGILDEAAKLDLENEFKTSNADQVIKIILEKGEDKSKTGSIGEIGGSHNDSIGNGDAAN

SEQ ID NO: 14947 - protein, 307 aa, Candida albicans
IEVDQPQHYTIMGTSTSEALKNIKNKQRRQKVFAEIKHEKNKQRHKQRAERAKEERENPELREERIAANIPDTIDSKRIYDETIAAEVEGDDEFQSYFTNLLEEPKILLTTSANAKKPAYEFADMIMDFLPNVTFIKRKKEYTMQDMAKYCSNRDFTALLVINEDKKKVNGITLINLPEGPTFYFSITSIVDGKRIKGHGKAGDYLPEIVLNNFNSRLGKTVGRLFQSIFPHKPELQGRQVITLHNQRDYIFFRRHRYIFRNEEKVGLQELGPQFTLKLRRMQKGVRGDVVWEHRPDMERDKKKFYL

SEQ ID NO: 14948 - protein, 99 aa, Candida albicans
RIIYRMREDHWAFNGNVAMSINSAADANGPNGEDADNNLYCFCQRVSFGEMIGCDNEDCKYEWFHWSCVGITSPPKDDEIWYCPDCASKMEKRKKKRKN

SEQ ID NO: 14949 - protein, 166 aa, Candida albicans
IAGGTNMTKDDQLNLAFGNYHEETPVIKTNRTQNDPTSSIYTPKQNPSVINFDSNTNSTPIHGSTTAGLGSTTFLDGAPAPKGDELLNPNAGVGRKKSIVQRLRKNSGSESNSRRSSNEGLQPPSPPYQEPRRGSLNTLELDNDDNELKPPGNSFIRRVRSLKVRK

SEQ ID NO: 14950 - protein, 921 aa, Candida albicans
SHTHHYQYHKVLSQCLLSTMSHNQYQQSYTERLDNGANTAINGNELSENLHALNLDQPQSLSAQQQQHSSKKKSRRPVRAFHTEFNSPIPTTSSTPAFPSSPIVAGYPQNYASVYGSPVVNSTGQFQQSPLVSQAQDHHHLQFATASNSTELDQTVLQDSRNFHQNHDLSLQEHRLDSQREYNTPDAQGTYKSFQTFTDTVPPEAGTQFHAIDQGNALSKFMRSTMYYVPESEQLRLATKLPMSITVRPFAPLLLTEEKVQTVDFSMNDPNNTPEDPLSIGPIRCHRCRAYVNPSMQFTHNQRFVCNICQFANNVVPSEYASILDGRGYRVDKFVRPELHKGVYDIVVPKEYNFGGPEKDSNPLHIVYLIDITENSMKQNLPILITDAIRATLFSYNNSSEDATNGCNHDRSYKTKVAIIAFDKRIHFFNLSSSLETTQISVSPDLEDPFVPFSEGLFVDPEESRFVIEDALNYIENLASQDRVSDSEPCFSAACRTASMCLDLFGGGKIISLLSNLPSWGPGGLKYKDNKTIGRTAAPEVEKKLFSADNEYYKLLAREFIEKSVGLDVHVVSHTPVDLSNVGWLASVTGGEITRWANFDFERDGRALTAKIYNSVKNISGYQGQLKLRCSNGLQVTQYYGTSSSISDTSIVGNIQDPVIPVLSEDLTFTILLEYDGKLSPKLDCHFQAALLYTDPNGVRKVRVINLVLAVSKSLEDVFHFTDENAVVTTIVRDTLSFVGQQSLLELRESINNKLVDIFTHYRAMNEFGHNRAKTLSNKMLFPDSLKHLPLYMLSFLKSTVMRASAGLTADARMADMYQMLTMPIERLMYHLYPALVELHSLQPEDGILDETTGFAKLPLYKDLTIRNLDRGIYILCNGERVYLWIDPDTNPMLLKDLFGSDVDDIKNINPMMDELAQLST

SEQ ID NO: 14951 - protein, 408 aa, Candida albicans
DEVSNLKAKIFFLKKVFNPIFIYESVNKGSVDTFFTNTKPEWLEKLNDSIWKSTKDIITNHTSGSMDSYRYALLEVTALLLKLASKYLGDLRKDIIKFSWNYIKLEDNITKQVAYVTTSYFISVYETPAKLTTQVFVALLRTHQTDSRYLVKQALDILAPVMSERMNDADSSDNWLKWPRRILSEDGFNVTQVLNVYQFIVQHPDLFFVAREHFVSNIITAMGKLTILANPAIENQVLAIELAELILYWERIAKDSKEESQATQEDENIEEDKEEAADTTTTAADKVKPEGDFTTSPNYSIPFGQREACVTFLIRYVCISPQRASESELGQKALGILYDLLSPEHWAEVSVKLTFFRKILIISRYQFQLFIGLLFECITNFRGCFGMEKTKMDCFQFYHIFQNYLKNW

SEQ ID NO: 14952 - protein, 63 aa, Candida albicans
VLNIGQKFLSSLHFSEKFLLSQDINSSYLLGYCLNALQILGVVLEWKKPKWIVSNFIISSKIT

SEQ ID NO: 14953 - protein, 114 aa, Candida albicans
  UNSURE (28): Identity of amino acid sequences at the above locations are unknown.
LEKLGWKVFYSVYVLCIARALLEPESDXEQYLTLFVREEVMFWYSQNDKAALSNEETMSDIVRLNVESIIRRVMTMGHMSSANGVVIRHVLELISQAVNRGNLASADTLWMAYF

SEQ ID NO: 14954 - protein, 255 aa, Candida albicans
IPKLELLFNEKILIGDGLTSYETLRPLAYSTVADIIHNVRNELTPAQIWSTVNIYCDLLKDDSLAFTVQIMSAKLLLNLVEKIMKLPNKLEGRQLFLIIIDSYAKRFVSLNRKYNYIISKHNEFENKKASKERKAKKAIERYSSKIEPEEPEEQQQEKQQKEEQKSDNANEDMMDIDKPNQDEVSDKQETPSPLDMFNIDTHSPIAAIPVSNNTDVLKDARYLFRTLMTFLKSVIFGLKNCNPPVPPLPTSSDPN

SEQ ID NO: 14955 - protein, 137 aa, Candida albicans
PRLQVNYDKWNDSAKLIAYEEVDILRALFKGGISCLRFFSITKSKPPMANKTIDFSTGGPNLPITSSKEEKDLMEIFATIFIHIDPASFNEIVSSEYTFMFESMLENAASLHLPQFCLASEITSANFSGILISFLRR

SEQ ID NO: 14956 - protein, 214 aa, Candida albicans
IMPILPVLLENLNKMITNAIIPYERDIYVELCLTVPVRLSVLVPHLNYLTRPLVYALNGSQELVSQGLRTFELCVDNLTAEYFDPMIEPVIDEIMAALWKHLEPVPYHHQHSHTAIRILGKLGGRNHRNFKPCNKLVTQLDLDQEVKALFEIHGLKGSVPVSITPGVESAVKLLEDPRLKIHYKISAFKYLANILKLLINTTPIPGNSHNFSPG

SEQ ID NO: 14957 - protein, 463 aa, Candida albicans
DFTRFMIILLSKDYHTRQVDMRPNVIQSLLEGVSRCDDLQLPPFAVECLASNFDAWSQGIHILENIDEKLVNANAEVREVTEDALAKLYATLKEDDMFYGLWRRRAKYAETISALSFEQLGLWDKAQQLYETAQIKARSGALPYGESEYALWEDHWILCSEKLQHWDILTDLARHEGFSDLLLECGWRVADWYNDRETLDQTVKNVMDVPTPRRQVFETFLCLQGFGQEKETLQDLSRLCDEGIQLALRKWHGLPERFANAHIPLLHTFQQYVEFMEASQVYASLVTTNAQNLDMKSQELKRVLQVWRERLPNVWDDINIWNDLVTWRQHAFQVINKVYMPFIPVLQQNSTGSNANSYAYRGFHEIAWVINRFAHVARKHNMPEVCIKELTRIYQLPNIEIQEAFLKLKEQVKCHYQNANELNTGLDVISNTNLVYFATQQKAESFTLKGMFLNKLNQKDEAN

SEQ ID NO: 14958 - protein, 607 aa, Candida albicans
GSVGPSSRLVKTSGTLAQAFENFRGEVPVWYWITFIPQLLTSLSQNEAKLAKQILVRIAKNYPQALHFQLRTARDEFAAQRRRVVDLARQQAAQVSAATATVPSSSSSPNGVNDTNSTNQQSKLNGSLAGNGDKTQRSPTSQPQQPPHPQINIPNSVRQPLEHIDEIMAILKTAYPLMALSLESLVDQINQRFKCTADQDAYKLCVALLNDGIQYLNEIGNPKEDAKLPPIPEANITRFADTVLPKQIRAEFEKDLVISKPHLETYISKLRNWRDRLEDKLDRRFSQVNLENLCPHLSEFHHQKFEEIEVPGQYLLNKDSNAHFVKIERFLSTIDLARGSSACYKRLRIRGHDGSLHTFAVQFPAARNCRREESVFQLFRIFNDSISRKVETRRRNIQFTLPIAVPLSPHIRIVNDDTRDVTLQRVYEDFCKKNGKSRDEPFIYTVEKLRAAFDQRLPKPDIASVKVEILSAIQSLLVPSTVLKNHFINLYPNFEDFWLFRKQFTSQYASFIFTTYMMCINARQPQKIHVNRGSGAVWTSDMLPYRLSTRNNGEITHNKQSPIFVNTEQVPFRLTPNIQKLIGETGLEGVLFGLCFMYCSSIIGTRI

SEQ ID NO: 14959 - protein, 133 aa, Candida albicans
QTWKKLKEIYPKDHLLIVSNSAGTDDDINHAQAKTLESNTGINVLCHSIKKPGCLNEITQYFAKLNVKPNEIIVIGDRLFTDMLMANMMGSWGCWINQGVELSDKILPKLERDLYNRLVVNRPENPYFPPTPN

SEQ ID NO: 14960 - protein, 91 aa, Candida albicans
NVSRLLYNPSLCLPHITVKSFDQLVLPFTIPTAPNVTIKGVVLDKDNCLPKDHDDKFWPEYEVCLLYSRPTDYIIVVLKPLSSITNSFPHT

SEQ ID NO: 14961 - protein, 547 aa, Candida albicans
LDYDLLSPGWTIDLLGTISQPNATVTTTNQALQQPPPQPQPPLHKPNIKSSSASHIPTITPKIRRAHSISAMQTLTRTKSKFISSSEAKQRQKLRKKKYDENDNDDYDDEEILEEFLFNVPIIKNKAELYSLTAANSSKTSHENYGNGNGNGSNHGSANSSSVTILSRNDLVSDRDQYCTIKPCPLPGKLGSLTDLLASVGNRSTSHNDESIIEEEEEEEGEEEKEKEEEDRTEQGHQQDEVGLGIVNDDTTIISNISTYYNQQVEMKNKLARQNVMYKIPNFIKSNSSLEDLHLISLEKLSVIDSTRPSHLPPKSMDERKKHNQQIDKILHNKNNSSPHLIKSPTTRTSFNGSDSLSNNDVVVVYNQEFINLVEELLQATDSKTFSKKFQSQRDMIRTFAWTLNIPNDQCFQFLLKILSLNQSCQDSLNTIKNSFLLFETKFNNLPEFIKSNKMMEFNKLCQEIMTKPLFKTIPLEEQVEFMDKLKLIWNIKAISESGLNQDEIFLISILLKVFPQKSCQDIYCLLELINLEVLTKEFNKNLINIY

SEQ ID NO: 14962 - protein, 168 aa, Candida albicans
TMNSDTTPTHRNKSNSISQLNKVLPVPIELHNGESLEQHQQNHLNHITNVIVGEYHLISGEFGKSYMTWQIKITINDLDYSSIVLYKRYNEIYQLRQDLLKIFPPHDHTITTNIVPSLPPKDNLSLDRLMMSKNWLEERRKGLQWFLSNVLLNPVFQNCSVVKQFVLS

SEQ ID NO: 14963 - protein, 321 aa, Candida albicans
VMSSSYSLDKINPKLLRRIYRACRPTNDEPNLALNLEICDYVNAKKGSAPRDAAIAVVKLISQRDPQTSELAIALLDNLVKNCGYPFHLQILRKEFLNELVKRFPERPPLRYTRVHRLILAQIEEWYQTICRTSKYKDDFGYIKDMHRLLSNKGYVFPEVKVEDVAVLNPNDNLKSLEELQQEESIVHSAKLQELIRRGRPQDLQEANKLMKIMAGFKDDNVKENKKQIKQDITRLTRKVEILGEMLTSIESQGGKIDDSSDEAIIELYSSVKSSQPIINKMIEQSSDHDDNEEDVNKLLALNESANNVINKFHLLKRWHV

SEQ ID NO: 14964 - protein, 226 aa, Candida albicans
LSDLSNLTFSENNNATTASSSTNVNPLNLYGAGGSISLGGGSGFPTISNTPSIYQPTPSAAQGKQTSSSNFDLLADLNSPSPQLQSNTNSSSLDPFGLQFPATTPSQVTGQGEGYIRMIPINQTSNLKIEIGVKSSSANSLKGKILFSNLQTSTISNLKFLIAVPKSCKLELRPQTSDKIFGFNNHGIQQDFNIENPLSKQLKIKWKVEYQINGSANEETGVSVLE

SEQ ID NO: 14965 - protein, 273 aa, Candida albicans
LLSMDYFNVPPIKESELIINFLNCMEPTTETHILITYFLAFHTIKKFRQRLSPKSPYYQESPVMQLNTYLNILSATSTIKYPADHFHKKLDYISRDIDDEFVSTYCEMSQKIKLEYESLIEQLHALYHDVPLFDIAKLLSFESYFQICQAVRSRILEIPRDAHNDIDDVVGPPLKKMKAREAQGEPLENAVTTGLQELSINPEEGKSNVGSGRNDTEHTNNTDDYVIDVSLVPILDFVNHNHHSNSYFDIDRRTNDIVLKLKVQCANDGQRKI

SEQ ID NO: 14966 - protein, 367 aa, Candida albicans
MNKLLKNASIIERNSADKVKEKLHAIDQTIEQNNPKLDITMFIKHNAVDWKEPQDFYFIPCSFWHDDESLIIKEPELTELKKKLSIASNEYYKFEQSCIDVKQKLEESTNKRKRDNENITLKFDTGLQGSLSILHKFMKEDTNRVKNEVEIEVIQNFAGDKDLTYVAPVKEKKSRFGFLTGNHKKSQSGGGGGGGATQLDASSEVHSLNPVKTSTSLHSGIFDLRRNKSIASTVSGGVGNGAASIQARALYDYTAAGSDETTIVAGDQLSVIEEDDGSGWTMVNGPQGQGLVPTSYIEITSRGPPPLSQQPQQKKKGPSVAPRCGAKKVQYLEALYDYTADGDDEISITAGDRIVLVQDDTDGTGWT

SEQ ID NO: 14967 - protein, 216 aa, Candida albicans
FLTTYTMSIETISIGNELKDSYKLTSKWVNNGINWLQDISDFYQERSNLEKEYLTKLKELTKKYFDKKSKLSASLSVGDEPAITPGSLENASLVLWTDLLTQTEAIADEKSNLSREFQSKIADNLITLKNKCERVANLANSINDYLVEEKNKFEDEVNKAKKHYDSLCQTTETARDKNEKAPNDKHQKKLDEKQVIMNNGKNEFLIKIKLAIRIKK

SEQ ID NO: 14968 - protein, 163 aa, Candida albicans
FFFIGLPIYVFTLLDSKLAPIFKAMTEITETKKEADTPIIPKNTNTTATTTPTTKQQPTKLISDEVEKDTSKVDFTKGGVEEFKFYPDNPKSHRHKYKWSMKEPSKFYDPCEESRMASMDCLYRNQDDKYACQEFFDAYRECRKDFFRKKRQDNRDGAKGWGW

SEQ ID NO: 14969 - protein, 228 aa, Candida albicans
VNIIYPMSDPINANPTIIDVADLPTRLNNDNNNNNDNNYQTTNKLNLKKNKQMISQLVSLSLLNPDESPEAADDETSLSSDEENEDDDFDPIDEQEIFDLIATISDPEHPLTLAQLAVVNLSDIKITNPPNCGGDGGDGGGGGISEVLIKITPTITHCSLATLIGLGIRVRLDRSLPSRYRIKILIKEGTHQLENQVNKQLNDKERVAAACENDQLLNVILQMLSTCK

SEQ ID NO: 14970 - protein, 158 aa, Candida albicans
KKINLFTTHKIDPKFQQNQIQGTGGFSYNQKGRLRNTPNGIKYGTVVPGRIIANKEAAIMGFVASVTDRSITLQSNYAKNAPGKHHRQFTVPFKINEAELGEDGSIRFFAEGIKTGKWMKANDNRYVPTKTNFASSSERNKADGKSLESLLNLILPTK

SEQ ID NO: 14971 - protein, 518 aa, Candida albicans
YIHDSMSVESTISQKPIALPATMHIQPLQPIPIANTRDIKYAWPQTNRSPSISSSASDDEEEEDNDDDLSLEIIADRSSTPPTPCSSVCHDKFMYTSSCDSYLQYIEPNPVSPPSYDTLPPGGCPRFPVSAPSIFPYSAEISCENNDLQPPAYKPAIYKIGVVARKMEWINPNELSPHRSWKYYIIELNSTQLNFYNVPAKYEHQLVTFSPDSLTSQQPFQNYDTNLNSLFTCSADHQFYDMVKKMGLIERNLGCSKKGKCLVRSYSLQNSKIGLATDYKKRANVLRMKLEDEQMLLNFGNVDELITWNLLLNVGKDVALDLTDREFPKYRTVPRRRRRNRNTEGNGSSSLLSAIHPNGSLARLRSVSDPNKFRGRFSRLKSKLSSAKLSTYNNRQVVEPAAMYLNNSLPRSIYYIQLPTPVSTPSSESIVATTRSNSVSDFRNVSTAESSETEPHDDDDEEEEEDDGEFDQASVNSATNVHVEESPSYCYKWNPEKKFDKHKYHRDCLRCIKPLLYN

SEQ ID NO: 14972 - protein, 225 aa, Candida albicans
LLYEFSLLTSMNCIKLISLLLIQLVVTHQIQIPFDFNGLFSSKDVTRPHYTSVDPQYHPIDLSQYNDKHVVRIDYSNDPDLGKYLISLPLRGDANVHFAKWSHASNLKTIDIQIDKESLAKLHEMFPSMSFKVIVGDLAQKIFETYPLQVNQLNEDPVVANELFFKEYRSLETIDAWLDLLQATYPDIISVEEIGETYEHRKYKVVHSLFLARKVMMIMATGELL

SEQ ID NO: 14973 - protein, 162 aa, Candida albicans
VQGSSFTVPSSEGNDDHGDRRTVVVSGGIHAREWISTSSVLYSIYALIEFYKNAPDSDIWSKLDFIFIPVSNPDGYEYTWTTDRLWRKNRQPAIHPKCFGIDIDHSYDYHWTRSSDWACGEEYSGEAPFEAFESQIWTEYLNNTNANHKIWGYIDLHSYSQE

SEQ ID NO: 14974 - protein, 309 aa, Candida albicans
QKVMVKEGHGAFPVPKANDIPPPANIKKIGALKRFSDEAYAKSLLYDAARLVAPIIHEQKFKVGKLYEMYPDKAELWGLNVNHGQKIYLRLREHHNDKLFLPMGDIVGTLLHELTHNLYSAHDSKFYKFLDKLKSRYDDIHCRGAKTKYLCEENKVGRGVLLSGSLVSVREQRLKELSKPKFANESKVLGLNSKINKPIGGSPRDLRQAILEAAERRLRDSKWCHSENAETESVPKEDEYDTTQVELIGPTEGKPVGTFANDIIDLTSDTEETPIQPDNPKRRILHEIIDLTSDTEDIEPTTPEVICID

SEQ ID NO: 14975 - protein, 144 aa, Candida albicans
IFPFLPPKEKIDKERIKKYLFYLIFSYFSSFFSVLMNQNKKLTGLILLAIISIITLFNFKTISQITVIRSFVSPASSTATNTNTKSTMSDSKGYIITLKDTCADSEASSIKSKITELGGKITNEFSLIKGFSAQLPSSPQGWKI

SEQ ID NO: 14976 - protein, 258 aa, Candida albicans
VLFFHRIYLSPPFFFILLIYLPFLCKKRCLEGSVGNHVILGINAVSIVAGLYGAWRIFLIELSDDLKGAGHYQFLTNLSLIYSLVVFGLGFVAHLTRSKTLYDFKNLLHPIGLALETIVAMVYWPLRLFMLHLLTPDPENFNIPLGLDLCIHLMPVVSLLIDYLVFMPRWTIKSNTVLLLITALSTGYWCLLKYLVDTENGGRYPYAFMDMEDDGLRALVFVAVGLVAFLQFHFMRNIYDVVVKKTETVDIEIDRKLR

SEQ ID NO: 14977 - protein, 285 aa, Candida albicans
IMSFGSFDHICNKTALPLCSVVGAVNQSAFFQRGIVPDCYARSVELANTMIFQIGNAFVHFGGLIILLIIIFNVRAKYTAIGRKEMLFFLYLAIGLIVSSLIVDCGVSPPSSTSYAYFVAVQIGLSSALCICLLYNGFLCFQFWEDGTSRSMWILRVGCFAWFAVNFIVCIITFKHWDTALDYRKTTTLFIFAYVLNAVILAVYVVSQIILVVFALESYRSLGAILLGVFFFVAGQLLKYFFNEQNFSWGLSIFFMEYSLEIHFTFSTRRKIAKSWGMISNLINS

SEQ ID NO: 14978 - protein, 398 aa, Candida albicans
MDTTDQSSDSLQQSPSISSSISSNSYKDFAIDVLNKAVVKGNSIAESNPGSKRAIAISTASTIVEMSLEKYSSSNLSSRRSGRSGSIDLTDEQISQIESVPSSADDNGDGNKRKSGHFADRMIEKLLKSVLPQDIPEREIFEKRLNDPERNKRPGLSFGILTSNVKQMASKMTNFFALQYEVLYIIAWKKPTKTISALVLYTAVCLWPHLVLAYPLLFVLFGVLIPGFVHRHPQRNPELIKVKKRGQSLLSFLFETPETSIVEDLINEEYLQASDEVASSTYSISEETSEVTVSSLMPTDSESPKKDDVAKHRKSQIALLINLRDFQNLTTDILKGINNAEKFYYETGGFKDERLSTFIFYGVLLSTFGILFVGKYVPWRLIFIQRKMDRGNFMPSQL

SEQ ID NO: 14979 - protein, 207 aa, Candida albicans
YLFKGRWTGAILCHPNCKKFLVDASKARKARAAIEKAKKEEKSVPEIIIEEADDTVTQFDRNDIIVDDSPEARTVEIYELQIKSILKHSWTFYRYSTTIYDKNNKARIAGKRPPGVDHLSKVYPPNDWKFDFGLVNKWNLDTKPKEFLRERSLNPNLFIVKNDESQGWIYDNMEGIVYLDIVYEFRRRRLYRECYRYGRPHKQPSKY

SEQ ID NO: 14980 - protein, 557 aa, Candida albicans
NSDSLSNLNGLLKENVDGVMIDLYWNEFTSKWQLCPAPFPNNITYTTASNRIVDVLWNNKTYKCDPNLSTDNIMSILNSFIRDTNTDVEANFMHVMYNLKSIHYEKSNQTISLENIYKEKNSNLNVVGMDTLNDTVSLLSSYIFTPTLLKQYQSTSNKYTNSSSSIRYIDSLNETQAIQDFYSQSTILMPSLQTVLLTQYKRLMVHVVTNDMAESSRSYQISSSDKDTIFFNSDLPALIFHTDNALADELCYELSDAYNGTDVNIAEFNKVLLNATLRLVVDDDKTPFTTKSLSKYVRCGYCPIFNSTEYSSQKVTEGNSLIISREFASNLFWSWAPGQPSGPDNCINCTRPTTNNTSKHSDDNGEEEEEGNNIAYKCVALTEEGWEVSNCYEKYLFACQNKLSRNEWKLNNSTKRNYFDIDDDDCPEGYFFSLPRLNIEMLSLMTTVKQENVNYPIWIDLNDITVENCFVSGGPYAQCPYQETVTTDKFVRMIDPSFVVAMVVLVLIFIEKVFRKTPIQTNRKRYWKKAIHEYYAKNDYEGGTLPKCCIVQFGQFF

SEQ ID NO: 14981 - protein, 264 aa, Candida albicans
  UNSURE (10): Identity of amino acid sequences at the above locations are unknown.
KEPKFEAFHXTVDTHMGKFDNEGNYIPNEQKDSSDADDDDLWLEDYNNKSEIYKATQAQLLRERQQREKSKSKSMEKDHNVEPLEVLLSDLILLLEPVESPMEALARLNPKNLRKKKKKGDDDDNNKNGIANHEELINKITNVCSILINDKQIDDIYELTREELTRKFQTITGQSFNVERGLKRSREESDDEDDENSQINNIDYGEKIWEFRWIGDENEDKVINGPYSSYEMNHWKETYFENKVEVRKIGETKFQNIEYINEFT

SEQ ID NO: 14982 - protein, 182 aa, Candida albicans
RHPESHPVVAKLQLQVDELLKIGKQNETTFSQEIEALRKELQEKTTSLKTVEENYRESIQSVNNTSKALKLNQEELSNQRILMERLIKENNELKLYKKASSKKLGSRDGTPVVNEYQQGEDSPGVDELNNDDDDDEDVISTAHYNMKIKDLEADLYILKQERDQLKDNVTSLQKQLYLAQNQ

SEQ ID NO: 14983 - protein, 551 aa, Candida albicans
LLTMIPRLYRSFSISTTLRNELLDTAKLLQSSSLNTLNQPKNFKIHTTKPTSPESYERTVYPTNYNKPQDETLENSDIPMIKITELSRDLTTGLTTATTSIADYFFGNTHHSHHVFYLNLTVLKAKRAAKVENKKFIDLKLIKLTSGNGGNGCVSFFKDNFKPMGPPDGGDGGNGGSIYLNVVDKNITSLHGLQKRYVAKGGQPGKGSQLDGKSGDDIIIDIPLGTIVRWIPDPQDFKKFVSQREGDALNDVFMEFDIDDRDFIQLNRGGYRPGEGWIFKEHDEEYFRDKDFFQDLNEKVTGYDEELLFEESYNDRFPIVGLDCNQVTQKPLLLLRGGKGGLGNMHFLTKEIKGPRFCKMGRPGITANFLLELKLIADLGLVGLPNAGKSSLLRAISKARPRVGHWEFTTLQPTVGTIFTRIDKDPFTVADIPGIIKGASQNKGMGLDFLRHIERSGGLVFVVSLESANPVDDLKILLEEVGPRRMKDKNVLVVATKADLSSEGANFKVLRDYIEHNHSEWKIVPVCAPKGENVERCIKLMSEIAQTKKKP

SEQ ID NO: 14984 - protein, 631 aa, Candida albicans
  UNSURE (2),(3): Identity of amino acid sequences at the above locations are unknown.
SXXYILNQSFVESSFFTKLSELKLVKYKLDSSYIAIHGFQTHPTKLNKFNDTPVLNLDQSSFDDTLNDLRINIPGELFNVNTIEEFKSLDKLKLLNTWGQNVYLEVTNATSFDYKLFNKFYILTYSDLKKYKFYYWVAYPTLSNTWTVESESQETDTTITQLVETELDNEYGQFFQYYGGKLHKSVQADKEHTFVFIDTCLSKDRKPSSQLKNYLYFIAYKGIKEIDLVTYRNNNLSFTQHLKLDAFTDSPKISGWERTNQGKLGPKLADLGSLINPLQLAEQAVELNLKLMKWRIAPDIDLEIIKKQKVLLLGAGTLGSYVARALLGWGVRSITFVDSGRISFSNPVRQPLFNFEDCFSDSGQGEYKALRAAENLKRVFPGVDAKGICLAVPMVGHPVTDEHKERENYETLVKLFEEHDVIFLLMDSRESRWLPTLIGAANEKIVINAALGFDSYLVMRHGVTNQKDRLGCYYCNDVVAPNDSLSDRTLDQMCTVTRPGGALMASSLAVELLVAILQHPERNLAPHDAETKFGNIPHQIRGFLHNFQQTKLFAPSYVHCSACSPRVITEFKQEGWEFVRKCLDDSQYLEDISGLTKVQQEAELAAKQLLEDLSLDDDVSNDIDEDSEWLS

SEQ ID NO: 14985 - protein, 587 aa, Candida albicans
  UNSURE (67),(70),(577): Identity of amino acid sequences at the above locations are unknown.
TNHTTASTLILPINCTNMNTFSSPPNVIREYNDSTYQLPLNSQFHQSPFLQTQSPDYVSLRAEEDDXNDXNLDIMSSCIVDSVIYKSQKIAGPLLSSISNLNIQQALIIRELLFTLLGHEGHYIQYSKRYDPTSQISRIEGPDYKIAKNLDISLKVITKKLVKFGKFYSGLKSFIQVFDNNKFGKIVQKFCSEVRKFLSSYQQVLINVEHEFKFNKNFNLNMLDLLLHQEISNEMTHLYQIGIEISRITEERQKMSQAEIMGNFEPTTLANTSMNGINSEPNLYYGKFDCCKGGLLLQVIQERMVYYKGDPTSLDFLTQLFDIVSSDYIGMLNQWLLEGVINDPFDEFMIREKRVPDSFMEIFQSKSEYYWNELFLIKIDGLLNQFQNSTIQSKILNTGKYLNIFKRCTGLHNFESLKEKLTTITSLAAPDLELKIDEFYHRANKMLMKLLFDGYNFPSVVNIFQRLFLFADSFQIDNFIDSTFSELKRGKLKISVSRLQKQYDDIFKEKIENKVGVRPSVYDVLKKNQKLSVTSESLYKVVEELMEKNLDYLISDNNLRGIFHRVASLRDDPRLTXFLNDRDRSSC

SEQ ID NO: 14986 - protein, 99 aa, Candida albicans
DLRAWAGEYNNPYIPPLEVRLIPYYVPPRIPTFVEICSFFGLLIWLVPFALFVSLSAHDNLLPHHLYKPYDKNKNNGLAKVLVGNLREYIYAISIKFGY

SEQ ID NO: 14987 - protein, 1183 aa, Candida albicans
SPLTLDIHQELDCLSVLKDCMRKPHYWALRDHHVIITRIIHISFKGTSATTLNDKMRHGFDIDYNSEKFLNSLANTFYIYFDDKRQNTNGNPLTEEMKQSAEYFKNYQPISDWKVMKERQKTINAILVLCLNLGVAPPDVIKPSPCARFESWCDPTTFNDTKKAIENIGKNLQTQYENISSKTRYRQSLDPCVEDVKRFCNTQRRNAKDERILFHYNGHGVPKPTASGEIWVFNRNYTQYIPISLYDLQTWLGAPVIFVYDCNSAGNIVHNFKKFVQKRIDDDNDGNHDQSAPSPTSAYLDCIQLAACKSNELLPMSPDLPADLFTCCLTSPIDVSIRWFIIQSSLKKGYYDALPRNSIGNIIIPGNLNDRRTPLGELNWIFTAITDTIAWTSLTRPIFKRLFRQDLIVAALFRNFLLAKRIMPHLNCNPISDPPLPDSVRFHPIWDSWDLAIDQVLSRLLKSAKEETVTMPLAGNIQNGSTKGDSVSSAQQQQANGSQSAALFPNLGNVQYTTFFEQQLTAFEIWLKFEGPSSKTPPEQLPIVLQVLLSQVHRLRALILLSQFLDLGPWAVYLSLSIGIFPYVLRLLQSPAQELKPVLIFIWARIMAVDYKGTQQELCKDKGYNYFYSILNSPPINHVGVNGNVATTNTGTMLINDDHKAMSAFILTLFIKDFKNGQRLCFSSEIVTNCLKFIQTSDNPLLRQWCNLLLSQLWNRHPEGKWVIYKNNYITKLLNLIDDPIPEVRTSILVALTTYLSDPPHLAPQQPTNPVAVNTNDLRKDEIRQQDLKLANTVLGLLGDGSPIVRKELVFFINKFVQTYAKFFLVVAFNQLQEEIVLIENPNYLNDFRKRSPAYGSIFSSVWKALLILSEDPHCEVKQLAETLIDYVMVQLNESELSGLVKEMQDYLLSKSTINISESFKPTKPVVNRQLGEKRLVSSASIGNRRNTLLIDGSSLTTRSASANNITSNSNNRNIKGNMDDSDAESITSKIKNLSVSKLFKSFHITEENDLNSFTRILNPGPVQSNYGSEYIPKTAFFKKRDLSKTPELPFESGFFEYSCEYFQEPQMSKNEIDEPGSKEYVKRLWRRNRNESIIQETQPQKEMALRGEWNKDIQILNNITQPKCIKFTQFEKILVASDEKDNMTVWDWGNGQIVKKFSNGNPFGTKITDIKFLNEDDSPLLL

SEQ ID NO: 14988 - protein, 260 aa, Candida albicans
FFFLFGLFNSLVTSSSVQLYFSLLIFYNQCNMSSTSQNATVLLTRLLSLKENSSFHLILDSLTQSSYYLIQEYIHRCSKTTSKIIYLSFETINKPHYCSEFIDCSDITLHQIVEKVNPLRESNERLLILIDSLNYINNDELAHFVAQLVGPEITLVGVYHTQCPVAASKYPNYPSSETLLSYIASTIFELYPLIPDSLDEEELDAKVKKLTFPINSNLNSAIFKVILTNRRKSGRSLTYTLLINSVNQEYEIWKDKQESG

SEQ ID NO: 14989 - protein, 325 aa, Candida albicans
LWRMNISILLVSLFLSLACADEIKPSGEFHEHLHLKPLSRNRLLTNFEFDVESSPFQIDYYNSSSPVEASRRSHYNYFPNSLGLIIESTNTKELQLRFTQGWWDASSWGQLPFNGKYSGGTGVEVSAVIEAPNVEVAKRNWLKLTKTLSGFFCASLNFIDDHITTYPKHAVKEINLAEYAPEKGNKLYLLRAALPSEPVCTENLTPFLKLLPTRGKSGISSLLDGHKVFDSLWHGMSIDVTTNCDTNNQCTLKLHQTVNQIVDIIRSLRKRKEGAIPKPTPGDQLRCDTEKTYNSWQCFPLSDPVNLEWNLETINGRGIYVPAER

SEQ ID NO: 14990 - protein, 283 aa, Candida albicans
LRILPGARGEKSIVRKFINQSIRKNHIVQYLHENVKFDFQFIAQNSSIVLPIDTPPLYASRSLTGYSLDKGGLRTVFTNNNDEPVKFVYFESTPWFMILYLHTLRLTLKNSTGLFDIFDHEQYIKDVYFRPAVDRERPSHMELIMEVPAKLTLAISYDFDKSLLLYREYPPDANHGFDVEPAIISVFDKDSEKVYEFRTTSLLLTLPTPDFSMPYNVIIMTCTVLSMVFGTIFNLLIKKVVTEEEFEEIAANTKLAKLKRGIKSTIQQLKGQKQANILTLTKQ

SEQ ID NO: 14991 - protein, 157 aa, Candida albicans
LLMPSKRRPVDIRTPKYKKKHPNMRTRLTADDYHDILKYFVLDLTLRLNNVRAKVPFKSPELSYINYALIRPIVAYINSKNTFIEIHNRIVKNLQDFSGSWTIYDSLLMDDISEEVYDNFAEYVADEEARLIRLKRIGFWSLQLLVQLVLFGVGAVA

SEQ ID NO: 14992 - protein, 616 aa, Candida albicans
MNKSLVPSSSSLLNVNRILVRNVATKQLAPSLSVLSTRILKNHFTTKFKQHSIAFNKQRYFSTFSRSYQEPLNKHTQPKDELKQTITKATLLSQANSGLSRMLIHLKWPLSRNTNTTSTWDMTSAFISWLVMGNILWIILGTTTFGLTLMYSLHYLDSLVGKFSDDKETTDKLNQTKSKTSTNVMSYLIGGIISFGIGVDLNFEKGSSLPELKDGKLRFKNVGIVSHDGNNKHVKCKGTVEAMDITLSFNKWYEGNGLIYDLELYGLNGKLYKLRSPSPPVANTTKKSYRFNENIHYQYDLDHNVEEIASGSSSIIDNNYTFDHVKIHDSYLEIYEEQSSTPIKINIFSCDLPKLRGDKLVLDFFNANNASGAINDAMFTLHKRQNLDPENKNQDKLIRFKLDAIDLGEINKYDPNLKFNWIINGKAEVIADITLPEEQDDLNESITEVLTKMFTNMFQTADMSQTSEDSLLKDAISAIYHTFRKPEETAKPAENSYVMVNVKMKLYDLKASLPQVLPRTNNGIPFISLTDLRSLISFINTENQPITIKSTVIEKITDLSNIQHLGQTKMFDYIMGDAYEELTNLVRDDARRIINEKSWSNSIATQLLLLGLGAMV

SEQ ID NO: 14993 - protein, 472 aa, Candida albicans
EFKVQFGFLLAQSLVSCLTKIKTDLAIPRRLRIFNGEWHPQIYLNSHIHSTFMSLRNILGLLKQLNRQTLLFLKTCQKSLIRPTVISAIQPHRQFSASLFASDRKQVNQSDKQPKLHSKEQSEDKPKHETELIPTKEQLLAKANNMYSRLKIRLKWLLKKSNRPFNTDDYSAFFSWLVVGNVFLFFVATTTFVSIVIFTANTVFAQEFVARKLGEFITKNSNLTVTFENAIVPGWSDGKISFRKCFVSRRPKRVEKFIKGSQQEAYEESLQNEGTNEDEEDIFEDDGNYTQFDLTIEEVNISLSLNKWVNGTGMIETLELKGMRGVVDRTHVHWKPDDDATNYKNIHQPGDFEFESFRMEDVLFTLMQPNGFRKFNVAIYNCELSKLRKHWLFYDFLNANVMSGAYDNSLFTIHKKQRLNDFDEYTPTNSNLQKWKRVTRMRVDSLNIDHLNTGLEGPFGWITSSPRVEDRV

SEQ ID NO: 14994 - protein, 362 aa, Candida albicans
NKLKTKLINLIDGGGGEEFINYPQDLQLSIYNTLAMLPIIEKIEPETKWYNDVINILGEINGLIQIYQEFLNFKDDQDLSNLIQKLPNRPTTTTTTTTTTKLLTDLSIDFNKPQTILSISNHLNILMGVLKSYLTVETSFTVKLPLGLILTTCELICSINTKFLSFKGDIRDETIKKLIKFSLIENYKTTLGVLIELIELYKGSLIPHLTTIWSFLETLIPFQNQNKRIVNEEIIESESLYVEILQFMKQSLSLLGNVSENTQLLRFVDMALILVEPRINPTTTTTTTNNNNNNNNTKQTNVQQGKKQKKRKNTSSVALSDILSHEHLFMTNIPTITITTVRSFINQIITKIILPPTQHYKI

SEQ ID NO: 14995 - protein, 247 aa, Candida albicans
FFFFLLCSLTMFRYVRSAFIVSAVAATPLFHPKILLEVKQVVVDSSLNPFPTEIPKGLFHNDFQLLGHGVRSVTFISFKVYGVGIYIAKKDIPKASSVLMGMADKLKDPQESAQVIEKLLDSDVKFLVRLAPVRNTDFNHLKDGLIKSILAHPKSKEMKTELGVGLDELRQAFTRRGTVPKNHLLYLEMLDGGKMELSYVNPEKKPYKMGVVDSPLVSRQLMLQYLSGAKPLSPSLRDSCIEGFINL

SEQ ID NO: 14996 - protein, 383 aa, Candida albicans
IINYNVVPVCDRDTFQGASCKYVALTDEIRDLLVSFDISKAVDVTQPFAGHIASLLNPLLGTITADVVFQFKQPGIPEDLRVFKLHRFLLASRSPYFEEKFNGEWENLTVITMPMSVDPAVFKRIINYFYLRTHAVLNDSYAIQDQLLKLARMYELDDLVDGIEEIKGIEDEKARAKIGHDLSFKFVEKARKDLDDFLLQKILGEKLSTDMDLKDDVDLEDIDCTEFLSDAQREALLEADSIPDVILACVDSESESVIYYPVNKSIIARSEYFDTMFKSEMFTVAEEDLPLYREAGVQVINRPQLDTDHLAIIQVSTSTANQKIAEMVLSFLYHDNINNIPLDLSLELLFAADELFLERLKTMSAVNITSQFQKFNFRLHARD

SEQ ID NO: 14997 - protein, 364 aa, Candida albicans
GSFQPRGEDYCSHENKKERNRRSVQPSPKWAGFFLFFLFFSLSIFHRFAFLPISRLIYSIVLLLILFFTDMSSELLQEVPKSIEHVKHIILILSGKGGVGKSSVTTQVALTLVNKGFNVGVLDIDLTGPSLPRMFGVENKQVHQSTRGWVPVSVYNNNNNQGTDSKRGNLSLMSLGFLLGDRGNSVVWRGPKKTAMIKQFLKDVVWGSAETPLDYLLIDTPPGTSDEHIAIAEELRWANPIDGAIIVTTPQQVATADVRKEINFCKKVNFQILGIVENMSGFICPHCSECTNIFSSGGGKALSEQLNLTYLGNVPIDPQFVELVELQNEQENKKLIELYDDCELKPILNGIVDKILDKNLPSRI

SEQ ID NO: 14998 - protein, 241 aa, Candida albicans
IIYTRIIDTMTVDELDVSGSFQGLMRSLNLDSEQFKEYDDIDFESLNFIQLSHVKDEIENQLNILFDLLRHKYNADMDTPLVTPDGFPRSDLDVVTIRLLRIRIIRLRNDDRKVIHLLDDRMAQEFATRRESNIEAGEEELTTSSTSRYHIPFAQVREVVSGGPAFNSGLKEGDQIIVFDDDIHAANNNKLGSLVSRVRSKQNEEIKVDLKRGEERITLKLIPSDNWDGQGLLGCRLIPIW

SEQ ID NO: 14999 - protein, 106 aa, Candida albicans
KREKKMAIKIKVEFLGGLDIISNSVREHKCVIPFEEGEATVADLITYITKNIISDPKDIPVFIEDGTVRPGILVLINDTDWELEGMEEYVIESGDVFTFTSTLHGG

SEQ ID NO: 15000 - protein, 218 aa, Candida albicans
GEKIPDVTLLNQDGEEISLTEVAKGSKYVVIFAFPRASTSGCARQVSGFRKLDKDYKDVSIFGVSSDSVKAQKNFQTKQNAEYDLLSDPEKKLIGALGAKKHPLGIIRSHWIFVDGVLKVKQIQVSPEVSFTSAEEEIKKFINENENGKEATENDVTKEEVKEESQQDDKEDNTEQTDEKATEQTQDEVKKVSDETKVEDETADKPVFTHAGRRIHCY

SEQ ID NO: 15001 - protein, 319 aa, Candida albicans
KLQNWAIMSEDDEYIKALEIQRRNFEAQFGSIEDMGFEDKSKTQVELEDEDERSSQDSPDQSSGEDEEDSEFDEIDSDSNEEEMDFLGNDEEQDDIPKPKVFKLNDSSNTPLPVVSKQDRKLLKSGRAPTLLEISKKEKLAAKQQSKQQSAKSKAEDEENLANDLKLQRLLKESHILANTLEYSGADLTLQTIDFDDPTGKARRRALDSRIRELASTNSRTGGLPKKLEKMPMAMRKGMIKKRDERIKKYEQDARDAGIVLSKVRKGELRDLDAGRGSTSSIDRLGTGKKIDKRIRDRGLKINGIGRSTRNGLVISRGK

SEQ ID NO: 15002 - protein, 294 aa, Candida albicans
  UNSURE (135),(143): Identity of amino acid sequences at the above locations are unknown.
RYTRTNISISPIQPKMTKFRGCIDIHSGQVKQIVGGTLTQDDSASSETSSTKENFVSTKPSSQYAQLYKDYNVKGCHVIKLGSNPANDDAAKLALSTWPHNLQVGGGINLDNAQYWLDQGASHVILTSWLFTKMXQDKMKLDXGNLREISKLIGKEKLIVDLSCRTVIENGKTNWYVAMNKWQTITDTILSAEFLLKVSAYCDEFLIHAADVEGLCKGIDEKLVENLGEWCPVGFEEKIVYAGGAKLINDLDTVAKLSKGKVDLTYGSSLDIFSGKLVNFTDLVEWNKANSKTN

SEQ ID NO: 15003 - protein, 507 aa, Candida albicans
KTRKNTGEGLRKNSTEFITSTLNQQPLNMAISPKIKALVDLATVIAILLNFFVYFYPDIVNPTEKCNWYNAPEQKSKYTFLNNNLPTDWVNKLVLNFPSLKEQEEVVSNDIHMLLFGDPQINGNWPLTKYIKRLDNYGNDYYLGHIYNTMKRRLNPSHVTVMGDLFSSQWILDSEFYNRTYRYVERLFPQPLEYKQNALEVHARHENYNWQQWLEDEKAMDPIHRFQSRVYNDVYDWVYRNRSTPNYDQPLFINLTGNHDIGYSGDATWQHMARFHLLFGQNNYVINYKKGSPDEWRIVVLDSLTLEGPALQEEFVNYTWSFLENLRDRENPNFKGSTILLTHVPMYKKAGLCRDGPEHKYYINNEKEPYKNGKLRSHNHLAYETTQKVMDIVFPNKGKSGIILTGHDHEGCDDWYNYINGEWIASKEKQSAERESVREVVVRAMMGEFDGQTGILTGHFDDARDTWDFHFSYCSFVIQHWWWGKQNCFTGINLLTTLGEPLGWNIN

SEQ ID NO: 15004 - protein, 191 aa, Candida albicans
YMVLALRLKTLSTATDASILTSDKSQDPLIKGLDLYSSNLNKIANARLGQDQLIKSKFNKPLLTTLRSLISQSNNIQKKAEDKRIDYDLTRSNLASCTNPQKEPKLRVDMENAEDEFANTVEDAINIMQNVLENAKPLEEFLELIKAQLAYHKLATELLDGMVKDFEELIDEQHKLSGSATSGRESGDFDI

SEQ ID NO: 15005 - protein, 375 aa, Candida albicans
ILSIYNLFFYFFTKVQTYSPSISVFFFWYSYSIMSFKFPSFDFKSIQESLPSVDQVKESFTKTSDQLSKSIQPYTTKTTQLISEQLKHLEQLANNTTDDIDVSELPQDYLQLESNCDLLLKLYTDLIQTTNETYGKVSYDYPPGNYAINKIKDANVSGLIGQKFNQLKNVSSPQELEKVLLGQDVDAESKDESGVVSIQPTSPQLPKTLFGHLAEICAKHSDELKSSEHPLSFALLQVSSTYQEIAVARLDQDKKIMSGLNAELIRTLNESFIKVNELRKKVYATRGEFDLLRSKYEKLDPENEELIAKEDGFVSATEVAVVEMKKLLKPSKNIDLLKVLVAAQKDYFEVGAKKLKEVLDNLDKIPTTGEEEEDD

SEQ ID NO: 15006 - protein, 274 aa, Candida albicans
QFFNSMAIYDSQLTVVALYLLIIIAIYSAKFITPLNELLQYGKTVSQDVREHARLENNLIKQTIGFISKYFVVPKAWFVHFYITLFALSSLIFLASFNEPISSDPEKFKNLILIHRLLWVQGIRRLTECLTITNFSKTSKMNVSHYVVGLSHYILVTWATYLGLSTYGSHQVPNNYTVFDIVLIIGFAICSLLQFQAHYHLSTLVKYTLPDFKFVSSPHYFYDILIYTILLSFAIKDGFDMVSVTFFTAWLFVISNLSISSLETFSYYHKKYKE

SEQ ID NO: 15007 - protein, 299 aa, Candida albicans
PVVKTNKLSSELSLSKFFRQLDPVNTNGINDETAVISLYILLGAMVKDFGFEEVIFPICEILYASVLQEYPLMAKNSIPFRNEDQHLGSNNIAYPSENDVYSLNKLAEVASHLQNTGSDTSMSTMEPSRSVTPTLSLTGSYKKRVYLKFFNQKLEFLYPVRIAATPRYNELLENAKSAFKLPDTTIVFKHHGKIVQSDLELERVFKSDEDEIELEISTHNPMPIYEMHKRLSQQDYQQPTESQRIILPPPIASNTAMSNGSSLNSRLGLFNFLSNSDDVPGPKPLHPQQSILPKFQPLL

SEQ ID NO: 15008 - protein, 476 aa, Candida albicans
TSKKQCYNNCEILEIRLVKKKVKKKNPLLNLISISTKHTLTNMSANDEYSSDEKSFDESTKSKVLLGFVDAPIISDGKDPEDNDLPTIEDTFIGGQPVWLHPDSKPAEKSLTCDVCNGKLALYLQAFAPIDGKLYDRVIYVFGCKNTKSCSGKKGTVKVIRGIIKDSETVNRIKKENQEALRKDMEAKLKLEKQKKFNDELTKDLFKKKDTPEASNPFGGNSNPFSNPFGLNPFSKKPEEEKEEEKEKEKETSKSKSYADVASKNAPKPKSVKKLQDDLPEYRGLFVYVDNEKFKKIQHDPELEKYKHLIDKEEYDELDILEKPSSSASASGLDNPQASQISNMLNDKYFEMFSNTVKHNPGQVLRYDLGGKPLLYSGKDDVAKKFLAQPANIPRPSFNPSSERRFELQLMPKAIMDLEDLGNNRNVGINDILNGMSWGTIIVCTDEEDFIPEENFDANQVGYIEEWCGVQWEESV

SEQ ID NO: 15009 - protein, 210 aa, Candida albicans
SNNDNNNNTRIAMVSEDWRSIDIDALEPDAHLTKEDLLPTDIPPTTNEQVQQVANQIRSNLSSGQFQQALSLALDNVPYVADLSTKELHSKTVFEVLCSIRNNNNLNDLTGFVKSLSSEQQDVLVKYLYNNMSSPYGQKQGGLLLNWFEKTIEVTGVGSIARYLTDRRTVKRDPQYSTNYDHEGEKQFTSIVFGMMVLNIRKQVCHIHIY

SEQ ID NO: 15010 - protein, 177 aa, Candida albicans
IRIIVRQKNKKIHKFMIFLSLSTMFEKAVYPALDALQQPLSQEKFRILKDQLNSEEPTPSAQTKFNYAWGLIKSNHHKQQEYGVQILTELYKSEKSMRREVLYYLSLGSLKIGDYTNAKRYVEALLEIEPENQQATGLLKTIDDKITTEGLIGIGIAGGALAVGLGLIGALVRKNRK

SEQ ID NO: 15011 - protein, 496 aa, Candida albicans
  UNSURE (10): Identity of amino acid sequences at the above locations are unknown.
TYSLIPIGDXRIKYRGYYIGGGDKVTKEIDDNQITNPYRADSYPCGAGVHAGVISPFWGGCARMSYESGEQSYFKASKGYYGVSDSIEFSSFFKFSFIFKNLKLGEKVSFDQCYDPRLSILLINIILGIPVVYLSSGSVAYWTISVVGFWTICLATDPPVDVNPNRATDFPRLLSVAMERFLPSCCVLFVLWHVSAKRTLSDLPLNSDTKVSYVSRVILWYPLFWLGVLNNMTFDRLPVDRLTISDLKEQSGAILAVGSIILTITTCAFIQAYKIWLSGRFKKYLFVYSLFIIGLVFLAQLPGLTLRVHHYILAMLLIPGCATRGRTALMFQGILLGLFLSGAAKWGLAAIVETADSLRRDDPRGNIIPPILTGYNDTTGTLEWTNIPPQLELTKIKSKLYEKYSSISLLVNDIERFVGDKAKRINLKELLTSSDDLTEEIKRALVDGMKDENGDILIYLRIGRKIPNTHHYSDFSNAAILKWPSGQLKLPLPGIT

SEQ ID NO: 15012 - protein, 286 aa, Candida albicans
PPTHIYFRLITNPIHINTSNITMSRLLSTTLRSQLSKRLVASVSRPSKTVLATLPKAIATTSLRSFHNTPITFNQTAESDLKQILDKELQVVEAIPNELDQSHVDFLETSGFKVVSKPGNANVELVKKDEQGHIIHVYFDVEDVTDIPAEELELEGQELEEEAESLDQIFSNVKVLIENPTKNEGLFFSLMLQASESAFLVDYVNTQADVQKFISKIDNEGEFADKFNYQGPKFGLLDESLQVEFENYLVSKGIDEQLADFIIGYSDVKEETEYRNWLNSVNKFFK

SEQ ID NO: 15013 - protein, 620 aa, Candida albicans
LTLIKSIGTPETQRDIKKAFSHMQHQFPNKFEMYCLYFEICDDAEEVETEDVLMRLVTSVDTAAYFEKTVDLLKLNVNKCFRGVNKCIDYLLAHINSNPSFSDTLITTKFVVNVLLNTSKDSEETLKELQLFLQFAEKSLQKQLSGTTKTSIVAIIWSQGIKFYKQAEYIESLEWLKIALSRLFYTDYKENQDRGKVLRVIQNNYFLLGEYNQVISTASQMDPEDKNAPLTQFNLFRANLMLGNEKLALECIDKILSNDDSLTVLTIAVCILESKGKLPFEAIRSIFLKLVEHICEMELTKESISKLESHNVVLPICCRCAVVMYLTELENSGNLSESTLHSLKELLENSCAIAKKIAPTQIHIFTIDDLEWLASKSYNIAMSCQNGELNSFVGLFYKICIAFIDLISPDIEAERGEQLILWKVRATIFGILNTCLDCSLGASEWIAIREKCLELKGVVYKQNDTDSNWKECLQQIIVIHFQAELSLGSSQSLHDIVLECKGFKPAVCNDMYDLFIQLITDSEIQISNQKRKQLIGLVISQAIKNIEPSQVKNIITWMRLLMEVSGHNFSSEEEVLMLQLYKLIKANRNEITIPTFEMEWLATKSWNHGIYLLMYVFCIY

SEQ ID NO: 15014 - protein, 358 aa, Candida albicans
SRNQRINHSTMTPPQLKNFHTANPEFEQAIDRSIPEFAAAQLSDEDKYFKNHKPPVYLPEIAVEVQDFVKYHLEHSHKRIALVTSGGTTVPLENNTVRFIDNFSAGTRGATSAEYFLENGYAVIFLHREFSLLPYSRHFSHSTNCFLDFMTEKDNKIQINDQFADEMLQVWRKYNEAKDTNSLLLIPFTTVNQYLYTLKEILENLHIMKSKALFYLAAAVSDFFIPQSRMPQHKIQSSATQDGELVIRLAQVPKFLSRLVENWAQGAMIISFKLETDNNILIQKAESALERYHHQLVIGNLLQTRKKEVVFVTPGHHQENWIRLTDQEINDNVEIESKMIPAVIKVHDDWIAKNDNNN

SEQ ID NO: 15015 - protein, 311 aa, Candida albicans
PHNQQSTTTPLPHSPRMKIQTDAANVLQRASAQLKSGLLKEKPLWYDIIAKYPPTSTNDLIKKSHVYEGKSDPRNNSIIYKYPNSNNKNNNVLFKTRPLNKELKSKNHNIHKLPKLKFIEDSLRKIFYQQHPWELSRPKNLIDNGNGNNNEKCDWSHMLQLYKPLDGESVVQRTLWLLKNNTTKGLTMVEAYDKARFEFYKLRMSEEMESHVAKEESTMYGSVFTSTTVNWNLSKEQEYINDWTIIAKERTQVIEANMNKSSAPIGSVVEEEKSQSSLFEDLLLNDNLQSEPEVEQSGQQQQEQQPKQETN

SEQ ID NO: 15016 - protein, 367 aa, Candida albicans
PSTHQPTNQPTNKIMARKLKGKSIQAKGLKGALIRHQHSEKITSKVVKNVEITNQNKMDKLKSMKTSKLARKHNKAHQKEGKSTTKGLMPFNKDGNDKVLLIGEGDFSFAKSLILQNFIQPENLIATSFDSFEQLINKYENVNEIIEELKNMGVIIMHEIDGTNLLKSLKLNPNKLKRNNQNSDVGKVKKLKLFKDYGNVNYIMFNFPRNGKGIKDVDRNIRDHQRLMLLFFENCQQLFDVINTDTISGYNTFNSNNNNNNNASGSSSTGKIIISMFEGEPYHSWGIKILGKSQGWKVERSGKFDWSMFPEYHHRRTTSMKDTTKPANERDARMYIFEKFTKQDTVKQRKRGNGDSDDDDSDSDNDD

SEQ ID NO: 15017 - protein, 359 aa, Candida albicans
FNKVFVSIINNHDLSLIVGWFNENKNLLNKINSNLEFEINYCKFLTLIEKGDINEAINYSRENLSGYGNKENYQQTNNNNNNTFSNGDTTSTNHLTNLERLKGLGGLLVFRSMENNNKNNNDLNSNDTPLSSKLMLNSTPFKEYQKLLSNERWESLAQCFIENFTKLYGISKNFPIYIYLSAGLSSLKTKSCYHNVENTIFKHSTGNGIDYDNGNDDYDDDDDDDDEGGVIDSNLSFISAETTTNTNTSSNSGKLLLNDPKYRGPNHYYKLLNKINNCPICSPELFKLSQNLPYAQLITSIFNNPFKLPNGNIYPFDKLLAPTDKYLSEKNTLLRANKVKDPLTREIFTIDSCIRVFPA

SEQ ID NO: 15018 - protein, 498 aa, Candida albicans
RHIQYTPQFHLENLPQNTGQFQLNQQFINSPHFLAEPVRNVPNFTFPATTPTISKTEKVINFNSPMMDKKIMKNGPGKLQYKKQTSKVKKNDNKLFKVTSKPKTKKPKRNHSLIPNNSINFPIQIVSPNDILSVENNSFLNTVIYPNIEIKKYSTSAIDPQRNYLTAYEYPLNNHWVIWDYETGWVHLTGIWKASLTIDGSNVSPSHLKADIVQLLESTPKEYKQYFNRIRGWILKIQGTWLPYKLCKILAKTFCYYLRYSLIPIFGTDFPDSCLKPNEKGYGELKLDDLDSFEKRDLPAPIPPVSPPIEQMVQQPQQQHHQFKQNDKAAAISSFQQMGSLLPLPQNYDNSAAAMNSENCLTSNTPETPIVHHFSDTASTRSTSSSSSSSSLSIMSGGRTASNASERESLEIPSFNEMIDIVNASKCLQTLSQKAQSPRSVPMDQPNSAQQLSKNQDIGISAILVAAGINSTLNQSSNISGLSQPINKGSMPISDMLT

SEQ ID NO: 15019 - protein, 314 aa, Candida albicans
LILIMSPVEKPVEVEKPKVPKRRFVGKKPQNITIKDGEQPLTKTINPARHIGRVMNQIPDDILNDKELNEAIKLLPSNYNFEIHKTIWNIRKTNCKRVALQMPEGLLIYSLIISDILEQFCQVETIVMGDVSYGACCIDDYTARSLDCDFIVHYAHSCLVPIDITSIKVLYVFVTINIDETHLINTIKLNFERGTQIAIFGTIQFNPTIHSVKAKLENDTEKPMYLIPPQTRPLSKGEVLGCTSARLDKEHIKAMIYIGDGRFHLESSMIHNPEIPAYRYDPYSRKFTREYYDHKQMIDVRKDAISTTKYATKV

SEQ ID NO: 15020 - protein, 93 aa, Candida albicans
LILGALGRQGNPITLDKLEKSLSEKGIQVVKIILSEILPQKLAMFDDVDAFVQIACPRLSIDWGYAFNKPLLTPYEPMVMLEKDTMGDQKIYP

SEQ ID NO: 15021 - protein, 530 aa, Candida albicans
FLEIQFTFISYEYPPIISSTTMITPFFTISQDDEFIYIDVKISHIRFSAPNIEMTVENELFVFSLPPYYLRLRFPYPCIEDDRSHAEYDSKTECVKIKIPKETKGQFFPDLDLTAKLLARTNEPKVGDIGQANSSKPLIEELDVDNTNPGAQAERDLAEREQFNWEVKQDVPTNPDLTSTATDNSDVNLKPIKYGFNNQYDNIVGVSVANGNDINELADPENTPENARIIERLIKENIKFDPEMYAADYIMKVHPEQDDENKNFKELIDWKNPLIQKFLKWYKADKQLPEAERTSIMPVEFSKEEQEKMMNLPRKSYLKDDSDKPEILLTTICLLFAYHFDLRENEGDHNIESAWTIGKIVPQFSFLDSKIVIENNYNVLRAAIITCIRRALTYPYHRNFDMITKVWDDVYYNLRGGKRLVLKALLDLKELFRFHDIYYVYDKIWLEDLCAYLISDNVSEATIRNLAHDIQKEVSSIKKADITFEKANLESAETVDDNEGNGEDSELIALSLPEIEVMAEEMFQQVQSQQ

SEQ ID NO: 15022 - protein, 289 aa, Candida albicans
IFICLIHYKLLTTILNMALFQNFNTHSLRSTRGFKLKQSSPISSPQPIGNSVLPQTPFDNSQRPHLDQTEQNPYQTINFNNGNGQPVSSHKDIRNYAEQTLGSDNALIQAVKLPRDEDVNEWLAIHVVDFYNQINMLYGAITEFCSPATCPRMIATEEYEYLWQESAPTNQDGTVQSPKRPVSLPACEYIENLMNWVQNFFDNDNIFPTKIGAPFPHQFPTLVKTIFKRLFRIYAHIYCHHFHEVSELGLQSHLNTSLKHYVLFANEFQLISRKDYGPLEDLVDTMLQR

SEQ ID NO: 15023 - protein, 746 aa, Candida albicans
YRQSQTMTVSFNYQNNEIVSSPTVIVSGSTSTRLYRGVVSFTNNQNKVFPPQYFEVNNGHFKAIIHVSPGERNIFQVDILDNGYINDFGFVEYGNGRGPNIVDSGSLTLSFNPLPQNKPIHLCLIRGRDSNNTYDMPKYRLQRGEVPNLENAIKKLKVAGRLMQAYTQDEMRSAGFSNRCFQFVEETIHDQTIFGYKVNSPTPHQEIKIHVLTSPKTVAELRSPELAQQNPNAKDSGGLLDHAIDLVKNCPEIYNQRNGTAVQCACMYLDSTWQNNLILTHAALGGGTNEVKMAIFGSHGLHSYPQNFPLVTPSFLDATHLTTTEVANDCNECGTSWECLNICLGAFLHEIGHSLGCPHQVDGVMLRDYVMLNRSFMTRENECLRTKSRGQIIANNGTWPKVCHWNRLDLVRFLHHDSFSLPIDRFGKTYSTTWNPDNSYQDNSAPSLYAMPLNESLVKSSAGIFLIEVITDDLARYHIEFLPKEYRGPGLQHALDLEFNNLYNALRSRKNDAKDGFKLRILSLGGDLNIDNFKDHCSKQLKQVIQSDFGLNRGHLQGFKSATLGRTDDLKMEFVGFDIKTIYKVRVYHGSALDGIKFYYKSGTGTAGRSSNGGGGAPKIPKRDYLSKMFRSKLNISNQSHHKQSPQQLTNGSGGEKRTALVGKETGNYSEFIFNPNEYITFFNFRDGAWMDAVQFGTNQGRISPMFGNADGGHLSTLDAPNDDFEIVGMYFYLNQILPKGLENPR

SEQ ID NO: 15024 - protein, 776 aa, Candida albicans
INCSNMSGRRRAYPQPQYATGPAEMATPPAPNQFQQQQPVQQPVQQYGVDQMQGQFQQMNVGGVGPTGVPPTPQYPYQQPGQPQQSPQLSYDPYQPQPQANTGVYGQGMGGVPPSAVPAGGAGYGGYGQQNNIGLGAQLNALYTTDLSRDLPPPIAELSFQPPPITLPDNATLIPASKTANATPEYFRSTLNVVPTNSSLLKKSKLPLAIVVNPYNALKIENENVPVTCDTVISRCRRCRGYINPFVTLAENGRRWRCNFCNLLNDIPSAFDYDEISGQVKNKFDRVELNHSVVEFIAPKEYMARAPQPIVYTFIIDVSVHAIQSGLTGTITRTILESLDRIPNENKTARVSFIGVDSNLHYIRFNEGLEGTEILVVADIDEPFLPSPGGLLVNLDENREAIEKLLLDFPSYFENNANQGFALGPALKAGHKMISNIGGKLVCFAATLPNIGEGKLSVRDEASVAGKAKEAKALLAPADSFYKSFAVTCNSSQVTVDLFLTSSAYQDVATLSNLARYTAGQTHFYPAWTSNKYEDVAKLSKEVSDHLSQDIALEAVLRVRGSTGFRMSSFYGNFFNRSSDLCSFPTFPRDQSYLIEMSIEETINKPVVYFQAAVLHSTCFGERRIRVMNLALPTSSKLVDIYASADQLAIANYFTHKAIEKALSSSLPEAREYLIARVVDILNVYRKELVAGNVSGASPLQISTNLRMLPLLLFCLTKHLAFRGERVPSDHRAAALNNLGSSPIPQLIKSIYPTVYSLHNMPDTCLHHALKIRIAR

SEQ ID NO: 15025 - protein, 246 aa, Candida albicans
CFLLLKKFQSIKESNQLQSSSDSGLRLILSDFNYDVLRLVTVPNLLIHWASTISIEQLHELTSTTNDDGGGGDKIESRFVNDEILITTKLIDQFKNDLNNYNIELQFISGSWGNEFINLPAIKDKDTNGIDIDVIISSETIYSLDTLPIVAESIKTIFQQSSSKSIATSKNNNNNNNNKLAIIAAKNIYFGVGGSLIEFLNYFNQITKNDNDDHQGQGFNVSVEEINDSQLKRSLVYIDYRGGYSS

SEQ ID NO: 15026 - protein, 1132 aa, Candida albicans
MIHERVPLVISQAKNFQGKVPLNVSRESSRRSSIIKIDHHTNVDVSTKPENINSRDNKTEKNMTLSSGSTKPSVEEVSKSLKPTITKKTSFTDYLKSAKTKAKEEKVTIEKSDKTINSEERKTEPIQQSEQLLTDKKDNKVEPNSEVNLKDNTDDMKATAGCALGPDKNTGKNDSDKSETTQPKLARSESFADTSLLSPVNESDTDFNFNELAEIPEAKDGSVVAANVLENIDENENISEAETVIADDLPRLDEGKKLLREQTADVKRHKLKKTKLNTIFSSDEEEEEIQEPDFKLQEPEKLPEDDQHPDFQNSKATTEISNDKTEVNKPEVKEVGEKERNHQLEDRLPIKKEKMRSENAKTSENGVSSKSESKISKSKKLPYKVKRDSSGRSLLQRACKKGNFADVQDYIERGASANEKDFCGFTCLHEAALEGHTQIVKYLIENGANVNAKADEAGDSETPLIDAAENKHLDCVKVLLENDADPTIFNIDGFTALTKIYNEHEGEEGYDEIIQVLEEATANYNSRLPREVQFVSDAPIGSGPIMEDPNDNYFAELIKGKGIYKYAAENSKEKTAEYFVAGHNLEGKPDILILAARNGHTELVDIILGLNPTPFNIDTESSCGVTALLASIGRGHFEVVDSLLSKGADPFKTRKKDGLNALEIAQHSPHFDSREVSVIMKFMEKKSGTKILSGIPSRVVSRATSRAPSVPVSSDEDDVVEEKEITAHTENKSAEKKLEDKITKTVNEHVSNRKPHESTGRKLEKTHSNEERKRKREWSDDEPKEPHLLKKSKSDLKLKSLHREFTSDDHHTSESHSDSFAEKRKHLSATPPAPPPPPPPSQAVIKAQEEQKIKDAEEARLWQEKVEAKKRARREMFLKSEKEKEQKRKEEEELRAQEEKRIAKAKQEEQERLAREAEEKSKELEEKKVGLRQQLTLDHYPIGLRYCKFDGNPNISAVDKFLPFYVFVIDDKKYAVDLQVSLITSTVVSKVINTVQPHQKREINATEKSKLWKLFFKFIGIDPRNPNCDQRSSITNGQKQFQNLLLHFVEVDLAEEFLKEFPEVHSKAKDNQIDVSLESLSGFSDCVKDDIIVDGNLEIDIDSKKIEKFIPPHLNTRKDIIRTVSTLAHPLW

SEQ ID NO: 15027 - protein, 345 aa, Candida albicans
YLSADPSSPVGNIILLLKILDSQYGSGFNNESNSLFSLGSSKSQSSFGFHFNYDPTPQTTKEVHIQLFATVIEAIPWGIVGASGDNNQNLIPFKQVVDILIRGAIHPDSRISMASIKSLKYLASKKNPTSLMTIYAKLAFHFSDKTGPTYDTQYLYSDQFTKLLKLYTELLDCWLILFQDLLEKKKADQSIGVLAGNDKLNNRDALNNLYKINRKNADLSDSHPTRLNPSDEFEWKTIITAIEDIEGNGLFFLCSQNPKTRYYGIKVLKLVEQFDQAVYNVTDSATDTSSGTKQHSRSSSKFAADVGTRLIHILEDLDFVELIQPYRKELSVPERSSPRAADPTG

SEQ ID NO: 15028 - protein, 1106 aa, Candida albicans
MPVAMCRNLVCVCLVQMHEFVLEFSDSYKSYTSSLFSKSATNVPPEVLVNQWKLYLIFACSTLTATNDQKISFPNQPTHGRKKSLQMFIQHQKITSAKSVFKMVLPLLKLSQPMVKESVIVGLSHININILKSFLENIPLAVEEWNTNIKTRNPQDDAFRIEVVHILTNLTEKFGLHELIYTDDSIVANLVAIVKNVKNFLSEPAIQTNFECQRLRRYFCGFLENVYTGLEAKSDLEKWLPFEARVACFNYLKEWCGYGDSSAVTEERYNAIISRIKTEKAGPSALAILEIERKKLQLASLKCMAILCSGQIKKKIEIPGNLAVVSFDIPGLMNWIQALLESNVEKIKEIGHCASRNVIEKNFEFQDIISAVVQRCYVSQTSLESYFCLFVEIFMEKNTFEIVSDELVCLASVLTANESFQVRKSAIALLKYFEKKSLGSESLERYTEAICSKSSVVYKKVLFDLSNDVQNIKPESLYNRISYLTQNINLIFPAAREAILSLLVPMVSKVTLNYETPLPEKDSTTDIHEKAFDSSSLMVLSNLFEITVNFGSSMSNQVEVLWISLSNNVQNIDKIVEFLLQSSLELKNPSFVEQSRQIIDYLAFARSDPAYIIDKLINNLQPRMMVPPQLGNKSTAPISKDYPYVCDIKRIIQTNEKDVIFSLGQLSMVFLVDIVTLKNDLMIEKLPLLLHVSLSLMDHYLPIVQEQAGTFLVHLIHALVRDDPKAQETILSLRENDHITHLWVYDDLNNDKKGVRTPKNMDLLIRSAIKMFAAVAPNIQDDWSRVSLHWATTCAVRHIACRSFQVFRSLLSFLDQSMLKDMLHRLSNTISDETVDIQGFAMQILMTLNAITAELDSEKLIDFPQLFWCSVACLSTIHEQEFIEVLSTLNKFISKIDLDAADTVACLTKTFPQKWEGKFEGLQQVILVGLRSSTSWEPTLKFLDKLIVHKDSLIIGMGDSRVLTALLANMPRFLHHLSEENVTPEIENTGMALSQLAEDSGKSSLAKLLVSFDKRRFRSKSDFLDQSISCIKNAFFPEYQAQTLVLLLGLLFNKMPWVKTETLGLLQLIFPLVDLQRDEFIGVGADLISPLLRLLLSSSPRGWKDP

SEQ ID NO: 15029 - protein, 610 aa, Candida albicans
NNYSASNKVTPEENHREVEVNTTTTITTRTVHISTTTVHPLTTDRGGCYFQHQQNQLHQYMQQQQHNTLTPELRTISDFTKDQLPPSAIYFQNSTIGSDILGETIALYNSLANSSNIHKSQPQLPQESSDHLTQKETSTVSASPHPMLDQAPQMIDARLERIEHEVDNFNERENNYQHPQMQPYSQDTESGLSLGTEDSQNISSQKVDYVQTKNSSLEFDAPIGLVYMPDNLDEHKTSFKLQQPPIVTDYRDTTTTTPDLASESNDQLGQLETPLMAGFDFNLGTNTSLANQLSSPMSSFPLHNRVEPSPQLPPPMSSASLQKLTLRNGEEFGSIRRDLATDSKTSAEYTLHIIFTQFVRHAERKLNLCLDYPLNEEPPILDLIAEGVDTEFDKIISALGYIARRKPKPVIDSVMFWRKSKSEVASMAATEVEKAVGVAQTNLLRISKTSSATATTTTSPISPSNPGIAKNSNTASTAKRSLSLMRKKSFSRIAHRRNVSSSAAIQSSQNVPESESVFMKQKQFYDDQISQAKETAVHADRKSLASIYILCRVLIEIVKQTPLSVMGSDLSSKLEEIVYTQLKTTDPISTSQSLVRAANWNLFAELLGFM

SEQ ID NO: 15030 - protein, 435 aa, Candida albicans
LKPKILRDNNEDSSHGEKTKLINLMMTDRSIELDIDYHQLININTGHKGYYRVLYDQLDVGNLSLMDPKDIITIISDLGTVIGTPNSNSQDLINFIILMSNLLKLETQFNWEIWECALSYLEPIIDILRHFSEFNKFNTNWLNKFVSDLFNAIKWDNNNSLDNISKNHYNSLEWKVRSSILQLQLNINNNNNNNNNNNNNNGNHTTGDAAYKVAHKYYQNFMNSGINKKFTPKELLPAIFNVTMNKTSMKEYKKVLELVKNANVSLLKQTNATQQDLQTLSLTSLSFVYGNNSGSAADFELVNKTLNFVNNNIDSKLIELGLIGFTFTNNQQIIDTVFHWFKLNYDNWIMRSLRKGSDWSKQIGITIQNIMKMIIMKMMVNNEMNKLKLNEFIQLKLKNLPNHGLKELVDDWYLENKENIRIGTFYNDLCDHICQ

SEQ ID NO: 15031 - protein, 594 aa, Candida albicans
QSRTFQPVVENIRGKVMSDPLIPLSISNEYIPIEYHYKLDINHQKPNFNGVAIITIDKNHHQQISHKYKQSEKEKQEKEEKEEEKEEEEKEEEEKEEEEELSFSITLHANKLVIISATIGDEKLSIKYDKLQQRVTFLSSTQTYSQLVTNNCLVMEVKYMGQIKTINTYKDETQGLFKTNFLDNDSGKSDNYILTTHFQPMGAKQVFPIIDELTHKPMIKLDLKTLKKFQVFCNGDEEDVVSNDDEWKISKFVYSKPIHPAIMGFLIGDFTWQLSKTVKTNNVEDSVRVYAPSGEISKTNMALRIIENYLPKLEAVFGKYPLNHLYFVAVPFLKDGVMENWSMINVIAPNLLINDGNYQSNYNNNNNNNNNNQSETYQLTELIVHELVHQWIGNWVSFDNWGCLWFNEAFATWAARKIIGTDTTTSRSSNNNNMLAIDCFYDDGDGDFKIGSIFQYMERHQNPNLNATTESIFSTNIYEKGIILLDMIDGIFEAEGKNFLKQFANKIIEKYQSKTIKIFDIWQNLNDDILIDLPSFVYSWTRSKGYPLLRVTHKQNDNDSLAKKIVIEQHTYFHNITTEKAGIEEILYHIPLIN

SEQ ID NO: 15032 - protein, 339 aa, Candida albicans
  UNSURE (318),(330): Identity of amino acid sequences at the above locations are unknown.
NCKLFFTQYHYSQELRPRQKPPYSISMSQTSNPIYGLRRNNGFAGGSNPSNNNNNNSNNNHNGNRISLGSATRTSSIISNNLPFRQSLLHGNYDNAINNTPSTSSLQKQSQQQQQSLQTLQTKRRSTLLSTPATTTKRRQSMMGNNLHQQHQYGSTALRHSTQPSSSMNSQFNQALQHVSPYYNPTSYSSQTPSSQPSSQQYQQQQQQANIPSSASSSQQQQSMDPRPLKDKKYQELIQKEIIRYLIDYKFEIKTNIALTENILKLPTQKNFNAIFKFLYNQLDPNYMFIKLSIEQEIVTLLKLLNYPYMHTITRSHXSAVGGNNWPTFXGILYWLVEL

SEQ ID NO: 15033 - protein, 231 aa, Candida albicans
NTKNCFSKEIRMEKNFKQKNVNLFKLSNLFRPSIMISRQLMGLVPKPSITVRRFFSTSSIILQKSATPGSSTSIPHPHVTSADYKPPVTIDRELPDPFSKRKTNRRYLLIYGIGITLSCIAIFNYEKTQSPIITSSLYFLRRSQPSIELLGKDIDYSSSWPWIWGKLNTVQGIINIEFSVKGSKGNGVVKLNASRESKAHPFDVHQFVLEVERDGKKQVVDLTKEPNFDFM

SEQ ID NO: 15034 - protein, 246 aa, Candida albicans
  UNSURE (24): Identity of amino acid sequences at the above locations are unknown.
DNMAYYQQQMGNPQNMQFHQSNYXYQQPTNAQGTSGMMGSMDSNFGSNIDVSGVMGNGELTPGLLAAFGTSGYPGEPPLLEELGINFQHIRSKTLVVLNPLTKDIPSDIMADLDLAGPILFVLLFGTLLLLAGKVQFGYIYGVGLFGIIGLHYLFKFMSNETTIDLIRSASVLGYCLLPLVLISVLGVVTSLDNLVGYILSAIAVMWCTYSASGFFRERFEIAQCQAINCISFSSTTGSWEDSRSY

SEQ ID NO: 15035 - protein, 317 aa, Candida albicans
TTLMDRVEELLKTLTYGHPKIEALMEELDDFFKNHETAGSRVIIFTEFRESALEIVQCIEKANDNRKPHIFIGQSKEKEKFDVENFGKKKQKGQTKKKKDERPSTRSSSENAQMTGMSQKLQKEIIKKFKKGVFNILVATSIGEEGLDIGEVDLIICYDSTSSPIKNIQRMGRTGRKRDGKVLMLFSSNEESKFDKAMGGYEYIQQHIMKGDFIQLRPQHRMIPDEYKPEAVKQLIQIPEENIELKAEDDEDEIIRIATLYMLGGKGKKGKKANNNSTKKPAKTFFMPDNVETGFKSAATMVRKVGDNKSLAERNKV

SEQ ID NO: 15036 - protein, 264 aa, Candida albicans
INIQNISPVFFSMIIFATPKVCKGKTRILYFYLSKLFFYVYFFFLIYYSIQKHSYINSTMPIIPLEDDKDDDWILEDEDDPEFQAILQGNSSKGPAQRTLEGSVAAVSTRPQNDKYETIPVPVKINTPTHHAMDFENLKTYIYPTNFEIRDYQYNIVERAFYDNLLVALPTGVGKTFIASTVMLNFLRWFPISKIIFMAPTRPLVAQQIKACCSIAGIPSSKVAILLDKTRRNRAEIWNSRQVFFTTPQVVFTSGLDGSALKSR

SEQ ID NO: 15037 - protein, 273 aa, Candida albicans
ESSQRDTQASVKLKPPPPKPKKLSSKIAAFQQQLFNPANASSEEDVSSTGSKQPESGIRKRSTENSVLLRFGGKAIPLPGMFNPNQMPKPSISHGEETSDDREEKQESATANAPVRRTRGPRGKKLPKAVADAEVKTESRFAIELGKLWSIEFKKKIVEEKEITSTSVEDLEKPKILSENDEAGDEGKETAVENEVIDNPEIPVKDELQHDVVDVVGHPEKDVVTGLDDDDEDVPPEVNERFIKDEEISNVGVERTIALETTTEKHSTDEEEV

SEQ ID NO: 15038 - protein, 817 aa, Candida albicans
MSIPQMKLPATPYMPSYEGDCTDPDNIFFDGDNVSFVGRPFPLQEARMHLQRIKDWGYTTIRYLITWEAMEHAGPGKYDREFVNYTIEVLKIIEEVGGLYVFFEFHQDVWSRYSGGSGAPMWTFYAAGLDPKCFAKTEAAILHNEPRFHDSSDTYHKMLWTSNYKRLASLVMFTLFFAGKIYFPDLILNGENIQDYLQNHFLGAVEFLWKRICRKLPKLIKNGTILGFESMNEPNSGLIGYPDLSRVPDYQQLRVGTTPTAFQAMKLGMGFTCEVDEYHISVTGPRKTGIKIVDPKGARAWISRATAQKIDKHYGFKRCTDWPIGKCIFAHKGIWKWTDGFDFNSLQELTQEQRLEVSSKCQMLDPEHFSKLQSTGRIDAEYFVNNHFVDHYIAFKNVVRKIYPDLFVFMLTPVLEIPPTLKLDDRNIIDKKTVYCPHYYDGLSLMFKCWNVKYNVDTLGIMRNRYLNPVLGIVFGERAIRNCLKKQFMEMRNECNTHLGNIPILMSETGMPFDMDRKRAYRDGMFDSQTAALDAISNALEGANMSHTYWCYNSANNHKWGDNWNNEDFSFWSPDDRLLTFDEDCNENQSISSRRRRRRSFKKDPRTALRRAVVATKMGLSASRGSTRSAASESSFTSEKDSSEGYESDDTSSQCSLITSHSLNIYHRQFKKCYPSPDGVRAVSATIRPYLMATKGSVVAVEFDIKSVKYSLLLSIDKSDLSLETTPSIIFVPKWHYPFLDYGDIYLTSGYVKYNEELQYLEWYHSRDPTLPEDENETTQGISTETIIIKNNSGSLEDSKLVEEKGVFGNEIGCPVT

SEQ ID NO: 15039 - protein, 452 aa, Candida albicans
  UNSURE (361),(402),(413): Identity of amino acid sequences at the above locations are unknown.
LTLPEPQSLQPRKKNLEAHPRLLIYFLLLYQLFDKMSHQQEDVVDDTQEEYINVNEVAEEVADDDQAPPDEEDEEMELDDEHETLEIDMSNNSWTYFDKHTDSIFTIFSHPKLPMVLTEGGDNTAYLWTTHTQPPRFVGEITGHKESVISGGFTADGKFVVTADMNGLIQVFKATKGGEQWVKFGELDEVEEVLFVTVHPTLPFFAFGATDGSIWVYQIDESSKLLVQIMSGFSHTLKCNGAVFIQGKDENDLTLVSISEDGTVVNWNCFTGQVNYKLQPHDDFKGVESPWVTVKVHGNLVAIGGRDGQLSIVNNDTGKIVHTLKTLDNVDDIAELSIEALSWCESKNINLLAVGLVSGDXLLFDTQQWRLRKNLKVDDAITKLQFVGETPILVGNSMDGKXYKWEPRTGEKXFAGVGTNMGSYGLCYFKIEVKNWLLLVDERCFHWSLFMK

SEQ ID NO: 15040 - protein, 154 aa, Candida albicans
SDTLYQIINRLITMAKGKGKGKGKGKDKGKSVSNRDNYAKISYLYQISNQFYLAHPEYQALSRGYNRNLDLIAKKTVIKLSPHIKRTLCKKCNTMLIPGLTMSMYIENLSKQKSQHNDVFVNKCLNCGKCKRFPVGKDRNYILFTDKQNENIPT

SEQ ID NO: 15041 - protein, 240 aa, Candida albicans
LWILDLLNLDYEVKIYLRHPETWRGPLQLFDAHQLGKAPVLEVIFGDGRPPIKISELGFIIQYLLRYYDCQNILYLANLDQQLEVDYYLHYSEGSLQHIQMALLINSSAKHIAPFATKSVVKLVTKAINNGYYKHEWFLNMKYLEDRLEQNGTGFFVGDKLSGADVILSFPIYENVFDNLEGTKEILGDKVNIKKMFPNLFNWSRMIKNNLSYKKITELMNEEVEDLIALNPRFDYGREK

SEQ ID NO: 15042 - protein, 253 aa, Candida albicans
QLIRLDDSRTHRILWLLEILQLDYEVKIYLRHPETWRGPLQLFDVHQLGKAPVLEIIFGDGRPPIKITELGFIIQYLLRVYDKENILNPISQEQQLEVDYYLHYAEGSLQHIQMALLINSVAKHVAPFATKAVVKIITKAINNGYYKHEWYLNFQYLEDRLAQNGTGFFVGNKLTGADVILSFPVYENVFDNPGGVREICGEKRDLRKVYPHLAKWSRMIKNNPTYKRVTEMMNEEVEDLIAMNPRFDYGKEK

SEQ ID NO: 15043 - protein, 256 aa, Candida albicans
FARHSSPFILLTRKYVRLNYSRSQRVLWLLGELNIPFELKVYLRNKEFRAPKELENVHPLGKSPVIEVIDSKTGKSEIIAETGHIFNYILSNYDTTNILIPFNRDLQSQVDYFLHYTEGTLQPKLVALMVHGVAKKKAPFGARFLMGLLMGGIDDAFYIPDLKKNLKYLENIIHKQHEKGSKYFVGDKLSGADIILEFPVITNIFQNKRGAEQLGAGDVEKEYPHLNQWAEDIKKEPKYIKAQELVAKHETVKPNI

SEQ ID NO: 15044 - protein, 258 aa, Candida albicans
LHYARHSSLFILLTHKYVRLNYSRSQRVIWLLEELNIPFELKVYLRNKQFRAPKELENVHPLGKSPVIEVIDTKTGESEVIAETGHIFNYILSNYDTTNILTPANRKLQNQVDYFLHYAEGTLQPNLVALLVHGFAKQQAPFGTKFLMGLLVNGIDSMFYIPELKKNLNYLEDIMRKQHENGSNYFVGDKLSGADIILEFPVITNIFQNKRGAEQLGAGDVEKEYPHLNQWAEDIKKEPKYIKAQELVAKHETVKPNI

SEQ ID NO: 15045 - protein, 89 aa, Candida albicans
AKRGSFQPPVVKTPSRRAALRLGFTFEGIFRQHMVIKGRNRDTAWFSMLREEWEGGVKGAMEEWLQESNFDESGGQQKSLEELRMGRQP

SEQ ID NO: 15046 - protein, 292 aa, Candida albicans
VFMTITFIPGEVNKSNYSVAHSNWKNHHIIAYGSGNNLIITGGTVQPTNKNPNPFNVDKSLQTIYLDRDPLAIDINPENGYILVSIESKILVYKPMNEYMKIPKWQLSIEIDVNESTINCIKWASEENEIVVGTDSGLYLFYLYEEYGELKYRKRWQANQVNPVTEILVTPNSKMIMTKSGLFDRLIKVWTRISYGDENTLFEVTYLPHPQGTFVIDYHLKKQITEEDKKNEIDASMANIKNIRDYLNNATDEGEVIYSFCSDYKFRMWAACEHSGHNQINNWATLDLKEVS

SEQ ID NO: 15047 - protein, 950 aa, Candida albicans
FEGSFLKISTVIVIENYHLRETLIPALKNSDCTLFNGLDINDLDLLFVVSDTAEVKIYAITNISQCPPTKILFTPISGNYHFGKNEYPLINTQVKTEKISSSYIESEEFITTVLKPLLVKEICILNERVPFLTFLLHDRVKNTLRFNIMNIEKLARGSKLESVLINKYQGHTKSIRKLVKSNSSFSQNNVLLSILNFPQHNYIWEPMLLQTNTMSVTKRFQINVESGIVNAVIINDVEPPVDWKRRHIVVTTGRNNEISVWDCNGSTNDDQPADLITKVKTGVEKDPLVFVLTEYPDNTQAERKYCVVALYAHDQIKSWKLSLHYKQNKITDILFDEESVASLPQEEEIYQATAVDAFVSEANKSLIAVISKNGLLKSYSLNFDESIRWKKVSELETNVSAASKIHGSTVINKFAVVDSTGYKLSIWDVMQGVLEYEETFPESNGPVTDLDWTFLSASKMKLTSNALLSVGFSRFVLLYTQLRYDYTNKIPAYATLKKIDISDFTSHEIGDLIWLDGGYLIIGAGNQFFIDDTWVKLGSSAIDSTIRQLMSGYTDDDEEMVSDISYLVRVLNGPLPIFHPQFVIQALFIMQFTAVKKILVQLFQVIRIGDVITWDLNTDVDNLFRNDEIYQPKRTMSLTLDTFTEYNDEVADLLIDRLMTISLPLLTRHQQSTLISTIVIVKDFTKDMLVELDPNGIRYLILLKLSSTATATSTSSATTKKRLAQIQWAMMCKTPDILLEHVTKHYGGKIKWKEMKDSGMPFWVEKNSFTKLFEKMAALEFKDAPLGRICLYYLLLKKKDILIRLIKHKDDKEKNKIIGFMQKDFTQASNRSSALKNAYVLLGLHRYLDAAYFFLLADAPKDCCRILADKVDSDLAVAVAKVYGVEDIAENQLLISNMDYLHDPILLLNSDNFYKSELSETLIRICMIYTRMGCDYIALELLKNWKFADK

SEQ ID NO: 15048 - protein, 380 aa, Candida albicans
  UNSURE (2),(9): Identity of amino acid sequences at the above locations are unknown.
TXYCIYTLXKCNTQNFITVRWLLQALVMLPPKSLSFENVISCTKRLDPNILKDNSIQSTLFQLICKTIDFNYKSLVYVLSLFVSLLSGRNTELYTVLKSLFQKFSKHSQLYFEVFDFFTRSIDAVPVEFNLSFAQIASIFLSTVPKDADANRYNSKCFTFYVNALQSGNECVAMQILTSLKDLLTNQSWIFKQNLLEITLVIVKTGLQKLNSFANQEQIYILSTQIVSHILLYHRFKIATRHHLVLNVMSSLLKYLADGTSKLSSNTEAASAYARLLSNLCEPSERVGDKMFHLTTSASYFKKLLRKHLSVLLSNYIYFNLKYTFTRTVNDAIMPGIYSMFTVLSQNELRVVNDSLDYGGKAFYNTLYNDYKDHGKWKDQ

SEQ ID NO: 15049 - protein, 487 aa, Candida albicans
VVFFSFSILQNILFFDSTIHIYLPLSRSLYLVDTHFLVKMGKDLLTAEAVTKLLRSKDTSITEIVNTANSLLNNTLDIYLPGKEVFVLNLLCDRLNDKSNGKFGKWKFNKDVWNLLLLVWSKLNHQKVDRQRVIQRLKIIEIIILVLQQNNDNEVFSSLFEFLGIMFQESYIIADENSATQLLKCFVEHMDVLQASDSIVSWTELVRDIYTRACLKISLEGSKKFYNKFFEDCCFPLIEYLAISEGLSVSPILKELLIQGVFNADSTKYYQSSLERELKKKDIKEVSVIYLYTLTVQLFSAKHMEICEGVYSIMASKCPDLAEKLLSILASCRKTISKPFIELIYKVEVADKPFKQLNWDMVKHIFAIDSELAISKSGFLFKTYKSEFQLDDKVVPVAEVIVDGFARNRELLDFFTKVWPKAIKRDEIWESDEFIHTVSQHVKTFSGKQLIDVIESSFYADKGSQRAIFTAITKGLTSSSANLIDAV

SEQ ID NO: 15050 - protein, 148 aa, Candida albicans
YKTIMNPLNKIIFLSAFLASGFLLILLSCALYNNYHTLWVILIFLLAPLPNLIANSIELARDYNFLTFNDYGNSNDSTQSPLQEFGKYITGFLTVSGIALPLTFYHCGLIELGATIMSIIGGLIVYSDIIIFIWFFNTEEEEHDDFNF

SEQ ID NO: 15051 - protein, 253 aa, Candida albicans
RSVPEIYRLDEELVIKFSSTTQLSRRREVFIKNINKWIETHQELNTIPPKKSSYTTEATFELCSSSLPSSPVSFLKTSPNKIIKPRSANSSPTKIKNRSLNFSDLKNDSSRFKFKEKLESIESNKFNGLSLLERIKLKEKLRKQQEQDEISKQQAPQDKYQNYLLTKIPMIYNAIYQLYQCQPNNCKTFSTKKLIQTIQDSSSYPVIPDEIHDGMKLLSTKLPSKLDMIEKNDIKVIRVTHLNRDQDLKILDI

SEQ ID NO: 15052 - protein, 289 aa, Candida albicans
ENRNITSYYSNRTTTPPIHSKTTKTTHRNMGSKNKRYSYLPASKNDHFNAENEIKKYHLDVSTFDVIRVNNFRNYNCSTLFWYFYMWVLIFLSFALLATDIYSCLNILVFHRWASDDYKPYAYSIAKWIFTGCIIFQFVLLFYHWIWAIHIARTRNIALVYLNSIAKRLYLIKYYDNFCLLNSINEGHFFDWCCFLTYYEIDNALQILVADTPRQVINILTLRYYATGGELNNNILNNIEQIANTNLYLSIILSFMCLSVFILCYILLEVCIWDALLHSIKDPIEQRWL

SEQ ID NO: 15053 - protein, 246 aa, Candida albicans
KNIHMDLSNLSNTLPLDNTRPGNTTAVHSSTPISNINQDLTNHFKDAAKSVASLYNISLNNTVDNNVNNRNIKTEFANAAKAVASLYKLGQSSQQTSYTKGYLQCLDDLLAVLTNNEDIEDWVLTRRIELMNHMTNPNSKPPSSGDASQHSESDPFSIPHDYEFTFNLDMKPPTHFRPSMPPLSVQHNSKQRASIGNHHLKHSKKIPFSEDSIMVDDSDNEDKEVKQQQLFPKYLKESPLKKKRKI

SEQ ID NO: 15054 - protein, 277 aa, Candida albicans
GENFVFESHKERIDKLRDNYEKSKIDPVVEFEKLTQGSNSYKPKPIIDIPLSDFEYEKEFVLESIKNLEAKPELDQHQKSYLWSMKKSIAIQESLDSETRYFNEATMTVGNGNEDSGWHYDWRFFNGKLRDGARTAIILERLLRNWFRFTEKYGVVSWIAHGPLLSWYWNGAIFPYDNDLDVQMPIKQLARLGELYNQTLVVEDLREGFGKYLIDVGTFIHNRDISNDGNHIDARFIDVDTGVYIDITGLSNVLVNRASRYDGRDIHDRSSPRAEDP

SEQ ID NO: 15055 - protein, 820 aa, Candida albicans
LFTRKPKKPTLVMADFRQFRNIFLVVLFFNLCYFLKIYRNNKIQNEILNFRHSYYNYYNDDQISIGYLKEEDSLPEEQELLQLLHKVKRNENNTYWLANTTMEYPSIMLNALDFLPPSENEPQYITWYNNPKLYYEPRLTLAVYLDELKHQLKLHNPDNSKTKDHMIKLPFSWSDWVDLTMLNSEIMKPIGLKNNCEWLQKEANKRTRFPDFCKDLVDLSDEEIDEIGLSKDQLPGFIVKSSPMNKAPHMEVMLQGKSYLYTQQENPLTLVFLTSNGTYEAQLTEKREKLLQTDLFHRFLKRRKIDCKQAHGVVPVEFNPQSEFRKLLRAIPPRPLDPKDDLHGISKIVSNKGDRNILRQLNLDPSTFHYTQQNVEQQIASYETRLSKIEKVITDELNYDLNVLEANRLTRHELNHYRGLKYANSFSVDVEPTYYKLATLKKNQYNLDSGWHYEWRFFNGAMRYLKDETWSYEQMEVREQIILDRLLRNWFKFAEAKGIVSWIAHGPLLSWYWDGLMFPFDIDIDLQMPSSELNRLAANYNMTLVIEDLNEGYGKYLIDCSTFIHHRNVAGRDNHIDARFIDVDTGTYIDITGMGLNDEKPPPQYDNYINEKTEANESVELYMDRRKHWLNYEKINPLRYSMLGGVPVFVPNDIMSMLNHEYPRGTKSHYYDGYYYVPLLRLWLQESKILTAFKPEQYEAVTDEARQENILELIKNLRHEDAFQLLTLSNDILIEYYLTQKYTGLHVREKQLMMDEASERLILDLEHNEQYNSLTSNFYIGPPLRKCLFDFEYYGRFKHMAKQTVSTIVENEKMEESKTF

SEQ ID NO: 15056 - protein, 214 aa, Candida albicans
RQPKALGGSWVIKESLPLLEKYFKEDPLLEIRQTCELAIERIHWENSEKAKNEVLEKSLYTSIDPAPPLATNDSTSKVEKLKEILNDQDKPLFERYRAMFRLRDIGTDEACLALASGFDDPSALFKHEIAYVFGQMCNPVTVPSLIKVLKDESEAGMVRHEAAEALGSIATDECLPVLQSFLNDSEPVVRDSAIVALDMYEYENSNELEYATVK

SEQ ID NO: 15057 - protein, 458 aa, Candida albicans
KDIVHKFSLLKYCVSLVIIIITITIVLSVTFQCMRTEHRRTEKKKYKINHSLLLFDLKPSPILYTANHHTMPTPPPTIICIGMAGSGKTTFVQRLNSHLHSKKTPPYLINLDPAVLKIPFGANIDIRDSVKYKKVMEEYNLGPNGAIVTSLNLFSTKIDQVIKLIDKKQDKINNVVIDTPGQIECFIWSASGSIITESFASEFPTVIAYIVDTPRNTSPTTFMSNMLYACSILYKTKLPMIVVFNKTDVTKDDFAKEWMTDFESFQMAIQKDKDLNNEQGSGYMSSLINSMSLMLEEFYSNLDVVGVSSYTGQGFDKFMEAVDNKVDEYNEFYKAEKERILKQKEEDEKKRQTKSLNKLMKDMKMKDTKGDHTKKDSEVLSDYEEDDNEIDDEIQGEVLRDEDEPEREYTFPEDRQSEVNSRTDADLQSRYQQAFESTAKPASSKTAENIANYINRTQ

SEQ ID NO: 15058 - protein, 289 aa, Candida albicans
GTIVRSISNSIIAIDNSSTDQAPYNEAFIVNNKHSVIDYQEIYSKCDLNLIIQGNNENNFKLIELKNQQLKSQDDWIILQDYNLIGWIDNFKLNIESIDLLDKFSSLKVNGNGYVLIDGGSNEVYELDLDENEDMLVNLNSLIAINKPSSISLATDLKYQVIPYFNGIYNPISSYVRIPKFSIPKYGITSEVFNPIRKSIHTLTNNYKKFVQNIKTEADKYHWLTIIRANTTKIYQYIYSKLFYNSEGILLRRNPIFMKIKGPAKLIMNNNETINNNRLFTFKEIKSIN

SEQ ID NO: 15059 - protein, 182 aa, Candida albicans
ILNRREKNGMRLSRGLFFSLLFLIPSTQIHFFFASHFFFFNNNYYHSWLSKSNTNYYYFFLPKSIYTQTFNTMGLDHPAFTLSGLCAIGGIMGYARKGSFPSLVAGITFSALYGGAGYLLKQNADYGLELALSTSTVLLIAGLARSIPTGFAKPIPLVLLVLGGASTAYYAKKYNEFYPLFN

SEQ ID NO: 15060 - protein, 398 aa, Candida albicans
NFKSVSSKISSQTFPNSSDMIPMTLLLKVTLWTCHIYIFVVVFLPFSVYFTADRTNFARKKIEPIQRAEKNAQLKNVLEIHHSNQTLTTVYHPLNPMSSDPILVKKKLLQIASTGKYATFTPEQLHTHYEELQDFLILNQDSLLDSIELFNLYELQFYLSILTLHDIEAKNVLDKICDQFDFKDSNKNKGRSQRIKILQSVYVELKGEIETASKLLSEDPDELRLLRRLTTLSRHDKNPTKYINNLIYYLNLQPSDLIAWAELSEQYQKLGNYDKSIYCLKEVVLQNPLAYPIFYKIGLLYYYLFLQNEGNLKTDKKDKLFELMKILINSRDNYLYSLEINDKYEKNWVGLKTIASLPFNDKLKKISESSKEIKDYLNYNEKLTPIIDRKLKELNISI

SEQ ID NO: 15061 - protein, 350 aa, Candida albicans
GFTSAMFSIKGYRNIASKALVRRNLHTTTLLQSPRFVNSNFNSRTRVTKEISPEEVRQFQEAQARAREQGQAPRNPYSHQFNNDPYYSFHLPDNTNGIITPHDPIYDILKEPTLVIERQIEFMNLFIGFEQANRYIIMNALGERIGYMEEKDVGFGKMLGRQFFRLHRPFDIDVFNARGELAMSIKRPFSWINSHIKALLPGYDHNNEIMYEVVGESVQSWHLWRRKYNLFKLEDETTDEYEQFGAVDAPFLSFDFPVKNAAGEVVASIDRNWVGLGREMFTDTGVYILRYDPKSFEGMEAAYGTISKQGITLDQRAVILSCFTSIDFDYFSRHSGGHGLFSFGGSYDDV

SEQ ID NO: 15062 - protein, 273 aa, Candida albicans
LSSTLDLPQLIMFNCISRGVFASSTRFTRVARFLHQVPKLESHETWTQEGIPGFLSPKGYNLAWTDYQNYLLTNLTLLTNGTSLEYKTPYQTLLHTAKQTTQQHVFHYASMAHNNHFFFQQLDTKENASKTKPSRFLMEKLMHEDILDLDQLRNKLLTMAENTYGQGWIFLVETEDKNLKFINCHNDGTPYYYAKQQLLDLNGGIDEGNFSYLENLKSRALNNEKDYTLPILAINYWDYMYIPDYGVTGKSDYLNKLWDHINWDVVNKRLFQI

SEQ ID NO: 15063 - protein, 162 aa, Candida albicans
SWVSIILHYCEYYRITSLSIEGIPKHSQLEVPLSLLSSIFINKTINRQVNSDFQKLIVIHLIHNKKAEFINPKKPELGVYIYWRSLVDWGDLLYQYVDDTGQKGTVLTIYELTKSEETTVPQDLHNLDETFLVKIIKDYLIKQGKAQLLIDENNEIGGVKIV

SEQ ID NO: 15064 - protein, 466 aa, Candida albicans
SIINLKTGRMDNVFKVENVILNRRGYHIPGTLILSSFHLVFSFTSNTSTSTNPKEIWICYPMIEKMSKARGSSWINHNNGNSSKTRNTGSQVDNTPKIVMKGFDHYSASHIRLQCKDFTYYSFDFMNDLICSEVFTKLSSLITISKTENDIKQLYAYSYKPNMLEQNLDVKGWQLYNPIEEYQRLELVQENSQYWRVTNLNTEYKFSPSYPKVLIVPSTISDNVLKHAGKFRSKQRIPAIVYKHKSGINGNVIARCAQPLVGLNIQNRSIQDEKLIGEIFLCQERERKDKIDNSCGKSNNVDDEFQREQPQRNLLVDLRPVTNAMAQHALGAGTENVDYYRGKQNLNSKESSKDKGDGESISSQRIRHIDKIFCNIDNIHVMRDAVNKLSSILNDLDRYPATYDKLSASAALLQQALTKTQWLNRLSIILQSVDRITKSIHLNNTDVIVQLFRMVGGYRPGGCQSA

SEQ ID NO: 15065 - protein, 175 aa, Candida albicans
NLSAYPATRGEDALVQDENNQNELNSGQSLESSMYGESPQNDNSQSVTSIGSGAAASVSSFFQRAARAAREIKNTAQNGLSSSPSPEDGADGSGYTSSSSIYSGSSEKSPIFHQFLDCVYQIYRQNPTQFEFNSRFLKRLFYHYYSCQYGSFLCDSEKELYEVYKVQDSTVSVWE

SEQ ID NO: 15066 - protein, 131 aa, Candida albicans
IPTVMTLLTAERLVRLAYKYPSLSNTWYLIATACLTVINQPDEIPKLYHFALRQQLLQDPKSSSSSTSLLTDKHLIQLAQDSIDSAKKYQDLTAVGINLPDVLIPSTYYPDLPLRFPIFHKRKIFPFSKIN

SEQ ID NO: 15067 - protein, 386 aa, Candida albicans
  UNSURE (370),(371),(382): Identity of amino acid sequences at the above locations are unknown.
TSPPATLLSPSPFSYSSDHAFFLTYSSLLLSPLTFLPYALHYSCHTLQCGPPVRGKTATTTTNPSITPELLLKLAYSYPNLQNSWYLIAVATLTQLNLSEEIPKVFHFALRQQLLEFQNDSSLLTNETMLKLAEDSISSSERFPDIHQTGVKLPDVLIPHTYSEKLPLNYKYYQGKDIRQTQQSIVDQIREVLLKISMFSGLPKSINSLLILKSVTPTALTNSNTDTNISLPKRKNIVEPIEENTTTNTQNVVDTIGGKISNGSIVVDQIVTNLIEGLEYWNKIYSNKLNIRIKKEMLRAYPDLWYFVYHHIYGPLISFTEILCPQKTSFSLIACMIPQDVNSQLKGHLKGAINNGATKEEVNEPIVFTXXEVATIARILPXNGGG

SEQ ID NO: 15068 - protein, 319 aa, Candida albicans
LSPIGYYTSIVSFQFIQTIASLLAKIMVLSYILEKIPVVTEDPFLQYRPFPEVPKTLFQKHWHEIFASFTFYFIIQQLSGPIFSIIMGPRYTKLSRSTRVNFDVHVTSMVQCFVSFALMVPHLNNPHWVNRLNDPANSLLRSTDFGGLVCALTVGYFIWDLYVCAKYFSLFGVGFLFHGFAAMYAFATGFVPYCQPWAGPFLTFELSTPFVNINWFASKLPAGTFSEKTIIINGILLMVTFFIVRIVWGFYAVSQLAVDMLASLDQVNKLLPISLLVLNFLLNSLNVFWFYKMVMIARKKARGQESTREAAKEVREKIE

SEQ ID NO: 15069 - protein, 171 aa, Candida albicans
SIVMQFLSAKILLYIRVFALVVISFFLIKDPDALSMTGFIVLLGQAMQVPLIRLTPTNPLLGMASIVFISLALSDLIPLLAENWSYFENLVPIRLLGYFCLAAYIYFVPTSIVSNSLVITYVLFEIWGNFLIYNNLRDEKYYRMKKFVEENSEAIRTAHDEQVRVVELDEQ

SEQ ID NO: 15070 - protein, 435 aa, Candida albicans
  UNSURE (56): Identity of amino acid sequences at the above locations are unknown.
FCFFLKIVAMNWTEMESKVVEATNNEPWGAPIKLMPQIANGTYNYREREEIVAFIXVEFTEKAANEWRQIYKSLQLLDYLIKNGSERIIDDVRANISLIQMLKSFHYIDSKGRDQGINVRNKSKNLIAFLNDDNLIRSERKKARANAKKFGGVSSAAYGGASSMGTGFGSGGSTFTGDDEDFANRVYGDGGVYGERFDDPASAYNNGATGNDNFEEYDVQASSSQATSKPTTSSSRINAKASKKEPQNDLLGDLLSFDGDGQQTSTNTATASRGTGANDDDDDDDFDDFQAAPSQPQKPANLSNNLNNLYNPSSQQQNQAVSGPNYNVNYQASQSTGPAKTTSNNDAFSSLFSSAKTKSKTSTGNTSTSSSTTTPAAAAAASVNASNPTSSANDDFFGGFSSNNNSSSNNTNTKPATNGNGTNNTNSGDIDLLSF

SEQ ID NO: 15071 - protein, 327 aa, Candida albicans
TTLTMNRRFFSLIEQRVPAKYISFTVDDLKYDSQLEFVNRIQTVLPLNPYYVKTVLKEYIKHIESSNEDTSDELYELYCDPDVLNSKELNPEQTDVIKYFISGFNQQYSGDGKDTITIKETPKLISGSNTTGLRTWEAALYLSNFLNGKDSPPYNLKNKTVMEIGCGTGLVSLALAKNYHRKIDNIKRLIMTDGSSNVFDNLQETLRLNELNDSSIIQCQQLIWGENTTIEDDVDFLVAADITYDTRILDPLCQTIQDLFANNNLQFAVIAATVRNMDTIKEWELKLDVWFAGKWLVRATESDPHSIQSNCWFNVNTPQIRIYEIHV

SEQ ID NO: 15072 - protein, 231 aa, Candida albicans
RNHSRPEFVTVHYDRVHNPEHCYHIRLQWLNATTKFIEDTITAWTRLCERHGLKLVETPWNELCSLPKLSPFHSFVDIKLLVNPWTDPDLCDDRILSSNRYYYHSYFLKQMGYYLDNRSTSFFLRENIDIGYSWGKPTFRYAQFIHKTGFYIVELRDNGDFFLAPNNMHLTRVRSSTTLVGDYENYSKGVLADSQTVMLNFRAACQNKEFLKETFTLAKSNWKDDYFSQII

SEQ ID NO: 15073 - protein, 221 aa, Candida albicans
  UNSURE (1),(3),(4): Identity of amino acid sequences at the above locations are unknown.
XEXXYNMIRLKRKNLAVEIDVYFYTGNLYDFLNEEAPNYDIPGTQPALMIPESSRFNKTIKLPELAQELQDRNTGLTLVDRTWHFKRHLYCFVGSELVSWLVDCFEDIETREDATTYGQNLMNKGLFKHVELRHGLLDGHFFYEFLDEYVDKTDREKPSWFGSKKIDGASTPQSNSSPRIAGQNDLQKIISALNLRSETSSTTDSMGRKRKKIIFKSICEI

SEQ ID NO: 15074 - protein, 835 aa, Candida albicans
  UNSURE (801),(807),(810): Identity of amino acid sequences at the above locations are unknown.
KDLFNLDSVQVDSVDIFIKDVHLSRDAMWNFSASMIGNCVYIDQRLLYLGSRVGVTTHIYKNGKNVTSGYVDKNTKIIYRSESAKITLFVQLSREMWHFEEDGEIMFHKLINNLFPKIFRRWRETNTHHSITIVLFTSIDLTDIPWTNLGPGQRPPQRRDFFRVVVDQVNSMHWDRIMEDLRLEFANFKRDTMLNLDDDGKFIIENGTLPAIKGNLLEAVNLGLTSLNNRFQNTDLKHSISHIMVITPGTGLFDVEHDLLLETSKKMSSVDSSLDIICLSQPPLHVTPLFRYIKEGKVCHCVPLWCDISFFIDKVQQESQWIPRCKIYELQMMGVMENEASDARIPRLHLNNYGKTLVEIMDEYDSAVFKPIKRIPKPAQVEFKQVKPKFQAPELKNATATLSLMFENKPLLQPSNSSTISLATGTVANPSKDTSALSSLYYINKNSEEIKSPAPSVRSETPVSTIRAIDSYRKSAGSPRLIRGETMFKRKEEIPNTEPPSALSEKNAASARKKSSILAEPEQEISTGSFWIEISNPSQETTTNVLQRSQSSRWSNIFPNKIQRKLIKWRSFQAPASLPTTTGVFPSTNQLQTDYTFQIYTVFLNSDNYWELKSTHSLMREMIQLRLMLGFQVCYGERVDKAEAERKPSGNVDAIIKYFPEEHNYLGSRIYLAFGDEIHRIFCDYNGNINVQLYRKIIENDEKKITLGQTKLKPYFPLIRTRYTDEYTPARIDAIADNPQKFNWNQFDQLLAGFDDAMPEEKKQFHKMKFVVMPTDIPKNAYFVSNEKLTPEEIRVESLRXMIGVIXRSXIQHDSSQKKKSRRGNRCLFLYWQFI

SEQ ID NO: 15075 - protein, 148 aa, Candida albicans
DKNQHSKTTTPLYNPPFTQAMSYSGNRVFRGKKEHESYDKTLAGRYVKLVKKNHFLFFGLPFLVSIVAGSIYLQKFTSVKWEKYYEKYQQLCEEEMLNLIENKRTVDKKNDYYRLQGLLNDHTNQVADDYEIVRVQRRKEDEPVWDRQ

SEQ ID NO: 15076 - protein, 329 aa, Candida albicans
  UNSURE (232): Identity of amino acid sequences at the above locations are unknown.
ILFYLHIRKGVYLFQIYFFFFSPLLHASHRTAQNTFLRRASNFSKFIIQFFDIKVPLRINKPILSNMGKTKSRGRRAEKKNKKNEPGFNEDVSNLDSDVTITNQEPLSSSMSSTSGIPNTFFGLVDNNELDYFKQAESTLNINAFETDEERQGFINSVLEEAQGKELKLVTNQICSKLMERLILFANHNQLKKIFKQFQNHFVSLAFHKYASHVLETLLVRSAALIEKELTXTDEEKLEEAEEEEAEEEEAEEDGLNNDVPMEDLFISMLNEFKPHLTTMIDHRYASHVLRLLILILAGKDFQPSVTFNSTFKIEKNPKLPEKLMEIYR

SEQ ID NO: 15077 - protein, 107 aa, Candida albicans
FYTIKVKESTYGRLVWKNWGMELFVRKKYDWKALIKQQEQEYYGETEDSTEKRTKKPIELKMERLAEEKRRQEEMAERAQSGYTKRKLEEATGTASEKKQKLRGRRR

SEQ ID NO: 15078 - protein, 217 aa, Candida albicans
WKQHINTNSKKFDKKWNHQKYFFSHIKKERTKKKNYTYNPKSHLKICKPLQYKTMKVLTERDSFLSNYEVLQHLQNIKKKYNWSFNPNDEKFMKNKKNKHHFTGCGINLEIITRDVLSCLENNESSLIQSTKSFKQLMEFLNQFELMKVEKLQIVNSLPRSLVVLYALVEECEDRFGEETSESIIEKINELFPIQEEEEEEAGEGEGEGEEDAEINE

SEQ ID NO: 15079 - protein, 570 aa, Candida albicans
DNDGIWNNDLEELFLNALETELDKVYSFTKVKNTEVNRRIKESEFYVYEVVDALHRYENHDPSITNPPLEEDFQDLEEELSDIIADVHDLAKFTRLNYTGFQKIIKKHDKTTKFTLKPVFQARLNAKAFYKDNYDNLIVKLSKLYDLVRTRGNPVKGDSAAGGGQQNFVRQTTKYWVHPDNITELKLIILKHLPVLVFNADKEFEPEDSAITSIYFDNKDMDLYYGRLRKDEGAEALRLRWYGGMKSEQIFVERKTHREDWTGEKSVKARFALKEKKVNQFLSGELTASQVFEKMRKEGKKSPQEIDNLERLAKECQYRILKEKYRPVMRSFYNRTAFQLPGDARVRISLDTELTMVREDNFDGYDRTHGNWRRMDIGVDYPFPQLPEKDVCRFPYAVLEVKLQTQMGQEPPAWVRDLVTSHLVEAVPKFSKFIHGGATLLTDYVNLLPFWYTQMDVDIRKPKIQQEYGIRRNAPLRIESSTSANELDEEELSGYSGSGVQFSNDINPLEEDLEETSPLLFQNSHRSRQGNSFFNQLMSYFKDDREFTVKDRTNFDLNGTFKDKLPNGIS

SEQ ID NO: 15080 - protein, 313 aa, Candida albicans
  UNSURE (21): Identity of amino acid sequences at the above locations are unknown.
HLTQSPLASLPEIKFKQQQPXITSWGNHPKGAAMISPSLVGSNEEENAPTVRKSLDSTVTRSKSLRKHSTVASQFSSNFAMNGWWLEDELPDELASQLGSDLVYEVDSNALAKRGNRTVEYKDYYILWYDLSQLVIEVAYDVNDSENSARLINQYVKPTPPLGTGQAFPILDQATQLLGDRVDNDLVRYLFELNSDILPIIGNKSFGVTVYKVVRTPSVNNSTKLGEVLPGDILYIKGGNFSHKGLIGHKSTTLGEGEPYTAVIYEFDPVKEKFKVIEQDQSGHIIKGSYKISDMTSGRLRVFRPVGRQFVGW

SEQ ID NO: 15081 - protein, 534 aa, Candida albicans
SLDTTMSSEDQFTSIQWDRDDGENTNNTPTDTTIKSKSSKSKKSKKSSSKKKNGNKISPLSTTETSDADDTMKEVTDQLESTQINDDNHEVDDGNKEQNVDANQIGNSDEDPTNSLLLPVNPQPKEPQEEKEDLQQQLQQPQQQLASIQQEPAPIQPPFNAVVNDESLSIQQQQQQQQPTGYVDISYYEKYSIKTTVTHPNRDLDTASKPFISYLVTTTTDNPSILKLTKEKKPKQGEEYLTFSVRRRYGDFRYLYESLSNDFPTVMIPPLPSKLNFKYLTGDTFSSEFVHKRLHSLDRFIRFILQHKILSQLSIFHLFISNSNDWATFTTSLKLKDSSSDESGIVGRVVNEDLITETVMNFLTPSKHKKETNKDILEINDKLKKLYENLIKLDKIFTKLKKKNHELGNDYDQFLNQILKLSSVQKGEDSIMTTNFKIFSDSLNYFLKSYNEMYRYIDENFLISLQDLAKFCLRFIQLIKLKNDKSTDLAVLQDFLNKELANNLGGSGSGSGSGGSGLHQPPNPVISSYHSAYC

SEQ ID NO: 15082 - protein, 391 aa, Candida albicans
HSWCQLIEILVTDSGINSLNFILEVLQVIIPKINDYFDVDILFSEEMVSLCVLLFDLYDQLTLADRKGEDFALGIERLIPLFQTCIAGILNSNSTPSLRSDLYVVGNKFLLKCFERESFLKQVMHIIKSVDKKFFQVICNDAIYSEGPSRITSTLFLESLVHLGTLVKVDFILNALIKNNALLLLVRSVKRTDAMIKLCQEKNSGVTLDHFIFDLMAFKATLYFFVRVAKSKNGALQLIQNELFSILHQSKFLQIDPDIGLSLRIEEVQDHKTVNVNVLLDTPLSITDLVDPYKLRSENTISYFEFLVPIFQLLTTVLLSMGPNYQPAIIQTRELMKSVNRLVVGVMKRDFLVETKQIGQGLYKEESHELVSLKELVKLFILIDSLAHYSV

SEQ ID NO: 15083 - protein, 376 aa, Candida albicans
NCYRVAEDSLFFISGFNQLLSPIVKNLNIKTERSKEIKSVYNTRFSPIIKGFLKFDNLINGSRFLQVDASIQSTNNPKFIDLPNVFVSDDSRIILTNLILTFLGDFVTNDSDPYIRYEIWRLVDRWMYQGLHSLPEDKKDDAFRHIKRKYISKKNVPINQAFSTNLTHLSQIGNFTVLVKKLLTPYADSNEAFTKYSLLYPCDLGSGYRFNNQLGIWPYIEFLMQNVFANSATIANKRDRVNLQLNLLELFSNALQEVDWKFLIDVAPKIIRDLKNFNGIFDSLIPGVQLDFEVFVKLHHSVAVINYLFENKTFSALFKLVNIGVDSVNESGESAALVSHALGLINSLLRVQNSFINKLLPILRNKDTQQQLHCGS

SEQ ID NO: 15084 - protein, 354 aa, Candida albicans
VARLCEAKKKEKFVDIFLSNHPSFFIYIPLNQRQRTRMSGIFNWSLDVFADIYNTLKFESNIDLDTIDFTSIKNDLANVLITPVPLDQSRSKLGDASKPVALPSGDEVKLNQASIEITGVLSNELDLDELNTAELLYNASDLSYKKGTSIGDSARLAYYLRAHYILNIVGYLVSHKRLDIITNNNQVLFDNILKSFSKIYTLSGKLNDMIDKQKVTGDINNLAFINCINYSRSQLFNAHELLGQVVFGLADNYYESYGTLNNYKSLVEFILKNISDEDVFVIHFLPSTLQLFEKLLQLGEESLVDQFYKTITSSILKDYEANNFSKSEDIDLSKSKLSGFEIVTNIPHGLRYAS

SEQ ID NO: 15085 - protein, 236 aa, Candida albicans
RVDQIYTRQKTYLDYIKCSLPISTSNQKMRSMILLAGGIICVGRGAYKEYLSGVHEGLLGPLEKPQSVIDEETKLAEEKKKEKEENPDKDDDNDEEQSNLKPVPLRYIKPEDYANAQLAPELDLSTVVKDDKGVPVFFEQPVYTFPLPNLVGFTNIPRKIYRYFTKRFLVDDFGERTATIVNNKSRPFVYKDVLMAKEEEMDWPKKWVEKGKERNSEWVQELEHDERVTSRMKVFE

SEQ ID NO: 15086 - protein, 220 aa, Candida albicans
DPQNKLHTSSTTTMPDANEVKPKKGWSNPALRMMGIPRISLPSRNWMIFWTVVTTIGGGIAYDKYEQKQMRKKWMDAVKQFGEVSYGADEIPRKLTIFIAPPPNDFLDESLKLFRKFIKPVLNAGVVDFEIFSESRQGDIRASVAEKIRELRRKQLVEETPKKNESNGNQDNDEEELKSRSDLYKAKDVLGLYKVFPADINVKSEDAIDDSSCWWYYMCW

SEQ ID NO: 15087 - protein, 232 aa, Candida albicans
HFKFNYFYSTMTQKSIKVCVFCGSSFGNKPVYAEEASKFGKALADKKWGLVYGGGSTGLMGAVASGCATNGGYVHGIIPEALISRERTVDEEAFNAKLKSSIDNHDGSTPIPDSKQYGKTTLVKDMHTRKRLMAQEADAFVALPGGIGLIDELAEITTWCQLNIHGKPIVVYNVDGYYDNFFKMIQGFVDCGFLSEKNGQIIKVANSVEEVLEIIENYEIPEGRFNLKWETT

SEQ ID NO: 15088 - protein, 221 aa, Candida albicans
YQQQLQDEARSQNIESIREVKYSVNYMSKHVQNTIHKITPLILPYMLPLTTVYISEYVINQGISPTLLFPLKEVPRWLISSYRDIYVVYGFLYQLGVFISRSSVTMGIRIKRLYLLSVLQFINVMITLYQSIYDLPFHLIWWLFLLIFYEGLLGGASYVNTFKSVSEQVSRTKREFSMGCVSISDSLGIVIAGCINWWLELKLCHLQVARGRDWCLKGGSL

SEQ ID NO: 15089 - protein, 680 aa, Candida albicans
LSHADLPAAWWKTILNVADDQDDSQGLHNQDSWVHQFRHANNKTINFFGDDTWLKLFQDQFTEFEGTNSFFVSDFTEVDNNVTRHLDDQLSSNKWDGLILHYLGLDHIGHKGGPESPYMKPKQIEMDKILQRLYTYVTKNDDTLIVLMGDHGMNEIGNHGGSSPGETSAALSFISPKFNHKGESPLPYNSDYSYHHKISQIDLVPTLAALLNFPIPKNSLGVIAKEILEIWPENQRIKILLENCAQIMNLYEAKYGPSGEVWTQWENLQAKQHPIADYYEFLQDIQSEMASSATNYGYKDIYAGALILVITALAVIVVFNRYFLTASNMNISSVMFYELFVVLYSLHFHGSSLIEEEHQIWYFFTTATLLFLAITFFDTFKSLQNFISFGVLFACIRFMRSWNNSGQKYSSQYNIAYYLSHSNPNLMWGLIILTYFVLTLCIYIQGSLVPTFAFSFGKRLPDVKDPGGLISFIVVFVATSVSFLFKLLQYYIDGNTIPKWLNRFLLWIIESHHIDLSSATLEDNELKFQLQSVSIQLSKFTTIILLLLVISRVIIGKIRKIRYGTITDITNIMTIYLIHQTRHENIPIFLALMFAKFALSKLIYRKTNRIDQYILTVTMTVLCLQNLTFFCMGNTNLLATVDLSNAYNGVKAYNVFLVGLLTFVSNFAGVLTSGLADRRK

SEQ ID NO: 15090 - protein, 150 aa, Candida albicans
SMSGSLNSRWVVQVSLTIINIIGFLVFLRGFFPSKVVLPGFNSFQDSTKSPFSDQYGNPQFNKFILMVVDAMRSDFCFSDRSNFLFLHQLINQGRALPFTAFSNPPTVTLPRLKGITTGGTPNFLDAILNVADDQDDSVFTTGLEGHALA

SEQ ID NO: 15091 - protein, 324 aa, Candida albicans
STMSNKKDQDSFTSDNSNNNSTKDSEKYTESIDKIVSNLGALTHSILDVTKDVGKDLNAKAKKLSDSWLSRIYDDEEEDGRLFEYPSFYQNRGYLEDEVKSHPIFGDLWNVFPFLQFGQFSGSFKSGSTPFGYYAYHGPSIRNYNECLTKNGKSVWDDQGYWRCLFPNSEVPVELLNFKKKYLKDEILTKEDFMSAMRKNSALDSFQGDGMIDLKEHGRFFDSYDKYLNWKNEQYNQRVKEREAKWKQLSLNKGDNFATSSSFSTSIKSDMYTDSETNEVKFTKVKTECDADGNCTVTRITKLKPVGSSVWTNEEENVEHVKKL

SEQ ID NO: 15092 - protein, 93 aa, Candida albicans
TSIPNLRAMRRELVPLWVALILKSQDKCSIVPPKWLTVAYLKERYQDEIRKPLQFSDLPWNWLELSKILLEKAPDELLDPVESINVGDSRFRR

SEQ ID NO: 15093 - protein, 67 aa, Candida albicans
RYGSENVYNHFTAIVWNNTNSLGCAYKSCDTTTNLNALYIVCSYYPPGNVIGYSSQNVFPLNSKMVN

SEQ ID NO: 15094 - protein, 139 aa, Candida albicans
NQRRARHGVPDLTCDVTVYQYAQKFGDQYSCCGNLQHSGGTYGENLAVGYADGAAALQAWYEEAGKDGLSYSYGFSSVYNHFTQVVWKSTTKLGCAYKDCRALNWGLYVVCSYDPAGNVMGTDPKTGKSYMAENVLRPQ

SEQ ID NO: 15095 - protein, 292 aa, Candida albicans
NSNQFIPTVLTALAFPLATTTMKITNTLLNAAALLAVTEAATITKFFTASTQTLFVTQTSQTVVATKSFVETIYSAPPKQLTSKTQDSTSPTTSSVNSLTSSSATSYVETTTPAPSSSTLTTSTISSSTASEDSDATPTADVEFAEEILKEHNVKRALHGVPALSWSNKLAEYAQDYANTGFDCSNLNLKHSGGPYGENLAAGYMGGISPVDAWYDEISMVDWNNVDFTESTGHFTQLVWRSTTQVGCAKMMCSTAWRQITVCEYLPRGNVIGLNVTSGHSYFVDNVLPPLK

SEQ ID NO: 15096 - protein, 329 aa, Candida albicans
VDKRDKSKRRTVMKFLQSFPVILAVFSFAANLVSSKLVYEYETKYVTVEIVTIVSGETTYTTERLETNGPTSTTTTIVIPSSKPSSPESKPKSDSQPMFQSPSPVQITPSTTSINNAPLPTKPETTVTASPAVIAHTSVFVVTPNSAPTTSSSPPNIVQQVKAAITPLAPKPQPQPQPQENNSGTNDDSQLSLFSRQILEAHNIKRASHGVNPLTWSNELYNYANKVASSYDCSGNLRHTSGPYGENLALGYSSGANAVSAWYSEGFNFGGAGKLNHFTQVVWKSTTQLGCAYKDCRAKGWGLYIICNYQKPGNIIGQELANILPLIRS

SEQ ID NO: 15097 - protein, 376 aa, Candida albicans
TFKLSNFRTFHYYQIILEMKFSQVATTAAIFAGLTTAEIAYVTQTRGVTVGETATVATTVTVGATVTGGDQGQDQVQQSAAPEAGDIQQSAVPEADDIQQSAVPEAEPTADADGGNGIAITEVFTTTIMGQEIVYSGVYYSYGEEHTYGDVQVQTLTIGGGGFPSDDQYPTTEVSAEASPSAVTTSSAVATPDAKVPDSTKDASQPAATTASGSSSGSNDFSGVKDTQFAQQILDAHNKKRARHGVPDLTWDATVYEYAQKFADQYSCSGNLQHSGGKYGENLAVGYADGAAALQAWYEEAGKDGLSYSYGSSSVYNHFTQVVWKSTTKLGCAYKDCRAQNWGLYVVCSYDPAGNVMGTDPKTGKSYMAENVLRPQ

SEQ ID NO: 15098 - protein, 555 aa, Candida albicans
NSHDVGEDDSSSSDNEYCDALEEFDIEDTLNLPPPQIHSSAQSVLSSIETSPSLAQNASDNHLHVSTIDEYIHSGVQLCFGILQVVLSLIPPAIGKVLSIVGFRGDREVGLRLLWRTAITCRNVHGELALLFILVFYDGPVQFVDNGFRLPDQGNDKKIISLDNKATVSEAELDIILERPELYTSQLLRRARRMFPHNALWILQEGRMLAAEGDLALATKTMQDFTDDPANEIQMQQAEALLVFDRATIYIYQHEYDNAARDLIYLIDINSWSKAVYLFMAASCYLEKYRMIKMDIISVDNKESEMAKYSSLFDKYLDLALSYVPGHGHNAVGKKGGIGGSNKQMPFDKFLLRKSRHIEARKKKYPNLPTADIVGTSLIHELIYFWNGYNRMSSHDLEIALKLLGYSGAPNSEYSANTNGNLYALIEETEDEAMIRYFLQGITLRQLGSINDGLGLLDNHVISKYVISEPLHQFRFHKMTYSPYIYPTALYEKTMFVWLLRTKNTAKLDVHQAVQESKSWLKRAEIVGEGDYELSNRTGMRIKAAGDRLEQLATL

SEQ ID NO: 15099 - protein, 293 aa, Candida albicans
YIVDNRISIFHISRSTAMLKGLRKKASILSLGSMASQQSTSSAINSESNYDKILTQVYDFEIALKAMDYLLDDRTKTGTDLLQNEASKNNNSEQPHAIFPLALGVMEFIEATLGFEPEVMAKAHKTLSEAENASLNNSKYNLKYQLATSMIYPPGTEFQVTFAESTLLNALLMLLTENNGMVESAKALFKLRRAYQTLDAVYKKIKELEPIFNKNLAKLKKEAAMQGNGTKSNSIITTENFSISTVDLPGYSSQTSSTSSLTARYFRDEEFGEDLFDEEIPNRRCYFTILCEP

SEQ ID NO: 15100 - protein, 1009 aa, Candida albicans
THHNTTDNPSNCLMNIPNSPLFAPQQLSNHNSTPTNSSNDKGTTITSTPTSKNHLNKSSSSSLAVLTPTLPEKPTVSTSSLAVYIVPSEQNLFVQGFEEHVYLSRPPTILRGSLVVKVLKPTKIKSISLTFKGIQRTDWPEGIPPKKNQYNEINEVITHTWPFLQGNINDKLPHNGADYFIEKDGTTHQGGINASFEDDLSSVRSSTPPPLGHLATSPSANLSPTRKSHYDEQSSNNATNFFTRNLSPSFIRRGKSSSISSMAEIGKASSFTDLMPSTSSPSPGDGHSNIIHFAPGDYIYNFEHPLPASIPESCNATFGSTSYYLEVNITRPGAFKTNLAGRLPINIIRTLAETSLEENESIVITRDWEDQLRYDIVIGAKSVVLDLYLPLAFRFVPLWGKVALHRIRVYLTENLEYYCSNKKVHRMEPAKKYLLLEHKAKKGRSLLSSKNPEDESSTDSLNDFDDDILPKELEFQLFVPTELNARTNSRLHPDTSYENIQAHHWIKICLRISKQDPENPEKRKHYEISIDSPLHVLSHLCSHNNTLLPAYDDLIPGMSLVHNQSELPPLSPGVTPVEHTARPRNGSVGNQILGIFNNNGSNGNSQSRSSSVPPENENGRPLTPIEFHHISSGLESAGAVEREADMHLEANLYLPKENAITAINSPQALPHPDTFSSPVLLLPVQRPIHLIRKPSVNPPPFDADVPPPPATIPPPAYEERDSGSRRGSVGYGRGLSDNSSNSRSLSLSPLRIDEPSEDRNTTSTRPNVATNGFHSTAAASNTPVRDLLIQQLNGSGSSSLVTPTELVEPTTRIDDNIPIDSSIPQIEIHNENNVEIHGTDASTISNSSARRSSVNSERGGTINGHSEDRALNHETETETEEEEEDIADYPSPILPPTAIHGMAKISRTSSAASATSAASVNSAEIPVEQTIPLLSLVPSHNSQANIDSYNKGRNESTGSLLYEVAKPTEFYNGLESSAGVDNDFFKVMSSSLSKLRNPRLAKHYQDQQS

SEQ ID NO: 15101 - protein, 488 aa, Candida albicans
VVTMSSSLKQLKEQFVSDLTGGTIEEIYAVTSIALSSYLSFRLLKKSLGDLALIYDYILNVLTILASITVYSNSPSYLHYFIVIPSLVIYLVNYHVEKPSSPHRQNDTKEDKSDELLPRKQFITAYRSQMLIITNLAILAVDFPIFPRRFAKVETWGTSMMDLGVGSFVFSMGLANSRQLIKNHTDNYKFSWKSYLKTIKQNFIKSVPILVLGAIRFVSVKQLDYQEHETEYGIHWNFFFTLGFLPIVLGILDPVLNLVPRFIIGIGISIAYEVALNKTGLLKFILSSENRLESLITMNKEGIFSFIGYLCIFIIGQSFGSFVLTGYKTKNNLITISKIRISKKQHKKELLLFFSVATTQGLYLACIFYHLAFSLFISNLSFLQPISRRLANFPYVMWVVSYNATFLLCYDLIEKFIPGNLTSTVLDSINNNGLFIFLVSNLLTGFINMSINTLETSNKMAVIILIGYSLTWTLLALYLDKRKIYIKL

SEQ ID NO: 15102 - protein, 155 aa, Candida albicans
ILLISSAIVYYINSTTDYFPLLFFFAFTFVCYLLFYKMKGYLILYNSVSAILWGYILFQCFRDWNIGYYEVEEIPHKFMVYTQIFNSSIEIFHSMIGLVPTPIPTLLLQSFARLIIMVGICVVIPESLANYDITVFSGLTLAWSITEVIRYGFTL

SEQ ID NO: 15103 - protein, 127 aa, Candida albicans
LITSRCLQYVIHYFYYAFKVKTKSSFHFLFWLEYNNFYLTYPLGLVSEMILLFLSLAFVEQDSIYDYVLRAAFLAYIPIAYFAWGHLKSRKKKRYTEIMNKRNVRQVATLESTTTGTKNTSIELRNM

SEQ ID NO: 15104 - protein, 312 aa, Candida albicans
FANLTMPYSNPDSSVSNHDMNSVSPKTTTTNNTSPFATLASTMGKTTIDPETETEHNQGEGNDDQEITINGKATALESTTRPIFHVNSLSKSWHYDTSNSASSKSAPNTPKIKSQSQPVSRRASVDDIHFQHIPSHQETHNYSFKNSVLIPAAKWAYLPISKIRGLTSSSIKNTPLHEEYLIEYSVFRPIKGLPELNSHKDILIHLRDTIESETNKPFEFPETYISEIDFHNLLFKITKIIETDHIYPERISTGSSGSYFIFDIDFSLYKIGIFKPKDEEPYGPLLPKWTKWAHRTFFPCFFGRSCLIPYSP

SEQ ID NO: 15105 - protein, 174 aa, Candida albicans
LKDVFMKDNDFKERMWLKQLAVLKGQAFNIVEILKLTYAGPLELTRRENLLVIDDIMYMPNGKCDYDFMKSSLYESDIFKSYRVKSTNRNHGGGDDSDEEGGQSETITQNTPLLTHPHNHYLEVINESMDDTNNESGYEHMNRENNVAATDKGKKVIIERLIKETSKPPVFTWC

SEQ ID NO: 15106 - protein, 127 aa, Candida albicans
LVLPFQMAHRLLVNVIFTGASVFGRAFTEAYRQAAKASAAGAAGRPAKASSAGGIPVEEAMKILDLEKSELSLDKVEEKYEYLFNVNSKEQGNSFYLQSKVYYAMDTLKKELEYLEKLQNEKGAASN

SEQ ID NO: 15107 - protein, 721 aa, Candida albicans
NNVHKNKNGDSQSVVEFVHGYMKSFSAEEQLAGIVAFTKLWNDIPLNQLEPGSEEFEVLNNRPVFGTTIATLGQSGLAVLRNDLLQFLDETLSSENKHELSSLKTKMALVLIDDEDSEVSKKELVLDKFRAITSFALASLDTFTNSHADIKLCSTLYSLLGNLLDLLPLNYFIDSIVASLDVDTLSDSLSIKVARNYAILASRKFETELNVAHCDQVVIESVINNLLPILIKGIKKNVDVELQQAYLDTFSTIVNKFGASGTEFALSDVSKVLIESLGIVTTDRGLLNEQPEVIIASINAITSIVNILGVKTLGLFPKVVPPALKIWESTNSLGDKESAKLLQGSVLVLLSCYIKKIPAFMSTTLEAVLLTILSSDLIDNHIRSSVLDLIVDHMDLAQVLKSLCNVWLTKKFYTNDNSGNIGLFLKTLQATINKMEKKQATTQATLFMRWLISAFEFRQYSEDNDNKFDNNTIHRLESSFHGCAIAFVMKLNDKSFRPLFANLVRWAVDGEGATLKTNEVSRLLAFFRFFNKLQDELKSIITSYFSYLLDPTSALLKRFSEGSLVATNLRRIILIGLTSSFKYDQDDYWSQQGRFDSICSPLLSQLSNIEDSIGKYLVKSVSTFVTDVSSDEYNETLVHELIKYISNANENSAATKIWSIRTLKTIFQKMGEQWLSYLPTLVPYIAELLEDDDEEVEMEVRRGLVRVIENVLGEPLDRYLS

SEQ ID NO: 15108 - protein, 200 aa, Candida albicans
TNTMSSLASQLQSINEKTASVALDRKQRSKLHSRSLIFDPKQAATQDYEYIYEIATEGLEDLCELDSRFNKFKLTLFSETSVNLDRNLQTKDVISQLDKNIDAFLTLVGPYYGLTSSLKAVEWLVRRFHANIHNAELMILTALPYFQHPVFVEVLNVIPKQNLPQIFEWLVGYKDQLKTPPASSILKGMSAMNFQFFQLL

SEQ ID NO: 15109 - protein, 755 aa, Candida albicans
GHVGNEFSIFSTFIVNFWNDQIKNHTVYKEQLVFYLSNTVQLLASFSKNIEELNETHIPVVLETTALMLLPQQKPKYSSSINSDLKLTSYSIISVLSSIFPFSADILKSLTVSILEDEDALKGFTKPTLIVLSQLWKHFQGNLEVIEAFKNFKIGQHELGVLDELKNENYQLSTFIILVFISTFPSNESYKLLPFIDLSNKTVFEIITKLVLQNSTTQEDSIRSNLTKIAQSLTKSDPKLFQTTLESENWKVDELELKLMSVLVESKNDEAEFDAGDEYNAVEDIEIVKTVDFTKLQSTAKSYFNTEYDEEFNLVLKELKSVLSASDAKLHVSVILTFLQKVFSTPEVALTFAFRVALTPAVPLSIRLSAIKSIRIKIKNAANGKTDFYLLIPLILLALFDNSKLIRSGFAQLLRLVIEIKTKLTTGAALFLEREIYGSVSDKKYPTPHDSLFLCSLLSEDNVKDTVLDPSRVINILFDSIFKAKNGKSKPGKYFRSFIFTQWSLCSLPIVLKANAWKIVAQANKAGTDDRFFFLDGDIENYFSKRNVWIDQASIAGIAFFDNAEVSVVGLVGGVASNDKNSNTESEWLCRALENPSGNLQMTANNRVLETFDTFKPIESRLKIVNKLVDILINDDIVEFDPMATLQELNIDRNLFLQALTSVQIGDQIPEQGIAKRRRRSSNSTKQAMVRDEINNMASGHLKKLTFLLEILESSLRKKRNVAGPDLLKVLFKILTDLEYLGNDGNLPVLYAQET

SEQ ID NO: 15110 - protein, 154 aa, Candida albicans
DAFTTSSFPNYPTMAGRNAINKPKIKLHAQSHAKSLGRKRAARRTTATRSSTSRYAAKGTTAPRPTDSKAVALYTGNAPQPTSTMTTQTLSNKRAKKIARNQRYLAANKLKDNDTAMEVDNTSEQEKQTKLDQIKKALWSVIENHQKIWVFSCF

SEQ ID NO: 15111 - protein, 191 aa, Candida albicans
PSQHKLLQSPTGTTMTKPTKDNNDDVLDFINSLPDSKPGTPKPSKTSGSNTGGGNDSTENKEDLLDFLDELEQHEKTKKTKKPSKLAPKTASKPTSSDADDEPTTGTTTDKSDTTNEDIEPQQPQEKTEEESDNQDIPNPISSITSWWNLEGSNKVNSLWGKITDNAEKLSEHTYQLANDATNQLNTRARN

SEQ ID NO: 15112 - protein, 167 aa, Candida albicans
NPHGQVQEPDEILNVSIINEINYDAINVNILVLDNFLKVVNQVEGRIHVRLNEFNQGQEEQIKKNQEDQVEHHQEQSNIVITCNANQDEENKLVYFEITLKDITNGITITNKSQSLPLQWWKWIQGEKLEFDESIDPKEWVKTWVKNGLDLSVGILVQQYIINRMGV

SEQ ID NO: 15113 - protein, 438 aa, Candida albicans
YITKKFNSIMSLRIILKREFSQCIRVLESGSKSPTIANRFQAQYGNKNNNLKRNTANNGTGNGNRFHNKYNNESRRPYPKTKYQQQQQQQQQQRKPQQHQQYIIDPRKIKFDNGTELARNAIEEIINRVYQLQRNYQIQLITDSGLKKCHLSEILQKLDLSINGLQLIDKSTTTTATTTTTTTNTSDEDLPLIKIITVRDMINQYSTYLNNLKQLELIKLGSSKTLKTLDIKLKLEQKKSTTKEILMKWSINNNDFKLQKTNEIKKLINNNGGNGKSFLINMVYNKRNTNKPIDTIFKRRSNTEEVEQELIEIELQRRQLLIENLQSLLTELNCKWTIEGDINTKMTFNVTPKGQPTTIEPSTTTNIVDEEVEDYNNNNNDDDGDCDEKKMNRTERKKRKSEQQKQKQKQKQQSKTNTNSNTAKEEDLDALYLFKIED

SEQ ID NO: 15114 - protein, 503 aa, Candida albicans
TSISHIPLIYITMQEGVQFAAATNLKSRNKQGNGTAAESPSLSPQISDHSNDAGNKSNNHYKERLSPFRYKLRSLILPLIRQETIYLAKMQSFLRCSVFDFYFAWTANLASHTFYVLMLPPPIWFGGSYLTRDLVYVLGLGIYLTGFLKDFFCLPRPRSPPLHRITMSSYTTQEYGFPSSHLANATGVSLLLLIKILSLENVSNTTYYSLIVGLSLYYISLIFGRLYCGMHGFLDIIIGGLVGLFVFLFRHYFGLQWDKLLFDNGLGLVASTVIIIAVFVLLIHFHSEPVDDCPCFDDSVAFVGVLIGLDLAHLVAYQTKYFAKMNLTGNPYLIPFDVNRGVLNSVSRFLLGVALVVTWKTLAKPIVFTILPPIYKAVGVYLPRRSYISTAHTQTSTRKIRSTSMSNDSNMGIGDINNFIKGVTDHNKKDEVGPETEIDYYEMLSYSQNQNSDNTTIQTPPKYNSGVFKYRYDVEIVGRLIIYAGISITAVWTFAFASDYLNL

SEQ ID NO: 15115 - protein, 342 aa, Candida albicans
ARGAVLTFFSLRYKKKRNTQRKMSSSIEEVKATIKSVKLTDSQAEKLSKLIDSLPKILSGLDNPEYDEIFGYRINTKDKPYVDESIRNEILLKFLAADDYNLELLEKRLIDSLNWRNEFQPLSAAFEETFDKELNELGVITNFPNSNLKITTWNLYGNLKNPKKIFEKFGANNKVSKLPGSQFLRWRVGLMEKSLQLIDFTSTTDNRIAQVHDYNNVSMFKIDPGMKKATKEIITIFGANYPELLSTKFFINVPLIMGWVFTFFKTIRVITEATLKKFQVLNHGNLLESFNPDELPKVYGGKVEKSLFDIDVSDDIKLSEYREMILKKVRDEKINHINDDVQ

SEQ ID NO: 15116 - protein, 224 aa, Candida albicans
TLIHIMAPSYKSSEYIDDSDSELSAEEREYEPPKNFQKVTPESKEFSSNLKGKEVWLIKTPKGFPLTDLKKLPISFSGKSAESFKVNNLSYQVTEDLGASASDTNNKHTIFSLKKRSFRPLGEKISRFYSIHEVVDIPEIQLDKVVVPRQNVPKIKKLRMRHFPTGYGADDYQFDKEEEEEEEEESENDDVEAGKVLKKAKVEEKEEKEAKHKKDKKEKKDQKD

SEQ ID NO: 15117 - protein, 277 aa, Candida albicans
CRGKVRISMTGQVSRLSQFENLFHLSNPQLPLNIFFIFFYYSIVMKSTPVSIIDFPDELLEKIIRSLNQKDLIQLALTHPRFSNICQLSLLRRIYIYNDDKYFKFTKKATYIQEYLHMTTVGLSNFLKLLTSPNFQPSLTKEIVIANDDNAYLQYFELMERQQLPVKYDRIKDIDVRNWLREVKPSRKTKLAMELAELKRRSQFVADINRNKTDYYDSNDQFIVVITIIFVFVGVLVFIVMWGNKWDLQMMNLFLTGSTPFGILKIDNAKKLFASLF

SEQ ID NO: 15118 - protein, 353 aa, Candida albicans
SSQFNTVKILPALYISSHRNMSMKRFLSRSSNKTTAGQGDDTSASIGSDLPIVPLPSNQSGESHDSIKELGPMFRQQQNKQIADNDDSYDMMHLNLNPTILNLNKTVPSIKGSTIQDSLFSSRQSYSTNQSSYKTGGTNTSGGSSSNSQFGKRKHDLNTSQPLQTLKILEENEHQNLEELIRDNLKQLYQDLAYTMSQFYNSSASLSTTVINIIDCLKKFNVFVEKATIAKPNEQYIFTSYNSSSLRKILKIYLELYDNLLTDQVYIKLKLLLVKNFNDFAMLLNSQEMNQISEEMIKPKNYPIGSSKGKLLPNEEILVRIMEKVSHSNLSMKEQNGSFIAPITRGISNNLNI

SEQ ID NO: 15119 - protein, 501 aa, Candida albicans
CLYFGYPEPTEYHHSLTQSLRELYDDVHVVLAKNQIELASATRVDAASTFNKPAAFNDGFPPLQAQSTQKFKLPFRVPTDIHHVPMSMSISIENATRTSGTMGGYIYPIIDLQKQPHLKSYANSKFAISCGHVCLDSDNPENYPNVSSPSSVLISLYKQALTEQYHKSLNRNNSTAGVPSETRVAFGAVLQQLEEMFPLKQIKKSSTRNNNSAYKDDYEVRNLPKYRFGQIIWGERTLIKLNGDTNGNSSNNHQINEMSGIVEKKLSDLAIIKVNKKLKCEHNYLGDDVQFNEYDPSLMFDNLYVRKVINLKRYVPKVINTAIEDVDSDVSNNSEIQTYFGIPVFKYGSTTKYTKGHLNGIKLVYWLDGAIHSSEFIVNSIEANSSFASGGDSGSWILTKLDDIEDNSKGLGVLGMLHSYDGEFKQFGLFTPMTEILLRLEEVTHIKWGVVGCDNKHDEEDDDELHGFDTDDNDDRHSAFLDDDDDGVSENSDAAYPPDIE

SEQ ID NO: 15120 - protein, 128 aa, Candida albicans
  UNSURE (10): Identity of amino acid sequences at the above locations are unknown.
QSGFSTAVVXNPSSNSTLSDEDELSSTIPKACSSANNLEMTLHDSVLKDTHERWGAIVANHQFQFDGPIPQAGTIYSAGWSIKDGYLYLGDSNIFYQCLSGDFYNLYDENVAKQCSAVKLSVIEFVNC

SEQ ID NO: 15121 - protein, 283 aa, Candida albicans
SNHLSLIIMRFSIATLSLAALTVVSASYVTRGEGVSRGEKYECDFDTFEWKFGLAVKELKHRGKNWGKDVDLDIVYESDDGQLYHGCKDTYDASKCKNCYETFEFSDDDDEGSDCDDDDCKKKKKAHRYTKRCGGGDDDDCEDDERCNYPYCELYDDNCDLVITLRDGVLHDERHATGEIVANHQFQFDKPPQKDALHKKGFSIVYTEGNYYLALDHKIKFWHCKVDDNGLYKIYDKSIGEQCSEIELIILKSDKKAEFEFSDNEGSDCDDDCKRKKKHGKKY

SEQ ID NO: 15122 - protein, 95 aa, Candida albicans
RILSYTNEKGATGEIVANHQFQFDKPPQKDALYDKGFTIVEKDDYYVLALKGKTKFWNSAIDDKGAFKIYDEKINENSKPIELIILKVEKHGKKY

SEQ ID NO: 15123 - protein, 284 aa, Candida albicans
SNHLSLIIMRFSIATLSLAALTVVSASYVTRGEGVSRGEKYECDFDTFEWKFGLAVKELKHRGKNWGKDVDLDIVYESDDGQLYHGCKDTYDASKCKNCYETFEFSDDDDDEGSDCDDDDCKKKKKAHRYAKRCGGGDDDDCEDDERCNYPYCELYDDNCDLVITLRDGVLHDERHATGEIVANHQFQFDKPPQKDALHKKGFSIVYTEGNYYLALDHKIKFWHCKVDDNGLYKIYDKSIGEQCSEIELIILKSDKKAEFEFSDNEGSDCDDDCKRKKKHGKKY

SEQ ID NO: 15124 - protein, 253 aa, Candida albicans
LTMKFSTVALSLPLIAMVQAGISSPTYYKPEHTEEIGVETVDYEFALGVREKCDEDTIYLAYEVDDGQLERNDKKVDCNCKSEPVVYPTPRPSKTYWDGGDDNDECDEDCDDEDKKKGHKQYKRGEVEEPCETSDCDFCTIEKSFCQDQFTLCEGVLKDQRSAIGSIVANHQFQFDNPIQKDALHTCGWSIVEKDCVKLLALDGCTDFWECPVDDCDTYKLYDSSIDDKCKEIEIIVILFEEEEEEKKKHKSW

SEQ ID NO: 15125 - protein, 347 aa, Candida albicans
FIMLSLTKTPTETATTKTHTETKTINTAQISLQIFSFFFFSFHHYLIKYQINQLTNSIIMRFSIATLSLAAFTVVNAGYISRGEGLTRGEKHERHECDFDSFEWKFGLAVKELKHHGDKNWGRDVDLDLVYESDDGQLYHGCKDVYKASKCRNCYETFEFSDNESSDDEGSGSDCEDDECQKRKKTVHRNYKRGGYGSERRQSDCESDCERSERCNYPFCELYEDNCDLLLTLCDGVLHDDRHATGEIVANHQFQFDKPPQKDALHKKGFSIVYTHGNYYLALDHKIDFWHCKVDDKGLYKIYDKSIGEQCSKIKLIVLKSDEKATFTDDSDDCDDDCKKNKKKQHD

SEQ ID NO: 15126 - protein, 191 aa, Candida albicans
REQIENNKAISWINRPSVYILGLVICIFMIAFASTIGVKQIILFKLACNTVANSKGYCDPIETQVLVSSYEMYSMVGGTLVSLIPVAKAGELSDIYGKKPFFIAMFVSATTSHLCSYLIFHHYNTFPFKLLLGAQWISSICGGMIMVPALIGSYISDIVESQGRIYALGLGMSSLFIGQSLGPMFGNWINS

SEQ ID NO: 15127 - protein, 228 aa, Candida albicans
RLANREELRIQKEKEMKFIEMQNRDRKLKELIEMSKKSMNNIGGSSGTTITAATINGLSDNGGNNNGNITGIYGDDKHSKHHHHHHDKHLKNGPRNTSTSSSSGNNVEKIWKRIFAKYIPNIIKKYESEIGRDNVKGCAKELVNILTQSEIKHGNSLPSSSSSNGYSMELSDNKLKKIKEYSHGYMDKFLIKFNNSKKHKSTMGSKGSDNHKRKHNGDGDNGVKRSKV

SEQ ID NO: 15128 - protein, 542 aa, Candida albicans
QIMSNNNFQESSNNTSLPSKRSTPMLFLDAENKTQEALTTFELLNACTYQNKYVGSANVTTTATTSTKTSNSTLTKSHQQQHRRKLEYMTCDCEEEWDSELQMNLACGPDSNCINRITCVECVNRNCLCGDDCQNQRFQNRQYSKVKVIQTELKGYGLIAEQDIEENQFIYEYIGEVIDEISFRQRMIEYDLRHLKHFYFMMLSNDSFIDATEKGSLGRFINHSCNPNAFVDKWHVGDRLRMGIFAKRKISRGEEITFDYNVDRYGAQSQPCYCGEPNCIKFMGGKTQTDAALLLPQMIAEALGVTPRQEKAWLKENKSIRNQQQNDESNINEEFVNSIEIEPIENQDGVTKVMSALMKTQHPLIIKKLIERIFLSNDQDDINVMFVRFHGYKTISTILQDLLVAKNSGKESETTDNNDIDNSTGDDDQDKDELIIKILKILVSWPAVTKNKIASANLEEVVKDIQTNNENSNNNDEINQLCTSLLDRWSKLEMAYRIPKQESVPTNNAAAAATTTATATGTTTSASPFESFHRRMKTMSKE

SEQ ID NO: 15129 - protein, 470 aa, Candida albicans
TRKGRGRVGNRYHDGSVVGSILDGSVYQVVALVHVIVLARFGSLIENILLLRKKTEDFQALFYIPYTIYSTASPRFGNFFFLVHQTMLFSSLLVSTLVSVATAANQEVEAIQFSNLGFSGTYNQVEKLSNIYKDSCSCEVNKTPVSFSGTNAPLNEEVSVHFRGPLVLNKFASYVSDGFKYGDDSSGDWKRLSYYEGSSGTSENVTFLTSAGKNSSCLGIGLTYAGTDGISKADSSTVLAKNTLINSNDEFVIFSNISCGKSGYNNDCGVYRSDIPAYHGFYGTTKMFLFEFQMPNETHTSTDISNYNMPAIWLLNAHIPRTAQYSMNVNCSCWRSGCGEFDIFEVMNSTEYLHMYSTIHDYQGSDDIQTGMAAPAYIERDLTGTMSGGVAFDLSGNAVVWVSNSTSFDSTIQASSVNSWVKQAGADVATTLATVTGQSATTTSKKSGGVSYQPSFITNLLMTVLTLWVI

SEQ ID NO: 15130 - protein, 264 aa, Candida albicans
LLNILLGITSTIMILASLLTFATAALAFDCSDKELERYNFESIKGVHSYTTLKNTPPSQTNVTWNVGICQPISAIKDCPANSDICGVTSILRKDEKPVVSEVVSFKSDLQKAYESSDNGIKVIYKGANWGDVLVNAELNFQCDKDSQNNEFTLDQWDGTNLKLSMKTKAACITSKEDKKKEKHDNGESWGWFTWIFIFLVLFLSIYIIGGAWFQYNKGNAIDFQSALKEVVENFIELLKGLPSFGKEIIEKFTGRSNRGEYSAV

SEQ ID NO: 15131 - protein, 273 aa, Candida albicans
DADLPIRGEESKYPKLVIVTAVDFNKYSLDGLTKIVQNRVDYAHLQNYGVYVRWSEEFLPILNNFQYLEDKERAKWIRVYCMKAAMFAFPKTKWFWYLDENGLIMNMNINIHDYMLKPEILNSIMLRDLPLIPPDGIIKTYKNARADSIRFILTQSNQKIETNSFLMKNDYIGKSMIDIWGDNLFFQYPNFPYGPDSALTHILQWHPFILSKTTIVPIKTIAASHKFKDNGLPGNLIYEDGDFVAQWSDCNNPSECENILNIYYNKLKKTPKS

SEQ ID NO: 15132 - protein, 124 aa, Candida albicans
LLTMKLTPTAIYTAPDIDSPKHFHLSKNEDHSTNGKTTQISDIVIKAGGEDRDKPSDHKDTPLGNLRAELTTLQDHLNIFLTERMKLEKLKNGGGGGGGDNNKSNEQDLERRILDEGVEEEEIE

SEQ ID NO: 15133 - protein, 260 aa, Candida albicans
LINLLDLFYLTLLRLSHIPTYITPTHSSPLPPSLHMDRIFYKSDLRDPTTNYPIYIFDTSYLPSPDIINYNEFLITLMSYLPIKPYVLIMFSCGLNKISWIWGIKFIQKILNRRDLKNLIKVYTVHDSWFLKSMTSILQNFNSTRKNLEQLDQLLGAFTFVNDLSDTKNDRQTLVIHCQTLSELSYYLDITNLKISYNIFKHDLQISELKLSMRYQPIIHPLITLNVQKYPIFHHHLYQIFKIVENNGNKVELILYKPGT

SEQ ID NO: 15134 - protein, 99 aa, Candida albicans
QDIFQSIQHCFVELIELINLDHLLPGFDRALTYLQTYNPKSPAYTKSDNESIDQPLILFFNLINMADIIIQMIDIFYKQEILITQQNENSILNPSLQNK

SEQ ID NO: 15135 - protein, 419 aa, Candida albicans
LLFQEWIIYDPNLMEGEITFFRDLLNLIISKNLKISLASVSPTSLTTDTIFPFNTSFDLYSGAYECYYELLKILGVDILTQDTINLLWVSMNIKPCLELKQFIKLWLESSLDKNWFAILNSLFKLSSKKLIGPFIETNYQQKLLPLLQRQKKKNAQNVDFRDEEIENIVGGDESSDMDKNEPISWEFKLFIYEMLNHLLDLALGNSQLIERLKLKIPDIVKLSFLGSTSSITEIKLKGIELLNRSLALFGELEDPLYPSVSILEQQQAQIISALIPCFSPGNDYKVIVNAINVSSKFINLPRIKFYSKQRILKTLIYLLEEISSNKFVRFGFLESMSEFGRKSIQLAILNCWAVLKIDSYEDPENIEPEFEETLTNYSALLTSLWILVLREFSTLKYSESSSRELEIYGNYWINLISIL

SEQ ID NO: 15136 - protein, 371 aa, Candida albicans
KKDENPTNKDIPVGEEEEELELDLPHVSSETGSSFIRGILLNLIVNNNYYIRSYATQTLLVYAKNNQAEINQLILHTFRLVDQEHKHSDKETPGGDQNINPISSVRLLGYSLALLSLIKQTDPALLQNLTIVKVLSFCTQSLKHNTQSGVKNSSCWIILSSLVTLHNFSEYVKLNSSQFLVFWKSLLTSQFMSTSISASTPEGQTKEVIFNLMLRNFSLVCLLNYLNSVELTPESLKQIQFLLTKSYNYLTYLESNIEVVGAVTLFNNTNFNELDYNVNMLSNLLYTNYAFNNKLSTDRVFISLILYSKKIIFQSFTKLATLLKNEINSNMVIFLIKVFSDAKLFSRIPSTDNEKSKSKSKSLHHGVEGPR

SEQ ID NO: 15137 - protein, 263 aa, Candida albicans
LLEETEIAFDRTSKPVPVITEESTQTLEDLIRKRIKEDDFNDLPRRIITDISKFHKTPRAEVSEQKSSKSLAELYEDEYNHVDAQQESINEEVKKQHDEISELFTKVTHKLDALCSAHFIPKPHQAKTIDIKVTDSISMEDAQPLHVSNESRLAPQEIYKIGDDEAKGDGVKGKTQVQLKSGLSYSKDELSREDKQRLRRASKRKKAKTFNQRQETKRQRKDGVVDTLAGAKNLTVIGNKGEMRDIKGNLKKASGPQSSYSFK

SEQ ID NO: 15138 - protein, 64 aa, Candida albicans
DNAVNSAMLDLFAEEEPQPKESCWSFERQQKSIQAEIARLEAELWADKKWTMEGEIKSKDRPQE

SEQ ID NO: 15139 - protein, 153 aa, Candida albicans
LRKFGCSIRVVKIWKQVAQLMVNFEFLVKTLQLLIMGKSFFNIDSRLSMYNDYIQNVSSQINPETKKSSKGLLTESIILGFLINNDREFASLIFDKAIENQIIKDELEISQIKKIFKIYSDCFIDNEIWENHAQLKMIDVALKYIENIDSIKY

SEQ ID NO: 15140 - protein, 341 aa, Candida albicans
LSEAVLGKIAIKLCSGVLSFILLLTTKLHTIRYKMSIRRDTHAGFWYSNNPTKLKNQLDQFFAKARSLKTPLSGEDASNGIDGARILIGPHAGYTYSGERLAESFNAWDTSKVKRVFLLGPSHHVYFKNHALLSPFEYYETPFGNIPVDVSTIKELLDEQCKHGPVFKYMSEEIDEEEHSFEMHAPFIYYKGETAIHGLPKIIPILISGMDGKLQEGIVNSLLPYLDNEENHFIISSDFCHWGSRFGYTKYLSSGETTLDTLSDNITSLGSLHRPKGLQIYKSIELLDKIALQIATNGSSAAWSKYIDISGNTICGQKPILIVLKLLEKYNNNSFTARKYI

SEQ ID NO: 15141 - protein, 425 aa, Candida albicans
NFFFNVSRFQITETPQIFVFPFNWKRIMSQLKYLITFSILLRFGFFFFGLYQDEYMPVKYTDIDYLVFNDASKFVYQGLSPYLRETYRYTPILAILLIPDNFGKYWYHFGKLLFMVSDVITGLIILKLLSKQQQLSEKKKMILSSIWLLNPMVITISTRGSAESVLTVMIMLSLYYLLDKDNVILSAIWLGLSIHFKIYPIIYLPSILYYLSSQETPFLASVPGINLVNAKNLKYIIITLTTLAVVNYLMFLKYGWEFIDNSYLYHVTRLDHRHNFSVYNMVLYYKSALLEDSNGFDIEKIAFVPQLLLSAVIIPLIFAKEDLISSLFIQTFVFVAFNKVITSQYFIWFLIFLPHFLSKTKLLTTDKITGISCLLLWIISQATWLYFAYKLEFLGENTFDNGLMYSSVFFFLSNCWCTMKFIQSL

SEQ ID NO: 15142 - protein, 188 aa, Candida albicans
ENLSTGATPDELNKKSKPNTTDEKDITGETTGGEDGSNDDIVTKKLLEKGVSELSISKEEKLQQELNKRAAKEELKLERKQLEKISNSKIIIKKISRNKKKSIVSISGLEILETTAGTTGTSNNKVSIKSLQKKFSSKFATGTSVVKNAENKSDILIQGDVFEEVHQFIVNLLQEQGLNDIKIELTDD

SEQ ID NO: 15143 - protein, 284 aa, Candida albicans
LLLQLVELYNYSIIMSAPCHCKHVDDSSSNDKLSALSPELQQEFKDPNHPANLICELCRLFYDNNWVTGTGGGISIRDVDGPNPNLVYIAPSGVQKERIQPWEMFLVELPDEKILRTPNDIPKELTKFYKYKPSACTPLFISCYTLRDAGACIHTHSQHAVMVTLFFENEKEFAISHIEQIKALPKLKYNDETGKIEKIGSMEYYDKLVIPIIENTPHEEDLTDSLQEAIKNYPGASAVLVRRHGIYVWGETVWKAKVYNEAIDYLLELAVKMKLAGIPLVKQE

SEQ ID NO: 15144 - protein, 206 aa, Candida albicans
WISWRGEDRKRLQSKKSTGLVAENASGTKETKDQDLQKAKERLETLLDYQATGEERTKIIDNASDFEMPSQSLWLTPEERALNLKKQQRLMRESLVNKERKSRGEKTVEMTIKDGKVTMVEKYVTHTEGTSHEESELEKSIKEKKMQSQTSNLVWDYEMDKSKWEKPIYFASKNIPQVDKSELKITKNRVQFPKEDASEVIATVIN

SEQ ID NO: 15145 - protein, 287 aa, Candida albicans
SLLEAKYIIMSLLFINEEDDMTPEPYKPSTSTIREEEEEVQVKQEFPDEKMVDPDEDDPIVESIPLLINTVPERAKQSLHVLQYAGRPKSRPNRAGNCHASIKPESQYLQVKVPLDTEKFFNVDKIQEWGEQIVEQTILGVLDGSYEVGNYAAKIINDSDGRRVVLIPVDSTVQLKPSFKYIDDLEAQSIQQRRQQESTNEKPANVQILQSAAKHSTQSGEFLHSLGDSLKLVKHFEEEECQNLIWKRGDDDVTKSIKFGLDHHTDTNIELKTNTSYDEYIDMLINN

SEQ ID NO: 15146 - protein, 201 aa, Candida albicans
TQLLFLPGPSCENVKPYTDNQKQKFNGISKLALFISSNGGGSGGGSLTIPENTPIIEYLGEIDLFKNYCRDSINQYRMWGSPKPKVLKTTIPTQYSDETLDIVLDSRFVGNESRFIRKACPSSANCRIETVYVPEQNKFRFLVFTSKPITLKSENQDEELRLPWEWDVDHPILKLYANNNLEKFENLTNEEKSALITYIDN

SEQ ID NO: 15147 - protein, 104 aa, Candida albicans
ISFPDSRLPYYTIMVVDLDKYLKPGKDHYLALGLEGSANKLGVGVIKHNKGPLSSTNRAEVLSNIRDTYITPPGERFLPRDTARHHINWVVRIIKHALSTAKIA

SEQ ID NO: 15148 - protein, 405 aa, Candida albicans
YHIYHIHHIHHIHYKPPTAMSSDVKQLLPQWIYIISFYSSITSTIIILLSIYFHLLNYRKPFQQRLMIRIQLIVPLFAISCDSMLINQTSPINKCLLEPIREVYEACVMYTFFSLLTDMLGGERQIIIVTSGREPISHPGILRYLLPKLDISDPHTFLNIKRGILQYVWLKPILCITIIILELIGLYNVNDLSIKSIYFWLTLIYNASVTLSLYCLAIFWKILWNDLKPFKPVGKFLCVKLIIFASYWQGVILAILSVLKLLPNGDIAENDGENIGIAIQNALLCIELIGFAIGHWISFSYYPFTISQLPYGRFQFKYAIKDCLGFKDLISDFGLTFHGDYYKDYKQFDSVEAMVAHPESKGRMSRIHQGLRYPYDCQHKHWLPENHSLLSANTLLSQQGLGTGQ

SEQ ID NO: 15149 - protein, 230 aa, Candida albicans
TNSKMKSSEFILGETAYKNAKKSLQSLIKQYNNQPETINTPPPPDDDDDDDDETSTPIPTNNQGMAIHLVISIKIPLSRKKDYIPRIIPISYKLDDVTNKSILLITKDPSTPYRSKLMIKDSPTEDLFLDIISFKKLKSMINKTSTSSTNNKGKKQNLIKIFKNYDIIVCDHRIMKFLPNVLGELFYHKNKKLPFLIQMAKPILLETSKLKAQLKPKSHIFTADGLTGDM

SEQ ID NO: 15150 - protein, 173 aa, Candida albicans
KLLLPSFSFFFQFERYTILVQLHPLILYLKMFSLGVQNRLFTRRALFSGFRFNSTTTTTTTASQPRLTWVDYFQLKKQNNRINTIAGVFTGLGGAFITLSYLGNIEIDVEKPIMGFDPLMVMGGAVILGGLVGFLVGPFIGSSIFRLTNRAQLKQFELKNTECLHHGTGRSRA

SEQ ID NO: 15151 - protein, 65 aa, Candida albicans
VIGSVVSIKNTEFVSRIRIKRTDPSSQSFSNPIPDYYGEKIYSLKDYKQWLRDCNAFRRKSKEFL

SEQ ID NO: 15152 - protein, 400 aa, Candida albicans
ITMLIRRLPIIPTRAIPRISYSQFHTTVVNLNKRITGCDHKGHDFAFVFDIDGVLIRGKKPILQAKPALEILNSHKIPYILMTNGGGVLERRKAEEVSEITQLNPPISPLQIVQSHTPLKALALHHAFNRVLVLGGDGDNARHVAKQYGFQDIIMPIDIVYNNPSVSPHHRYTQEEFDKFAQPIDVTKPIEAIFVLNDPRDLNSDMQIVQDLLNSENGLIGTKRNIHHNRNLHDPSIPIIFSNNDYVYANDYPLPRFGQGAFRIITERLYKITNGLKKHQHLNSLILGKPFKIQYDFAHHVLIDWQNKLINEDFNSEQILPILGSEPTNTPFKKIYMVGDNPASDIKGANDHGWESVLLKTGVYRDEDAIDTEAAKPTAGIFNNVEDAVITILESHGIKV

SEQ ID NO: 15153 - protein, 326 aa, Candida albicans
NSVVEEEDGGAQFQSYLNNDGIDELTPLVRKHRVSSLSLSDLNQWQNGLTKLSSSTSLSKKNSSSANLKKVDSLAKLSRNASIIKRKKKEIIDHERVASYAFCFDIDGVILRGPDTIPQAVEAMKLLNGENKYHIKVPSIFVTNGGGKPEQQRADDLSKRLNCTITKEQIIQGHTPMKDLVDVYKNVLVVGGVGNVCRNVAESYGFKNVYTPLDIMKWNPAVSPYHDLTEEERVCTKDVDFHKIPIDAIMVFDDSRNWAADQQIILELLLSVNGVMGTQSKTFDEGPQIYFAHSDFIWATNYKLSRYGMGALQVSIFFTHGGWKVT

SEQ ID NO: 15154 - protein, 174 aa, Candida albicans
  UNSURE (12): Identity of amino acid sequences at the above locations are unknown.
KRKQLLVIPLPXKKSLPLFKKLNKDEINNSDKDINNDNITNNNNNNNKRKLVETKLTYFSSDDENSSDGSVLENDDIDDDELIDENDLLNFNNNNNNTNGGSLLSDKLITPRKCDISLNGGKKRKKACKDCTCGLKELEELEVSNQQNLQDQILGKLAQSATLEAIKIEERLKQ

SEQ ID NO: 15155 - protein, 67 aa, Candida albicans
KPKKAHGSKSMNLVINFDNDEDWVLVNPSNNGDKQSLWDLDIRNETELSLFNWDDYVAYKENPVEKW

SEQ ID NO: 15156 - protein, 919 aa, Candida albicans
FNGLISLNYTKRRVFLQNTFPFSNRSLFSTSFIHSGKYHLHTCNTQLSKPRTPNSPVAKGTLMFKVTTITHLTDDTTRPLICLTTRKGFKYLFGKVPEGTQRVVNTFGSEVKFSKLQGIFLTGSILSWSDIGGLPGFFLTVSDATKNGLTVMGCERILSYILATWRQFVFRMGIKLHILDAETNPTIVDEEVVISPIMIDPANQTSPPENSSKLVRQIKKLASLMFPLDTSQVNSRDPESYKSDPTQNDIHTHVHLPSASEIATTQQSISYCISFVPVLGKFDPKKAKELGLTPGPQFRDLTNGLSVVNKNGDTITPDQVIAPNRVFRKILVIDVPSNDYYENTINSDRWFEHDHPKNAGEVGLVYHMLGQDLDLDLLDYKERFLSKFPSDTYHVISHPSMTNNVIMNDRFISNTLKIKSILNENFNLVNLENFKPLSNSQVDRLHALQLYHLNDNGVVPDSSSAIKTTNKSLFEEEVESLDIPNAANFETMEKTKIELDCNKHTNLKDRVQVFMLGTGSALPAICRNVLGNLIRLPYQDDSGAISYRSIVLDGGENTIGSLLRLFGHENGKEFVQIFQELSLIHLSHLHADHHLGIVSLINEWFNINQDESKLLYLVVPWQFITFLKDWYSLELQYNKVFDMNRLVCISCEDFMMDNRTPEFIKIDMDKFEEFYDEGGLHKPIPRDRLLLVDHKKIKNMYETVGLNSVTTVRALHCAWAYSTTFDFKLNENGETFKISFSGDTRPNPRFSECGYGSDLLIHEASMDGNWIEEAIAKKHSTMIEAVAVSKLMNCPKLILTHFSSRYGISNNCVPKNELQSCADNLDTYLNKSHCELNIFQSQSPSDLSLEEIDLWFAYDLMGVCYGDMHKQEYVWPILSELFLPSAEVDHEKINEKKEVKRLERLAMMKTKKKRKMSPK

SEQ ID NO: 15157 - protein, 69 aa, Candida albicans
KKNVTTDFMGDKVAQIHVGKQDLSKLQTRKMKGLKEKYDQESEEEDVYVSDEEYFGEDIEEPETKRQKV

SEQ ID NO: 15158 - protein, 190 aa, Candida albicans
KPMFVFNGPIFDSHPVYQHIKSLFLDFFRGEETDLQDVAGLQYVIALSAGEVEDLNNDKVLPLVHFRVYKLKSYKSGQKLPRIELDEIGPRFDFKIGRRITPTPDVEKEATKKPKQLEAKVKKNVTTDFMGDKVAQIHVGKQDLSKLQTRKMKGLKEKYDQESEEEDVYVSDEEYFGEDIEEPETKRQKV

SEQ ID NO: 15159 - protein, 140 aa, Candida albicans
LRQARLLPSRGEDFQMLKTNTAIYQKIAEKRANLERFREFKELTDDLVLQLESIGDKLETMNGGTASVALILANWKSVVQSISLASLALMKESNDNNKEAFPEPLVRVRVGQSNEENQDDEEADEEEGVRDSEEVEESTE

SEQ ID NO: 15160 - protein, 270 aa, Candida albicans
GNNKSNNPNHSQHQYQPLEIVTMFGSKIFLRLFFKRTYATYKRFDNTTSSSSFTTSYAHLLTNRKTLYIGGGLLGFYVYNLHDAPYTHRSRFIWVPYWLETKIGDYSYRQIYQQFQLQILPHSNPLYNRVSTIMNKLLDVALNDNINDDLNARFLNHLKSLKWEIDIIQNDSLPRNAFILPNGKIFIFSSIMPICKNEDGLATVLSHELCHQLAQHSSEQLLKQPIYMVLSTILYTITGVSWFNDLLINGVLTISASRDSPDRARGKHRA

SEQ ID NO: 15161 - protein, 363 aa, Candida albicans
FTLPRPPQLHQPTMPQLPTSSDREYRYNYNQDSSFSTLRNVLTTKLAAVSDIIQQARTWYLEQSTIKQILLGGALVVIGVISVLMVIFHIHIIRFLIYLSDEWHNLKYGSLIIFALVFMVGFPPLIGFSALSFLTGMIYGCPQGWPLIASASVLGSTCSFIVYRYVLHNQAVKLMNHNDTFRAFAEILGEGNSLFLLILIRLCPLPYSLSNGALAAIPELPLLTYFLATLITSPKILIHLFVGSKLKQIGDDKSSGGTKIVDIISIVITGTAATLAAYLIYAKMQQKLASYHSRGIAADDVMVFGNFEDDLELGSNEIELNSADFDADNFIIEDDDNEDDPNQQGNGNNVKKDNGVQTSEEIL

SEQ ID NO: 15162 - protein, 600 aa, Candida albicans
  UNSURE (21),(31),(32),(39): Identity of amino acid sequences at the above locations are unknown.
LFEGTPKVLNWFGRKGQVFQXPGIIPFKFGXXRKTPKTXGNSTNGIMTSFMKYVDGSVDNDLPITRLLEMFNVDHIIAVQVNPHVVPILRVSVSNIGGQVENDLIYKMKHILNNVYDFVSCEAIHYLQLLNELDVYKNLSNKMISILSQNYSGDITIIPEYKMSDFVNLFENPDTEFMLDFICRGAKVSWPKVSIIHNHCSVEFALDKAITILRGRIITSANYRITSNSSGVRRSQLYYKPKQQIMNLVTSPVMNDSTQFNTAPATPLKQKQRPLGVQRHHSTSNTISNKHQPRSKRNSMSATDGGQAEAVAAAYSTVGGATTPQKKLLKGISTTALVQLTQGYVSGDSTLVNDDSENSNGPATTTRRGIRKARSSGNIRNNMDYNNADRPVSRLTIDRIPYKNNPYLQQRSKESLESFSKAEEGLSQRKKPNLPSVSRSNSHRNSYIGLNRLKDNNLSKQNNNLYYNLKQLGKGPNNQELINKLEQERKGILKNGNRESIANLELFANSDDDDLCKLELSHDSSLGDDEHSNEKEYTPGDDDDDDDDSDEEDSQSHSDEEEEDYGEKANGSSLKVAFESVEMTNRSESVVDDIDPYFGN

SEQ ID NO: 15163 - protein, 292 aa, Candida albicans
SNMSSEVTLVPTVSTTSSDAIIKELFQQYISLHPNDNTTSNNNKQTERTGFSLRSLPIIGNFFPEMDDKKKAINELLEIQKVTTSYREWYDTSLKLDELLGNNAWKSDPKSDIYDYDLIYKNLNEMRRARLNHDYKLLLYYIRTKWIRNIGNMGDANLYRHAYVGTKKLIEEYVRECQLSLEYLVTNDEVNLNDRYLLGMLIQTRKNIGRTALVLSGGSTFGIFHIGVLTTLFEANLLPRIISGSSAGSIVASILCCHNNEETFELLSTITTKKFNIFDVVDCDTSQMSRIF

SEQ ID NO: 15164 - protein, 1059 aa, Candida albicans
  UNSURE (97): Identity of amino acid sequences at the above locations are unknown.
LISFLRLVYVIFPVMMTPQMMSFPNFIREAEQTTRPLDHAFPPLKVEHKYKSVYERAGFDVNKGDNSHRNQSDNKSIGSGMKKRNFSNPRIQHGSTXNSSSSLPQVNTRKAPIPPPQLKTDSSDRVVSPTSSSSSKSSKSLSMNSNFTGTHKSNSSHTTLRNTAEFNGAFEQPLTTGSSTTTFFGENDVQPKPSNGNPMSTVDVGLTAANTNVPTKPHFDNKSMHEHHQIGSNVLSENKNAPITTRNEDNSPNRPAFDAHNDQFDFSPSPSQSGKNLKNLKLELNHDNLSDTSSLPDVNQNQKFESSNNPYQSRNSSSDGPAKDIYAQQGYQTQSQPNSQPGSANSGVRFDPRRQRHQPASATSSKFPAQNSPQYPMVHPQQRGPAPYPASPMGTPGHGSQYPPPPPSQQQQRNMSPTSGHSQQRIVSPVSMHSQQRHMSPTGMHHHQQMQNQRPNQPPVPRMGGMHPNPKQPQLPLMTLGGQKQPYYPQSPGAPPLRLQNRPYPQPQGNVHGHPPAHQLGMQQQQQGYPRPQGPPQQTRQRQQTYSQIRDDKLSSALNEFKSDYESHKGSNDSPTTSNTETDLPSSSSSDLDLYKSTPAKDSLNNTPEINDYRFSYEATKQQQQHQVKPVAATTATNDPSAQFQNFTTQQLAKEGDLNTEYQQFLKQKEIGKRDNYDNRHLSMVSSIISKESNNSNEDEIEKELERQLEKLKMSGSSINLSKVESQGGNGSNAGTDYATPDTTMIIPKFNIQDVDDDPEPQLENVQNELELEEETTRPLTITRTNSTYEDEVAPAQVEEPIAKSVKFTELQPEAKITSNVPQPQPGYPINDSFGIDDDDNDNGDDEYVKPLSPKNHLIEQELQSMNFQISQTTESPTTLINQTFESTTIATKDPLPSGTGPCRSCHESISPDAKGQLRAIYSKTGELSGQWHRKCFQCCYHEGDATDGIKCNIQFNKHVQCYVFDDQPYCFQHYHILNNSICQHCEDGIEGECIENELMEKWHLQCLKCSNCHMGIRQDYYIVNEHDIICHECKTNNNMGLNVQDRIEKRRTRIYNNV

SEQ ID NO: 15165 - protein, 78 aa, Candida albicans
  UNSURE (9): Identity of amino acid sequences at the above locations are unknown.
GGRGSSSPXGRRQILSKVLDEIGVDLNTTLKDTPTGINAGNIEQADRARMAEAVGANGASSHDADEDDLQARLDSLKK

SEQ ID NO: 15166 - protein, 372 aa, Candida albicans
TQVRIFYRVVKIDNNLTNYDLILFDLYMKINNNIDSGQDFKWWNKLTNNSNSFFTVLIKFIITTQTIHNNSNSNNSQVIIVKIYQLLNKLCNDKMLFNNQLLVSPIMALIYSLDDNISNNKDANQFLNKIWNMLDETISRVVRTPYKYLDLSHSQYQDTSIFNVALIEQFKFILNKKESFNVDDKDEDDVRYINWLFKFFKYLILIGESKESLLLLVKNQLNIDDHTLEDLGLINSLNLSTTTTTNQDKNNELNLKDSLIMEIIMNCSIDELINKMGLFEKKIISSNLDFLACLLLIDLLIQQPPPPQQQQQQQQGKVKQLIELIFSKIWSFLMNSTINNEVDNDNSDGAIKYFTSIKTWNPFFKSMIKPTN

SEQ ID NO: 15167 - protein, 396 aa, Candida albicans
NKTTKTMTNLSYDEKWNQIKEFYQISNSILDVNKLAYDHEFLMMVILNNDELLKYHENKLKPEGNNKDENKSTTLKESSINYSFNIKNLIDTGILQVIVISLGDNNNNNESIKKIAQIILGNILQSINCNIEEGDNNNNNNNDINKSFKDKNIYRIYLSTILFTLRNQQTTTIPHLIWYIWSQFIPILSNPGHFLYDKVTRFVLSHPMIKPNQIPLFNSIINHSDKYNESISINSHDNNTNSGGYFYYRELNWLIEIINQGILTQLDLSLICNYDNGIIIEFFINLINLKYLNFKLKSSILKFIYKLQSIDQGSDLLITRFGLLSDLELIIMPQQAQAQSKVDEDIIDKQLKINIDELILRFGISVGSSKRVREWIGGDDELEKTLKRIHQESQMS

SEQ ID NO: 15168 - protein, 276 aa, Candida albicans
  UNSURE (220): Identity of amino acid sequences at the above locations are unknown.
WLKNKLSKITFQIDQIKSYLSIPIKQLINEFYKQILNNSQYMKIIYRALNNMKPSITIANIRILINMIKFDPLIIGQEFLNGFDLTLNVLPKLLIPKKYELETEANSLSANESFQSSTIRSNFIRFWFELCSNVSFIHRQDLLLNHRKILNNIWKYLSIDSIELIEFIIDFIDLKIFQELNFKRSIKCKILNENFIYKISILFTKFSNSTNTSKSKFITXIDKLAIDSKYGLSFPNDKLWEKESNIGVIIEINNKQFKIANKLLYTLVTSLKPMNQ

SEQ ID NO: 15169 - protein, 451 aa, Candida albicans
LVYLYLKYKFSSSYKFFFCLYLYLWICMLAFFFLQQLANTPQVQVMETKNNWYTYGSNYTTNNITYDLASISPKKSLECELTIEFLKIIYIIDEAPYKSWQKTIDSCQTIHKSFERISEILIKQPNLESNVTNFLKNNRLKYILENVILESLKSQISKWDILVHINNLYPVSLLIEAVYDWSNIYLVNIDEELSLVLLCTFQVYRNIEDETHELDVMIKEMKQRHSYPEIRARNVNNLILLILSKMKPTLVFFELIKQLILYAKTECEIRHLIQDFATLLENLKQTTNQENNNELTKIKLLIQEIIIIILKSSYEKINWNCFQQAQSDYESIFQTLLTAYQSQLASSTMVQNSDIQLFIDDYNNDPNPSLNRENAAEWINNVFCNSENLEEDDDYFEPEFELPKMIAEGSNTSIRPHKRSLTEPIKRLILKRTPKDKSKWHFLEICMSHHG

SEQ ID NO: 15170 - protein, 426 aa, Candida albicans
FIRIGHPARLLMTNLQHSLEILSKTYGRDIINEILNDIQSVLTKIKKCKKYGERKALYSELKLLKKELRQRERKIVNELLVQAQVVVATLHGSGSYELKNSVGTNNNEGIVFDTIIIDEVSQSLEPQCWIPLLLSNRFKRLVIAGDNMQLPPTIKTQKSNSSSPSSSSSSASILATTLFDRLMKHCHGEKYKKLLDVQYRMNKSIMQFPSMQLYDNQLKCDDSVREISLVDLPGVEINDDTMTKCIWYDTQGGEFPEQISESIDGDSKYNDMELLVVKGHIKKLLSSGVQPQDIGVIAPYSAQVQNLKKQMGLGGEVGSSANGDKDGQIEISTVDGFQGREKEVIILTLVRSNDSREIGFLSEQRRLNVAMTRPKRQLCVVGDLELMNQSGNKFLQSWSKFVEDGNNDGDVIFEIEYPNLDDYIEN

SEQ ID NO: 15171 - protein, 224 aa, Candida albicans
LRGGHDKTFLSSSYDGTVKLWDLKSSSAVGNLKVGQNSVIGFDPHGVVFAIGKYSQGETGTVSLYDLKTFDKAPFLHVEIPILPGQIWNKLEFSNNGKLILISTDSAEHYVLDSYLGELLAVVRLAIGSVASNNWMSFKYPYTGCCTFSPCGKYLLVGTPKSTINIYDVSNLHNSNNKPVILSRTNHILQSTNGIPKIVSFSPKMFTLATADTTVTLWLPPEKV

SEQ ID NO: 15172 - protein, 401 aa, Candida albicans
FLIILDYLIDSISLQMSVASNLTPMLPSILLIIVKIAGIQLLESNQLHDVLTDMFVILDSFHGYNKLVESFFIVFEALIDQIHHKFDSQLKVEFKESSKTNTSLYKPWGMTNKDQLLELLNESNKMVDKYEGYDSNKEYFKRKADLPFSEMDADSDDEEEEDESNIDDNGEKEEEKEEIWSSPVSKDIYMISLRIFNYGFTLVSQESYTLKTQIIKTLRLLLPLLCTNYKLLLPVLALNWQMLIALVTGSKSLSTSIESNGEYASEDIGVMTVALQLVTEILEEDKRRYEHFFSKKFQEAWEFISRHSKLVRQREVKSTTNIREQKQLVVSEKAIYTFRNYPLLKTSLVTFLITGVQNYEKMIPDIHRFEIIKLCYELQIPQSIPLSRDTIGVLEVLKNTT

SEQ ID NO: 15173 - protein, 237 aa, Candida albicans
  UNSURE (11): Identity of amino acid sequences at the above locations are unknown.
HRAIFQARCRXYIHNLKTVSRNWNTNEINNSSGNTLIGISSKFSETILQNFINYLSSLKYEASNSSTLTELENIFELADDNDMITKSTSLWVASNYYKRSTLGKVINFDLGKYLVLDDDEDMEIDDDTKEMSFLVLSRAEELLEEISENQEKYSSQTYILAYNAALQSIKVVAGSIPLDQFRTNFLMDHLLSVFQALTYNDMPEIQLQAQSTLKVILDTYYNGSMVNLISDNLGLSY

SEQ ID NO: 15174 - protein, 136 aa, Candida albicans
RKMRPVCIELSEASTLQPFNTNKVVNLMISMEDILKKHHDEYNKDGNFRIYQLSPKLADYIFYPLSNILKQPALDDTIIQHLFGIIRFLVEYSWSFNVNFVLTDQLLPLVIYLSSGDLNKEPLLITKKSIQFKIKG

SEQ ID NO: 15175 - protein, 476 aa, Candida albicans
EKKKYICLAVFFFFPLPPVTTTTTTTTMAIDRQTLVFFIIMFIFLSLPSGNEQPHSDKDRETLQTYQQLIRNSLSILQNSTYALGYGNITGYQLSYKDQLQGKSVADWPIHEFSPSHPWVESQEYSILPDEISHRVRKFWGISPVKDKAYLLNISGRADGEFQLIESKVKPTKLSIPKYLKEYYKSRENSFTNDEPTEDNREYFKKPIDKKGNVTTNEGVVSIAIKGSQYNFDDPKLSRFVGPEDKVDNAICVSMDLDIKDYPEIEDHSLVLNGVYFQETGSLIGVTNSVKFYGNYGLSHLTMGDKNFAIAKTLMTQFSNMTNDNELTMDDMNYGIVKAHEQCEYIAFIQFAKTNFTHERLREIDEELETPTGRPLPHEIPKIVIEEYILYSPDCGKVLSLKPGSVFSGKKTEVTRAQMRNVLTGILVLVGFQLFLVLRQIKNAQTPGQLSLISSKTLFLLGYQDSLVAIMTLLLS

SEQ ID NO: 15176 - protein, 207 aa, Candida albicans
MRKINQLLRKNKRELDRSMNQLVPLRKKTESLIKKSAKDKDYKSAKLYARELININKLYNKLYTSKTRIESITMSINEQYSMNKLTQSIHSSTSIMKDVNLLIHIGAVLHTMQELSKELMKAGIINEMMDDMVDLDEMDEELEEESQEEVNKIIANLTEDKFSKIENEVPSNEFNEQVIEPPAEVAEEDEEDELALDEMRERLKALQ

SEQ ID NO: 15177 - protein, 126 aa, Candida albicans
PQTEPVITKWLVDSANGAAGSCSGGSDGVTCGLSWTDWSQGWDGKWGLGEQMSALEVMQNLMVHKRPAPYTADTGGSYIGNPAAGYGKLTSDATPLSIDGGDKAGAGIITAIIGASLVGSCVWLIL

SEQ ID NO: 15178 - protein, 315 aa, Candida albicans
TTNMSSKPLIRFQVIHYYLIPIIALIVWWGMLIAMLSCWGAQGRPIYSFMNGEYQNPVYISDIGATNLQPLFISCSGFQAIFFVGTLIMGFYLRYKSGKIQPYISKHQPRLAIASIICAAIGQLGIVFVAIFNTKNFHPVHISMVGVFIAFCFLACVCDFTISFIFGTNPSKLDPVHDQVVFGTSKFADLYFVSFMLKLVWLFAAVAFAICFGVYMKNDQNSKSAIFEWLISFWYGLLLVMWSMDLLPSALRKYRFKHPDMYPRYVQYHGNVNNNKANDYESQWIKDAREGNSSSEIDDNRTYVGNGGPMSPRLS

SEQ ID NO: 15179 - protein, 214 aa, Candida albicans
PYSNTLSNPIEPFLTVMSSVVYYKFLHQKNKSVIHFDGTSISVFDLKKEIILQNQLGSGQDFNLRLYHSEQPDQEYELDQDVIPRSSYVLAKRSPAFVKLGKYNNALRYITGKPRINRKAITSTVGHNSNSNPLVSAQLQQQQQQQLDENATEEDRIKLMFQNQSNAWEQTQEDLAHHKMVFNKPTASSTANKQDDHPHTGNIYYRCGKKGSLD

SEQ ID NO: 15180 - protein, 283 aa, Candida albicans
EQLVFQKYYLKTISREEVESKANTLTTNDNGDVVDSEGNVILITDDGDYAITMADSKTWQNYQEKLQNDALKSKREYELKLVAEIEKDNKWEFLDPLANTKAVLTSPIVMTPCCTDSSKLQNLKNFNYNQPELERVLIDNDFHCPNCGKADVFLDSVIPNKDLEEKLKEYVSSKEKELNIKDPSKRTAAEMTADDNNDPHHSGEPDAKKQKIVPNTVQPGMFPVGVMPPPPPPMPFALPPGLQIHPPGFGMVPPPNFMPPTQGQQFNNNNNNNNSNNQFNQPK

SEQ ID NO: 15181 - protein, 184 aa, Candida albicans
SPKQIQLVTMVHADYSNLKSGDFSKEETLQHVLDSYKALETDNWVANLSNCSSLLWHAYKSLNINVNWTGFYLTVENKNEGQTSPTELILGPFQGKVACQLIKFGHGVCGTAASKKLTQLVPDVEKFPGHIACDGETKSEIVVPIVKNGETKGVIDLDCLDLEGFDKVDQEYLEKLAELIAQSL

SEQ ID NO: 15182 - protein, 393 aa, Candida albicans
TIGLLSVCRKPHHLDRVRTLTDGKVEIVTPTIIQGVTFNAQPPSTTNGLEYWVSLKDDGSPKTIKPQMKNGQIKNGRPDYSTWFQTATTIVYNKEQLKAHNMADDEIFEEVKYIQEGDLENHLLSPIIRCTPDRYKKKGIGRDKTTEPFCTPKDDARLTKDKTYFVTWYSRFFDEKKVDKVRIHLSNIKESLKQKGLKKRDERTNQEFDKRSKVLEMGGKVTDFSFFTSDWISNDQGYFPLYIDENWFGSEYWRKVLISIQPDNIPDEEFNVLQNSIVVEIWKGVKVSKDHLTDLKKLEEKYANRHMHDIEVEEGVDFEKYMIMMGLPTCVLIAGFGMWLFVTINKIDLSSIKKRKFARKNTTHKRIPFKTKSNKDYDHLPQFNTELDELKHD

SEQ ID NO: 15183 - protein, 450 aa, Candida albicans
ERLKTHSSAFDGLLSLIPAKYYYDDATQDQWQQKKKSKQEIKQNKRAKLNPESVNNANEYSNGQASAKDVMDNKAKKATSVSLPKKLPKPITQESDEEEEESGDDDDSDEDVEIPDMDVSDDEDDEKQAKEDDDSDIINSNNQLIFDDDGNEVELSSYKKQEIQSTNNNSSDSNNKSKKKQLSDEEQRKRQENLAKLREKLESKINNLKEKRKAIGSKSNGALKSREQILAERQRREELKKQQKRKHDELDNDDEEDSDSGSDSGSDSDSDIDDDKNVLFGNIVFNDGSQVTSDLSKIRNSAEKKKQKGPANKDIKAHLQKLEKKKQKLASMSAEDQEKQREKDKWQRVMAQAEGIKIKDDEKLLKRALKRKEKKKLKSEIEWKERKQVVKDTVAARAKRREENLKARRDNKGKKHQPKLKKFTGTVNKAQLKKKRAGFEGSAKVKSKKK

SEQ ID NO: 15184 - protein, 151 aa, Candida albicans
PTTQKLSFKQLFNLQNRTKIHTIVCLFVPFSFIMTKSESQIQKISPNISLIGQLVDNHTRCTHYHTKLDIIAIKFKCCNNYYPCFKCHQESTNHEPDRFDKNDNTTKAVLCGNCVNELTVTEYLNCGYTCTYCGGQFNPGCSLHYEIYFNN

SEQ ID NO: 15185 - protein, 135 aa, Candida albicans
TFKMSMYTSRLATEYVPLSEIKRPIPPVLDYQKIDAMLSTLKGVPMESATCKVEDITAGELPPIDVFKIRENGKNFYFAFGGCHRFQAYDRISKETEKEVMVKSRILPATRKSLRIYLGASVDALFDSVDSESSS

SEQ ID NO: 15186 - protein, 512 aa, Candida albicans
KTRTDNNGAENGGTGDGKCTNGSNNFDINNETIKMIESLCELFPMFTIDELRDHPTNVDHSQDLVTELFDEATALIQSETEKEKKEKDLLLQQSKQYITNVGTPIYLDAVYELQAMFPFIAIKSVEKILQQNNNSIEDAAIALLELSSETTTTTTTGTTRIPQKPGANNNNEWVEESPIVVKVCRFLQSSSNDVYIDKGDVLHYARKNGGDYYKTLYDVVMNCKYMTMSKQQPCHSNPTKTHIQKNSRKVQRGGARGLGGGNRILQDKETQRETSINGNDAKPIPIPSNYRYDEHSMEAKELWSLVPVNSKYSNRMGSIPNQKFPINEVFAIKALEFFQGDVYKVVELISELSSSPISSNKQSKQFNEKRQPFDVKINKSSSPSSTLEYQSDSVSFNSDDEQQLFNKYLKTGTVDFHGFTVVEAMKLVPLILNHWWNQELIHRQSIGQLQKFGNSASLGSVLIITGRGIHSTGGVSTIKASVNRYLINNNYIFNQPTSGSFEITGKRMNNKK

SEQ ID NO: 15187 - protein, 305 aa, Candida albicans
IMTTVEIPYKPKGTPEIEFVEHNGANFKTVTWKVPQSVSYKGKIIYVHGFAEESNVYTEFFDNLSQNGYEVFFFDQRGAGETSPGNLVGLTDELHVFNDLDFFIKRNLDARPAANSNEKFFLLGHSMGGGIILNYGIRGKYLNDIRAIVASGPLIQLHPNTQPNIVLRTLQPVISRLLPNFKIDSKLNFDYITSNERWKNYIIEHDKKLIGSVRQFNDMFVRGDALLKPEYVAKFKDDLPLLIVHGTNDNINDIKGSEQFFKLVPNDLGNKHLEKIEKGRHSLFIENDELFKLIFKRVIDFLNEN

SEQ ID NO: 15188 - protein, 367 aa, Candida albicans
FFNIMENLYTALSISLITDDKRFVIVSDDSNKAIPKFTSMLVNTCSFDTSQYCVIDLLNVHTTIDLIHQMTNFRDNQYFLKNIIIWQNVQYLTTNQHKSLYKLILQIDQFGLRGVRGKPIDIAIGNDEIISINRPQLFTIIMAFDYKAFSKKLYIYLKEKFWFAVNYNNVEEEDEQESDGLPQDSQYQETILGFRNSLADVFISPDIKGYIYSLIVFTRCHRLASLSPKLTRLPTMAIDYMHDFCKCLALWKNQLKLNQELFITPAYVKLAFRKIGYWLVDWEYNEMFAKDTQSSVLVDDDSNTLNNEIDYQKRLEISMLTGDWYGSDYFFVNEYLKSSKSKLDKKSPTGYTYKIIEDVISSVRPPL

SEQ ID NO: 15189 - protein, 370 aa, Candida albicans
NKIVHSITLIPTKFHYMDIVEIKLKIKEWEYAFRKQHNKLPSKADIKDDVEIHKLYSLYKSIKLGQQQKPSKQETVNEPASVQSSPVKRNDYSPRGELGPTPQANGRVLSIFDLKMTPPDSSPLKHKSDKASPSAFAMPPPQSPVKNIIETPTKSKNKLFVTPIKGRKIVFETPSYLNKHRQNPQTPDSHNNNNNNNNNTVINFLVSPSPFKTQRSIGKRLTEVYNTSLKEAEDLKSFNLEEEFQSHEEQESEETETTTNNDRKIAPRSKRTQKRLTRRVKMAPRPVNSKPSLENVNLQDHITKLEEGERKQLVAYMDSDEDDENRDGEVGIASVFESPTKKTRMPVSNNFKRLKINDPRSRRFKQRMRR

SEQ ID NO: 15190 - protein, 101 aa, Candida albicans
VACFVDLYPAVGCFSTNAKFQVNLGQLGFVWIEANVRKYGFVSTSDYKKISGDRGLASLPQYDKVIVEGDKVLDKGEELPPRYPEEELDFFGRTVNDNVRV

SEQ ID NO: 15191 - protein, 137 aa, Candida albicans
NTTNLSMSNYYNKNKKSYSDVELPTNPNLPSWIITPKEEKAVFERWRKRAFARCDELINKYIECSNSYSNPVDAVKKCQKINEESLACVAQYQTKEYLDIEKDLFIKEKLEKKKLYKLYLEKQMQEKQQQQQQEKQG

SEQ ID NO: 15192 - protein, 122 aa, Candida albicans
  UNSURE (36): Identity of amino acid sequences at the above locations are unknown.
TLLFSVKVNTKWMFNSSKFLIQEITGSNKRVGGQGXTLTGAIATLVNGSNNYIGRLWDNPVDLDQEDANLLACLAASSVVRNASSKAFNKYGRSMQTSNVHEYLHESFTELFGDSIFRTSNI

SEQ ID NO: 15193 - protein, 110 aa, Candida albicans
QQFPLLIITMLRNKSQKELLHLSRQLIQPLLPNFHKGQAGKIVVIGGNEDYTGAPFFASHSAALVGADLSHVICEKAAGPVIKSYSPDLMIHPYLLDLDILTQAMENPRP

SEQ ID NO: 15194 - protein, 161 aa, Candida albicans
ARELGEDFENELNEIFGTVSEVDLQFEDEDSEELEVFDVNTPREDMYDKVDYHLSVIAPCPHHRKCPLQLGDPKYYKIPDHRHRLNFCSFSKIVARPPYVIELKKGQKLAIRWDKSAEDGIGSISRNAVKRLAGSGRPGGRDTEVGSYSVFVLHPQGLAGS

SEQ ID NO: 15195 - protein, 196 aa, Candida albicans
LIGGAHTEGRDPELGSYSYLIVERSANDLETIKKIEDLRSYSDNVIDENDITNWPRIIATPNKLKRNVKLTVCSTEGNVETWQVPKSLGKQTYHDARKSQLGDSWALGRKTRTIKNQIPEAVKDKLDVLYKTSKKTFKKEQQRKRWKKKVGTSVEEFEDGFFATEVMASQLELSKKYKQQARQAQFEEDPSKFDGN

SEQ ID NO: 15196 - protein, 131 aa, Candida albicans
INKMGKRKSSSRKPAKKIKQTLDTTFTCLFCNHEKSVICTIDKKNLLGELHCKICGQSFQTAIHSLSQPVDIYSDWIDACEDLAEEAEKHGNDEEGDVYSDGDDNTATNNNSGRHEKDPILDSEDEDDENF

SEQ ID NO: 15197 - protein, 428 aa, Candida albicans
LIMARGILKQQLKSHQLIDAIDKAKSKPTKKTPVTEKTVEEEKEIIEAAPVTTKVKSNKKSKKSNTKKDDDDYQSEVLSKKEQRRLKKLQTKQQEEEKEAENNEEEEEEDDDDDEEELDLEKLAASESESDINDEEEEDDDDDDEEEDDEVENDDEAEDDIPLSDVEVDSDADIVPHTKLTINNMAALRESLARIELPWSKHSFIEHQSITSADKTESEIKDIYDDTERELAFYKQGLDAVKQSRKTLLKLKIPFSRPMDYFAEMVKSDEHMDKLKNKLLTEAANKKASEEAKRQRQLKKFGKQVQHATLQERAKQKKETLEKIKSLKKKRGANEISNDDDFQIALEEATENNQKYGHGGSGSGGDNKRRKPNSKRLAKDAKYGFGGKKRGKRENDAASSADISGFSTRKMKGKSTSRPGKSKRSRRH

SEQ ID NO: 15198 - protein, 356 aa, Candida albicans
LPTHLYTDNPSTFMIEILHNLSQGWTLTLLSSCLCILGTLIILIDDIYYTCLPKFITSKFKIQIKQNYRFLNGSLAFSSGCLIFTSLYRLLPSAHEYLANSNNNNNNNNNNNNHPGHTHNLDENGEGADDNHQWNQFILILSYIMGILICLSFNYILHLLTSESVVHCNHGGDVTTDLHDINGDLENQIGVHHHHQHHHHGDTLFNDNYNGSDGRGDHNKNSNSVTETTPLIDNTKNGVASVPVATARKRKSIIQLILKHDDIEDGSGGECKGYSSAELCTFHNNNNNNKILTKLNGDGNECDSNISEELDGGHPGDEEEGEGVVVQQTQQLHYCEIPTLSQELIQNLHQVAGKPA

SEQ ID NO: 15199 - protein, 529 aa, Candida albicans
YNLFTIPIFFFNFPSFFFSFFLFWMLRLNNSISLLKQVRKIATTSINMSSKLSTNHTSGGEEPVVLSSVKNHARLITLNRVKKLNSLNTEMIELMTPPILEYAKSKENNVIILTSNSPKALCAGGDVAECAVQIRKGNPGYGADFFDKEYNLNYIISTLPKPYISLMDGITFGGGVGLSVHAPFRVATEKTKLAMPEMDIGFFPDVGTTFFLPRLNDKLGYYVALTGSVLPGLDAYFAGFATHYIKSEKIPQLINRLADLQPPAIEDDITVLSGNNQYFNQVNDILNDFSEKKLPEDYKFFLSTEDIATINKAFSQDTIDDVLKYLENDGSPFARKTLETLLKKPKSSLAVGFELMNHGAKNSIKKQFELEMVSATNIMSIPAEKNDFAKGVIHKLVDKIKDPFFPKWSDPSTVTQQFLSNILSTSKNTDKYLKTPFIKKWFGVDFEDYPHQMGLPTNKQVADYISGSDGSNRTYLPTPAEVFKHFKQKTNNKLGVDEKIKQILDLHGETAKYDHKYVTLERRAYQIIR

SEQ ID NO: 15200 - protein, 217 aa, Candida albicans
DKFIIYAGGDKFSLSTNTDLSDLNPVSVSLFVLNTNFIVWFNRNNVGIEIAYPAIIFHGLNEDSIYLNIEDNQIIGTYITIRCNPELQNNQNPLFNIIDSKITNVYEAISYVSELHAVSSDDDYDEGEVTGIPALEISHTNSELENSVLNCLNNSGQADDLDDNMINDNDGIHNVAGMHVDVGFTSIAGVKTRRSEQEDYNGWTANLNSTNKRNKLH

SEQ ID NO: 15201 - protein, 90 aa, Candida albicans
FFDDANNLKLTMLLLSDKLKNLQLEGFHTLKFFVANPKRSQKVTDILIKNKANFIEFFKTFDIASFHDSNIIEERDYTLGEIKNLPDRIH

SEQ ID NO: 15202 - protein, 125 aa, Candida albicans
VLPAYNHFNYQQHIIMAFLFKRNPKTPPELVRALNDQVLKLDYASPDNAKKYQDECARYLKNMKVILHGDDEVEPQPDQITQLAQEIYSTDCLYYLVVNLRKLDFDSRERCCYIVSDIIATNYGE

SEQ ID NO: 15203 - protein, 86 aa, Candida albicans
FKEAFSCFVFSETEPKGIDCIKKFENMRSCFKRYPEHYKDELYDDGEEEASTEVVEHVVLETSEPAIEQIEQGIKEDKVKPNTKSD

SEQ ID NO: 15204 - protein, 78 aa, Candida albicans
LPKNFEIKDNNYKPANELLQIYNCRNNHFNSYDELSPLMKSSVEGEIGYIPSKISPNINTFNIELGLSSNSHGGIYFH

SEQ ID NO: 15205 - protein, 183 aa, Candida albicans
NMKSSSGTSLRKVFNPDLKHSTLIIPSVSIGNVPQLAIDLLIHTHNLEKVDSLDDLYLYPFASPVDYVTEPKKGISHAAEVFHNRDLNLTLIQQRSPILPYNTKLYVTNIIIPFITSHEFDRILILDSLDAGLVEHISSGGIELYTKEDLLSESLESMKLSKEESTTAAHEDNRNSKYVRCLH

SEQ ID NO: 15206 - protein, 199 aa, Candida albicans
  UNSURE (62): Identity of amino acid sequences at the above locations are unknown.
KKIRYINRKILKIRKEKFQWKMEIQMNFHVKSPSENNDKDPLAAFNDPSSNEALMQMAKGNXMNYILQTLIMGWVNYFFAGFVIMKLPFPLTDGFKSMLQNGVMTPDLNVRNVSAISWYFVNLYGLKPIYSLLMGSSEAEELMQQQAQQTQQQQMPNLSGPGAPKAEKVFKAEAENIQILSQESVFNGIVDRFLERYSA

SEQ ID NO: 15207 - protein, 362 aa, Candida albicans
SMEVRAVTQDNDQLPIIRELYEAITSSCRSQKIIQIVQIPQNENRIATYDDKANDTLEIGISKPTYLAMFKQSHDYWYRYTESSQCTLDKIEITILRELYLMTLGYLITANDHHSIMNLHELIVQILGNFETDIEIISCFLTSRLKRINKSSLLWHWMKKMTILVIFNKLEEKQGSQHLSDSQFYNKIVSRAFRSCELHYMNYYANNFIHWIIQFNMIVLGIEDGDYLFHQLQKHCRQALLDSSLWMNMKNYIKCIQGSVQHDNQIIEEYNRINLSYGVPLRIHSKKQLISPNKSDEDIIVGEFQWLVKVQCKNVAPFSNLIELAQTKTVLKRLNELIQLHGFKHNAAKIESLIELRSRMIG

SEQ ID NO: 15208 - protein, 115 aa, Candida albicans
TNAQLLSRWEQLAPELRSASLLPPNAGLLGHLASIVFSKLLLPVKGVKEDGKDIESVIGRVESSLARGELDIAVEEAANLKGWSRKLANDWVVEGRKRLEIEFVLGLIESESKII

SEQ ID NO: 15209 - protein, 352 aa, Candida albicans
  UNSURE (311),(319): Identity of amino acid sequences at the above locations are unknown.
SLRVIATQKLFIKGKDTMIRITSRSVKGAAGIRSVSSSTVRFNIAPKVVSPPVPPPVKPQGSEIPPPPPPPPPPPKAKRFSLFGFLFKTTLLATVVYGGTLYAATKNDKVMDFVIDKQLPFHEELIDLIENGSTEDLQEAWEQLKNKFTDVKLPTKDDIDELTQKLEHRGEDIIKETKKKIASTHIGHKSGTDLTPTEQLQRGVEIESVKKDVAHLPLIELNSDLGKSVDETVKQTITSFNNFIQSIDASSLATKDDKLITSINTSVNQLASRLNSLTKDFDNELQNKLKVSQTELFSSFTKKELELTENXLHQFNTEXPQLEAKLNPKLSPEIQAARPAISQAASNAIGMG

SEQ ID NO: 15210 - protein, 231 aa, Candida albicans
  UNSURE (204): Identity of amino acid sequences at the above locations are unknown.
SRIFNKKMGVSDDDNILFEYDDDVDNDESEISFVSEDENDGNNLEPPNKKLKSTYNGNGVDDDSVVAGFNGTIYRPWTFEEFIEQRFLNPLKKLEKVHLNGCTEDDLLIMLQYKKWNLDEVINSFFESHDKLMEKCGLPVGKPSNNTFEEVDNYDCFICCELYPKTTVYSLTCGHQFCFSCYQQYIGNEIVRGELITCMDPECXYTIPHRDIDQFYAPKDKEKNLIVTVKS

SEQ ID NO: 15211 - protein, 656 aa, Candida albicans
  UNSURE (41),(80): Identity of amino acid sequences at the above locations are unknown.
INNVCLSCFLLYIFIPSLMSGNSAANAAALAAFNGIGKKKXESTTKLNGTDNNTNHLGVIGSTSNQTKQHQQQQQQPQAXRTPLPAHPSRKKSNKFSQLKRLNTAPAMASLQPALQIALPSISPTQPSAPASALDSDPDYFTLLPHTIPSKNEIAKSPQTPQDMIRNVRQSIELKAIPNNAQAKRLSVDYSPQEMLKNLRHSLHSRTKTSPMLTTSDKMGQTMLAEMRDRLENTRRIASNSVASLSLSPNLDFNKSTSDVSNLSHHYDVDTVSTDSFASFSSSINDRHLPHGISIDVTNHDSDEDEIDDREREEDHEPLDNGELKSTNNKVTVSSRLRRKPPPGEDFQMQLNDKSRDTISSGSYSLNPDEVYSFTDPDLYENLVSEVEVGETTRLFPQFPDANHYHQHSSKFRKKHQKVKPINGIYYRDMDLSNTSDTEESTSNLPLRSTTPLLGQPQQQVHFRSTMRKANTKKDKKSRFNELKPWKNHNDLNYLTDQEKKRYEGIWASNKGNYMSQVVIKLHGVNYETQKDPKEEAKMEHSRTAALLSAAAVEDSNYNGNNSLHNLDSVEINQLICGPVVKRIWKRSRLPSDTLEKIWNLIDFRRDGTLNKNEFLVGMWLVDQCLYGRKLPKKVDNVVWDSLGGIGVNVTVKKKK

SEQ ID NO: 15212 - protein, 219 aa, Candida albicans
SSSMFKKRVIKDSRVSKRKIGDINEASEDAPDTQVTKKSTLITKKSDIQKKSVVMPRSSPQTPLSKSSSDDAAAVEVVSQKSKKGELKPLAANIKTTIITDFQPDVCKDFQQTGYCGYGDTCKFLHVRDESRQKIPIKKDWEIGGQKEVKEKEDIPFKCVLCKSDYKSPIKTECGHIFCKACFLDRYKAKKKGTCFICHKETNGTMVPVNIDKLSATQV

SEQ ID NO: 15213 - protein, 321 aa, Candida albicans
DNCRKYTCGTPKLSNSNLDNNRDFALTKAGNGSAISGGGNAFGGAYPLFGNLASANKPIKRLSQQTLRKPPPQTQRGGARPHSMQHIEKQSGMSNRSLRPNSAVQPIPSHPALQPGYQSPSKLKAEALYAKAQARPHSEFKPSLAKKSSFSREIEFNGHNNHGVTPRSQGRRIGDRPARTTLRDPIAPTATQSHASKPFTPETTAASKPVKSHTQQKLQSQSQSQSQLLNHQQAKPVQQYQLPKTFKSRFNDSDDEGVDSLPTRNFTSRFNDSDEDISTPRSSAPSPAVASLRRDTEPKDSSPKKEKKFKKLRKLFGSSKD

SEQ ID NO: 15214 - protein, 152 aa, Candida albicans
  UNSURE (10): Identity of amino acid sequences at the above locations are unknown.
SNASLVPSCXGWCTDTISQAGEKEVEIGLISPTPPQSPGYNSPVLFVRKSDLSYRLCVDYRLLNLIIISKQFSIPRAEELVRDIAGHRFYTRLDMTAAFHQLRLEALSKYYTSFSAFGRRYHFNVLPFGLSISPASLCEVMSEVLDGIEGCK

SEQ ID NO: 15215 - protein, 456 aa, Candida albicans
LTQCSLTYTLIFGFCYIYISIYLYTLYNVCNSTNLTSKLYRTQQEQKLPYLIMSTTVIKTQERTRKRLRTNTSGIVFKELYQEKSTNDEQEDVAIVPPTEISFDKKHQSILLITHFKDPLKVQSRYPIPELQPYEILVNNKAIGLNPIDWKGKKYGFGIYHFPWINGRESSGDVVKLGDQVDKFSIGDKVIVSSTSYRDNRTSTFQQYTAIDSRLVWKLPESFSYEDGATIGVGLVTAGIILYNSFEFELSATPTKQTTTASNNNTILIWGGATVVGLYVAQLAKIYGLNVIAVASTKHETYLKQLGVDHLIDRHLSEDEIINEINSIDGIESIEYGVDCVGKETSKTVLKILDLKSQPQQKSKDEQIVKPKFSGIVGVPKEYPESVDVRNVVIKRFHEDVSFGEKFIDVTSELLNKKVIEPVRFKQYKGGLHIIDNALKDLEKIGANGEKYVVSV

SEQ ID NO: 15216 - protein, 685 aa, Candida albicans
MIRTLITTTIIPIIAYIINNTPSYIWAIIDFIMDICFFWVKQLYQIYNRKDPLKEYVKQLKIAPNYNDWKEVAYEVDKLTNMDLWRQNFISKHYDYVLIDERLKLLREARLNQNSQVMMSLLRSGLIRNFAGVAQKRLYLKSYMGTKFKIEEYINEVLNCLDYLNEALNNDNNDEFIMNSKQLKLDFFHDARQSFGCSALLLQGGSLFGLCHLGVVKALYFKGLMPRIIGGSAVGAAVASLVCTLTDEELIPILVNIGDLMKNIDLLNHEIDERYGNVIENVVKKGYSQEILLFLKFVRDTIGDLTFEEAYMKTEKILNIVVHPTNQCVPSLLNYITAPNVIIWTAIYASIGTGVLSDDVALYVKDFNNEIVLQTPDVDVKFLKPQDVTYHQQYFKFKPHDSFGGGVGGGGGTNSGGTNSGGSDTTGIGSGGATGIGNDITGDGEKPTSTTTTTNIVLQQQSPYTKLTELFNVNHFVISLARPYLAPLISNDLQHYHAYGKIRYDKTSSTTTPTTSTTTIEDKNNTNTNTNTNGSGSNKRKRTSSGGGVEVSKKKDIEKYAQDTTSYNLMKKIKTIIGMEIQHRLMVMNKLGLLTDVMKRFFIDEKPPTLQSLASIREVTIVPELRYLMKDFGRVFDVHKTMENIPYWVLVGERSVWPLFPLLWSRCAIEFALDDLYNLHRKRGG

SEQ ID NO: 15217 - protein, 461 aa, Candida albicans
KQCTMSSSSSPTINFFINYNQPLQGKKITVPKSTSINQLILQALTVYKIDPNNYEGQLYHNGKLLDGSLPIRLTNLLNNAKLNLKTIPKLNSSTNVDTTTNTGSANHHKINVKFINDDTGSSKVQKCSSGLNLIELIEKFNGDISRQSDLRIVNVIIESEKYRETTLESIVGKSNNVVVRLKYRKIDNDDNDRMVKEKQEEAIRLHIEQESIRKKKVHEQEKVEQSLKEQQQQQQQQQVQQQQQEQQDNKNVDAVEDAIIEDPKEDLPHEVSSLNERQAIQPKQENLSHPTIVQPQQYTFQEEEIKDTPQLYIPSNKQQALYENPDEDYELTLNQAKTYQNMIRDSAKRKPKSKGDKPISLPNKYQIGIKFPDASILQINFIENVHEIKFGNLIKKIDELLLPKFINIYNLKHGHPPFKTIDMSYSNNNEYLYYLPDFPQERILLILGITKTRFEFKRTLF

SEQ ID NO: 15218 - protein, 475 aa, Candida albicans
SSLDMLQHIVYFTKDDNEQLRKLAIEAINKLISNNSQELIGMDSQLDRKLVDGVLFAFQKQTIHQKIYLTCFGTLADALNVRLKPHLNSILSTILYRMKNKLAEIRQQASDLIAIIAPVIKQCSEHDDELLMKLILILYESLGEVYPEVLGSILNALYSCLDSIDKSTLYTMSNPSINQILPTLTPILKNRHEKVQEACIKLVGLIARKNSETINAKEWMRICFDLLEMLKAQRKRIRIAANNTFGYIAKTIGPQDVIVMLLNNLRVQERQLRVCTAVAMGIVAETCLPFTVLPAIMNEYRIPEKNVQNGVLKAMSFMFEYLDGKITKDYLFAITPLLEDALTDRDLVHRQTAATVIFHIAMNCIGLTDKDYSDVFIHYLNLIMPNIFETSPHVISRILESIDALRLVIGNGVFTNYIWSGLFHPARKVRAPYWKIFNNAYVQCSDALVPCYPRIESLPDEDEISYKLEELDLFL

SEQ ID NO: 15219 - protein, 251 aa, Candida albicans
FVFLKEIILNQWMKYVQSELIQSSRILGIDQVSILDYQDGMNETWQLNDIVQSLHENLSPTNSGSDTNSNNKPSVLITFDDQGVSNHPNHISLFHGTKKYIQELRRKLENKNKTRIKTTTTTTINYIDIDSSSSTKFYVLKSLNFFEKYSFTILGNIEILFNYISLLIKKFINININVSFFSNQIIKSKFDNNNNNLQLQNLNDIRFYSDLNMLSLSYAAMAYGHFSQMVWFRYAWLLLSRYLTYNHLIEQ

SEQ ID NO: 15220 - protein, 520 aa, Candida albicans
SIQIMGNVPAKETRSRSSSSVSDYRNSTSSTTHGSSSSNFSKRRNTTSSLYGIVSSATSSSNHHNRSGSHDLRKLKRQEEKEQAQIQHYMQLIVKFNESVDGGYLAPFGTYKSNLDYDCDIVRNLIINRKLSPFFTPLQDFDESWTDDELCILLGQLTLHALEPGYNNDDDEEEDDIDNHKIHKSANYYKRQEEKAKLKSLINKVKELQKDEEQKYFDEKQKNFNKDCPSRDLLLRLYRNASECPICFLYYPKHLNISRCCLQPICSECFVQIKRLDPHPPHDDQSNQEAGELPHRLISEPANCPYCASPDFGVTYEPPIDIHTGIDGIKPGDYKVSPPIVEESELAIDDDGDNSSNGSTTGKGEITSNSATAAAAATATPPPVNSISPKKNSLKKRRGSLAANAPGVITIDMIRPDWETKLNSARSKLARKAATASAIHASNLLLDDNSNSNSNNGNGNGNNSGNNRRRNNSSSGRSGSFGGSNNRYATVEQRMIEEAMRLSILDEEERKRNANKENKK

SEQ ID NO: 15221 - protein, 293 aa, Candida albicans
LTLLYFFFLLFLFLISCCIYHCLFHYQTMATPVPSVSVESGLDPQNQEVTYVYDVYNEIASHFSQTRYKPWPIVEKFLMLRSKHSVGLDVGCGNGKYLNVNKDVFIIGTDRSEGLIKCAQQISENKYNLGVADGLALPHPDGTFDFAISIAVIHHFATEERRIEAVQHILSKLREGGEALIYCWALEQETSRRGYKEGDDQDVLIPWVLKKQQPLKKKGANKRKQKSESVLEQPESTEQPADAEETEPDVTKYRYYHLYKKGELVDNCLQTKCCTIVEEGYEKDNWWVIIKKT

SEQ ID NO: 15222 - protein, 104 aa, Candida albicans
LGGLIDANGNFKIINKINAQCEIIVSINDEKLLRQIQNKYGGSIKLRSGNKTLRYRLINNNIKYLIKDINGNIHTNKRLVELHKICNILNISVLRPVPLDKDNG

SEQ ID NO: 15223 - protein, 68 aa, Candida albicans
RIKRNMKVVFTFFNLFFLAGTVLLLIFTVLSGSSKHFPLNKFYWLEADTSGIKNAPANRSAWTLGPGF

SEQ ID NO: 15224 - protein, 205 aa, Candida albicans
MFGSFQPPGEDYPISPEDNFGTTADIPKDFVDNENSYYYLSRFAFAFCLIALAFSGLAFIIDILGFCFEIIDKVVIFLITIGLLFLAGFASLQTAVVVLAKNAFKNDGRYAHIGAKSMGIMWAAFACLLICWLLIFAGTISNSYKKHIARVKAEQGQYSQPTHGPAGDESSFTRAAPPTKDEENTGGIRFFKIKRNQKVSDDESV

SEQ ID NO: 15225 - protein, 106 aa, Candida albicans
LIVVKNESLVQEIYSNNPDIEKLDVITNGPIEDWGGHNKTVPYWRCQPYFRKVDGVKQNTALLKMDGENELIKSIPQANNKRQLEDESNDDEGHSKLKKQATLVQN

SEQ ID NO: 15226 - protein, 144 aa, Candida albicans
NLFMKSVNSQTISNLLKVSKVMTTTKATSTTTLVSTSVATDSAFVKTKLTGRQLYNAIGQPKTIVAPMVDQSELAWRILSRRYGAQLCYTPMFHAKLFATQEKYRNSMWTTNLDGNKDLDRPLVVQFCANDPDYLLQAAKLIEN

SEQ ID NO: 15227 - protein, 264 aa, Candida albicans
NTAQLTHTFKKMARPGSVPLHLNPLRLKTALKMAISKLRFIQEKKTAITKQQRRQLSELLSQGKESSSKIRVENIIRDDIYIELLEILELYCELLLARLPILLKRTTVEKNLQEAVNSIIYSANHTELKELVTIKDILVYKFGGPEFAQPILDNKNGEEVPEKVVKRCDIEPPSETLVDLYLCEIARAYNVPYSGLKEEEATNASGDNSDDDNDDGGQKEFGLAEPLGGVAVKPVFKNHDPKQQEESDFDALKARFAALKGTLP

SEQ ID NO: 15228 - protein, 555 aa, Candida albicans
SQIFILIIGYFRDSFSVKKWNSLHVAMICFKELLQISNSVFGKEITNQTGEGDEISQHEIDRELAEGIIRKLFSFNDFLSIIVQIPQTAAKHSPDYLRVSVSVVHILLKAFETFANEDVHLYIQSKRKQSKRNRKRVNNLDKSTEDRLRDVIYASDEELDQSSAKEITQERKLDFKKTEARFFHQAIVSTYINYLSRYEDLSNQEIKTCLSYFHRLFVVRKDFTGLYRLDFMQLLQKLRNYLQRGSSLRLQVEEFIYYFMKKFKTAFERFPMPIEVLFPRFEDNECKVYLATGEVYEKEETTSTSRSPRLAKDLEFVRDFGLDDQIKILVSQLHVQEKQSLLKWLIQELERIINDRILNSDSIAELNASNQHRRLFINNGYLRFLLRIIGFDLPYTMEEVPELATTVDMEHLTKVTELIKKWDSSQPVIFEDDKVPSYFVRTREAGYDEDQYNENDQEYDFNDDSIAFETEANPNSNRNHVSELDHLEELERQLLSNGSRVNSKERNGTKGKARKKSKEKKRPEPKKVRGLKRRRIRTDRLHLPELDGSALNPGR

SEQ ID NO: 15229 - protein, 585 aa, Candida albicans
HYTSIFFSSFFFQRVVYFCGLKKNLTTHSTFHHHILALYKMSDYESGSDIDNYYEADEFDDFIEYSDNEVEQEKSKPTPGQIEVEEIEEPEEDRIRTLTTTLKPNETQAQKLLKAHISVLVSALGGPDHTSDIQPPPYKLGHDALACLKDIKRWIRAVDEKKNNYEVALACAESGLVTNDLIVIMCQWEDKMQKKETIKNKTTTEKTMLACLELLVLLTWPVEFGKDLSESQKLLYSEIKKVHVSYKKQILMFNNGQLLKAAIRLVLPTIAKSRIDREPRDNQILKLVLYLIRNLLAIEPANLSISNKSRKGASVTASDLPLGVTQDDISINNVLSVFKKNKVLMLLLTISGSLGTEFDRDMFGEICLESIYLIIKGLSASEVLVKKNLGSTPVAVPSQNTVPDAINASQPLQPVTTTVGMQLQDLLATETKKKKIQTQNIASRHGRFGSLLSIRSADSNSFVVSGQEALINTDSSLAKLDKSKKWKDRTYFKYDSDEYVNTSTPVYLNLTGQDILYNFVEQFLSGGCFNNLIECMGSRLTSQTDLNMVDELTLASYFFTISWFLSYQRERIGLDLHAGAGRKRA

SEQ ID NO: 15230 - protein, 570 aa, Candida albicans
TAPSNFFSVMGLSFRHFNYFGYGIYNDIKSRLPHYKSDFTDAFNYRVIPSTAFIFFTNLLPAIAFAQDMFDKTDHAYGVNEVLMLSALAGVVFGLFSGQPLCIVGVTGPISIFSYTVYELIHPRGTPYFPFMCWVYLWSMVFHIIIAVGNYISFLRIISLYSCDIFGFFINMVYIQKGIQILSNQFDDVDLASGYCSVMIALLMVICGVGSNILGNYLHYFKPWVRKVFVDYGVVVLVIFFTGFIHFGGKLDDTDLARLPITQSFQPTRNGEIRPHGWFIHFWPGENISVGDVFLAIPFAILLTFLFYFDHNVSSLMCQLKEYPLTKPASFHWDFLLLGLTTGLAGILGIPAPNGLIPQAPLHTDSLVIHDKTGKRLSVVEQRVTNTAQGALTFLMMSRPFLVVLGLVPQAVLSGLFFIMAIGGLHGNIVTNRIRYCFLDKEYIETDPQCPQVWKDIHRLPTKKWFYIYTLLEIIGGVAEFAITLTKGAVGFPGVLLFLAFCAKWVWPLIIPKDELAKLDGDVADEFILKNFTVASDEKKRRRRRSDAEEKERGSNYHESTNEQSESVTS

SEQ ID NO: 15231 - protein, 688 aa, Candida albicans
FKMLGNTPPALPIYRRVRSPLAQPPATLNENAPAFTTPSPPPLPTKDFTIPSPVGFLANSDKSNDSSIDDSKPGITLPKINTTISSNQASESSSYNETGLHRRTLSDRIKTTPSSFVRQSRIFSNEDADSIYSSHSVTGRSLLLQNKIQTESLSPEFHPIVTLINAQKLRTYCIGSLQIPGVIGSERVWLEVEAKLSGNELAIWRPLTDEYTLEEGNEFKPKYINLIDAHIEVVSGLQIKIYQDYREDASVAVQFHDKKSFDQWMSAIILSKFEYVKLNEAFTAVLLSSKGSKLLDIHVLLGNKKRFPQYEWCHIRLPEVSTKWIKVYMAVLPGDKGHVGRIEFYPSDKKLQKKNLIAYISDLAGVFNVYPEQSSMIDFNSIMRAAGEIYVNKNYEYLFPHNSDEQLDPRKLIAKNHGVSRSDSNSSLSSLSNQAPNTPKNRSRSSSLHSTSSFFNQSTSLSPKQTNGHTRNRSLSNLGKSPANPSQTPLSHKRTNSSFFKKHTESFVLTNSVYIMPSLHPGVTAVETMIRNFIPIVDAFKLYGRLKRLISDKSDTASMLFGLPSLPHYQYLSNKDAERAFAQNFKIGSNWFEWPEIIAHEIKQLQSSNTKGYRGHGDIAKLYENLDLDYGEITSPVFKFGKFEDDLPSLSDSIEFGGKIETPPPGISSPISFAEDGSPYEPLPKIVV

SEQ ID NO: 15232 - protein, 518 aa, Candida albicans
ICLLNAALKGSTEVALDASEGVIRAVNATVVSATNDIESALKVLSLIINDLVTGFNAIKNMFTGSKSDPTQYQNKINITLGDLKSKIMIPSEVLTKLDNFKNSSLYGLSQLGNGTQTIVSTPFELAIKKLNTMKLSYNFTTGAPSPINFREECLKDMSKLKDVQTDLAKLVEKISKWLFIGLVLAMVGSILYVSYIQWRHWRRMDKFINETGIDKEVQFRNQYNIYNNFLIYTIVKRMGIDLNERAIWMLSFMFSKISRNVFFFGIMGVVSVVARYILLNSVQSFMNNHIKSFDITSNSTSMSASTIYLRDMNTYIDDTQDKLNQELFSGIKEISVSLNSTIVEFLDKLNETLSDIFGNTPLAGPINTVVYCTIGRKLEKVEKGLTWMNDNLNINIPSISRDIEDGLSHMTFLQPRSVLARANKIIDLYRKSILLELYISLGLLGVWLFQIFVGSATLTIRHWNSTRQGNNSYAISSPHELSEQEKQVYGYPLSHPLIDGKDLTTSSSFYPTTEEKLK

SEQ ID NO: 15233 - protein, 148 aa, Candida albicans
QMINRHWIDKNCLPWSKDYLKENIIDTTYEDDLFRFVVTAVDSVSGDCDVTQRKGKVLCIYDMRLQFLLSGAIKKGNEKEEEETISATIVIPEFVHDQDKDEYVFEIESASQKSEIRKYFVPILKEKLMKFQPDLLEAHAKDVQHATD

SEQ ID NO: 15234 - protein, 241 aa, Candida albicans
QQQQQTPYKSKENIMSSVGNPVHSLALTDSTASSSSSNKALNDEQIYQWISELVTGNNRERALLELGKKREQYDDLALVLWNSFGVITVLLEEIISVYPYLNPPNLSASISNRVCNALALLQCVASNVQTRTLFLNANLPLYLYPFLSTNARQRSFEYLRLTSLGVIGALVKNDTPEVINFLLTTEIVPLCLNIMEISSELSKTVAIFILQKILLDDQGLFSPRPEGPHQHHSGDHDSRRP

SEQ ID NO: 15235 - protein, 415 aa, Candida albicans
KNRNLKTSQKKYYWHCFTLSCMLRLKSIKMNGVFAVYKPSGITSAKFIEAIQNKFTKSEVFAKDLQEMKDKIRSDLSRDRKWKPQKIEKKIASTKVKIGHGGTLDPLASGILVVGVGLGTKKLQYYLAECQKTYETKALLGISTTTGDSEGEIVSKNKIDHITLELIDSTVEKFIGDIKQTPPIFSALKVNGKPLYEYARKGLPLPTNIKVRDVTVNNITVIKEDSLKTDHEFTKLESELDENGVPKEHGLKDNPTLNDSPLFFSKQYLEKAEKEGLPKETGKPKLLADDESLPEKLPMIHFISDVSSGTYIRSLISDIGRAMESSAYMVELIRTKQSEWELGKNVFKFEDFEKDERIWGPVLKKVFEKGGAEIQDLDKEFEEVAKTVEFLFTKETKESTSETIPQKRSIDEVEK

SEQ ID NO: 15236 - protein, 351 aa, Candida albicans
NVKTKDTEVIERDLNRTFPDNIYFNSSIKGVFSSLETLQQEKEQETLLIKSLRRVLVAFAQHQPQIGYCQSLNFLAGLLLLFMEEEKAFWMLVILTERIIPKVHLANLEGVHTDQGVLMLCVKEYIPQLWQVLGKNFDGETLSEDKILSRLPPVTLVTSSWFMSVFVGILPIETTLRLWDILWYEGSKTIFRFSLTIFKMCLDSPEFNTKQNRRSGSGSGGGGESEQIELFQFMQNFPKKILDANLLIDLCFKKIGGNGFGSLSQDEINKCRAFVSKQREKLTKKLNQKGLTDMTDEERNTLLKSSTGFETSDIHDVYGFNRSIMSGMVWNKNISNKMKKKFVVGKRNSSR

SEQ ID NO: 15237 - protein, 340 aa, Candida albicans
  UNSURE (334): Identity of amino acid sequences at the above locations are unknown.
IMYWKNAWWVGTVYSSCEPIELPEGMLISKQYETYPITTVSKAIYKQMCYRNCIPVLNTNVGFVIDTFAKPLPIVSQSWREFTKDSLRGSFAYSVVSIIYAIAVLAVIIWFLTIFVLTNYTIKPSWLLKTSTILLTVYILVVVIKSILILHGQQRDGYLHGAKLLSELNDYNPIQIIDLIVVLLLQINQVQIIMRIFQRQKDKRMALLIGIVATLASQVIWAIAQFYTPADANEASDILPAFIYLVRIAMALCYAAIITVFFISKIQIILANKKIWLLTLLTFILIYSPVAFFVADVSNAFVYELSEIFSVVNYVIGVVIPWEWCNKFNVFHHXAGRSAA

SEQ ID NO: 15238 - protein, 519 aa, Candida albicans
HIYRFHLFKVLKKHQMSNVQLLIGDLNGLLTDSKRRFPDIRLSCEAAIKVLKSYSLVVPIQEINKEDHKEEILKPFILSCKSGNIKLTNISIPVIHKLILAHLIPELDITQVLLCLLEASNLAVDIQLRILQCLPALMQKYPITGTNLLDMLAICSSLTANNKSSMVVNTASATLQQLFTNIYDSIGESSNEKKKEHEVVIDNDETVKLDSLSHEGFLIFQDLCNFIDNESPTYLKDSIHIKLYSVLEIVESIVHGHQVLFQTHKELTYLLRVRLFPSMLKILNSVTKNFPLVNRTIRIMNVLLSTQLENLKIESEIVLSFFCHLVIDGGETEERESNWEKYMVLELLKNLFSDFLVLKLIFQQFDYNKLMKNVLKELFSVFMVYLQKSNTIVDDIVRPVSRLAPGTFSTDGSSSSGSALHGSNGNYLSRTTSNLKPLVLDHLDKLEPPGNIPSTYGIYLIYQILILFSDGVANFVYNLNDESKDPISLEADVELANALIEGCGVDSSPTGAGRTRTCV

SEQ ID NO: 15239 - protein, 991 aa, Candida albicans
RGIVLPRRRRWIALQWCGYYLDGPDQFSPYFNNTKVQQTLKESKKPQISAQDVTNVENSIKKLYVSIGDSSVETFRTILITLTRLSDFALDVDNEKYEDELHISSFNKSYFVSRLAQVSEIDEFHNWLIKDEESWDIISSYFIDLGTKRNIHFSLRNYVVEMYMKVIETVAVFGFQHDDLIEETSQKTLNGLNGYLEKLFGMGSSKELLINNRETEIHLLILTTLHTLIDKYDKNYQQTWNEVFKLLNTPFRAVKKDEVEDTINGDDTRSDEGVLLKDKTQLLVEKSFDTLKLILDEFLSTLPFNQFKLLIDTLSNFVYQQYDLNISFSSVSYFWLISDSLKSRMVSFKCETVLKSHDKQTEIHGDENKLLELISGEKIESYNFYIYLNIYLLLSLAKISKHEINRAQVRDGAIQTFYQIIDVHGNVLKNKSWDMIYDIVLLPNFFTIVPESRGKDWLDSLQLIFTGLISLYNKFVLNDDNGNGIVVKWQYLIDYFDKLLKLQWIDLNLKIFKSLQDLMTSYGGSKNINKQVGDLFFKIWSQFPIEYDLINNNYQESLVQYMQCFLPLYKITSKDLSISDMDLIINIFNKCGMYPVLPSNQSDNVKPTNLQNSILQNLKLLSNVDNNINLRPEFEPLVIQQLSNIIIYPYGIRNRIETKLQNNEIVKNKLPTFVAFSHLSLNLLNENLNNFDGVFSSIGNDNAIMKCLKSLLEIIENKSIGINNSGKEQSLSSLWIESDLIFVKIIKKLINHRDNNNLLTNDEFWKLIIQRIEISFIAYDEKNQEINITQYHELIELVLPELLKYENSQHMIEDLVIKLYENSYLYKFNDLEIRLMDQEKYTVDKTIDNLTLYKFDEFFGTTESIEKYPNLRIRLNCLEELINFLLGKDTNTDSQKIVLKQLCEKYLILRASFTFRRILNDIKLVYKCPIPIVQQKELLMILNGLNELSVKNNNNDDLKKLSRLLIQLIPYSSRINNLDKVLPQVLIKISL

SEQ ID NO: 15240 - protein, 224 aa, Candida albicans
NKHSVLRIIMFSGISKLVLGKSAISSAYSIPKPFNYQTISRTLSTSSTVASVQRANKNASMSQLAQKLNKNKTNEKVVYWKLYATFNRHNTRCTLVAVVEDLDFMEKNKDLPYNDKVLYYLQLPHKVKYSVTAGQLGFRKSQRQEYEAGFQVSSKMFKTIEERNYIGPHDKIELILKNFGKGREAFQAALLGKEGSKIKNNIVRVCDATVLKFGGDRPKKLRRL

SEQ ID NO: 15241 - protein, 605 aa, Candida albicans
RFQLLLSGAKAKRTKFQNFFTSNLIVLAKSSQNTLYEVETSTPESCQLDSDLLLEKPQYESLEDLEIEIEQDTKRIRYDSFLLQQNTADEKLLPLAMKQEDIPADLKDLDPNNQPALNNLDNLQLLLRLTVLKQTSPASDPLVEEELSALVGRVLYASAGKVNWSIFSRALWERSLLETNKSRTIERGILQMTSLIEEMGIKIKTRIIPESMEEDTSATTALRLRFIHLLPLLPQWAMDAKLAEKYMSLGVLRSAIEIYERLHMLCEAALCYAAVDNEREAENIILQRLATHPEDARAISILGDIRQDPSLWEKAWEVGHYAKAKASLSHYYYSPPRKDIDLAIKHMFDCLTVNPLSYENWYFYGCCGLESGQFELASEAFTRCVSLDDSNSYAWSNLASALLKLDKTKPAFNALKKAIRSGGESRKSWRIYENYVNVAAKLHEWNDVLQGCRELIEIRKNEGDTAIDIPVLEKLVEILVSEEFPGDGERLSHYQLSCIDLVCNVLPKVITSSARCWRIVARVELWRKRPWAALECHEKAYRVMVHNPELESSETIWNEIVDACEDLVSAFESLGELPGKHGAGDLVCKDCKYKARTTMSLFTTE

SEQ ID NO: 15242 - protein, 284 aa, Candida albicans
AKKKKIPKKKRTNDGVLTPDMDCLKKYLSQLLLLVPPGTFEVGSNERVGYSILSILEGKSEHLFEVSDFKEILHLPQLQNILQKYSSNNLIDVLNEYVDQLIALLDKYFGKDSVICLQILGVACLQSFVQANFTGPPVSKTAQSLWFPNENTENVQAEAIKLLSIEGQQAYDLMQEPLFLVMSELIFERLLQTPPQLSLFSRSDPTKLLDFVTEASKVQDPITASLCWWKVRGLQVHLSVVSEPPSIILSVCGIILNSSLVNAIAPPDLPEFFSTRRRRACSGH

SEQ ID NO: 15243 - protein, 300 aa, Candida albicans
NQTMYRSHNNNNNYHSRNDGSNGRINKPRDPKLQDKYVAYQQNIEQQLASQEKKQAYRRITDHGNNMGRWYIEKSLGLTNRSQQAIGTIRPESSYLIDLLPSLAYSSSFNLNRRNNKNNLAVLDLQTKFVHLSSNKVKHTINTVKWTPEGRRLLVASHSGEFTLWNGMTFNFETIMQAHESPILTMKYSNHDEWLLSGDQNGTVKYWQPNFNNVNNISAHANGVRDIAFSPNDLKFLTCGDDSAIKIWNFNNGKEERPLSGHHWEMKSADWHPNLGLIVSGSKDNLFKLWDPRLGYCVST

SEQ ID NO: 15244 - protein, 275 aa, Candida albicans
VCCFNGWKLIRIIDLSSFIETEHGYCATPDEYNMPYELINLPTEDGELLQCYLLKQDPHSPSYSNKTILILSPNAGNIGHALPIVSIFYKKFGYNVFIYSYRGYGKSTGSPSEKGLKMDADRVMQYLTKEDSQYQQSSIILYGRSLGGAVAIYIAATKTSSIHAMILENTFLSIRKTVPHAFPLLKYVAGFVHQTWDLESLVPLISPKVPVLLLSARKDEIVPPLHMDRIYELLKSESKGMFEFENSSHNDTVVQEGYWDRVHSFIKNKVNPVGF

SEQ ID NO: 15245 - protein, 723 aa, Candida albicans
DRGSFEPPWVKKVATRAEEDIHDFDPRKPTARIYWGVKLTNIVWSLTAGLLICLICLLGAAFVFIFSGFAIERKLRPYVKALLKLGHYWLYPFGKFVLLNREQNYLDEDQLEGRTINEFHQWRLQEEGRLFFAPPRRYTGSESTRPLLKDHRGRPLRDAYSLLDDGIQEEEDEQDNDANDIKVRFFGRGDWSFGRIAFYVYFYGIIQPISFFIGILCWLIVFTIPMAKITNTMNDHMRRHPLALDYELEKDYYKRVERTPRKKNQVILLCTYRCCGFHYYKYTIDGTNIFFINLLSVVIFAILDYYFLKETMHWDSWITESNFIFCLSLFSIIPLAYFIGQAVASISAQSSMGVGAVINAFFSTIVEIFLYCVALNQAKGKLVEGSMIGSILGAVLLLPGLSMCGGAFKRKTQRYNPRSAGVSSTMLLYAMVVMFAPSIFYQMYGSYEMKCKDCTSPGVCGRCRFIQPTFVLDSLYSTVIKPFSLIVTVALFAAYVCGLFFTLRTHASLIWATTSHEPKRDDYFRSNSVVSMSTPTQTPKPTTPLPAKPEEDQGGGHDAPNWSRSKSTIILLGATILYAIIAEILVDNVDSILADFPINPKFLGLTVFALVPNTTEFLNAISFAVGGNVALSLEIGSAYALQVVLIQIPCLVLYSIYQNFENVEQTFTLIFPLWDIIATLISIYLFTYIYAEGKSNYFKGVILILIYVVVLSGFWFNDIIDSI

SEQ ID NO: 15246 - protein, 235 aa, Candida albicans
RVKMLNKKKFLRFLFVTYQPMSNTPIQGSSSKPNVAAEDYSRSSSRTNILSVRNRSATRMKKNSRPNLKRLGSVSHPQGLVYSVDDDINENDKDDSTKESEPKSDRDYLEGYNDALRALSNRKGRTSSGHLSIAGTPLRSPEEIATIESKLAKDLTDAEEQMRLLEDLDSGPTPNVTDEFVEPEDNNEDAGSIKSTSTVESLNLKERQNAINSTHPFGIKISKPWLYKKSRLFAK

SEQ ID NO: 15247 - protein, 347 aa, Candida albicans
QRNLVSLTRLNRTKVLILRGRSDIFFPTNRTDTRTHSPCFIIPIIMSRTADDAQQIDNGDQQREGVLDEYAQEGEYESSSDYDDELFVDKKEKSRRPKENSFTQQRLKAINPVLTAKTVIPLLVAIAIVFVPLGAAMWYASHKIEDITIDYSQCQNLARFDYWSEIPDNFTTYNFRNIDTNSELKPKFSWKLTNDTSQQFDDEKLVCQVQFEVVEKMKGPIYLYYRLHNFYANHRRYVKSFSEDQLNGKPATLNTIKNTVGQNCQPLSDVNGKRIYPCGLIANSLFNDTFTEAFEAVNGTSSDNTLVFDRLRDCLVPLDEIDLENSIHFSEFVHPPIGFKKFPNGYY

SEQ ID NO: 15248 - protein, 389 aa, Candida albicans
FLYMAAILYKYPMATNNNNNNGNPILRSLETSCCFLATLFPKVFCTLVLTWSLYVLLFIIPNYIKSSLNSTILNIIGITLYVLCIISYYKIILIGPGSPLDYPELRINDLNRMINENPYNNNNNDEEPGDLPPESMIIHTMKVNGNQGYRYCTKCSVWKPDRSHHCSSSGKCILKMDHYCPWFSTCIGFHNYKFFIQFLSYVAIYCWFLFIISGKILYNFITEGLFEDEILSLNLVAVLILSFAFAIAVSVFAMFLIYLCCKNLTTIEFQEKRWNYRGQANDERFNYEFDNNGKRKKINTNIFDLGIMENWKLVMGPNWITWILPITVTVTANTKSMISQDEFNNGVNFKVNEEIYAKYLHNAELQQQLNQQLSSYKDRLRRERQANIV

SEQ ID NO: 15249 - protein, 148 aa, Candida albicans
QPNFYMVLPIIVGLGATIVALTAKATITAYKQYLHLTPAMIATLNNIKLINLESSMSINKSDPRYAHYKYLRLKYPNRPFLDPMTEQEALLILGIEGNDILNLDKKMIRDRYRKLMILNHPDKNGSQYISQRINEAKDILDKSYMVNK

SEQ ID NO: 15250 - protein, 701 aa, Candida albicans
  UNSURE (114): Identity of amino acid sequences at the above locations are unknown.
TSNMSGLKNRKSTTNKDKNAKTTSSSKVADKNELKDPVETTSFDTEDKIAKPILQDEPQKHHHHHHPHHEHDHDDKESTSMSRTNSLQKKNHSKKLKHHQKKKLSESRRVMFIXGALIGLILAALFTTNSESFTRDLDKLVNLDQFSDIFDDWKDLKNLKGLLPNGIQSFLQDKGVNTQDDGFNGSAESFSVGLRLENLKNFTADHNVVMVPGVISTGLESWGTTTTGDCPSIGHFRKRLWGSFYMLRTMVLDKTCWLRHIMLDTTTGLDPPNIKVRAAQGFEAADFFMAGYWIWNKILQNLAVIGYGPNNMISASYDWRLTYIDLEKRDGYFSKLKAQVEIVKQLTGKKSVLVGHSMGSQIIYYFLKWVEAKGEYYGNGGPNWVEDYVEAFVNISGSSLGTPKAIPALISGEMKDTVQLNALAVYGLEQFFSRRERVDMLRSFGGIASMIPKGGDKIWGNLTYAPDDEIVAFDTEKEDIGEKKRSFGSFIQYKTANDSSREVTIDQSIEELLENSPDWYSKRVRENYSFGVAHTKEELEKNNHDQLKWSNPLEAALPNAPSLKVYCFYGVGNPTERAYKYMPADKSTKLDYVIDADSPDGVVLGDGDGTVSLLTHTMCHEWQKGDKSRYNPANVNVTIVEIKHEPDRFDLRGGAKTAEHVDILGSAELNELVLTVAAGKGHTIQNRYVSNLKKIVENMHL

SEQ ID NO: 15251 - protein, 445 aa, Candida albicans
KTPPITLSTHHNMIEYANKLCLAPMVRSGELPIRLLSLRYGCDLLWTPELVDKKILQSTRIINQELNTIDYIVSNHQQLDKKTVIFRKHPVETGRLILQLGSSDPQLAVDAARKVIDDVDGIDLNCGCPKNFSTHSGMGAELLKTPDKLCSILINLVEKIGIPNKKSISCKIRLFNNYDQLKNLIEKILQTGISNLTIHCRTPIMRNRQDPVWNFLPKLIPIIQTAGVNLVINGNMQNVADLKNLQSALNDNGGGKLSIMIAEAAEANPSVFSHSPKPQCLIIQELFEICQKYYQNFLATKFLMLNMIPSKSKYFQKLSQTKSFDQMGVILKEISQEYEKQKQMSTKGLDKIFTIMNRDCQKANFFNLDQFQKHIAQRGEYMTKFFHEWQESTMLEDFDDTPTKRPLLNDNNNNVSNQPSKRQKKKMAKSQTQPLSSIENPIKVT

SEQ ID NO: 15252 - protein, 197 aa, Candida albicans
SQSHLNSTMKILSKEEKDAHISHIISEGAKGLFYGGALSVGLYQYLKHRHPARFATFNPSIKAAIIAMPTISVAAFFADQGSVEFDRKMHQSEYQEAKYLEEYREWNRLSLSDKCFTVLNDNKYKIIISAWAGSLYGSWVLVNRDKIMDTAQKAVQARMYAQGITIILLLGTLLLAMKEEEINKKKPKPIPEWKRII

SEQ ID NO: 15253 - protein, 210 aa, Candida albicans
  UNSURE (3): Identity of amino acid sequences at the above locations are unknown.
SIXEKSSYSLLTLLTMKLITENEKNDHKSHIMKEGSKGFLIGSVIGLGLIRYFKFKQPLKYNSFNWTVKACLYTMPTLGFTAFLTDNGGTQFFKSRYRSTHLQQEKQVKSQQLDNLSMLEKIIYRLNEHKYKLVVGAWAGFLFGAWKIINKDLLLTKTQKLIHARVYAQAFTIGVLLSTLYLNMKEVELNNKLPQLPQSWERVLQDKGEL

SEQ ID NO: 15254 - protein, 263 aa, Candida albicans
QKISHEKEFSIFINNNHDKVQIESNMSTAAPQENSPELKLSPSSKLNGFEWWRRTLLYQTGLGLNAEEKAQYEFDYNNRNLAEKCQQCNEYRNWMLEYSPSVLFMMDHIKKLTKDKEPILTKENITCDVCDFTKGGGFHPDEGILLCANWIRNKWQLEDILTHELVHVYDYLKFNLDMNNLRHHACTEIRASMLSGECRIWQEIKKTGLGNFGKKFQDCIKRRAVLSVSSNPICKSPEEAEKVVSTVWNSCFNDTRPFERVYR

SEQ ID NO: 15255 - protein, 329 aa, Candida albicans
RLELRFFTLGFIIVFSLINKAGDLYDKSIVTRFLSGISEVMNKQFYRYGVSKDQLYIKDNSENYSSYATGRVNVATVNINFSLVPRQNIFLWILETAFSFFTGNVVAPEDKAEIIITPLAQYDNFISAVVSKLGMNDARKFNYFLSLCKTTDSPNLPESFVYMSETNEFQEKITTPELRSSLTLQSANYIKYIALTDQSVEKPESLRELMPKRRIVISVKAITSQNDLKQLSAVLDAVFNLVDKLADGAITFKPEALKKVVKTREAEIDKLKKIQEEIKKEELAEEQSKLKRQERDRLRNMSREEQLKAEKKAAERRQKKMQKKQRIKM

SEQ ID NO: 15256 - protein, 306 aa, Candida albicans
KKKQANCSIYTMKSLLSILSHVVHGYVGNRATVFPLQYAGWDVDAINTTNFSNHPGYGSLSGTASPPEAIQDIILGLKQILDFNNVYDIILTGYTPNAEVLQILKSEIEQAITNSRNKPHWIVDPVLGDNGKLYVKENLIPVYRDIFASGLVELTTPNQFEFETLSGVKIVDWSTAKDAIYEFRKLYKVKNIVISSVSIDDHLYCVGSSNDRIFYISIEQIGCSFNGCGDLFTALLADEFYNGEYVLSPQMLSKVLYKLHKILEFSYDDIFKRIGQIPTVVKDIRVVAAKEFLTSDYKLDTDVIYL

SEQ ID NO: 15257 - protein, 349 aa, Candida albicans
  UNSURE (328),(330),(333),(334),(337),(338),(341),(342),(344): Identity of amino acid sequences at the above locations are unknown.
LRGEYFLFDYISLNILIMDEIPELVTELPENGVIKTEKVPAAPFVPSSLTPTALAKKIPITIVTGYLGSGKSTLLQNIGKTANKRLAIILNEFGDSSVIEKSVTIQDQDDSVQEWLDIGNGCLCCTVKDNGVTAIENLIENSKDKIDYILLETTGVADPAPIAKMFWLDEGLASNIYIDGVVTVVDAEHITKCLDDVGGHWHKESLGEDVEFEDGITTAHLQLALADVILLNKIDKVSDTQPMTQRIRQINQTSPIHTTSFGDIEISKILDLHAFDVDAKLTTSETSFHDDRISTVTITFPFLENEEGFSKVENFLQHVLRDNLIYGXKXQVXXPFXXCTXXAXISPIM

SEQ ID NO: 15258 - protein, 266 aa, Candida albicans
KKRFDWFLVLDSFIVPIPFALLFLPFFAHTLLPYHWSNFLFIKIIPRRFIGFYMVSILHVLVFRLEVGLFGLIIAIVSSLGFGQSNIFGNIIYLAMGTLLGGFTSFCIDSYFWGRPLIPEIDSFIFNIVQGKSTEWGTEPWDTYFKKYLFQLFRPPVILMLAIPGLINDPANDGTKFGDKKSVPHPARYSLRILFISSILFIAAMSFQPHKEWRFIVYTIPIFTLQAANGVTNICQKWGLSVLNKVLIFIIGANVIISSLLWSHMA

SEQ ID NO: 15259 - protein, 162 aa, Candida albicans
ISDFFFSKHITRFSLHHGNKELIMYRYNKVLDATLIALVSFHLVISPFTKVEESFNIQAIHDILKFGIFPFETIDNYDHKQFPGVVPRTFLGSLVVAGLAKPILLLSSAFGFEIEGYELQKLVRAVLGLVNVLMLIRLRDSINKITFSDKKSERKGLIGFWY

SEQ ID NO: 15260 - protein, 212 aa, Candida albicans
QSMNFFNWGKVIIFSKCWGNLGKFLIFITPGGKVINSTTIIILENYKNETVSVHMDVPACMTGITRFGELDGKFASYDKSEQDFDITNYDIIITHNEVPNWELLHSSRVFDGISLRMFIQIFMAQRKDRLTIFNITKLILSEFAQGEFGTVHDMLRSTITTVEYLNVYKNVNKNPHMVQGVPETEIIDQEIDPEEIRQDVNEQIDKFESAVL

SEQ ID NO: 15261 - protein, 61 aa, Candida albicans
GPSSPVVKIKCSKAYMHSRMRFRVKEYLKILNRAKPENLDDEGKVIENRKTASGRRFDIRA

SEQ ID NO: 15262 - protein, 126 aa, Candida albicans
QLISIDLLSPTTMLHIEQNNLLIEKTLTERLFPNPSESSLKSLDRIVSDFDFTTFHLLTLPGEKHLLLISLSLRCWPDLVKHDVVKYLNDKYQPFNEVLTILSTNDVEQGYDYSLVLDTSTATTSS

SEQ ID NO: 15263 - protein, 426 aa, Candida albicans
  UNSURE (47),(68): Identity of amino acid sequences at the above locations are unknown.
TGFSPEEDIKEEEPGEEVEDTNKVENNMGINLQPEVDPDYIHKHQTXFNKFRQSTESEAIEQEKEEVXEEDANIEQHSLVPLPQPALPRDRKLSSVSTHTKNLDWLTKPQYASPLDKKAFTDFKLSSFMIKNLEKMGFTEAFSVQISVLNMMLPEIEAQKLKPDRVGDILVNASTGSGKTLAYLIPIIESLYRRVVPRVRVIILVPTKPLINQVKSTLLQLSSGTNLQIAALKNDVSINDEKDLLTKSVPDIIVSTPGRLVEHLLNDSINLSSLQYLIIDEADRLLNQSFQNWSNVLLDKIDSQINIAEVWKLSVQKLVFSATLTTDAGKLSSLKFYNPRLIIVNDSKQLVNEIFTVPVTLSEFKIHLGVAKNSLKPLILTKFLISTNKLSNVLIFTKSNESSIRLTELLISLFSQTFYQFKDCLY

SEQ ID NO: 15264 - protein, 689 aa, Candida albicans
LYSMTDKHLLPSPALNEAFETESAVSDTSDTPMTNNFEIPQIQIPQDSQINPMSPSIHIEEAFVPNDTSSASNFGMLSSANFSTDSLNDTTEPFVDYYNNSNSNNGSPRRYSNSSLTNSPRIGRANSNSATSRSRPLSAFLMDSSNAISEDGQPIQPVFNNTPRSRNSLTFGIKTPVSSTFANNYTPPPLAAPTGPYRSSSPTRQSSPLRINKHYRSTSPVRRGSSPTKANNNNNNSNPFNFQSQDLMYQTNLNVSNGSNLSLPVKPAHRKGHKYKHSSISMKLFEQAPPVDIGMTQLSAIPDLYPIPNFNETLNSITPNQKLRFMWSGFHVGLSLIIFTIGFKFKLPSLSTLAHLVFYDSLGSLLIVFVDTMSNFDVWNKSSLAYPFGLGRIEVLVGFALSTSLVMVGFDLFSHFIEEFIILWVSPDNHDDHEHLSHNVHAEPGNNGNSNWFIYIVVLIVTMAVSLFSSNYILTYDRITEMINGQDDTDLKGNFPTKRNISNGSLINEANTIDNNTTGEKLKKIVSAWKKNPTHLITLSYTLFLLVGPLIPQSLTSDLAIDINEAATITVALLLCYNGWKLVKTLGGILLCSFPYSDYDYHVLKSRIIDQILSKDFFKQTYRIEKFFITKFNYRLFVIGMKINMKGANSDEEVRMRFEINRIICNELEKLDNSSKLVKPEITIDIDRF

SEQ ID NO: 15265 - protein, 178 aa, Candida albicans
CVSSFFFSNIKLSERSLISLQRERKKYHINTIQTFRSSSYNLVKPKRKMKFLTTNFVKCAVKSCQSSLDSFPLKYEECQLVQEEQDYNPEFIVHMLDRLDWNAIIQVAKDLGNESLPPTKPEDLDPIMEDNQAILKDLHTLLVETQIIEGKMICKNCQHIYYIKNSIPNFLLPPHLAN

SEQ ID NO: 15266 - protein, 632 aa, Candida albicans
FVFPHSHVSMTTATTKTTTITTNANVNANQPQPADKSSATPSTTPSATGTPKPSATQVQLSQDRASNIGWFFIKSYYDFFISKLDEIHKIYHPHASINHDAFPGTKNDKSDSGASNDNVKDVLPIAYKAKGTDAIKETFSKHLSLRKNNRIVITSACFEVSLEKNIIIVVFGEWSSNDEPYKQFTQTFVLVPGKTDNTYDVANDILKFVSVNGYKEKHEQKREQEVKASSQTAVNGNGSSTTTNNNNNNNNSNTSVTKKPTVTTTGSEPVTKVTTESTPKTSGLKPESSKKDVATNGEVKKEDFEKTQPIKSDVKVENQEEKQEKISNTDKELTKDDSVNKQLNESSVTTTTSTTQNSKPVVTKNEESKEEKAPSTKEETKQPTVKKPQPEPTKPNAAAAAPQQQQQQPLTWAALAQQAVPIKQTTKSTGSSSAVAKPVSAGSSSGATPTVKKLVTSFSSINNSTTSPGQHGSNGGGGGGKFRKEDWYPIYIRGIRLLDEKELKDHLSKKFGELKFFKVNQNIALVDFVHQEAQRKALDAKETTLDGVTFALEPRESKTGNNFHNNSGNNNNSNNGGYRKFSGSGSGSGGGGGQSKEGSGSGGSAKNKDKFDNKKINGSGNKKNLNKAPSFK

SEQ ID NO: 15267 - protein, 343 aa, Candida albicans
KEKQRKKIPTRSHLSSHFQYSFSFFFLFIVILKHIHLRYISNYTHIMGTQKKEKQRRVRENDTRDGNLRVKGENFYRDAKKVKHLNMYKQGRAIRNKKGEIIKAADLQSTDIPNARVDPNRKWFGNTRVIAQDALTHFREVMGEKSKDSYQVLLKRNKLPMSLLDEKDTTESPTAKIVETESYSSTFGPKQQRKKPRVAASSLEDLMNAAEADSTQFQEKQELDSTLGLMGGSILDKDDFTQEAKEAIFHKGQSKRIWNELYKVIDSSDVVIHVLDARDPIGTRCESVEKYIKDECPHKHLIYVLNKCDLVPTWVAVCFENVNFWTNVFPFFFLLLTFAIPGN

SEQ ID NO: 15268 - protein, 131 aa, Candida albicans
TKRGLSLRVKRENYEIKGWSKFEADESLLERASTEFIELIARKQGRLLKGGEPDESGVSKQILNDFNRGKIPWFVPPPKDEEKDEDKTGEDKKIGYKRKRQEREAAEKELQEKEENQDEDDKEVKKAKLEE

SEQ ID NO: 15269 - protein, 73 aa, Candida albicans
SQQQKLNKSFVSNVEKSKMIANIQKKRKTTDDDNIRRDFKQRKVTTTRSDAKDDLKSKSKPTDKLNDILSKVF

SEQ ID NO: 15270 - protein, 304 aa, Candida albicans
LCDVSTKKFEKSEYFFFVRSSSFLLNKTNTTISNQKIENMSATSDRESDFESEDESNFQDKVFNVKSKTSSFFHANTPDNEDFLEDEEDKDEQDEGDTKTKPKDGKHNFEDIAYDEESEENIGDDEDGNADLSLDGGSKVNKKLKKLTSKELAKEQKRIKRTGVCYLSRVPPYMKPAKLRSVLSRFGEIDRLFLKPEDPSVYHKRVKYGGNKKKNFTEGWIEFVNKSDAQLCDATLNGNKLGGKKTSYYYDDIINIKYLPGFKWVDLTQHIAKENEVRQAKLAMEIYQQHPLYDLYIALEVHFR

SEQ ID NO: 15271 - protein, 354 aa, Candida albicans
VSYYYYYYHQTKQNEEKSIADTKSFTHKALPSSNGAVTLKTTSVKTALTTTSTVFSATSLPSTTYTPSTSVSLVSTTKKNPVSSQSVVSTTKTISINTSLITDAVTITKEATTLPNSKHSSTFTNGSISFISTSANKVKSTVTSDISNNSQNRSSLSLTSTIDQLASITNSTLTTITKPTSLVPDFSYTNSSRVSSTMRNSSEESSMVLEKSSSKLLSSTSFLNSSSIASTTESSELVSATTSDSSLSHSSSSSVELSSSLSSEADSSSSSESVETGSSDETASNYSGDLFKAIDTNAPPTVFARSEIPLTIPAGVDNNGKPIGTNKFYTNLLLGNQEFMVYPLPIRLYGSKTN

SEQ ID NO: 15272 - protein, 141 aa, Candida albicans
QFLLVSTTTVNQLEPTNSIPIYYLVIKNSWCIHCQSDFMGVKQINYGIAVQHNNVSDRVFGSINTNNNGVASYYFNPTNNAELIFSATSFSKDSMHMKMFQMAELSALVTLSSSSNEEFKYWDIPLFQSMGFCYRVLKRGT

SEQ ID NO: 15273 - protein, 994 aa, Candida albicans
EDRKSIADTKSFTHKALPSSNGAVTLKTTSVKTALTTTSTVFSATSLPSTTYTPSTSVSLVSTTKKNPVSSQSVVSTTKTISINTSLITDAVTITKEATTLPNSKHSSIFTNGSISFISTSANKVKSTVTSDISNNSQNGSSLSLTSTINQLASITNSTLTTITKPTSLVPDFSYTNSSRVSSTMRNSSEESSMVLEKSSSKLLSSTSFLNSSSIASTTESSELASATTSDSSLNHSSSSSVELSSSLSSEADSSSSSESVETGSSDETASNYSGDLFKAIDTNAPPTVFARSEIPLTIPAGVDNNGKPIGTNKFYTNLLLGNQDFMVYPLPYGLYWSKTSYYGFAVQHNNVSDRVFGSINTNNKGVASYYFNPTNNAELIFSATSFSKDSMHMKVSQMAELSALVTLSSSSNDESNYLDIPLVQGMGFVTGIYNGNLTPLLNSLFGVKDLSLETSDALLSNVLKYRATLLNNVQWLIYVTLPDKDTDFKLEVEDFYNLKGSKPVDGLIIQVAIAPEDNDNDKYYDAAAGMYVTGATVLGSVSQGTAASYKFSYTTAGKSSSNNPIVFALPHHMDSLTGSALDALTGITVTSTTKGEMTGFLTNELEFSETINQDVEFLPWTENMTGSLTYTKDQLELLASAANKELAANIAATVKNMNSNYFSGKVLDKYAQILLVVSEIIQDEEVTKDALNAMKDAFKVFTQNKQYYPLMYDTKFGGVTSTSAQDGDPNADFGSAYYNDHDFHYGYFIHAAAIVGYVDKKLGGTWAQSNKDWVNSLVRDASNPSADDTYFPVSRMFDWFSGHSWATGLFVTYKNIESSSESLHFAAAIKLWGKVVGDQSMEARGGLMISIMARSFNMYFYYKSDNTVEPKQILPNKVSGIFFENKVDYTTFFGTPADHPEYVHGIHMLPITPSSSLVRKTSYVQEEWKDQIAGFIDNVDSGWTGILRLNQALFDPKSSYEFFASNNWDDKWLDNGQSRTWSLAFAAGALNAS

SEQ ID NO: 15274 - protein, 93 aa, Candida albicans
  UNSURE (67): Identity of amino acid sequences at the above locations are unknown.
TTTSSMSVILASAGYDHTIRFWDALTGVCSRTIQHPESQVNRLEITSDKRFLAAAGNLYVKLYDIRXTGKFGKWGKRYNKYFSFNKFIKSKQF

SEQ ID NO: 15275 - protein, 165 aa, Candida albicans
RKFQADNKWMVTSLEDGTVKVWDVRSPSVQRNYKHQCPVNEVVIHPNQGELISCDQDGNIRVWDLGENLCTHHLIPEDDVPINSLSVASDGSMLVAGNNKGNCYVWKMQNQRDATVLTPVTKFRSHLKYITRVLLLTDMKHLATCSADHTARIWSTEQNFNFEIT

SEQ ID NO: 15276 - protein, 195 aa, Candida albicans
TMSTSLPPAIVFSDWDGTITLQDSNDYLTDNIGMGYDNRMIINDKILEGKQSFRDGFKEMLASINKPFNECIEILLQNVQLDPGFKDFYQYCQSKNIPIIVISSGMKPIIYALLEKLIGQEAIKTIDIISNDVRVDGDNWEILFKDPESGFGHDKAKSIKEYLTSHGYESDADTPRPTLFSNGDVVFTRRLEGTT

SEQ ID NO: 15277 - protein, 272 aa, Candida albicans
MARIMGASCRLREEPPPIQDPRPPTPSEVTHKSDYFDHAHMPAMEKLHLNVPINEVELSKRSSIGSFVSSGSDSDEEEAGNVPQYTHPELKKSQLHFSKLDNIEPLLSPIKRIFYVSPYGEEICPTAHGKVASTIANTDALIYSIGSLMTSIVPIIILKGIGKAILQNECKRKILLLNGCLDRETFGMTASDFIRVIVLLAEYSINSHANGLAAKYEWNRFITHLVYMEDSSIDVDVDYLTSKGVTCVKVAKVEGTNYFDLKSLENVLDEII

SEQ ID NO: 15278 - protein, 469 aa, Candida albicans
  UNSURE (7),(14): Identity of amino acid sequences at the above locations are unknown.
RRGIKVXMFMHPIXIIQPVISEFDPDLIIVSSGFDAADGDVIGACHVTPAGYGYMTHTLKGIARGKLAVILEGGYNLDSISKSALAVAKVLVGEPPENTITLRPQAEAIEVVDEVIKIQSKYFKSLRNGIPNGIFEDVYDLADVEKSNYKLVNIADPIRSHQVEKLFNEKEFINIPIISSPSNGEKPPFTTDLPDQLEDLIVASPDIYNCTTIILTIHDPPEIWANINPTNGVIETNSTMVLEHPLVQIMDKIQKEKDPENQEKFGYLDINIPSFQLPIPGTTSESSTYNPIIFAQEVLLYIWDNYIAYFQQLKNLVMVGFGDSYQSIVNLYGKRPSNEIKDLIKGTVAFLNRTTLKPLIPVMDESMVDWYYQNSIIFTSNFNTCWTGGSGAGNGNGNGNGNNGNSSNGGGNKSADSNGHDDFSKRPRKKFGRVIKAKTDGLCDVIQEKFDEGVDFILDSIEDYSSSED

SEQ ID NO: 15279 - protein, 386 aa, Candida albicans
ADADLFPWRRLYKNVDWSRRNLDSKLENQISEEENQSQNQNFPTAIEDSIQASIEKLDEVDDEINPIEVKDEFPTTIGTTYDILHPREPSPKRIKLEETESEPDSNGIADNDQTMVVVPPKKPQLFYTPLKTGLVYDVRMRYHAKVFTSYSEYIDPHPEDPRRIYRIYKKLVEAGIVLDPSLAGINEIGPFMLKIPIREATSEEILQVHSEDHLKFIQSTEDMSRDQLLKETETGDSIYVNNDSYLSAKLSCGGTIEACKAVIEGRVKNSLAIVRPPGHHAEPNTPAGFCLFSNVAVAAKNMLKNYPESVRRIVIVDWDIHHGNGTQKAFYNDPRVLYISLHRFENGKFYPGTKYGDLNQVGEGPGEGFTINIPCFQHADGHHSGK

SEQ ID NO: 15280 - protein, 354 aa, Candida albicans
HSFFFGGRVHLKVMIIKDRTEKKNTYKKKYPIIFFGLISSHFLYITYTPMKLYFEAEKFLKPNKGTNGSLQSRIFNDKRLTNSPKHIFALVYSTLKYKEYIDVIVKKSKIQHDLQIKKVKMSNELLCLLVHDLLFSSKGRIQSGKHPMKDAFLLNKTRLQAEFTKLKLKYKVKSVDQLPTKEADDDETPIRWFRINTIKIDIDRFYTKHPFFKQLQPVSSIDEITETGIIYSDDYIPNLFGVHPREKITSTEAYRLGEIIIQDRASCFPSHILNADPEDVHTQVIDACAAPGNKTTHAAAHLPNSDSVVYAFERDSKRVKILKTMCEKATGKTKKKLIQVTHADFTTTKPEDFP

SEQ ID NO: 15281 - protein, 71 aa, Candida albicans
  UNSURE (67): Identity of amino acid sequences at the above locations are unknown.
LTLISQPQNPKIFPDVTGLVIDPSCSGSGIFGRALEDSHNEEEIENVNTERLNNLAGFLFAANHHGXDVGV

SEQ ID NO: 15282 - protein, 281 aa, Candida albicans
KTVMESDVELHDRGLKLEESTSSNDKSETNVNEFEKPRHYHHHQEVADKVVYSDELDDYHEDEVDDDEVDYDDDDDLKVVVDESLGTTILREIQDGTYVCLVCTGEINKDSQIWTCHQCFRVYDLDCIQDWAVRGSSTNKTSKEWRCPSCNHATKVIPKVFTCWCGKLINPEHNVLMPFSCGSMCNYKYASCVHSCTYICHPGQHPICGATGPMMKCHCGKESRQLPCLITPYDEGWRCAQDCDTILCDLGHKCLKGCHSGFCQVCSTMIQVSCYCGDEQK

SEQ ID NO: 15283 - protein, 574 aa, Candida albicans
IQCHEKVLMNCGGGRVGGYSCGKTKRFYYDCQKHFEIKSCQPPPTSLMKCKYSPEIITTCYCGKTKADLHNRTKCTDPVPECSNICDKLLACGHRCKFKCHEGDCDCISVSEIKCSCGHESYLAPCKFIQSGIKPKCNHKCSVLLNCRKHYHRLECCPDEQIGLARERDRKKAIRNNIRSNFRQDVMSIEASHICTRTCNRLKSCGKHMCQALCHNGPCEVCLESTNEDLVCPCGKTVIPAPIRCGTKLVCHEQCIRVPLCGHRPEPHECHDDSINCPKCTALVVRECDCGATLDIPGILCFQERVSCGKMCKVAKDCGHPCFRTCSSQCTKENIHNSSRDCQSYCKKIRNSCPHLCKLKCHFNKVGKSSNCDVVTCTSEVTVRCECGRLEKKIKCGASVGEPSSIGTVLECDSVCVAAKRDAALRAAFMGTPEPETTATEGSLYNALIIQDLFFGLVKDDLDRELKPLYQDQLENYEIQWLKGSSFIFYSPEKSKNMDVEEENKLYLLLKSFRRVLREKSLAFDCKLCLIDDSASFVLKIDNNSTPQSQSNLIQDVSKTKKSQNGFDVLQTDD

SEQ ID NO: 15284 - protein, 235 aa, Candida albicans
GRGFSSPWGKRSQFKSSISYNLNYDTRDNKHLPTKGKFFQIGLEYNDPSILFFKLKNQYPFIKTVTQSQFIHRFPFINSNLIITNKFGLLYPLTKDKNSSLLDRFYIGGPNDVRSFLLNGLGPKDYNSCIGGDLFLNGGISLITDIPKYNESNFKIHNFINFGRLVGFNKDISLFNNLQNLNLTLTSQYSISYGFGILFNHPMARFELNFVLPLVTHERDSLRKGIQYGIGVSFL

SEQ ID NO: 15285 - protein, 377 aa, Candida albicans
EYNITLKKIYKKNKQNQIRDRDNSSVESFSLLSNTQLLPLTSFFLLYTIFNNDLSDPLTVFFLVPFYQHFGTWHSISETYFQLLTLSPLPPPSQLRMSDYMDDPFQMDEEIPSKKDPIPSKERSLPIPENATIDRDITPLYPTPPNIHYDNNKIIRSKLDQLKLEENTGGTNTTTEEEGEKYEEDIDDKLDMSLQAKLRLEYENCLDYDKPLTPPENFAPVINKIYRSSFPQPNNFAFLKKLKLKSILCLIPEDYPHLQQEFIKNENIKLFQLGMSGNKEPFVKISADLITEAVKIVLNPENQPILIHCNRGKHRTGCLVGVIRKLQNWSLTLIFDEYRKFACPKERPMDQQFIELYDDTEILEYCYEYDLLPLKWD

SEQ ID NO: 15286 - protein, 363 aa, Candida albicans
YYKIIQLSEKEFIASTSNGSLIGYSISNLSSTPTIKIEKAHESSINDIVKIDNDSIASCSSDGIKIWNLRSKSAIVTLTNAKKSNFLSLAYKNNLLAAGTELVGVDAELHIWDIRNTDNVVRSFVDSHHDDITALEFHPTLTNYLMSGSTDGYVNIYNLIETEEDEALHQVINFASVHSCHFITESRISILTHMETLMIHDLNDTNYEELVEPKFKDFGDLRKEWPLNEYVIDISPTGFAAYGSNSESSLSLLPFDPESESFDLSKLISFPKAHGEEVVRDFVLIPNSKMALSCGEDGRIKLWELPFQLKSFVLGSEEKETDITMTEGDVQLEKKSKKDKKDKKKDKKKDKKKHKKDVRFKPY

SEQ ID NO: 15287 - protein, 401 aa, Candida albicans
KIQFYSPKVVVNHYAKGTITLLPDNTKIIEVKSVLRDKLKAIHLVDELIEPGTQVRLNVDWGRRLDIMQQHTGQHLLSAVFDTYKLETLSWSMGETKDDINYIELPRKIDNDLVVEVQNKVNQLIVDSIPITVVTSDQHGHGHGQEHEHEHEHADVDISHIPDDYDLSQGGIIRIVKIGELDANPCCGTHLTSTAQIQSIALLHQSPIRGGHSRLHFICGGRVANHLRKEHEILKNVSTNQLSCSIDAVEEKIELLSLNYKKTNSTLNNLLKELASIEANKIFQNFKTHDNNNSKLAYVYRADLPEYLTWVQKELTTLINQDKTGDVDLSNKQTLVLLSGAAPNGGTIKILGPKAEELQKELKSKLSNLKGGGKGSSFQGKITKFEKGELEAVLKYLDSML

SEQ ID NO: 15288 - protein, 786 aa, Candida albicans
LAFLFITTATSRMDFIDFDTFTKDASGSDNDVFPQPQPPLSLPIASNLDQFSKKLSNLVLPGNILNNDNTKPSNEISEVDNVMEKYAKMSIDLIKRETGDVQLENEEDSKESSVRTSLSTRLSRVLNDSLSDATIREIFSNLQERFDKESNGYVVDLIELGIVGSMSRKKFKGRIESELIRNQLNILKQYQPIVKQLKQIEVKLNKLNELSVQTNDKINKNFDFSNKLNLEIKDLNDNKRLIGLKKNSLISFKEKFTLNEYEEFVLNSGDLNNEFFTTLARAERINENCSILLSLDNPQLGLKIIAKSNQMINRSIDRIVSYTNKTLGNMYSLSSKSRLATLHQCFKYLQNKLNYFNSIVNTFSESRSKVLVDEFNRQVQGDFEVNGQGRSSSISSDSRPIYMSAHDPVRFVGDLLAYVHSVSVNESETITSIFTMGDDNDKEFENIIQDVTDKILQSLSRPIKARVEQIVTTETKLSTLVQIFNLVELYNIMFTKQLGKAGNIVETVKQLIKVCQGRIFMIISNRLATIKNKNLTKLDLNLDLQPPEWIIEFYSDILPIVDQITTETILNLSPEENEKFLNLIVNEPIQVFNEHVDHNKVFSEKKDVLIIKSNFLDLILSKTIPVSLLSEKVLEVNEMIDKLTEEITQLELNNMLGQCGLYDYFNIINMICPFSDDFFEVSIYEPIKENKLYTKDSFVQVDEKVQEFFPSAMIEMQQSLLKLNSPIVVNQIIDNSFMQFVKFYCKLDLINKEYLDFSFTWSDMEIATLVGIEDVYSIFTTGRRPR

SEQ ID NO: 15289 - protein, 219 aa, Candida albicans
QDESIPQHTNTPSLSAYKFPQKQIEDQGLLALLGPNVTSFPFSEETFLNALKLRAEQERTKQEYYRVETANKNLAILQTALRAQMPVNMIPLLCVGNAPELTEEQMKMLIQQATFGTPSVLHPQQQVQQVQQHQQPLHFPTSQQQQQPQQQQQQQPFVGIQPGLLQEQQIQIIQANQKRMQQELQQKGGSFSQGKSISEITYTRRKWWWCRFPTGHIQC

SEQ ID NO: 15290 - protein, 198 aa, Candida albicans
HQIHHHGHLSLIASSALKSETKAKPDKLSSPITKVSSNKIIIDKTISNMLGLSEETIEEKSIWPYKMETLNGIISLKIEEEKTKQENIKKDLANTAIELLTLAKSLNVPGELISYLFISDSVTSNSLNATISKIRNETHQLFLKDLSEKSKMDSIIGIKRKHTSTSIKSSGSALVFPLRSPKKLPLEECTSSGRFGWK

SEQ ID NO: 15291 - protein, 93 aa, Candida albicans
KQTDLSEFSLEESEFNYRVRQIIGKIREQNDSIIWKNLYVVVGASSNEPIEISQQRDLMALRMWASSCLVEDKTGSEPSYRDFLTSLKSKVSQ

SEQ ID NO: 15292 - protein, 115 aa, Candida albicans
HIIRTNRSLLYNLESDYDSDTSDYVVPKLEFELKEVEENDNEDNKGGIQESNGSDAEFDFPLFAASDTVVEDRGRSKEAKPSIMKVSLREQSEERVINERPESFYFAKYTDKQRE

SEQ ID NO: 15293 - protein, 158 aa, Candida albicans
  UNSURE (154): Identity of amino acid sequences at the above locations are unknown.
MTSQTTEYPTNELEDFEAFLETNFDPQQFANELLLATNGQENPHLDLVTPIKKLKFDIQECDKRIEKISSSNYSSLISNFQKIAEYQKILTTQINPNLERINAPFKRIKQEVVEPFDEAMKLNKALKRIHLTLELLRGTSFLIFIIQFSTDRDXGQLY

SEQ ID NO: 15294 - protein, 378 aa, Candida albicans
  UNSURE (23): Identity of amino acid sequences at the above locations are unknown.
KILRFFWETNLNHQQFAKDLLLXTNGQENPHLDLVTPIKKLKFDIQECDKRIEKISSSNYSSLISNFQKIAEYQKILTTQINPNLERINAPFKRIKQEVVEPFDEAMKLNKALKRIHLTLELLRGTSFFIFIIQQIEELTSVLNERDLVRLAKLHIQINQMYQDATSEKGAEVSVLSVKLIRDYQSIAISKRSNFLSQCINVVSGDFNHPSTLERKNQKLHSHLSALYILDSSEFFNVFDRSTITRKVQSASAQLSRALQSPRNFTAILTEVKEESSEYFTKLSDILSDWKSESDDDKLTFLEIVLKYYKLESLTELFWTKLNQKFKKSIVAAMARGGPIAKNLKIYSQGLKTSVLETFKSEEERNMLLDSLSMIDYK

SEQ ID NO: 15295 - protein, 697 aa, Candida albicans
NNNNSTNNIINLDNASVNGSMIASSNAMVTGPPGTSIALGSGFRSPSILEGEQLQYFHDPVRQQQFKLPSTKAPSISNSISSSNNIDSILKRPVHLREASTYSVNDNDHRNLVLPNSTERFTASPSNNIGNENIPQYQKTSSVAHSINEGYNDDTFSYNEVEDNLIDEDSTDDGDLTKNTITNNNNPPTTSSQQQPQPQPQPQPQQPQLHTLSPLNQIQAATSATPSVSTKNASKRNYKTSSTSSKLRSTTSKLFDKKGSQPRRYSTIPDDIDIEDFDDELIYYDNTARFPANESTSLLNQNQRIPHYRSLNLNFPQVKRQSKRYLSTGQPLESSDRGSNKDGTDNGNNSDHNINSPLTANNNNNNVNHNDHGDNKKSNTNNNNIANNRAFPFPYQDQQHHYYYDYDDFDQESQINGPNFDLPDLPINRSASRNFNNNNNPKRFGDSHFFLPRKTDQYSQRTSFLKSCIHTFVCILIVLTIGFVLGFVLATTKDLTDVGITSIENPIVSKDELVFNVVIEAFNPGWFSVDINEVELDLFARSGYLPDTDNLKISNMGGSQKVETVKLGTILNFESVLNFKGGFLSREPTIQKGGIRLLYPGKNVTAEAKLVVNMADIKIAASNSIAKESTTSNDTNDNDNSKKWEIISSNPFDLIITGVLKYDLPFSRTSRSVVVRKTGYIDPTLFVIPQGENNISI

SEQ ID NO: 15296 - protein, 260 aa, Candida albicans
PNTHVTFKNVTKKKVKILTSQNFLAKLEVTHKRFSPANTPEDLAMRQETNDTQYVSNNKHSEESSRKILRLVVKLVPPLNFSLVENGIYRSGFPMPINYPFLKQLRLKTIIYLGDLGNQTSKKGKKKDKHGTAEIMNNYLDWIKNDTEIRFYNLLFESSQEPFNKPDDIQQATQSLTFALQLILNKENIPILIHSNKGTHRTGVLIGIMRKVLQGWCLSGIFEEYEKFAMGKSEYDLELIELWQPELYIDDANKPDFVRI

SEQ ID NO: 15297 - protein, 115 aa, Candida albicans
FPLKEHHIFSLFLFMSRISAKLIRDARRISPFLPRLLPANRTIEQASLELKWIKQELPKEDWNDAVNQRYQLVPLQYILGSQPFGGLNIKCKQGVLIPRWATEDVFTTGLEGPRL

SEQ ID NO: 15298 - protein, 247 aa, Candida albicans
QVENHYQRSLPKMKNYNVILFTMKVNKLEIDDEYSRLSGISDPKVVITTSRDPSVKLLQFLKEIKLMFPNSLKLNRGNYIISDLVSTCNRVQVSDMILLHEHRGVPSSLTVSHFPHGPTAIFTLHNVKLRHDLPNLGNVSESYPHLIFENFQSDLGKRVVKILQHLFPPGVKKDSSRVITFVNNDDYISVRHHVYVKTKDSVELSEIGPRFEMRLYEIRLGLPDNKDADVEWQMRRFIRTANRKNYL

SEQ ID NO: 15299 - protein, 475 aa, Candida albicans
TPSYTCIQIIMVFISTLLSSSLGSRFSNTLESHQIDDDYSGQYDFDTVELSSSSSSLPQSQRQVSSTNLSSGLLSYPDRRVITETTAATATINASNFSSPPSPPRQSLASTPTQPSNCVAVADIDTRFPPSSAVINQYDPYEEVPSYEASQRMHNQSANSNSNNIAHNNDNYITEDVSHIAPTTHIYTPIPSLPIPITSSTTGISYGNSYDALINNNNNNGNTSNRNNDNRNGNNSSNGNASNSTLRGGNIKRSSIKQLGLKFLNARQHFLLASCRDVSLIPPLIGLIRSWRMIYSNDTNNYSQVLNGDGVTLIRGSEHFLTGLWCIVAGYLSYSILDSLLVRWIMTYLTSAAIVRVLSMLTIIITIELYLINTTSAITDYGLHIWIFISCVLTFTYIVQNFVTSNLELINYYKRTTIHKRARFFDFYNIVVFAVVPVGLASFVTMVGLLRSLLLLRIEIDSNNNGNGMINLDGV

SEQ ID NO: 15300 - protein, 177 aa, Candida albicans
  UNSURE (167): Identity of amino acid sequences at the above locations are unknown.
QLFIIPPSPLQAHTSILYQMASETLSTTDINDNSANNDVEQDITSTTTTNNNSVNIPAKPNDYEALFKKLDIEKTGEITFLDFKRALKKFNHPINESPELLLKVFNSFDSNHDKKIDFKDFKEYLKTTDDQILKGFNQLDQDNDGRLNKSDFIRYLKESLHVKPSVXPIHFFRPFVI

SEQ ID NO: 15301 - protein, 328 aa, Candida albicans
  UNSURE (4),(5): Identity of amino acid sequences at the above locations are unknown.
NQVXXQFIFFAHLLFKQLDSNEDGYINYDEFREFLLLVPRLQGSRIKTAFTFLFEEYDINSDGDVTLINQFLDGFKFFLAGGLAGVVSKTCTAPFDRIKVFLIARTDLSSTILHSKQEIARQIALGAETHVIEALRKKLAHAEMEQAAELLAEEAKTTKSAAAARTAASGVTTASAQNAKTIRSPIVQAVRTLWRQGGIKAFYVGNGLNVMKVFPESAMKFGSFEAAKRFFARIEGVNDTTKISKISTYLAGGFGGVVAQLTVYPIDTLKFRLQCSNLDHPLNAILTAKEMLKDGGVKIFYRGIGVGLAGMFPYAALDLGPFPLSKNY

SEQ ID NO: 15302 - protein, 188 aa, Candida albicans
  UNSURE (74): Identity of amino acid sequences at the above locations are unknown.
PSETLEPPKQVEIKYQPLLKKDHAATDSSDIGQFNESNHKASKSTTSLSSLSRSSSQASLLTPSEDFDMSNVKXKPPPRQPVDPTYRGWKEVGGFEEEDVLTAEDETVDLLSRGSLFDQYLPAAIYGDWYHNAGYLIVAGLLSWIIGWFRFSVAPLFFVMVVFSLLYRASVKKYRGVLREQAQREFSS

SEQ ID NO: 15303 - protein, 395 aa, Candida albicans
HRKTFETQMSQNADEYEALTATLLSFYNFFRHQFEHIIKPRLIKFRAMTEKERALLPWYEAHTGELKQCIEVNRGFTELLSTSIANDWGVAGTSLDWHPAGPREFEITSTTLLQLMREWSDEAQAERDVAFTRIISELEELYPDEPSRQSIRILNPGCGLGRLVMELVIRGFWTQGNEISYHMLLASNFILNHSQFPHSHSIFPFLSRSSHLVKRKYQTRGITIPDVAPFAVLSELKEKTPSIAYEELMSITAGSFLELYGPNKPSDTLNDPAAIELKNSSKDSFDVVVTNFFLDTASNIIEYVRAIHHVLKNGGRWINFGPLLWHFEGDYNVSYINREDYVSIPDIKKGLELSREDLLELIKNMGFDFVKHESDIESTYCKDINLVFTTGLEGH

SEQ ID NO: 15304 - protein, 190 aa, Candida albicans
SNCTRMSLHHRLFSLIISIAIAMAPPLKALFVNSNFYMPNAPDELPPLSFIIDFTSYVGAASVPLGLILLGTTLARLQVKKMPPGFWKTALLITIARLIIIPIFGVGVTTGFYKGGWYGSDILVRFVSVLEFGLPNATSLVYFTAFYTDPLSEEHLQMDCLAICLICQYAILWITLPFLTTFTLKVSMGL

SEQ ID NO: 15305 - protein, 263 aa, Candida albicans
TRSFQPCGEYGNNHGGNNSVQSQRSESRREALAARKANKEDDRENNTATGGNGRKKKKEQNNNNNSTASGADGNNGSNGKKRNRDDKSNNTGSGNDLKKKKKLNNNDQSDNRRRGEDENGKGDGETSFNSGNAKNDPHGKLKTTTTGNLVGGSSTTATVSSSSTTSSSATTTTTSSTTTTKNSGSTGASTATATGASGAKGSSSSSSGNNEPTYCYCNQVSFGEMVGCDGDDCKREWFHLPCIGFKNPPKGKWYCDDCLKKLK

SEQ ID NO: 15306 - protein, 218 aa, Candida albicans
FLTMRTKQQQQQQQQSNSSSGVANNQKSYGYTTRTKSNSSVTNGGNVGATLTESRIITNINELLPGLNDISDAFEALPIDLIRYFTLLKEIDAKCINTIPQINHLINQYITNLHQDKNVTTTTTTTTTNDDNTIDLNKKLETRRLNLIKNKINEVIPCLEEKMHVTSVASDLLKKHMYRINQDYKLILLNNEIPQSIRIGPLNHPAFSPRRRRIRNCG

SEQ ID NO: 15307 - protein, 66 aa, Candida albicans
KVQNTTIMASITSNPQILINNDSSTNKAPTTNERLLRRINHPPNLRIVPPLNFCPVENQLYRSGQP

SEQ ID NO: 15308 - protein, 200 aa, Candida albicans
GRGSSSPVVKIIIRRTTDEFLEYCNDSSINIEYLGMINEFNSEPATATTTDKQSQSQSQSEEQKSQSQSQSQENQHHQFEQSDNNLLQDPSHLISSTIAKINNNNPWDSLNENTIKHALDLIVDKTNYPILICCGMGRHRTGTVIGCLRRLQHWNLNSVSEEYRRFTGSRGGRILVELLIESFNIDLVNINWELAPDWLK

SEQ ID NO: 15309 - protein, 187 aa, Candida albicans
SMKILGPRDHLNVIPILKGEDYDEIYDRAKLFWKKFIPEFEKKFPEIKNVLIVTHAATKIALGSALLQLKSVTDVIDDNQTVLRAGACSLSKFVRDGEDKTNHTIQWKIVMNGNCEFLTQGEEMNWDFRRGVEAGSAEDIAQRKAAAEAEAKALKKNEQTKSDGPITESATGAEIDGNEDEFEVRKT

SEQ ID NO: 15310 - protein, 83 aa, Candida albicans
  UNSURE (1): Identity of amino acid sequences at the above locations are unknown.
XSYKESMDADINDLNVGVISSDFMIKKLLNWGKWQNEISKLSRKTSEWVIAENSDHFIWNSPKGRKELQQLLLRLIGEQEYLK

SEQ ID NO: 15311 - protein, 278 aa, Candida albicans
RLLYWPFGTKFGVVRFIVKLPWGGLNSWFNSWMVNWVEEGKHYQEIRLTGRIEKRKTISELVIIFFKVLGEIIILWIVWCISWTLWINCFDTHEKPWGKLVPVNNNQFRVHVACFGDVHGKSDQPIVLVEGGQSTSSEAFQEWIEELHHLNKVERYCIWDRPGYGFSDSAPPPESLGIVTEYLMEALRKEKIEGPFSVVGFDIGGLYARMFASRNRAKIQSILFVDSWSPDLLKKWPFSGSGRKNESTKVFKKSLEVMDNITGFQLFSPTGTWAGSAK

SEQ ID NO: 15312 - protein, 379 aa, Candida albicans
KLLMPESSSNMIGREAAPSNRRTLSSKSNNSTPPINSSGSSRPSSPLEPPPPQLQQQQSSRRPSFGLNFLNNFTMRSHSSETASQPLMSNSPTLGNVHSHTHDDVSGNSQSFNEVAEESPLEEEEEPQNPAPEEIPQPPDSTYVDEDAKGGLDKDGFFSVRLTPLIDHSSTSSGLYFSPIIRRLSPKTSINIGRYTEKNKAAAHAPQGSSAPIVFKSKVVSRTHALFFCNEDGQWFLKDTKSSSGTFLNHIRLSPASQESSLMPIIDGDIIQLGMDYRGGTEEVYRLVKMRCHFNNSWQRKMNPYNIEMFKKLQIGDKQATECSICLNAIQPGHPLFISTCGHWWHYRCIHPLLQKSYPLFSCPNCRYVCDLEYFSESE

SEQ ID NO: 15313 - protein, 187 aa, Candida albicans
RKKKNRKETYSSTSSTHQIMPEAIVYLTETEICQKCKTENAVVHARVEKLCSNCYIRFIRGKLRKQMHDERYKVKFGRAVEQYGTQRILLALSGGESSLVLLDIFGSLLQEQNDLHKGKQGFELVVVNLDEYELDSLNNRIQKVFPELLAKYQPVKISLNVLSLDSYVDEESLHRILLTPAFRAMLK

SEQ ID NO: 15314 - protein, 108 aa, Candida albicans
PCGEEKRLVEKITVTDPAAITTDEEKEYYEMFRASLSPDNEDKNNSDSPIDICFGCTVTLGGVKGDTGFIWPLQGSLELKYEYRNDNQEKQKVLDEFVLTDDEGDIEV

SEQ ID NO: 15315 - protein, 106 aa, Candida albicans
QFLLIFTIGERDCSQNINVFNIIQSTSRILMGKPSSVNLLVQTRTKMKSHKAAANRFIKRASGLKRKQAGVNHGNGRFSYSALKGLRGFVEVSNKGGHLKKFINRV

SEQ ID NO: 15316 - protein, 266 aa, Candida albicans
  UNSURE (263): Identity of amino acid sequences at the above locations are unknown.
VTLDFPPGGQYLSYQIATCYGLPVKGVFVNGGTGSFEFSPQDTLGWMIESVDDERVEDLDEFVEVMKKIPDCSRVPVTYRHVSDMHSEYVRSIYIDRHWHTSFKMATRNDSTGLWDFETLQKEALPPVPLEPQNAKYIDIPFGDDSKKGCADLVRSFVQVRTLCPSPIDSHPFRKDICYAVVIDATHGYVLVSRKYVPHYLCDIFIVFAESIEVPGKVVFLHPHLNYAIVKYDPGLVLADVKTPVFGTSPLQRGDKSFLNRIXLSF

SEQ ID NO: 15317 - protein, 212 aa, Candida albicans
SAGLSSPVVEDEDNIKFLAVERIAAPSLGNQVTNPLKIGDVVLCVDGKPAKSLRDLNSMYTKDILEFKIIRQKKEMTLRVPTTETRELDTSHVVFWSGALLQTPHYGVRQLMKSIPSEVYVVGKSSGCPADQYYIVPNCFITHVNDKETKNLESFVDVVKDLPDKTYVKLRVVSFDNIPMAISLKTDYHYFPTIDVRKEIDTNTWMEKKYNE

SEQ ID NO: 15318 - protein, 282 aa, Candida albicans
  UNSURE (72),(273),(279): Identity of amino acid sequences at the above locations are unknown.
HESVDVKPIFRDLIHDFGILKFNPQDVKYLKLTQLELAPDLAKVGTEIRVVGNDAGEKLSILSGFISRLDRXAPDYGSLTYNDFNTEYIQAAAAASGGSSGSPVVNEDGKCVALQAGGHTEAATDYFLPVYRPLRALRCIQNNEPITRGDIQVEWELKPFNECVRLGLTAEAEQNARRLFPDKVGLLVAELVLPDGPADKLIKEGDTLISINNEPIATSVRVDEILDENVGKELEFVLQRGGREIRQKITIGDLHSITPNRFVVVAVLLFNDXFTAGTXISY

SEQ ID NO: 15319 - protein, 618 aa, Candida albicans
LLKANAMIIISGKEKNKTQNRDLIKQQLLYSDCSFLKMSESTNQQETALREIVEDTTNANEPTAIDKTTLPNETSHERETTTTENASSEIENIEPQVATHNSDLDKSIPTDTNIISDVSQAPHVCPDNENTVQTSEDLQQSNVEKQKMEFHNGLEQLKEMATETEIEKFDDIQREISDPIDDESLKSTQKPESSETEKVEADASHKGLADEAEQLSDEEINVDDISSDDNSESSSSEESLGDSSSDESSDENETSNIDYNDVEDEDEDSNEGPVKSVHEIIDEKAPSLPDNYEISPNTPIEEIGEITGLVENTMIIKARTSGEFRILQEKSIFCFEDRTVIGPLFEIFGRVQQPVYSVKFNSEEQFLKFKESKGKTVYYVVPDSQFLYTDSIKHIKGTDASNCHDEELPEEEQEYSDDEKELAAKLAKKKKKNKKTKDKQTHTSGPSLPNKRQKVSAYSPITTYSQNAVHNRGRQILPQHNTIYSNYGQQQPPQQQQQQSPPVAQYGQPYYPQTDSYNSLMGQTPQYPQPTFGQSQHFYQNAYNQPVQPQYEPAYQPPQQYNQYQQQPQEQQQQQQFNPNMPNAQTQQQVDPAQLEHLQRLLLQHLQNNQNQYQHPPQ

SEQ ID NO: 15320 - protein, 680 aa, Candida albicans
QEICEWFSIDDFKSLGGLNNLILNYTNDLNNNNNKASITELIQNLHANHKIDDLSTNTLQTILYYSFGEYGDKKSKSDQLDSIKRNNLQLINDKLYQPLINIIQNFFNDRISHDKATTNHPESSTLSIRQQEPIYFIILTLMYFMINVSLSIDHDNNTIIRSEFKKYLKETDFLTSLLTFIEHWKWHPNNCYRIRYLILMVNKLIFLELGDSNHMKQCDEFLVKLHHVKNKPTKESLESNLTCSPLDYFVFRQDLIDKYPLYDETELKPYDFRNLKKSLDNDDDTTSDTSSIHSHSSTIEGKYKYFMALHNSSNSLSNLIETPKTNKSHTIFGQLPTQTVHLATPVPSPTLAASDYMSGGEKIRKSYQVNQAMPMIYPITNNYNGDGVIPLAMREADEILRKSIYESYSIKRLWNERDYFMKQVRGYADGYDKTTKNDDDDDDDDNDEFDYNFNELRQNILEKTLVIDTLERIDTLYSQYLCRLNTIVEVFIETIKVNRLDYNLNFAELELYSKTKSGHRDETIQKKIEMVLILQLEVNNAKELTLKATSSLILNLLKWFKISHILKSYYFSSLLFDQQFFAISLEYLSRCFNNANLQSMITTTNSRQKKDELTEYEIFINQNKLMNPKISLPNGNFFDNCLCLSLTHQEVKYNDFNFINKIFILSLLDKFDSNNIVFIH

SEQ ID NO: 15321 - protein, 153 aa, Candida albicans
SRGEDILSDILNITNKILIKNQSQRIFTFNDLKPSELYKMILINYDCQSFNKPILKTLKKLIPYQGRKWKSSNMDLISQIYLNLKLSMKDNWLSGKDLESDFNNSYDQEIALRGLLQFYNMRNYPLQMNKIGYRINHDIMNIPQLDLNDMNIY

SEQ ID NO: 15322 - protein, 267 aa, Candida albicans
TPPFFNISLLFVLVFPPPPPPPFSKMTTTGSEKQVILVALGGASSSGKTTVAKALKLLIPSSVLIHLDDFYFTDSDIPIDPETGYQNWDCPEAIDFDRFRECLQNIRKGVFTSINSIEPSEADLKLLKQEETHFAKEIEDKSHKFGKKRIVFVDGFMLFHDPSIIKLFDIKLFFHAPFDTLKSRREARKGYTTAEGFWVDPPNYFSKIVWPAYVKSHAYLYQGEKVDSNELEQSIVEKYDLVDVDNNDSTSLYALVETSLSSIINHL

SEQ ID NO: 15323 - protein, 420 aa, Candida albicans
FASLSGARVVRIATNPEYSGMGYGSRAMELLRDYYSGKFTDISESTELNDHTITRVTDSELANASLKDEIKLRDVKTLPPLLLKLSEKAPYYLHYLGVSYGFTSQLHKFWKKAGFTPVYLRQTPNELTGEHTSVVISVLPGREDKWLHEFSKDFHKRFLSLLSYEFKKFQASQALSIIEAAEQGEGDETTSQKLTKEQLDLLLSPFDLKRLDSYANNLLDYHVIVDMLPLISQLFFSKKTGQDISLSSVQSAILLAIGLQHKDMDQIAKELNLPTNQAMAMFAKIIRKFSTYFRKVLSKAIEESMPDLEDENVDAMNGKETEQIDYKAIEQKLQDDLEEAGDEAIKEMREKQRELINALNLDKYAIAEDAEWDEKSMDKATKGKGNVVSIKSGKRKSKENANDIYEKEMKAVKKSKKSKK

SEQ ID NO: 15324 - protein, 622 aa, Candida albicans
IMGKKAIDARIPALIRNGVQEKQRSFFIIVGDKARNQLPNLHYLMMSADLKMNKSVLWAYKKKLLGFTSHRQKREAKIKKDIKRGIREVNEQDPFEAFISNQHIRYVYYKETEKILGNTYGMCILQDFEAITPNLLARTIETVEGGGLVVILLKNMTSLKQLYTMSMDIHSRYRTEAHDDVVARFNERFLLSLGSCENCLVVDDELNVLPISGGKHVKPLPPKDDDELTPNAKELKELKESLADVQPAGSLVALSKTINQAQAILTFIDVISEKTLRNTVTLTAGRGRGKSAALGIAIAAAISHGYSNIFVTSPSPENLKTLFEFIFKGFDALGYTEHMDYDIIQSTNPSFNKAIVRVDVKREHRQTIQYISPNDSHVLGQAELLIIDEAAAIPLPIVKKLMGPYLIFMASTINGYEGTGRSLSLKLIQQLRTQSNNATPSETTVVSRDKKSNEITGALTRTLKEVVLDEPIRYAPGDPIEKWLNKLLCLDVSLSKNAKFATKGTPHPSQCQLFYVNRDTLFSYHPVSEAFLQKMMALYVASHYKNSPNDLQLMSDAPAHQLFVLLPPIEAGDNRVPDPLCVIQLALEGEISKESVRKSLSRGQRAGGDLIPWLISQQFQDE

SEQ ID NO: 15325 - protein, 131 aa, Candida albicans
EDKLSFFFFIFFHKTSTCFSFLNPQLYINQIVHMGKKAIDARIPALIRNGVQEKQRSFFIIVGDKARNQLPNLHYLMMSADLKMNKSVLWAYKKKLLGFTSHRQKREAKIKKDIKRGIRESKFFTSAWRST

SEQ ID NO: 15326 - protein, 207 aa, Candida albicans
HIVPILAFFSSFFTTYPPTMKAAVVSNPVEPTKLTEVKEIPKPKIQDNEILIKAKAYAINPTDWKHIVFKMSKPGDVAGSDASGIVEEVGSQVTNFKKGDNVSSLVIGNVSPDNGAFAEYFVAKPQATIKYDHDLVSSLESKSSTIDSFEGAASVTVGLVTVGISFAHSLNIAKNKEKGDSILIWGGATATGILAIQVAKLVYILHH

SEQ ID NO: 15327 - protein, 386 aa, Candida albicans
IGSYFPRYIYQRQFLHILGYLFEQALTIMKAAVVPISIKDNYLTEIKDIPKPEIKDDQILIKAKACAINPIDWKHIVYQMSKPGDVPGSDVSGIVEQVGANVTNFKKGDLVSSFVMGNMSPMSGAFAEYVAAFPQATIKYDHDLDNPPKAKASMIDSFEGAASITMGLTTVAQSFSHSLNIPKHKKPGDSILIWSGATATGIVAIQVAKLVYNLKVITTASPRNHEYLKELGADFTLDYKDPKIVDKLKLLGHIKFGLDTIATPQTFQKLYDATQGTPEVYLDSLLGMDGNSIKTDPARETTVHWGHTMGYLCVLKTKTLGSTTYVQSTELLNDYNKWWENVMPTIIDKIKHANLKILPNGLESANEGLQMSRESKVSGEKIVFKI

SEQ ID NO: 15328 - protein, 375 aa, Candida albicans
HIVPILAFFSSFFTTYPPTMKAAVVSNPVEPTKLTEVKEIPKPKIQDNEILVKAKAYAINPTDWKHIVFKMSQPGDVAGSDASGIVEEVGSQVTNFKKGDNVSSLVIGNVSPDNGAFAEYFVAKPQATIKYDHDLVSSLESKSSTIDSFEGAASVTVGLVTVGISFAHSLNIAKNKEKGDSILIWGGATATGILAIQVAKLVYNLNVIVTASPKNHEYLKDLGADHTLDYNDADVVLKLQLLGHIKFGLDTISNKDTFQKLYDATAGTPEVFLDSLLLLDGKSIKTDPARNVHWGYTLGYLVVQKEKVLGTQKLVQTPELVNDFNAWWENVLPTIINKVKHANLKILDEGLASANEGLQLSRDNKVSGQKIVFRA

SEQ ID NO: 15329 - protein, 334 aa, Candida albicans
  UNSURE (29): Identity of amino acid sequences at the above locations are unknown.
EYEILIKAVAFAINPTDWKHIVYQLGSPXDVVGCDVSGNIEEVGSQVTGLPKGDTVNAFITGNRSPPTGAFAEYVAVDPATLISNNRNFEHVTNLQVSEIHSFEGAASINLGLVTVGLSFSHYLQIDNKKQPGDSILIWGGATATGVLAIQVAKLVYNLKVITTASPKNHTLLKQLGADYVFDYGDADVVNKIKNIGQIKFALDTIATPETFQKVYDSTEGSQEVFIDSLAGLDYRSIAANDSRGDQVHWGHTIACLASLKEKTVFNENYVQTPELLDDFTQWWQKVVPQIIDRIKHTNLKLLNEGLDSVSEGLELSRNNKLSAEKVVFRVLGL

SEQ ID NO: 15330 - protein, 369 aa, Candida albicans
FLLLLFSNIYFIYWFLCLYDTNLSLFALVMNSDIPPPPPPPEYTQSHEDLPEYTSSLNYYGLSLIKTEFITPYQYNSGNRSWKPVLLELNSTQLKIYNLNIDKKLQDLLICLYFELNCLDQLTKDINSHYKKSKGFDFSELSSNDADDVGDLFSGDAYGGTDSSKLSLNDSKFGKLKNKLRNQKSNKTLQSIKAHYDELKDNKFFFEPTSSTKEYNQFAKKYRGNLLHCYSLANLQIGEAPSLNQIISAIYKEEHNGNTNNSSLVKYKNTLRLRIEYKQILLQFWSFYGMISWFRNFTIGRDLSVPVEARHVSKLKSIPSRNTSQNNALLAATAAAANYGRNRANTPVDGVEEDISMFRSNYLILFNRQ

SEQ ID NO: 15331 - protein, 201 aa, Candida albicans
FLLLLFSNIYFIYWFLCLYDTNLSLFALVMNSDIPPPPPPPEYSQSHEDLPAYTSSLNYYGLSLIKTEFITPYQYNSGNRSWKPVLLELNSTQLKIYNLNIDKKLQDLLICLYFELNCLDQLTKDINSHYKKSKGFDFSELSSNDADDVGELFSGDAYGGTDSSKLSLNDSKFGKLKNKLKNSKSNKTLESIKAHYDEFKR

SEQ ID NO: 15332 - protein, 76 aa, Candida albicans
ERRSRQQQQYRRRTNNSNAPKQEGPKREAILDLNKYKDQKIRVKFIGGREVVGILKGFDQLMNLVLENVTETLRGM

SEQ ID NO: 15333 - protein, 291 aa, Candida albicans
FLFSFHLYTFVFLFFFFQIKNSIRRLNIMYPSLNGSNIGSISNEDDNDHTATADGTLVVMVIRAKHLPNRRKLDKQSPYVVARIGTVAKKTLAAFRAGQTPEWTHEMRFELSRERKPILKIDVLDETKNDPTPIGNVEIDASIIFTNPENNENGKYIYDKWYDLTLNGRRAGMIYLEMTFYPTAPVLPPKIPIDHPEEMVVVNEQDQYDTVSAMGQSMRSMNSSKYKDLPSPPLNQQQQQSYLSKLEGNHSVADDVFVNLENSNTSKTSSIFLKKFSKYSGGVTSTNSTNI

SEQ ID NO: 15334 - protein, 140 aa, Candida albicans
FPSNNNLTTIMELLPSGQANTSTEVTYEYQLKINKFSTLISQKDEQTQQLSTLKTEKEYLDDLSIELELIDDDEKIQYKVGDCFVFLPKDQVLEKIESDTDSLEEKINSIEELIDGFDEELKDLKAQLYDKFGDNINLER

SEQ ID NO: 15335 - protein, 320 aa, Candida albicans
QQTTDRRHPNFNMSSGVTNLFIDKSQRPNQDEQGLIDIGKNCQYCNQLDFLPFICEFCKKTFCSQHRTIEQHQCIAKNKFFNQHKSRSSSPDESDNGGGGGTIISSKSLFPDRNADKRKLEAKLNSINPIRPTTIKETQFRVGDVSISGSSNAFKKFQKFLTNQKKNKKSGTTNGGNSITSKLFGGKSSKTSSNNKFIDIANLKKNAKGDNKIIMNDRIYIWCIYVENPDLQISIDKDKKPVFISKNWVVGRSLDSIADNLHIQNKNNVTNESLEKLNIFKLEDNNGSSGVDGEPKLISTSLKSTVFKTGDTIYLVRGTI

SEQ ID NO: 15336 - protein, 340 aa, Candida albicans
NLFIKMAELRKIALSNSNLKNMASPSSSTPGSSGASSPQGNGMAKTDSLVNLTQPELYGIFRNDSNTSLSKEFEEDSAEIEFKVNSRLNKSTATTTTSSSSSSEAKYSKNEDFEKYLPLPLKIVVLTLASFIYNEVTSQINFNHTQSNYPLTIKHLFKISSYIHLDEYLAFVGQSKYGHLIDETFALMIQGLVMASFHPILDYYLPKSLTKRLLSSNPNPSSSTSYSTLINDLIRSSVAFLGVSYAIRNIEWSSFLQVAIIYSLVSPGLWLLLDGTISGLIGSLVVSIAACSVVYYQNYQYLNGVGDASPVELVAIWLWIGSFVFGGLIVFGKLGRFLFQ

SEQ ID NO: 15337 - protein, 136 aa, Candida albicans
HKGVNSIMSYSEEDPLSEPKNTQQLDLSKLSPQELRIYKMYGKLPTTQQILSSKFQDKKYFDSGDYAMQKQMGGGLKSGIPGGMSMKHPNAERMKEMSVRNSISATNAQVLLNGKSGLLNERTVGKDDNGEEQNKQ

SEQ ID NO: 15338 - protein, 369 aa, Candida albicans
NNLINTMPETEVINNSTTNNLDENNASSSITPENKITNPTDSSIIEDSNNNNNNNTSKLSLPSPSISSISSLDSNNSTEKLINSLANSSLNETKTNEKVSEDSTNKSTLIITQLDPETLSESEKRQLQRQNRIPQSFHSKTKFYDELSQASVDVVPTTTQESVAVSVQRPPEQKPIDGSEPGTTESNTFIALPKKIKKFTVRKISNPEAITSPTSSLNPSKEPLRQPKFSPTNTKFNVTPHVSPIVSYLENKSQGQSQSRKSSVNSNGDSQKHKHQQELHKLRKIEEKYDQYELRIEKIDKEIAYLKKLLPPYNVQIDYNTRVKINKAIEKLSMKKDEIDKKKYDLGITISRLWRNLGDGKEIWVRKFD

SEQ ID NO: 15339 - protein, 292 aa, Candida albicans
TMNKFSIITRPLFRSSRHIGVFVPIQRFLSTTSPRLSNLLGEVTKIDSEPPITTTSKSTTTSSSEDNKDISKITPENDEELIEYHAKNAESKQFKIEKYIHPLKLQLYNENISQFGFFKNGQIMNHNGKKLRFTLTPQEIDILEPSIYLTSYRIKSSMKKATIVNRMVRKFNVKLAINQLHFNHKKISTELEQLLKRGLEQAKQLELNEDELYIDRIWIGSDGKWRKRLDPKGRGRMGIIAHRYVHLKCILKTNQTKLRLDWEKQQKELKSKPRMFLNDEPLNLKVRPWYKW

SEQ ID NO: 15340 - protein, 503 aa, Candida albicans
DNERTRRTKRQPICEQIPTSNTAFFFTLDIPIMPVNFLTSVVFDGPEVIPYWDQIKEYGPTVLPILLTLAGAKYYFHGATNTWERDMHGKVFMITGATSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRNVRVLIATCSSQNLGDVDLNDLLWSNKRYPATQPWKVYGTSKLLLGLFAKEYQRQLMGYERKDKAPCNVRINLINPGIVRTPSTRRFLSLGTVWGLIIYLILFPIWWLFFKSAEQGTQSFYFALFAPIFMKIEGGNVVQECKIMTKVRKEYTDDDLQQKVFHNTEELIKQIETKSAIERKKHENAKKTPEQKAKERQEELNRKRDLHIKPETPEELELKLNLLRNQIGMGTGILSNEMPLFPDDETLKKVISSKKNASSNNSGGLKSNKSQKKSKKV

SEQ ID NO: 15341 - protein, 565 aa, Candida albicans
RKMLYWRWEFVHKLVAFLFFLSFHCLSANILWDVCIEKKKNIVQFLVLVVPLISSLSYKFTNMDEVVFYIAQGDPADKHSQESYGYVTSIHSSKQYASYRQADSHINGTTVTGIGPGERIFTAVPNKALINVYSWGKESVDQRIPIPEALTCITLINHPNGSNSDNDDNQLYKLPNYRVPWLLAGGSKSGKLYIWELSSGNLLCVRDAHYQGITTIKGSSCGTFLITGGEDARCLVWNLAELISIYDKSDHQVKPYWQITDNTLPLTDLCLNDTHNINDLKLYTTSKDSTVRIYDIVTKSLLTTFILPSSAECITKDPANRALYVGLNNGLVRSIPLYSINSHTSVLESIGGMNKIITVDADQNLKETFVAHQQKTKTGDDKPVVVTKLTISFDGTSIISGDSEGRVFVSDIVTKQVVKSFTPCNSPIAYIAVETIPDDFVNNLATSTTTNKADKKHRMIPQFKRVLASTNSEEHQIFLDIPGKTTATTNATGNIDFATWLQSKQSEELQFKNLSGINSIVKQVGNENVSDLEERLQRVSQAYTELRNKHEELIKEHAKLLDKLE

SEQ ID NO: 15342 - protein, 116 aa, Candida albicans
LAVKGGEKDHGKAYTVTKYVTETTHRYGRFDKTSRSKKPKETGTHRYGKFNKTPRPVTTTVLVKESDLPKKRDAVVARDSKNASSNYTTSSGNNGVATGVSLGLAGVLAVGAALVI

SEQ ID NO: 15343 - protein, 179 aa, Candida albicans
  UNSURE (7),(18),(23): Identity of amino acid sequences at the above locations are unknown.
LSPGGTXVLSVDPVRSAXGTYSXIRHPCIFKAITPAWNNVNLNNLAECTESSLVFAHVRASTQGVLAETNCHPFSYGKIMFMHNGGVSAFNLIKKKLINHLEDKFFLHIQGSTDSECCPALFVDTLYKMGYDPEDLSVKFSHSILRKALLTTIDLIKTWQCQVTNDPSLLNFAATDGES

SEQ ID NO: 15344 - protein, 357 aa, Candida albicans
RHLLNSQMEELERFVNDLQNIDTNNFSGGDIYIGNGSSGSDKTKQEELTSEEVVQPTDLFETVLSSYKLIQSVYENASSNDLIQTVSQSVAPLLQINDNVANELIIKYSESSHVNSMISNITLKDVNELKLVKLNLLALAETDIFRLLDIWKNDNEIPETLPEKFMVASDSVQALLDRNDINLLTVNSQGTESDKDTFWKILTFQNNMLKRAQELLNELMQLQKKSNLQLEDLGSLIVQVSEVIIARADIELQRSLINNYSSSVDNHLVLMTNCKNLLKNAINIASLNGGLRERMMVKINREQCKLEAVFRLCILENRTSIEELDKVMTRNKWVNELPNLKKLGLYDDFGLNKIIVP

SEQ ID NO: 15345 - protein, 200 aa, Candida albicans
NLAFPFIRWWLHRKYHKQNFNMRFRRLPKKSEIKKVYLPSTATEYLEQGSIDEESGERWLGSDVSKCLRFFNKAYSNYIQAIKLDPKLLDAHYNSVRLLLHTYQTFKRIPSGHDIAIENASLEVVQNISDIRIAYENSLERVQQLGQVPNDLLYNYAIVYLEWLESQQEEQDDESSLLVSFEQVVEVYDRVSPRGWKFRV

SEQ ID NO: 15346 - protein, 156 aa, Candida albicans
RRGFLPVVKIKQLQDLNVPELTTLTEVKHLLDLRDSKIKIIIDSIFGFSFKPPIREPFKDLINYLGQNHDHLPPIVSVDIPSGWDVDEGPGTEIDIQASCLISLTAPKPCAKLFVNSGPDKIHYLGGRFINPRIAKEYGIEDIVNKYQGDELIVKL

SEQ ID NO: 15347 - protein, 448 aa, Candida albicans
TEERECTNKEKQKKKKKKNCKDISYSLSHLSSSLEHTPIMKLDTSHMRYLTSDDFRVLQAIELGSRNHELVPTQMIHSIGGLKSPSATNRAIGDIAKLKLISRLRNAKYDGFRLSYNGYDYLALKSMLNRNTLYSVGTTIGVGKESDIYSVSDPEGVQKVLKIHRLGRTSFKTVKNNRDYLKNKQTSNWMYLSRLAAAKEYQFMEVLYNNGFNVPQPFDYSRHCVMMEWIKGIPMKHLRQHKNYKKLYSDLMGFIVRLAKAGLIHCDFHEFNILIRDDTDGHELDFVVIDFPQCVSIEHPDAKEYFDRDVQGIRDFFSKKFRYNPQHDPTMFDTDGYGDGYKYAYPNFKRDVIREKSLDVEVQASGYAKKKTGNREDKDLEKAVLGMRIKVDEDDDLSEIDDDEDVATEDEEEDEEEEEDEEEDEEEEEELFEDEEEFDEQAEAEENE

SEQ ID NO: 15348 - protein, 174 aa, Candida albicans
PSVVPSSPVVKTIIGIDVSKDGRWLLATCKTYLLLIDNKISDGQKNAGKLGFTNYFDKDKKPTPRRLALKPEHEAYMVRENGGKQLLFTPAYFNTGRDSKETTIVTSLGKYVVTWSMGKVLLDKENPYLVKRYTQNVIADNFKFGSNNEVIMALQDDVSMVSRRSLANPKNVFK

SEQ ID NO: 15349 - protein, 423 aa, Candida albicans
KRVNFFASLFASVFFLLVAMNFIKKFIGTTTTDEVALIPSGKLYLTRSKQSPKGAIECLYNDAFASIKKTTSPYYYQLCITKVYQEGEADFNRFDDSEEEYDGEELAPTNDTRRQSKDEWIFPIADELKIHVCEKEDGSRAIAWKDVNGDLGDKFEFVIDEEVRGSEVEAFGMTIYKCLFENKYQTSYAKVNDPNQLKEFIYNPKGELLTFDELKDLNDLEEYETDEYEDCETSPIDAPKGETKYASTDVDLHLYDTRTGTFILHLAKPDFELKLIDLGNWEYTLYIHGETTRINTTLSKNMNPTFNYQHLSFIFNDYTVDEGGINACSWLVKFPDYNDMSKFQTVFLGLMYETLNRRKWGETEEHDYFVDAFSRVSIGDAKDLESEEEEESEEENEGDGPVKWETEKNEKNSSLTVGYATDS

SEQ ID NO: 15350 - protein, 165 aa, Candida albicans
FPKMIKQLLISPSCKILPTTRFIYNWYSCYSTNKPRKSIESNQKKSTTTTTFTPTPTSTSTSSSQSQSPTTDQILFEQFQKSVIKNDIKHNPNNQPFWMKRNRTIKSKHSHWNPTKKLSRLEMNKLRELKQYFPHFTTADLGKIFHISPESVRRILKSKYIPDDD

SEQ ID NO: 15351 - protein, 278 aa, Candida albicans
  UNSURE (62): Identity of amino acid sequences at the above locations are unknown.
KVSEEEEDEDTDSPQPVSKPIKKSIKFTIKPPKKPNNYSTFSGSSKTTNVSPDQSTQRVTRXRQVSYYQDEEDEFDEEEEEEEEDDDDDEEDEEGFDQEVKVIKSNKLKRLKQPSNDKRTSDRRQTSSTSRTRKDQRQTLDPELLLTDEEDEYDPSTYNDLSKMTERQRARYDGVGGDDKNNNNKKKTEQFIELDDSGKKAKSKLDHDQQQQEEETEEEIALRRAENARKRQDYKKKVLEEEKRDTLNKLLKRRATKSREIINEADNKDISQPLQIIL

SEQ ID NO: 15352 - protein, 333 aa, Candida albicans
SLIHLSGRPASPVVKTEDLEEDNYKLKASEEEEDEDTESPQPVSKPIKKSIKITIKPPKKPNNYSTSSGSSKSTNVSPDQSTQRVTRKRQVSYYQDEDEFDEEEEDDDDGEEDEEGFDQEVKVIKSNKLKRLKKPSNDKRTSDRRQTSSTSRTRKDQRQTLDPELLLTDEEDEYDPSTYNDLSKMTERQRARYDGVGVGGDDKNNNKKKKTEQFIELDDSGKKAKSKLDHDQQQQEEETEEEIALRRAENARKRQDYKKKVLEEEKRDTLNKLLKRRATKSREIINEEDNKDGSDMGNNVLYKKKRPMLEHPAFIRYVNNTTSLNGNSVLSYN

SEQ ID NO: 15353 - protein, 679 aa, Candida albicans
IMTQSKEEQCPICSKSFPVSQLYKHVNSCLDNQESKKSPSEEASEDTSGKAETPALKKRNTLSALGLKADTSSLSQKKAKKTETKKPSLTSKLLEQKRLQAEIRKRDKEIPLEEQFKAIAEDAMTQSRTQEKPLANDIEETKLQKESKFLQKAKEIKELKRQASIPLAHRLRPKSLDDFFGQEKLVGENGALRNIIQADIIPSFLLWGVPGIGKTSLARIIAKTTSCKFVELSGIDSNAKRLKEVFVQAENHKNLSGQRTILFLDEIHRFNKAVQDLLLPVIEKGTLTVIGATTENPSFNLNNALLSRMHTFVMEPLTVDSLIKILTRALFEVNRVRKNLYGLHYISLQKDAYHYIAELCMGDSRVALNILETINAYLSADKFKSTVNADDEQTKKQGVIKVSADLLKPLMKSRDFHQFYDRNGDSHYDIISAFHKSVRGSDPNAAMFYLVKMLSGGEDPLFIMRRMIVIASEDIGLRDSSCLPFAIAAKEALEFVGMPEGEIILAHCANKLALAPKSTKSYRALRTAQNIIKENPDLTKLPVPLHLRNAPTKLMKDLGFGDKYKYNPNYENGKVRQGYFPDGMDPIKLLEDTHLGKERDLSVPDDEYERAQLAVEDYRKFKKSYRKEFFIDNATDLDENDSTHYGEYSDNFGKSFDENLPPDLQKEYFGDDESNIQDL

SEQ ID NO: 15354 - protein, 244 aa, Candida albicans
LYTTINLKNMNQPNPNKQPIVQSTLEQTSNEEVDTVLGRFTLFVKDLSNGLNGSQEVPPSQESVSEEAEVISRKIIVLGQTFDNFDNANDYIESKLWLSYRCGFEPIPKSIDGPQPIQFFPSIIFNRSTIYSNFANLKSLFDKENFTSDAGWGCMIRTSQNLLANTLLKLYPTNEPEIVKLFRDDTSAPFSIHNLVRVASVLPLHVKPGEWFGPNATSLSIKRLASELLQDQEIDGIKIPRSVY

SEQ ID NO: 15355 - protein, 231 aa, Candida albicans
LVNYYKIKKSMVSKSPGVFISENSDLFDVEIRDVFAKEKNASVLILFPIRLGIDKVNSYYYNSIFHLLASKYSCGIAGGKPSSSFYFLGYEDTDLIYFDPHLPQVVETPINMDSYHTTNYNRLNISLLDPSMMIGILVTNIDEYIDFKTSCLDINNKIVHFHPHTLPVQQDSIINQSWEEVQDEEEEFINLNVSKIENEQQQEQGQLTDAPDEFIDIGNQLLLVVLVPSNV

SEQ ID NO: 15356 - protein, 451 aa, Candida albicans
LGVDIRPLDRPHAPVVEDGGGRLHNEITTKLEALEEAMNNVSSDTELEQSVSHIEEEDEKVESHIPEPDLSAEVDEPLQEIDESENENQMESEVGTNTNTQDIETLDIIIDLPSNKVELHMSHSLPQKFKTPSSPDDDNDDNNNNSTPESEPEYGYLEEDYEFDVSKIEVSNVRFGIENQYHIKCMELTGLIDEYIWIDENDVIEYVLDNGVKEHRLNKFLSFITKGMIDEQEPEPEPEVYISDSNSEEEEEEEDDYNSEQDDYPYDLDDNLEDLIAYSKTSTQGLIPFEDRDFSNNIPSKKRQTFDHLDFDDDGELQDSLIRQLNNYKANKKLKKHQWEQQKLEESILHHDMLIKYPVSLHIKDIKSEFDQLLKDESRQSMSFPTLDTHGHKTIKNLADCYHMSVIKSGKQGIRKYLKIVKNKATFKYYPNYARINRILIFTTPWKDRTC

SEQ ID NO: 15357 - protein, 335 aa, Candida albicans
  UNSURE (143): Identity of amino acid sequences at the above locations are unknown.
QTYSNMTDMSNTTTDGNVSSIVVPGQYISPTYKLENSNNDSSIPVKYIPGSGTIISNINIPSPNTSTNSVKSMPIIVSTILGNVSISPIDQTPTSKPSNNDDMVIDNEQTKLDEDKDKDKYVKSYLVSVIPKSTKHQSTTSTXNSNQSGSKAISAIALPKENDIVLVRITKITKIQAYCEIISLDTTTNILPDSGLGNNGNGSHVSMSITGSNSQHNFNQNSIASSQSTNQSVQIYELGENFKGIIRINDIRLTERDKLKLIDCFKPGDIVKAQVISLGDGSNYYLTTAKNELGVVFAKSENGAGDLMYPIDWQNMIDINSGVIEKRKNANPFLQ

SEQ ID NO: 15358 - protein, 986 aa, Candida albicans
MRSFQAVVKIMAKNESKNNLFCGVSDGGVDVGSAGGGAQYNKNKFNANFSNKQIKENFHSSSQQLFQQQEHHHQPSFHQSPLNSTDQQMSPKSSEPLHPPRHVKHPTDTTTNTTTNNNNPFYNTTSHSNQNNLFNKNVSIPLNQPAYPGNNTTTTTNTNNHHHNKSNSYNNNYNIIRTVSNNSNSNMSLDSNFSSHSPLNNNSSRPKIVCKSKSMWTVLTNDNDSMSSSHTPPPRSPLPPQPTNDSVSLGSPHKRPSQPRSNSSYSIMKGKFNRKNSNTTTSTDFHPENKTLLHKRSNTLNDFSKLNKEQQPSSGVLPSTASTNLKSSNGKKKFSFKSLFKSKSKSHSLNESNSSILLEPKKMTSKSYSTPNMQMLSEQPKSIDDVEDTTNNEQSTKLESKAPLPTKTNTSFMNRFKKNKSSDSLNKLGSSHQQSGLKKGVSNSNPSLSSLNGNKPVVNSTNNNNLIQPNEEHSKFGLLAPPVNRNSFNFIREVSEDSVYIGDQNDDIEDEHSGEEDIKPSKKRQGYKDVGNIHNNSDDEEDDDNVDRLSNFKSIERGQERGASDDDDDDDDQEKEKDFDYYDAQNLTEDPPKKLSSGNKYGEEISLIPPLIDSNQFGSPFKVNYQSSPKSIDLKREAQHTNTNDDDDNSSPLQRTIKRFSGPPTSSSLIPIKPPLPIRYPQQQTNNNVHVTEDKPNTQLLGEALFPKSLNAHEVESIVSLERSRSMKSVKSNKRSSFVNYDGSDDNIVHYVGPISKPTTGNNGNNGITRSNSILKNSTSRKSNLNEELKMNSIDGTVSGTTNNNINNIDTSGNFKVINDTTTTNNDTFTTITDIGPSGGAIGQNILGSNNGFGDNSGIDTGDDDLMEFSEFIDVENMNFLDSPIRGSPINNNGKFMQSSTTPSSPLANYHFDNDSINKLQQQEEELQLQGKIVDQSTPEPPVIVINKDNLDDKPTTMESKLNSIPVITIPDKETIDISNKDSIEF

SEQ ID NO: 15359 - protein, 209 aa, Candida albicans
FPPPHTNSPPNIIAQPQSPAPSNKSSVFSPKQSNDINKKPLNQPPPRPSSSPPQTQQHFSLQPLKKFTHNKIPSISDQSSINSESSPRSFTSMISKKWGNRKNNNYNPSNSLNSNSSPKFNSIPPRPGPPPPPPPPPQVGKLQITNGVRFSSRIILYDTYNEDEYDRHPDTATCNQLTPLLAQQIKNELNSFKSEMEIHVESKCYTHFF

SEQ ID NO: 15360 - protein, 282 aa, Candida albicans
SKKIIKRKSSRNVNGIGSTNTNTMTRLDSTTIASSLFCRQLYFNLLSKDPTLEKMFPSIKHQAANMAGILSLTISQLENLSILDEYLAKLGKLHSRVLNIEEAHFKLMGEAFVQTFQERFGSKFTKELENLWIKLYLYIANTLLQTGIDPVLKLTRYELNGSFTTSTNIDLTNGDSILLDDTDTDNDNVSVSNILDPKHQQQQYGGSSFNQDDNDNNNDGGVHPSTNTVVLTKSNILIIESVAPHHQQQKNSSGSSAATPTAPSKKSKFSIRKKKKENCVVM

SEQ ID NO: 15361 - protein, 596 aa, Candida albicans
VYIQPGEAGINPLASSSTNTTTTNNNDSYNENGEVEIQIDSQGNPLEMSKIDDRQFQSDKLTPAQISLADCLACSGCITSAEEVLVAQHSHQELIKALQSQKETNKVFVVSISHQSRASLAMAYNVSIENMDKCLIDLFIRQMGFTYIVGTSLGRKLSLINEAKEIINRKTKGSGTGGIDSDSSSGPILSSICPGWVLYAEKTHPYIIPKMSTVKSPQQITGCLLKNLTSNSLNIEKSKIYHLSIMPCFDKKLESARPEVYEEEEEEEEEKDKALVLVPDVDCVITAKELITLLEECPQYQLIPPTLPQEELIGGGCLSMTEIYKQYAPPNWPFIEISWSNDSGSASGGYAYNYLTIYRNDLILKGYDGNKFTINLINGRNPDIYEMRLMYNGENKEKLASAAVVNGFRNIQNLVRKLKPNTGKTTNTTTTTTKSKVNPLAARRRARMANNRGKPETKSTSEVNSQEMEIVADASKVDYVEIMACPNGCINGGGQISAPNTTTTTSITLPQKEIEKQWINAVLEKYNSIPMFDLSSQSSSSSPNEIIKFIEWSKKFENQFNISDNRLFKTHFNPVEKNIIMSVDDPATALLVGSKW

SEQ ID NO: 15362 - protein, 389 aa, Candida albicans
RRSAKHKLLFDLKSIEVGVNVYSTRDPRRDKTDENMKYELLNFIELRVGTVDIYDNVSTSTWNKFLSYMNILGDREIGTSMVKVSILNVRPDPAMVSGEAIMNVSVLPLRLHIDQDALDFLVRFFEFKDERFELPPDEMVYIQKFEISSIKLKLDYKPKKVDYAGLRSGKAGEFANFFTLDGSTLTLPKVKLFGIPGAPKIGIGLGRAWLPVFQLTQVIGIISGVSPLRSVVNIGGGFKDLVAIPISEYKKDGRLWRSIQKGTVSFAKTTGYEILNLGVKLASGTQVLLEQGEEMLGGEGSSVRSPNLGGLDNRRNSNASDELPVEVAKPKSQNNLLVSSQILNKASTKIETHSYDTKKLYSNIELDDEDMDDNRINGINKSSPRGWKD

SEQ ID NO: 15363 - protein, 228 aa, Candida albicans
MIPQWIPQNIQKRLLLYVLQQLSLFSEIDLPNLEEVSLNNIILKDVALDPEKVGKLPGCNLRYGQIGSLELTTISGISGVNIDVNDAEIVISPDFDIDENMTNQVAFLLAQSTANLANTIMLNTNDGSDMNETSDPALEDDDEDDIDDKITKPIPPKRRTSSVTGNKTTALGGVMQKAVEIALLRLLIKVNSLKIKIVSDLTDLQMEVNSVSIKSTTGVFHKHRPISV

SEQ ID NO: 15364 - protein, 922 aa, Candida albicans
RYSEDPPIIFYMDDCTIEFDGLSTISNLEIEVGNINLAFTPLTPTLVSIFQGVAKSLKIKYYQQKKKTKSMLAQRNEKFPQYTNDNDEIPEDQSESDDASHEPFFNRFKVNSFVISATSALSENGLFAIKNGINIIFFNINIKQKNELLLYGGVETFKIIRFEDDNTYEIFHFDKPQSAPSSAPSYSGSNDVAGTSSSLSSSTGSATSKADIRFEVFKKSEESDDLEVTVLMAKSAHFNFDLQSLLILSNFAKAVSSIYDEYGLLKSVIDKLDTRDKKWSGGTNNSKMLSKSEFILQTATIFVNFIISDDCQLQLIVFPIKFNLLQEQLTISKILLNCTNGDTQVEGVIILTDVSLITKNQEFRAYFQSTNTTTSANTHPLPRKTTMNSKLSVIVQKFSLNVSMDKLKFIGEKLKNFSNEFIERSPTQSNSLENSFLNEPVERQRLESSLHMNSSLFSTRRPGRRLGLGFNNSPSVFLGSTRVTMASFQVCFKEATFNITGVFPKFGNFSVQMLDISFYKLKNDILGHILSVLVQRKKGDLVENLIHQYQDLSPNSLEFPLLLIKCKLGDKTTKIEITARNLVLEYYTNWLLLMDKEESIIDAVEEEIIEKVTPSQHSSSQNKLDIRYSMYDCMVGLTPGRLSCKSYLIIGKGDSDISFGVNQFYVKCSFRNISMVLIDDTKNILPFSEPSTSSSSSSSSATRQTPYVYIQPLDYYSKLGYIHLGLINVAHVGITFNTDIEALKDRNEKLGIKDSLTFVDLKTNLDECQFNLCADTANTLIQLVNDLKLPLNFRDEDKMKVDFADGINVMQGIDQNIFKGLTETLTELNLNGTENGSTSESSSQEASSLMFEEGHFDRGNRSLYDNSHVDPLHININLSKVKIYLHDGYDWKDTRKAIRGAVKNFETAQTAKTVAKGEREKA

SEQ ID NO: 15365 - protein, 156 aa, Candida albicans
STMAGDLNLKKSWNPALVKNQQKVWEEEQQKLDELKRIKERNQEYKQEQEYLELLKLQHGDQFQIKDLNKQQKLKISKLNWMYDDVPFEGNEKVEENSSGFIESNVEFTDGKSKVENLLKGNHVVGKKRDGSGTSDRINKIIGVGMTKSSKVSYSR

SEQ ID NO: 15366 - protein, 166 aa, Candida albicans
YIPEQEITKKFKIVIQEDGDERIVSESVEVKWPHELSKINPSVIKEKYKGKDKKDMSAKDKKNYRLGMKSFFSWFNWTGEKPGKEFRNGEDLATLLSEDLYLNALKYYIIALSPDEDDDANDEEDTTEGEELDLSDDDVEESELPNKRTLEEEEEEENEHATKKSK

SEQ ID NO: 15367 - protein, 398 aa, Candida albicans
NKAMKEKDYGSLVKNNGRSKENVTKISLPRTSSSLSATSSIPSSPIHDMFSPTKLSPRASKTYKKRPKGKILVHDNALETSKVKKLGEYQEIIAKPRKSLDPFDLIDINHIEKSTPSPVKMAKKRKTETGIKVEGLLEISDDDDNDNDKLKEKDKSQPKTLNEKFDSNNILHSLDQQNRSKYDDVLKKYKKKKIPKPIVSRKELLARANKYMDLIPKILGGKLNTSVYYEYAKAEQMKSDRETMPALDKWRIKWEKYYGGYYGFQRQSIIGAYILDRYEKKLTKFCKDNKTARYWNMSQFSTYVLANEIIIRMIMEDMNLDFDKAEKFCLETVDYGIVVADSIEVDYDNGLSQEKTTTKKSISSTKLKLLPILLNADDSSSDEESIFRVEKSGKTRTK

SEQ ID NO: 15368 - protein, 221 aa, Candida albicans
DLNYLSSKLTSLHGDDNDDDAQKLIQFVNCNWNQVLIKFYLELKIVLSSLNLENDEPLSNSDELDDYNLNQLSLIYKWFNILFEEKQLKSTNRPKFILLVIDLVEFINNWLIQMIFNLDDISEFQCTKITHIIDNINNVTIPYIQELGINKSSSSIESYDKLNNVKFIINNHLKDIMERFYQGELFNLETQELVNMIKSIFIQSELRDNYIQEIIEFRNMS

SEQ ID NO: 15369 - protein, 241 aa, Candida albicans
TTLYTISNMSCEDEHHNHNHGHNHNHNHVAPIPTTAGQSLNNKIDTSKVTALNMANSADDLAKVFKDSTKKYQIKPIIKSDSDEQMIINIPFLNGSVKLYSIILRTNGDLYCPKTIKLFKNDTSIDFDNVESKKPIQVLNHPQVGVAYNDSDDLPEFLESNNDDDFVEHYVSRHKFTGVNQLTIFIEDIYDEGEEECHLHSIELRGEFTELNKDPVITLYELAANPADHKNLTIVENQNLA

SEQ ID NO: 15370 - protein, 344 aa, Candida albicans
FGPLSHTKSMTDFDQSTNFLLEYFPKLPDDIILLITEQLPLEYVIDWLIKIPIVQDIVIGTLYNHNDLQFLISPTKRPYMNHISALKSKLTTFKGYYQISTFIKENSSRFIPKKVLLMSGGDWSAVEELITNFKSWLVQVESIEIALESNEITPSDLKLLLEFNNLTKIHFSAVSLTKCILFLQNNSLLIDHPSLNNIIFLKHGIVNWTGIKFPRKLESLDLSWESKVDITTVEVPASLNELYFNLANVSQLENIKSQISSINLTTLMLTHDGLTEISLKALPSTLTTLDVSENPISKISDIEFGWPQNLTTLLLDTNNLTNASVAAITEWPKNLKTLRLKSSK

SEQ ID NO: 15371 - protein, 400 aa, Candida albicans
  UNSURE (320): Identity of amino acid sequences at the above locations are unknown.
RPAYRKHNKVRSINDAIDEIGFTPYHLKLFFLNGMGYCTDCMLTYLESSVRTFINYQFGYKFPVSNECYAGGMILGALVWGFGADLIGTRLAFNLSLLLSAIFTIMTGMMGNMASYCLFVLLSSFAAGGNLVLDTCVFLEYLPHKDQWLLTFFAFFWGIGQTIAVALAYAFLPNNSCESADYCPSHINRGWRYVFYTNGSIVLAMAILRLTVVRLKETPKFLVANNRDAEAVEVLQEIAHKYNRKCSLTLEQLLECGEIESNDDYRKHFSFGGTLSLMFQHLKILFATKKSAWSTSLLFFSWACLGIAYPLYSAFLPKYXATRGANISADTTSGVYRDLVISNVSSVGGPIIAGLLLYLLPVLGTKGVLFIGGVTTMALLFGYTAVRTRAQNVGLTSAFY

SEQ ID NO: 15372 - protein, 60 aa, Candida albicans
EANFISSIDYATHGGSIPLRLINFDGIIGALTISGLSQEEYHLFAIEVVKQFLETLNLKQ

SEQ ID NO: 15373 - protein, 249 aa, Candida albicans
TKPFQSISYSQPMNKEISEEPSIEPQVQGNESIEETRLEHNYSTRSKERKREEELQKKSQLKQKQHNVVIHPRLKPVPFKNLDLNPASLPEPNAATTINEIEFFQTEDLPLNKRGFKYKHCRPNPEFPSNLYSTTDVPPYHVCASLFDRSSGILFSNDLKSITTAQGWRSSRTNVCIREGSYYFEFKILNSNEKSHVRIGVGRKEASLEAPVGFDGYSYGLRDVDGQFMTISRRQKLCIENGFKTGDVI

SEQ ID NO: 15374 - protein, 303 aa, Candida albicans
QVGSPPVVKTDQFSSLLSSSLPVTSTSSSTISSFSPITTILSTSITSHDTNCEATITNISTNTLIETITVNGNTTIYTETQLSTYLTSNTSINCPNTNSATTTTTQVIPTATTEQIHTTTLNGSIIVSTETATLKTTVIITHCPECTILSSINEYSSSLKAESSQQVTSIGSSSVELSVSSTLSLVESTASSDCLESTTFTSIVSTTTESIYTITSNESTFEMTTTVTNIDPIVITTCPTITPVSSSYSSSESLSSSVSTSLLTESNSTILQSTVSTDKSSLTNDNQISTVSTENTINVNYNY

SEQ ID NO: 15375 - protein, 310 aa, Candida albicans
LRFEIYNKGYFSVFKSTNRMKRQHNDTISSNNSEFTKTKLRKTTNMTSYPSPTYSFEESSDYYRVPIGRPTTPVDKIINSLETMPISPIKNNKGELTFTPTTWTTSMDLYKVRPKISPRPSPTPSPVGTPPPVRSPTPTPSSYPSPSPRQRQRQQQHCQTNQRLLSHNDLNSVSILPEMEIYSENEPEGKLQKLETTITTKNNLQITNCFNPFVCLNFNPFAPFTNSPYPFSYSQQQKTNANTKNAIVCPTLLPPPIFLSEKNSTNKITNENFPFLFITGGSRTDNVVCTNPKCPCDAKPSYFVEKFFNY

SEQ ID NO: 15376 - protein, 63 aa, Candida albicans
KMALQTPKQRAANARFEKKNTNQWGKPKKENTKTEYPVSKSRLFVLLFLVCGGAILELIRLIF

SEQ ID NO: 15377 - protein, 191 aa, Candida albicans
DIMDSSTVLFIGAVAVAFIFLKWMVSPIPQQNEFNIDHLSQDQSTGSTTSSNAHQNRDTHSISTQSHRNSRRAVSESMIEVVQSIAPMLTVEQIRYDLETTGNVEATVNRFMELGDLPFPPGYVRPQQPPTPSEEPKKQEVIGKRSVNLLEKYNIDAKNPKSDHNSLLHQRRQEMILGARKRLAAQLSNEL

SEQ ID NO: 15378 - protein, 459 aa, Candida albicans
QGGGAVATLNQQMLILAGSTFGGGTTVNWSACIKTPFKVRKEWYDDFGVEFAATDSYDKDQDYVFKQMSASTDGITHSLANEVIMEGGKKLGYASEEINQNSGGHPHHPCGFCHLGCKYGIKQGSVVNWFRDAAANGSKFMEQVRVVKILNKNGIAYGVLCQDVATGVNFTITGPKKYVVSAGSLNTPTVLANSGFKHKNIGRNLTLHPVTTVFGDFGREVQADHFHNSIMTAVCTQVDDLDGRAHGAKIETILNAPFLQAAFLPWRGSNEFRRDLLRYNNMVAMLLITRDSTSGTVKGDPYRPDALYVDYTINKFDRNALLQALLITADMLYIEGAKRILSPQSWVPIFESNVPKDQRSIDDKDYVEWRKKVAGIPFDQYGAAYGSAHQMSSCRMSGKGPGYGAVDTNGKLFECSNVYVADASVLPTASGANPMISTMTVARHIGLGLAKDLKTKAKL

SEQ ID NO: 15379 - protein, 231 aa, Candida albicans
HSRIEFINNNNIFIVMSVITLTKESHKNPEKFRIKHQDEVEILGPHRKDRFAINEDLPTITTTSKIAILGAGFGGMASAIKTMQKYNEQDIKIFERHDNFGGTWYANTYPGCASDIPALWYSFSFALTSNWSRVQPPQYEMEEYILRVAEQFKLREKTRFQTEINKFEWDDVNGEWTLYAHDVKTGQRILHKSKLLLACQGGLVHPLQLQAEGIGKLQRGIHALGSLGSFC

SEQ ID NO: 15380 - protein, 642 aa, Candida albicans
ERCPSSGVCENRRLMDDIISSFNQNRDELKNFWTDHEKFNDPFQSKTIEFRKQFYVNYPLDKIDSIPNSNSLSHAGFIYSPRSIEDDRVRCMYCQCALDYWEEDDDPIQEHIRNESTYCYFLDLYNNEQDGDKDSLELENPITKSINDIDHEEGNIDNKIDNNNDYNNNDNDDDEEIIELASFHASENDNDNKTKDDVISISDDSTTSLPQEITNKHKHDTSVNKMNDSFSTPVKDISQDLSIIEQDERPTYRRSKRIKRLYGEKDRNVDYWDKLPDEDLLQEFIEVSQKSSQHNNSKRKSSIINKNLIENSLLYNESTDDNGIDDIGDIKIHNDSDIEEVIDNDEIPMDEIEIEMEDVYVEENKSNDLSQQKQQAKDTTANGKGEYQLQSDNVLDKDKSTEPRSQKQLSFANGDDNEDKDLDIEKGEQAKVDLLKDINGFSPVIQEDSDSNSDSNSNSDGTDNKNREDVNSNSEKEEFDLEDSDDESEYHSDENSESYADSSDELFKISGNFDDTTQELENPKTKQRKSTSKTPAKETETSKQNNSKAKVKGKDISKSEPKKPKRVVISKKEKSTTPLENLFDNTDDNLEYDEKHIEKIENEPSTHLLEPKKLKKKNTISKKTKSKTSEQKQIETKQLAPT

SEQ ID NO: 15381 - protein, 67 aa, Candida albicans
WNSLETLFGEDDISITAEDLDHALSSIRPSVSDRDRMRYEKLDKKLGWNIISDKEPDDAGSTSDKND

SEQ ID NO: 15382 - protein, 133 aa, Candida albicans
NNFIFYNNYHFIIYNSYYLFLALYIFKVINLQLQQQQPPKQFYSSTYLFNCLCQIFITTISTPTHTHLYQVSTTSSNNYANMLEPLQRIRNAIIEGNLPIVKRILSRFSELWLNIDPKKQGWSNLHYASYYGH

SEQ ID NO: 15383 - protein, 433 aa, Candida albicans
TTVLHLCMEKKHAQTLHYLLQEFPGKIWLNSLGGSSRQTPLHYSCIHDFKEGTKLLLEFGAQWSIQDAHGDTCLHLCFQFGSVGCLYELLKYIIIHSKTKEDASEKIEELENVKNKQNWVAKDYSSSFDLITQYEEMKRDLLSQDYTGAVSEIKFSAESTTLPNPEVASIDTLGNKVLASPIVLMTLQQSVANNDKNFEGRQHSQSLPSAFKAQPQPQPLVRQRSNTTYVYKPPAALTIATEGLTGRSPSSNSSPLSPMTPQPTTSNRAPSLKSVTISPSVRTNGTTNYNAGTDDEPISPQSAISTTSSFNASPNYKLGSRKKSFSFSKSVPLPSINSENVLWPSVNEEGVTESPPQQISPIKRSAADYKLRKNSSASSIAAKLAFNSSHSSPNHNEILRKRAASKSNSVHSNSSNSASSVRQLHQVPTKGVG

SEQ ID NO: 15384 - protein, 312 aa, Candida albicans
HQIYMAKNPRIQIYQCMFNFLFFFFTLLLLFCCSILTKLNFFFFIFRFNKFTPKKHSDRVLIKRVLYTLVFLLVTYTIYSRVLTGDSRIPQSQDRQQSPTNDNNHEVYKVTKDGVYKQEVTGVVEEVEEEELKEVTTEDLYKSNVDIFDLNDYQGSQKGAKNGDILLFLMPLRNAEHVLPMAFYNLMNLTYDHRLIDIAFLVSDCSPDDTTLETVFEYSVALQNGTLVDKLKHEEELKNSGNVRGTSDLYQSYMEPSYIESVKKAYSNPESHHPNYRTPFRSVTIFKKDFGQVIGQRFSDRHAVKVQGIRRK

SEQ ID NO: 15385 - protein, 183 aa, Candida albicans
  UNSURE (166): Identity of amino acid sequences at the above locations are unknown.
YHRMFKFRIPQQILKQNSTSSKSIIMPVLKKPFSTSNPKGDLFKYQSQLPKLPVPSLEETATKYLKTVEPFLNKEQLAATKQKVENFIQPGGAGEALQARLNDFASDKDNWLAEFWDDYAYMSYRDPVVPYVSYFFSQKDVHNVIGYDQLLKSNLIAYYTIEFKDXMLDESLDPEVIKVIHTV

SEQ ID NO: 15386 - protein, 310 aa, Candida albicans
  UNSURE (4): Identity of amino acid sequences at the above locations are unknown.
IQRXNVRRKFRSRSHQSNPYCMNAFKYMFNNSRVPAEGSDITQHYDGEANRFFIVIYKNNFYKVPTHNESGQRLSKGELYSYLQQVKNDATPKGLGLGALTSLNRDEWLGAYNNLLKSPINQASLESIFASAFVICLDSHNPVTIEEKSKNCWHGDGQNRFFDKPLEFFVSANGNSGFLGEHSRMDATPTVQLNNTVYKKITEESPEDLIVEIGGSAPKIGPAEILPFDINPTTKANIADAIAKFDATIAAHDEEIFQHYGYGKGLIKKFKVSPNAYVQMLMQLAYFKYTGKIRPTYESAATSKILERYN

SEQ ID NO: 15387 - protein, 80 aa, Candida albicans
YISSSQVPSEYFQSWGWSQVIDDGFGLAYLINNDWIHVHISCKRGNGLKSDHLKWYLVESANEMKDILTKGLLSEPKAKL

SEQ ID NO: 15388 - protein, 236 aa, Candida albicans
INLNFHSYPYTTEKGSGNHLTKRTIPRLNMMPPGGRKSKIRPPRKSLISSSSSSENSTTDPVIDFDKNWSVLSSAISQIQNKNVSNLSYEQLYRKAYVLVLRKFGGKLYDNVANVIKTHLLTRREKLLSVSANHDLFMQSILQEWSEHLQAMKFISDVLMYLNKVYVAEHKKLLIYDLGIQLFKDYVIKYNNDEVGSKIVNMVIDEIAKSRTGVVITSSMYITKIINSSPRLEIPL

SEQ ID NO: 15389 - protein, 242 aa, Candida albicans
GMLVGYLATEQEEKGLLRNKNNTPVEVKLVNKDDKDFDMYEFHDHLPAEEKLSIQTDFEEDSKKHRFLDLNKPLLMQLLTSNFSKEFYLDQVHRPRHYGKGSAPLFGNFLEPISLTPWWVIPLVWLPPNFYLFYVGFVNQSPITALSVWVMGLFIWTLVEYCLHRFLFHLDYFLPDHPYAFALPLSFARDPPLFAHGWLQVGLTTNFVFGFGLPILQVDFLNISFLYGLFRICWWYLRLYHV

SEQ ID NO: 15390 - protein, 142 aa, Candida albicans
WNTVYIVSYSTWTTFCLTILMHLLSHFLLHGIHHYLPMDGYRLVLPPTLFLVLAYPFYKLIFSIFPFYMACSGFAGGTLGYIMYDITHYVLHHTKLPKYFQTVKRLHLEHHYKNYELGFGVTSPFWDVVFGTELTNTFEKRR

SEQ ID NO: 15391 - protein, 508 aa, Candida albicans
TVKVVLQLLQDRLMSISHSDRQQLLEQKRQRLQELKQRRLLQQLSRLPTPEEPHALLFKKRVDATTQTQYDEISSNKANPINQVTKKEIDKYDKSVQTTTPIQIETPSVPAEKKVNLLDKQAICENDLNEALTTSIKTVNKIQITKTIQLDQSAKRASDVNLLSGFNITATHNFKQTIRCMDVLSKSLALAFTDNEAVVYDFQESQFFPEFYLKSLSGIEIMQFDKYNNHRIVGGLSNGGICIWELGNSSISLMPVLSTPLYSSILRTSALLHLDKIVYLTQFLLDGNPCILSVSRDGVVNVWSANLLVEPKLSFKIFGSTRKADDLQVMNGLYLGPDEIVGTNFILDLIVATNDGRIYKGNGELVHEDCLSIIGSLIKLDNLIISSHSEWNFKIWKQQQVQPFKDIPTPYIVRQMIIRPQRKLQLVTVGYPNLANSRYVVDIWDLSKKIYSPITTIMESVDKIDDIAFNETGDTFIVVVKGNMTVYSIDDSKFSRFEKDDSHFDKGI

SEQ ID NO: 15392 - protein, 86 aa, Candida albicans
SIAILKASDLAEEIQTKIFELSSQAIATYKIEKDIAAFLKKELDQLYGPTWHVIVGKSFGSYVTHEQGYFIYFYIGDMAFLIFKSG

SEQ ID NO: 15393 - protein, 313 aa, Candida albicans
  UNSURE (302): Identity of amino acid sequences at the above locations are unknown.
RMASTRSNARLIRFGIFALVLIGCGYILTRGSSFQPPNYQQTQSPAAHEKQTGNVAAGGGAGSGSAGAQVPLGKNRGPIPKAIMGAGEGGSDAPVPQQDIPDSYTLNDKIKATFVTLARNSDLYSLAESIRHVEDRFNKKFHYDWVFLNDEEFNDEFKETVGSLVSGNTKFGLIPKEHWSYPPWIDQEKAALVREQMREKKIIYGHSESYRHMCRFESGFFWRQEILNDYDYYWRVEPDIKLYCDIDYDIFKWMKDNNKDYAFTISLPEYKETIPTLWDTTKEFIEKNPQYLAQNNLIDWVXFSPRAARSEYS

SEQ ID NO: 15394 - protein, 845 aa, Candida albicans
TILNIVRYNLNLLIIMARNSIKKSPVVKKKDTPIVRKRKPIQQEAEEDSNDEESEDELNVEGLIDASDDEDEEEEQEQEEQPQEEENNSDDDDDDDDDDDDNNSEADSEEELNQLLGEEEEEDPSDYNSDEFSDEPKDDDLSRINIVSLSVSDPSIQKNSISKFSDGSIRILKPEIEPKYDSDDSDAENFNTIGNIPISAYDEMPHIGYDINGKRIMRPAKGSALDQLLESIDLPEGWTGLLDQNTGTSLKLTDEELELIRKIQQQENTDENINPYEPLIDWFTKDEEIMPVTAVPEPKRRFVPSKHEAKRVMKIVKAIREGRIIPPNKVKQQLTEEEEEDQFNFDLWQDEIEISDHIMNLRAPKLPPPTNEESYNPPEEYLLTEEEKSKWLQESPIDRERNFLPQKYNSLRQVPGYQDSVRERFERSLDLYLAPRVRHNKLNIDPDSLIPDLPSPKDLRPFPIRCSTIYEGHTGKIRTISIDPQGLWLATGSDDGSVRIWEILTGRQVYKIQLINKEINNEDHIECLEWNPDSSCGILAVCVGENIYLIVPPIFGFDIENSGKLRIESGWGYDTFGNKKKDLKISSQKEEDNKESDNEDEDEEEDNDDDDDDDEPETSSTVEPKKEVAKWYPPNTEQASMGISAIIQCRKTIKKLSWHRKGDYFVTVSPDSKNTAVLIHQISKHLSQSPFKKSKGIIMDAKFHPFKPQLFVASQRQIKIYDLAQQVLLKKLMPGVRLLSTIDIHPRGDNLIAGSYDKRVLWHDLDLSATPYKTLRYHEKAVRSIKFHKGNLPLFASASDDGNIHIFHGTVYDDLMNNPLLVPLKKLNGHKIINQIGIMDLIWAS

SEQ ID NO: 15395 - protein, 527 aa, Candida albicans
RLQTTTTTIKMSKRSAEDDLSGNRSTSHTAIKTNKDSLPTTTNGKEEEPDNMDIGEFEDPYGDEFESDEEIIELDDNNDEEDDEMIDENSTQAKIEELEAKEQEQEQQSSIYLPHKSKPLGPDEVLEADPTVYEMLHNINLPWPCLTVDILPDSLGNERRSYPATVYLATATQAAKAKDNELLAMKASSLAKTLVKDENEEDEEDEDDDDDVDSDPILDSESIPLRHTTNRIRVSPHAQQTGEYLTASMSENGEVYIFDLLAQYKAFDTPGYMIPKSSKRPIHTIRAHGNVEGYGLDWSPLVNTGALLSGDMSGRIYLTNRTTSSWTTDKTPFFASQSSIEDIQWSTGETTVFATGGCDGYICIWDTRSKKHKPALSVIASKSDVNVISWSSKINHLLASGHDDGSWGVWDLRNFTNNTTSNPSPVANYDFHKSPITSISFNPLDESIIAVSSEDNTVTLWDLAVEADDEEISQQRKEAQELHDIPPQLLFVHWQRDVKDVRWHPQIPGCLVSTGGDGLNIWKTISV

SEQ ID NO: 15396 - protein, 287 aa, Candida albicans
KNYNSVAVATIYPVLASCRAFEDYTRVTNSLASQNLKIGGFTVPLNYLYNRNLGGTPNSDPNDKSSSSTSTNISINDERALQIHLISIQKWFIYWIVIAIISLLENILFLKYVIPGYSIFRLTFNIWLIIPMISIKQEVDANSTFDNTIEWKKFTSNGAGLLYFSYIKPFIEQHIDCIRKFSINPLNFILVEKLRNLYNKSNQVSSNDTNNGNTSTGSSNNNNDYSNVLDSFVMVMNMKNKFTGGANSTRDINELDNKNTSADNEFDVVNITPETDSQVNKRKGFFW

SEQ ID NO: 15397 - protein, 528 aa, Candida albicans
NLQHNNKKTHSKSLFSIMKIFRLFSLLIVQFIINTTVAVSPVSAVLPKLSFSPFDSPEFCSQIITPTCNTTFTYIDELNKDIRPYLSELVKTLYFRYFKVNLDKQCRFWNAQHFCASENCAVEILEDFNWSQVTNESLKPSGLGKISLPDKSSIDNSIETEEVQTCEDLDYSEIDDDHHCVYVNLVNNPERFTGYGGNQSFDVWKAIYLENCFPNTNPMSVTNDADNGGEQCIEKNLFYRVVSGMHASIAVHLSREYLNSETGEFYPNLKVFMERVGMHNDRLSNIYFNYALVSQAIVKLSEILPLREFIQLGYDDITPAQKQHLLANNDVESVEVYDRLLLDDIIPSLEANVVFNTSNLFDNSNLRDEFRSRFRNISAIMDCVGCDRCRMWGKIQTIGYGTALKILFEDDNYDNHNLKFRRIEIVALINTFDRLSKSIESINMFKEMYLQHLKDIAEGLTQPGVYDKIQNNKPGNGFAFPFVSPLPQKKPDQTNTPKNQQQKQPQETDKKRLTLPTRRDSRSWLEGG

SEQ ID NO: 15398 - protein, 223 aa, Candida albicans
RTFNMYFPIIVWLYVSITFVVANYGFDQWTNDDLKQFLKERKVAFNDALENPKLISLANEEAKKLEKGYKKVTEELNNNLNPPDDSLNDYLNFDYLFGKRKENYSIKEWIFESWPVTSLQTFLTQNNIQYSAKDTKDDLINKVKDQFDSISKKNHGSSFYPGNWLYESWSENDLKDWLKSYGIEFNPSSTKDQLVEKLKEFSYQATHSIRDSKDVFTTRLENP

SEQ ID NO: 15399 - protein, 211 aa, Candida albicans
  UNSURE (199),(205),(210): Identity of amino acid sequences at the above locations are unknown.
IHTWLANTEKKSQPWITKGEQKSQKKKGSNLINDTFFVGINNWSKDKLREFLDVRKVPYSIFTTKHQLIKLVQKHKFDPVHVDTYAWIVDDVSTDSIKQWLIEQGENVEGTRKDIVSAFQKQFESLKKGFKDAFNNVDLQIRLFAPDINGYKRYLQKKLSEAEYKKLTEDQISQGFKVVQEYYNMAGDAAKWAFTPTIXYSLLKXAKSIXH

SEQ ID NO: 15400 - protein, 647 aa, Candida albicans
FTNKETYNTKYLTMPSLVPVSSSSRTTLSLSGATGNNSYNNQYGVYGNGYVQSLGHNHRGIEDMKRIEMSLKSGIDSEIAWALSLLTHMSIQPLIDLEQSPFLGNELIKYFVKPYQLIQEKKFDLLTQDILTFSLDSVLTLRNLSQDLPNQQWLSQIPSFKKNLIELIKFLTNWFYQPGGNQIPQFEKYNNQFAESLNYIVDLLEPLTCYYIDNSKNDTLFNILLNTLMITTDRNLFINILKCISHLLIIWDKGAKAKAEEDGNGDDEDEDLAQEEEGEEEVKLTNNCIDSISDSQLETIINTLLIADSEMNNAVLDFLKMYLFSEALHEKYSSSIKDSQRHRLRKLLQLNTSKATFNTLMKQLPLLLVSDLPLNEPIEEQPVPSLNLTKRSQYSGVPTSAPELTEELYKIIVAFPEPLRASTWLHCCYEATMTEQAEVTQISIWKAYETQFQEIWKPNTEGTLNHNYKPLLPAVEFIKNVTKAFPYAEAKVVALPQAPGEENQAPKKKFIIKGIQPRQFPVSIDVGNYDALKPMGEATVTEGDESLPIGHMDVKKFHHLLTSGVDNILFADSANKIAKESLNLINESSHDILEYIILEVLEVAGIESKESSIFRLYNKYWIPELVYANPSLLEKGIIETTWLKYLL

SEQ ID NO: 15401 - protein, 367 aa, Candida albicans
LYPEMTRETDPLLKNRQQPQPQPLVKPLFKKLLTIIIPLSLIIISSYYIMTHHHHHHHQNDPNNTDGPILTLRLYTNNIRFDNKNYPDKYEQPWEIRKFQSINSMQFNTFQGNGNIICLQEVLHNQLIDILQGLNDIQEWNYYGVGRTDGEKSGEFAPILYKDQDFKIIENSTFWLSPTPHVPSKGWDAALERIVTMVTFQSRLNPEIKFNIFNTHYDHRGVEARRKSSQLIVDKMKNYNDYPSFLCGDFNTEPNDEPYHILTKAGFKDGKILIDKKSAYGFETTFTGFDINNEPISRIDYIWSPSFTRILSNSNNDTNQDSDDDNDNDESYEVTLKQFGILSNWFNGHHFSDHRPVVSTYELRKKK

SEQ ID NO: 15402 - protein, 513 aa, Candida albicans
  UNSURE (251): Identity of amino acid sequences at the above locations are unknown.
PGPDPQAFGNRSIYLGNLHPSTTIEEIANNVRAGGLVESINYRPEKRVCFITFIDPNIAYKFFMSHQVLHQLVIHGYEVTVGWANQPSGPLPRDIGVAVSSGATRNVYIGIKTANSSALDSSEKVTKIPLPSEKELREDFGKFGPLEQINFIHNRESGFMNFLRIADAIKVVSIFEHGVAISMKRLKRVFKLEEEAEKFYNRYKTYKVSFAKDRCGNPPKFSFKKRSTDHPNMYQQYDHHSTSSLRHLRSXQESHSSEQNSTNEYNKEVIAQEAAMVFGIVSKTNADSQGNTSTELSDVPETKEEDGEVHEYAAPKSTNTQNGENTDKGNKLEDIKEQKTERNGDHNKDREEENNDEEEDDEDEDDDDDYDDVSIIIGSDDTASFNNSFNKETKGEHKSSRSRPRYQKIYHNSYSEPTFRRSSSNLSINGSMNYSQGPYMQPQPVYFLPHLSRNNSSSSFMSSNMYGPPGNAPPPHPYFVSPPQFIPQPQVCYPPMMQVPSGQALHHGMEIRV

SEQ ID NO: 15403 - protein, 414 aa, Candida albicans
NVSFNSLHQNIMDTVLERIVGTLLETRNYTFTEQFLDQLTELTLQFVNELSADLSKYTRIQRRQQPSLSDIKLLLKLKHISINELIREIELSKKFTYRKQLASLLDQLVEEPIKEQSRPFFDQSSITELVPRLNVKPDYIPSYLPDLPPDYTYQSTPEYMETLTDLKKLRMKLVEESRMTENSLYKLIEYDDIEWRQKFEQELVELSPDSSANETTEVPIPTTNGKSEDFKFDIVEYARMRKRLLIKRDRDLENRRKAREENMFMKAEMYYSPYSTLKPTAEVKQYFSDALSDGFKSVIVSVRNAEKLKEQNIKRQMEENARREQELQKQNESISFSFPTINQLESESESDNDFEQEVKDNIELNFDGSDHERDSRNLVVVQNSDEKALQQDPPPSKFAEDVSDMSSDDMDTIA

SEQ ID NO: 15404 - protein, 91 aa, Candida albicans
KSILSTILKEQGTMSAAEPTNIDLNSLPPQQLIEFRKSIDEEITHFTQSLQALSAAQSKLKDCISSINNLEQSKENDLLVPLTSSLYIPGQ

SEQ ID NO: 15405 - protein, 581 aa, Candida albicans
RQISKWKDSVQALRQAEVLKFPMINQEQDTIRDSALTFRSDNVPTTELEKRINNVLTESSLVDDKKEATFEEIAVAKLSPEEMKKRTNELRLMRELMFRDEKRAKRIKKIKSKQYHKIQKRERLKNQEMVEGEDFDMEDEDHDTKRATERMSLKHKTQSQWAKSMIKSGLSKDASNRAELEEMLRQGEKLRTKQMGFEDGDQSDENADDIINEYDQDDIDDENNLRSKLGKGVMNMDFMKKAEARKREENLKELEMLRKLENGEGDLEIFEEDNSAVNVTKNQGRRIYTPAAASQINDNTNEQALEDIENDNAKSLDKKLAKKYKVIDNQETKTSAKSESNPEVLPVDESNPWLSSNTSANNDTTKKNSAKITTVDKESSKLAKAAAKLAKSKLKKHKSSDDNTLIDVNETLAVNDIYQDGSEDEDESVPTMFKQKDLIKQAFAGDDVVSEFENEKKRVIEEEDDKEEDLTLPGWGDWAGGDSKPKKRKVVRKIDGVMAKDRRKDKNMKNVIINEKVNKKNLKYQSSHVPYPFETREQYERSLRMPVGQEWTSKETHQKLTMPRVIVKQGTVIDPLKAPFK

SEQ ID NO: 15406 - protein, 478 aa, Candida albicans
SMTSIEEEEDHTQDSLGNTIINPSQKIESTNQIINHPKLSINDLPSELLIQIFTHLDPIYLNSLRLVCKHWNYIINDKELWMKSFQLRFNIPITSSSFPSLSQSLNWMNEYFMRLQVNKNWKRGISIHKTYQIINNEHRFNDLTMVDFGMNKILTYDKRYNNISIGKLSDGKNQGFIPGGNINGFLTDVLCFDINWNYLVIGTKNGEIILKNLYTSTSSVSQRSSVTKFDTIDEESPIMDIIMNKDVIISGSFEGIIKCWDLQGKIVKKINLEEEVIYNISSDFKKHIIVNTDRHIFVINYQTEEIISKIDLGFIINENESIEYDLLIRLKNKLDVDYGTQKIIICYKSFIRVFYFDNHNYSHRELKLEKDIEVIDSHFQIAPPNKFFNRNTYVVGQDGLLYGNLLSDGSVIIWNVREDSLLITPIIQIYPQLNHKKYSYGLNHAITRHNLLEITSFAMNGTMIAIGGILTHAAGISE

SEQ ID NO: 15407 - protein, 181 aa, Candida albicans
SLFQTEQSTKKKNQGRSPTVSKLFTSSKPLTLHRHCILFFQFPACNLPSVFYIPKFQTDFFPLLSYRRPMTIYSFFIFDRHCNCIYNREYTHTASSNDTLSGQINKSNDSNSSKLLFGILYSVKTISNKLANDKDTEMNELKSFTLVRLKSIFGSHYHGLNLLLSPMEKSVNYLMFYLNYI

SEQ ID NO: 15408 - protein, 248 aa, Candida albicans
ARLGGGILSLGLVLLFTNSVYRSEMRRFNRNIRDDLTRVKADNRLVNELETMEWMNSFLDKFWVIYMPALSETVMFQANEILKDQAPGFGIDALSLDEFTLGSKAPRVDFIKSYSKTGQDLIEMDWAFSFAPNDTDDMTKNEIKRKIDPKVALGVTVGKAFVSKTLPILVEDMSFTGRMKVRMRLSANFPHVKMVSVQFLEAPEIDYALKPVGGDTFGIDIMSFIPGLSKFVNTIIDVVFTSGRDNTA

SEQ ID NO: 15409 - protein, 503 aa, Candida albicans
QDLKSNNCFTFILWVNPITNMGGGLTSLTSFASFSSLAMHDSKRYRNLVVKKKKTEPTSTHTPIIHTIRHQLFITMSLLLLETLQEGLEDEYVQLLNLDSSFAQDAEKYLQELLVNDDLLSTDPYTTASGDSSYHKKTLTEEIAELDMSQHEINNKLSTITNSNRDLIIDISNDLQFINHQITKEYNQNTENLVKSITSDFRIDSSTSNYFNLKTNISINNTILNNIDSVLDILELPTLCKLCILQGNYQESLEISTYIQSLMIRYPKITLFKTINEQIDYGLKVMIRGLIKLLNTNLKQNHILKIFQILHKLFDNNNNNNNNNDNNYENWDIDNESILITIFLNSRFKFIINEISSLKPLIKFNKLTYLKRYIEIYREFMFNSLSIYNIIFKNKTHNQNQQQQKQIIIINQFIQSLVKLLCQEFKHYLPDIKSKKIDDSIESEFELKSSIDGLILQLIYLCRSLTGFGLDFEPIILLELVNDDLIPESDWLRNLSKVKIKNR

SEQ ID NO: 15410 - protein, 506 aa, Candida albicans
GPFLLYLSKQDNSYFIGILQILFQMNSGNLRTTDDLDEFPDDIRVQKLQSCKYIYPDCEIDLSSLSGTVNIKVKSDNDITIRLIERTSKGTRIIATNKISNLPPIVLNFQLSADYPFVAPPEIKVTCVWLATSKTDLLTKDLYDIWKEYRDQVLFNLIDHLQDQVQNHLDVLIPAPFDIFDIDEYYKVVDFNIDAEIEEFNSQTYTCDICQKTLKGLHCTKFDSCGHVFCNNCLAEYFESCIESGDIDKVHCPDFECTKKYVDKKKKFMELETWVHNDKKVKDMLNQLLIPSIPLAMLTKILKSPSLVDRYYNLFKKSQYEWIGNLLPNRLVKCPRVGCDEVIFREDIDEKLVVCPKCKYAFCNDCRKSYHARFKLCLKINENDKYLGIPIEDLEAYPLLPPDSYDKKIMNAKYGRKRIDRAIEEYQMDQLFQQMMRERKTVVQCPGCSVATEKSEGCNKMKCSLCKTDFCFNCGSKIGNNHDHFVDPSSPCYKLLFFGMPGTEDI

SEQ ID NO: 15411 - protein, 94 aa, Candida albicans
  UNSURE (28): Identity of amino acid sequences at the above locations are unknown.
TEIQHVFKVDHSTHRPDGIPGIYFLYDXEPIKLVIREERIPFFQFIAKLATIVGGLLIAAGYLFRLYEKLLFIFYGQKAVQQNREQKTGGLLDI

SEQ ID NO: 15412 - protein, 198 aa, Candida albicans
LRRTNCFYFSQSMDSFAQKVKTFDAFPKVDPQHQVRSQRGGLSTLLTYFCGLLILWIEIGGYIGGYVDRQFTVDDQIRSALTINVDMIVAMPCQFIHTNVEDITHDTYLAGETLNFEGIHFFVPDSFKINNPNDFHETPDLDEVMQESLRAEFRSEGARVNEGAPACHIFGSIPVNQVRGDFRPTVSLLHRRPIRVLF

SEQ ID NO: 15413 - protein, 308 aa, Candida albicans
RPQMNNEEIYTIRPTRSKLLIVWSILELCTVSLLFAMSFFFLFANSKLIQRGPPAFQLRIQSDSIFAKNTFQLVQQGLKFATYLSNDLNIYINETIPETYLQQIDSNYDNNLYQFNVFGFCRKTQFDKILNCYNGQGINIAACFLQDIGTQLGNLTNQADPSNVSAKLVSFYYNLVDQICSDSDKKLCALQTYNTMSRIVQYLGISSLICLAVTTATSFFEMIGYCVFAKSLARVFFIVNVISMLVFVFTICILYCIIMVMKNFLTDLITQFQIGTLEFPSIKWITWGVLTLMCLIIVVKRYLIYQSI

SEQ ID NO: 15414 - protein, 200 aa, Candida albicans
SILLEVEFDIVNVLLGVCFFRILCLVMMMRDGNISGPKKKKFTTKCRPFSFYKNRHIIMLINDESVYLYNLTLKPPSYYISSIVGQFYKQDNSTKNAQQLVLVSSTTLQLFEINEEAGKLELQSSQNLLGIINSIEKICLSEVDGVVITSDSGNLSILQYDNKTKKFISKIQEPMTKNGWGRNYVGENLAIDPENRCIFT

SEQ ID NO: 15415 - protein, 164 aa, Candida albicans
  UNSURE (156): Identity of amino acid sequences at the above locations are unknown.
LYTYKQLFIMQPVTSEESSGVSTRESFEIEDDSLQSDSNLNPLGVSLYGSKTIESIVYILGWYFFSLSISIYNKWMFGSGLDFKFPIIITSFHQLCLCILSCVVLYLKPNLRPLHTTNVSTPTSTNGISGQTIGKFLQSLLMDFPIYIRQIFPLFXLLALVILD

SEQ ID NO: 15416 - protein, 241 aa, Candida albicans
ALPKTKTQKKNFNPIQLKTLSKSYQIHCWTIIILLSLAMTSEVIKFPQFPEFTIHISLFINVSSENITTIKSNLISATDNDHNKYDYCFLNTKYIISKEHLFQSIYKSLLNYTSKLGLSTRNLKSEIIYNLSPINNVGDALKRFGISEDCPNCIVIKIINNNNKENSEETKILEKVTTDLKEIIDGELIELNDQYIFENFIDLAKFRKLYKLNDVVDLNKEDNLQGRLTRLAIGACIIRGY

SEQ ID NO: 15417 - protein, 133 aa, Candida albicans
LDTNFKPECINCLLHARCYANLEIGCFEDFMEYKPWFDFIVPGHKKCIPDTKKAEKLEIMIDVALDLLRSKNAAIQCGQNPNDEESGIKLNDLHDLLLSMKAPYITIDEFEELWDRSVIELEKEPDIIVRQVR

SEQ ID NO: 15418 - protein, 142 aa, Candida albicans
RNQRKKSTKILTARKRPSNVSTPSTKGKSTKKISPLVTKSALTPKPRLISLRSQKYESDDESDEEDVSEIRKPVTATKDVDSAGTSTKPFALPFSIRRILLSMFLWVFVCNGGLFGLWYYEQKYAVGYCGQEIDQPTVHQLR

SEQ ID NO: 15419 - protein, 93 aa, Candida albicans
PYQLYLVKIDILYEEVLKKLKTQSNMTKENPEVNPYIGASQLRDLILSNEDNLHQRITMWKDVSVKVEHNSNISSQIVENNGEIMKVWEYIGI

SEQ ID NO: 15420 - protein, 148 aa, Candida albicans
HILFFSTREPDVLQKMWDKSKQQPFVPLGSLLTAGAVLLAARSMKRGEKLKTQRYFRYRIGFQLATLVALVGGGFYYGTETSQHKQTREDKLREKAKQREKLWIEELERRDAIIQARKQRLEESKKELRELAKQGFIEEKESNDKKED

SEQ ID NO: 15421 - protein, 266 aa, Candida albicans
LMSYSSIKILKVSYPYNLINAMDNLIENNVKIVFSGVINDPFIPLYSSLAIQFSHPNITRNVYYNDNNNNIYNISNCEVIPFVSQLLKIICLMKNLGYDQDYDLVRDLSDKFESLTSTAMGYSISGASTNTTTAFTGFENSTETTNNTTTKYNSTIFNDDKLYLEAIRFSLETTNLIGKQRELVITDYNTMESIPSDGDFNFYNMLPWNMRSLLHDFIQIKHVKSYQLIEQLINQFNNEWDPSSKTWKDIKYCLGGLEDFHADELI

SEQ ID NO: 15422 - protein, 267 aa, Candida albicans
NGPFYGVDKSFFMKAYSAIENESLLELFELNKFDSQQSIAYKDSIQTIINANVKICFIASINDQLVPLFSALASHIFHPNIYRACYIDYTSHTPQFVGKLVSLCTHLLNIGYFDNNVIKELSTSLAGPFSGNGHSKIYNDGKVYDLGIKFVLDTDDIVIPFDGESNLLEEITKSELPISNQIYIKEYNIAKIGTNPYILPWCLRGLLFNIEKNWPNKRAGRIEDKETVKNGYEEIHDLYESFENWKPETKVYKDLKFRLNGLRASKL

SEQ ID NO: 15423 - protein, 124 aa, Candida albicans
LLERNSSIRSVIKCGYQCTIQNSVPFVAKSNNGDIVLISGGQYYQFGIETFLVGANYALLAGALLLLTYIGCYKVTERSFITSEDIRVLLVLLVTILIYLLYSCLTSIVLRKDQGYPYSFIKLF

SEQ ID NO: 15424 - protein, 425 aa, Candida albicans
HHSFTRRFLPLLTCVITYIDSMSTTDNIKLTILRYIRAFFIPDSTLHSRQKWILGLINLAAVVIFWVLSSFLVNAVVEDDTYRKPFFITYINTSCFCFYLIPYLRLEKLSVREFIDKFTQEYRYSKVSHKLEQDLIQDYGSRDNLAVLEEQTLRVIDSNELAEGGDEDQDINIYETAKLSLQFIVLWFSANLVINASLSYTSVASQTILSSTSSFFTLIIGYLVSIEKINQNKILGILLSFAGVLIVTKADATEDNPNTDNSALLILWGNILALLGALIYGIYTILLKFKITIPHSKREKNLNTHLFFGFVGIFCLVFLWPMLVMLNYFRVEKFELPPTSSVATIIAANAVITFVSDFCWCNAVLLTSPLTVTVGLSMTIPLAMVGDWVFKQFKLNLLYVFGATIVTTGFLIINKDEEEDFVESD

SEQ ID NO: 15425 - protein, 592 aa, Candida albicans
NMDSLSSDHKEKVDEFKSITGSSTDSENDDKIIEFLTVHDFDLNNAISTYFDSGFDSIGNSSAINQHDEIDNQVTHRHSHHHQNETPDVSLDQSGPVNLQHQMFFDSLLPKLPKAPVISNGWQLEVGIHTSILDEKIRQEREKTETTKEDVYETTESIHSEIEDTKKSPLSSLWIILLIIPKTLLHVILSALKFVFGWRVFKGPEERLPQLFNYEKFIPNYKFLPELKPSKEETNNDVNLINKFNFREDQFNETHLFCQKEYRWLLVVLVNDSSTTKNFIESLVNHKHFDKLFNKSNGLFKETEIFVNNIERSPEAFEIAQTYKVKRLPYVMLVGNVSASPDIMPSMSIVYKSNIAKPFITEEELPNTTNKILKNIGKLLERFNPQLVSARFDKQEMEISRQIRQEQDDAYLRSLQQDKIKKEMRLQEENAQKLAEQKSQLRQYYLLKLISTKYIEQNVLDQDVDAKCKIALKLPNGKRIVELFNGEITLLEFYMFIELKLFIEQEELDTDQVDDLIEKLDIDDNVKNSIQDLSDYHNSYPFKFEVIQPYPKKVIHLDVDMDQSIKDISEFSKGANFLIEFIDDDEEEEEEE

SEQ ID NO: 15426 - protein, 382 aa, Candida albicans
QNWSGIPFPIITGLILKLMEQEDDGDLNTKNKLPTLTLASIITDYCHANNLENLEILKRWYIYPPMILFNSTGSTSESNGHPTSDTIFNPQHQKLWENVLSNQKSIFGTSEITHIALNKPIIESDIMRRPHNLIPIIGDFGPDISIDNKPPSPTESDFNRAFWCHVIQNGIYQTWAPKYTMFSRGNIKEKKRVLDWFKNLDQTIVFDFYCGIGYFSLSYLKNGGKLLCWELNPWSIEGFRRSLEKMKINYKIYTSGDKFSINDLNQFDACLFLESNEQITTRVIDQVKDNSLPISHINLGLLPSSKQSWTLANNLIDKSTINTNVHIHENVHIDDFEKIKTDVKKVFTNGKVLHLEKVKTFAPDIWHIVIVLQPQGLEGPAL

SEQ ID NO: 15427 - protein, 87 aa, Candida albicans
EIMTSTNKSISHLPILHNPFLNCLFNNPQYFKSPLKGVVDELQSNHTNFTILVPPAHVLNEYYDPTTESSNSKTLLKELCYNNERFH

SEQ ID NO: 15428 - protein, 630 aa, Candida albicans
RNYVITMKDFIRSHIINTASPVSSTITPISKEQLVIYNTLNNKQILIKNRIIYTGKGFRRSLKLKTLSIQYFSSFCDYFPKRSKFMIIYIESTLFGGIPPRKMLPPLPEVRETNKTDKDIDSVTFEKLLRSFPLLSKAVSDKFYRLFHHNNYQFRVLRYKNRKKLSHIKLEFQKILQEAFSIILDSVNVDNPNSEQTYNLINHIISMYPGIDLNKLVHEYVELNLYDVLWSQLIFQFNCPNDDKEAYDPEAILILTKEKYEKLSCLSLNQLDIPVNKPWLMNELHERISLGVQEFEKLADSSIMNLAAKTQVVYSTFRILTQRKNGNIDPVINADTLIGLLIMVMIHSKIENIEAHIYYIKHFNSIDNTNDGQFNYIMSNLDAVLFHFSKKESGYLDLIENSKKNYEIWNAIKNNDLEKVESIIELVNNEYPETELPENHFLKSKNINGESCLMFAIKTKRYEIYDCLINLNPNWIPIDSILFEKNVMTNQNLLMCALIEETDYKIIDDLVDIILNNATLEEQTMYFNMTDISGRSVGHYLFHNYKLISKIGHLIDWEKNDNNSHTPLFSLCRCYDHPEYVELIRAGFNCVYKKYGETGVDYEQHVDKSGNTLLHVLLKGLFSPHAKKKF

SEQ ID NO: 15429 - protein, 167 aa, Candida albicans
IIPFVNQLYSIQQYLTMRRHSRSAPAPRQHTRSAHTAAAPAHHAPPQSYPYAHPAQPVQTQSSQPDLFGQMASTDVGVAVGSNIGHTLGDGITGLFGGSFSYAPVEVAPQQQQVAAYQLQQTQEQAIHCDADARNFTRCLEDNGGNMQICDYYLQHLKACQEASRQY

SEQ ID NO: 15430 - protein, 180 aa, Candida albicans
KKMVEFYFHDNKDTLENFTEDHNSGEPVSFDQLAEIGVIYKYITTQEELDALATEREYKNRDVVTLNLPAFNNDIDAYNAKMQQFYKEHYHEDEEIRYIAEGEGYFDVRDKQDRWIRAKLSPYDLLILPAGIYHRFTLTNAAKHVKAVRLFKDEPKWEAINRDTGKNTEARELYAKTIAV

SEQ ID NO: 15431 - protein, 96 aa, Candida albicans
RPENILIIFIVAGLFQMSLDIYIAFQYLQFKYFTTTNKNLNDGASLHRRNQLIDDVVNDLVSVSSEIELDVLEKGQKDISNNQTSSWSRSRSSTLA

SEQ ID NO: 15432 - protein, 323 aa, Candida albicans
  UNSURE (302): Identity of amino acid sequences at the above locations are unknown.
NSGSKSDLESFIKITHGDVINLVSKEVFSRFRYKLSSNWINIIQLPQLFREIAFPYGIQWRSQNYPSTKEEFALQNNQNKDIPTQIQIIETKSSKKSKKKTQTQVITEKSIRRSSIFIADDIIGFIPIIKDSSYKSTIVEEIYSNARSHLVQGNKEMGMALFNELLAINESIYGKVNPETAKFYNLVAQVYQELGYDIEAALIGRKAVILCERSCGFDSYDTITAYMNSAYYESSNEQYLNSLKLYKEAMNTWSLVYGKDHPTLINTLTNLSESLLKIKAYDSALELLQEALEITKKLNGEXSEITGFIYYRIANIVVTLNKF

SEQ ID NO: 15433 - protein, 323 aa, Candida albicans
NPSSFYITFCQNDKAVNNFVANLWNNKNVKKILDEIEWSSRVVRGNLTRQEKDSRIKATGSKVDLKDNESSDEGAEDDSEDAHKSLDLEDAYDKLAIYDKVDNGSGGEEQQPELDPNVNYNEVTDEEPSEEESSEDSSDDFFEDEPPKKKQKQSQDSGKSFNLPQLASGYFSGGSDDEADDADNDKVVKEITTQRKNRRGQRARQKIWAKKYGKEAKHVKKNQEILASERERRQMEFEERQRKRELKAKLLAEKQQTGANSLPLGERKPTTSNTASTIPQLLLVSTNSVATEEKSIHPSWEAKRLEKEKLKNVKFQGKKVVFD

SEQ ID NO: 15434 - protein, 442 aa, Candida albicans
  UNSURE (420): Identity of amino acid sequences at the above locations are unknown.
FADPSSPVVKDKRWPTIIDGAIEDVQQTIENHQEEASIGHKIIQQLLNTKEDFVNDAIVRPFTDEEITINPHLKHYNESLENLNKIKPVTWQTGPWLYLECYLYQYINNFFIVNTNEFWNHYDVFQNLKDKTFKQSELGVLELCKRYETLSKQLDQANDEVLHLLFKEFIDISLWGNATDLSLLAGNVTLEDIKSVQGAEVRKKNEEKILVNDLSQAWKQLHNDGNDSGTKRVDIVLDNSGFELFADLILTLFLLDSKLVQEVHLHCKEIPWFVSDTMPKDFQDLLNQLVDPEFYPQIHSDEPSSIKLVHDKIQHYYDKHALIINHDPFWTLDYNYWYIPKFDSLYSELQHSNLIIFKGDLNYRKLTGDLQWPKTTPFKTAIQELSTSNLPVLSLRTCKADVVVGLPEGVNEKLIKEYEXMGNENGQLWSSSGKWAVISFNK

SEQ ID NO: 15435 - protein, 593 aa, Candida albicans
PPYNPIIRSQYYLIDDSLIMPPFKLRSRSNSSSSSNPQTQWYNNKNQNQPSMSEPTYTLPGVINYLTSEFTKLEQFKIVNNLERSEMKFKIKELEGEIKSLTFTNKLQKKTIERLQTENKKLRLRLNEEEVEEVIMTPSPEELAKMSKIDLQTIKRTRERLANSMKEIVTLLKPPTLEPSISLAKTSKNTNDLESLLDKPEINKADDFNFNVKPYSFESKDYESPVRNPSSLISQYFNSNTDLKEISKEKKKAEMENDSIVDDDEILDAELEDVLEKAISETSDSATIVLNDDDDPLADLNDDDFSLDDSPQERSQINNNNNNNNDDDDLDFEDKLSSFPLLVSPLLVLPLLVPPPLKSPQLQPPQLEPPVLEPQVSSSISSSSKKNKEEEGGYDHLDVYYHDPNTIYLRSMKDTTKKEVKLDMLLDGKLASTQKFEMETSAQDIADILPIDVPDTLLIVKKNGDVKSMVFELGNGKEHTIMSVKSDFKDIESCGLTEFTVKMDDTYKYYGLCISGNTSSNRKFLLKIYELSYDLSNRAVTSKEIGSYNKKFLTKGKPADEVHFAGWINNAKVDSLVDILEADKDPKSSIWRD

SEQ ID NO: 15436 - protein, 413 aa, Candida albicans
YSMSLETFRESKAYKWTSKVISFLIGQWFFIFLGVFIALAHSYPEFAKQGGTIRAEYSIGYGAVAVIFLISGLSMSTKQLLVNVANWRAHFTVLSMSFLVTSAIIYGIALGIKASHNGQIDDWLLIGLIVTHACPTTVSSNVVMTKQAHGNDILTLCEVFIGNVLGAFITPALLQMYMRGTWEIGNPSHQTQGDSTVQELYAHTMKQLGLSVFVPLFVGQVVQNIFPKQTKWCLTTFKLNKVGSFMLLLIMFQSFSTAFAQHAFTSVSHASIIFLVFFNIGIYLFFTVLTFFYSRPFWILRVFKEEPNESSSKLYRYSYAFFRPFYYNRKDTVAVMLCGPAKTAALGVSLVSSQYGSHNPKLGIILVPLVLYQAEQVMTANVLVSFMRKWIHAEDKVPEDEETSVGSDNDPKK

SEQ ID NO: 15437 - protein, 80 aa, Candida albicans
ELHLLKSEGLIRNFGISGYPVKFLYEIALRCKNEIAPLDAVLSYCNGCIQNTLLFEYHDKFLQHCGVQTVLNGSILSMSM

SEQ ID NO: 15438 - protein, 288 aa, Candida albicans
FFPNIIYTCQLVICLILTFFFFDSMPPKKSVSAKLAFQPRQRVFAKMPGFSAWPAFVVPQEDIPDDVLEAKKRNNKTPYCVIFIPDGDYYWMSEKGLTELTEEKLSKALKDVPLDIKKKMKNLKGKIPGKQSSYKQAIAATDGLDYDTFRDFLIEINGVEEEDDDDKEEEEEVEEEPEEELEEPEEPESKPKPIKKEKIIVRSKSNKREYDDEAEDGDVEESYEDEDSVQLKKQSRNGGRRSRSSSVSTKNTLTTATNGRKKRRLTGDNSSNTKTSEKSTDSNMIPNP

SEQ ID NO: 15439 - protein, 477 aa, Candida albicans
  UNSURE (466),(475),(476): Identity of amino acid sequences at the above locations are unknown.
SVLFLLFFFDSMAPKKSVSAKLAFQPRQRVFAKMPGFSAWPAFVVPQEDIPDDVLEAKKRNNKTPYCVIFIPDGDYYWMSEKGLTELTEEKLSKALKDVPLDIKKKMKNLKGKIPGKQSSYKQAIAATDGLDYDTFRDFLIEINGVEEEDDDDKEEEEEVEEEQEEEPEEELEEPEEPESKPKPIKKEKIIVRSKSNKREYDDEAEDGDVEESYEDEDSVQLKKQSRNGGRRSRSSSVSTKNTLTTATNGRKKRRLTGDNSSNTKTSEKSTDSNIIPIPSIKKIKSETSDDDNQSHKSSIASVASNNHNNKPTVSDKEKNHQLWLCRVKLQKTLIQRNQATTPKDTTGLKPPTADELLTARLILHRLQDFPITAELLRKSKLHKVLRCIIKDPTLKYPESFKLHDRCQEVLDVWKEPIEQLKLEKQLEYEDNKHNPSHHSHGHGHGLDAANRKAIHNQDDSEVSGXEATIPDMAXXG

SEQ ID NO: 15440 - protein, 174 aa, Candida albicans
KISYRKKKKSVNKPKLFFFFHNNIILLPLYLSMSEYQPTSIVLAKVKGYPAWPAMVLDESLLPEHISNKKPKSKTNPPTSISSPTPQSPSKKKPSIIVPVRFFSDDTYIWINTNDLKPLTKQMIQDYFSTSSIKRKIDNLLQTAYELANDPPEMGLFIEYGSKGSTPTPPPMVR

SEQ ID NO: 15441 - protein, 306 aa, Candida albicans
GINIDNTQHDLELDRDSSTQQPAQTHEDDGDLLGLDKPIKLKTRAKIAKVDNQRIFNHNGIPLLVKTHSKLLRTLKKNDKNFYSEPRSSISKSQKFEHEYENLSSVLQFYQLWCHGLFPKATFKDCIHLIRALGARSPQLRLYRRELIAAELHKLKVAKGIIADENQDAPSIPEEENTTDPSNEEWNSMHMSALVPGSSNKNGLFVDSNSNEDFETTNEVNAAASLADKDALSTDDKAEQTNAITSDTHNNDVDSDDPFSDDDDINIDAHTENLHPASGTQHQDRPKETTEENEDLELELMREYGA

SEQ ID NO: 15442 - protein, 173 aa, Candida albicans
MALADLALSNIWGGLSSDFKKKNFSLYGQWISILTIFLCLALGVANIFHLGPIIVFSIICIVQGLIVLFVEVPFLLKICPLTDTFVNFVRKFDGNLPRCGFYLLNAVIQYLSLTLQATSLLVVAILFTISSACYALAALKHQEYLKSSLDVTGTGSGGALEAQVGEHVVRNVL

SEQ ID NO: 15443 - protein, 370 aa, Candida albicans
TFYMGSRVGNRGSIKLSLSTRNMSNGGAGNNGGRSGDNQNKQSTGDEVKSKRKSARIAQLEAESIPKLSASPEIKEGRKSSKPGSVSGNGNTVFVEPELAAPTPSYTGLPLEEFPSNKIKKESLWPAKYRRTKSSDSSRESTATPGDEIDTNKVEADYQHNLKTSLSEDLAKESELRQSLLNEKTSSKPKRTTRLKLTLRTPTQETGKQQQQKRSLDGSANAKQRPLKKIKVTSPTKSPRTKLFDAKTSNGSIVKQEKDKHHEEEEEEVKENDDFCFACGMPGIFICCEKCPKSFHFTCCDPPIEEAPEDEWYCRECYTKVHPESIQDWRDMGVFGQLLNQLETRNPKVFQLPLELREKTSVGVTTESNG

SEQ ID NO: 15444 - protein, 236 aa, Candida albicans
EQDFLIVCRQSWADELISEKFLAIVFFSALEPNFALINDATMWISTMFTRLESKKNIKFEKSLVRLIHVLAHHEQFLLLLKDGSDEDKLASYNYASRLLILYVQLIATQENISLLYYFASRVKQHRDATIATVDYEAENPTEQILNLYRMAELAQLVIKTYADGKNWPMQTWPGKLKLPLEIYAPMASSKEAQAVVTEIYIPEKLQVELLAMINKKLRTGIIVKKVATTSVDLRAR

SEQ ID NO: 15445 - protein, 752 aa, Candida albicans
YQSHRRRVTEDDKSKLNSKFDTKFSQAMDILKKVHHLSIQLWKFIPSVLSSVMALIDDELNADDEKVRILATVTIGQMLGSPVYLSASTNVNFFATHKQTWNNWLKKTSDVSSNVRSKWVQQIPNIICSNNYTTTEINQMLSACVHKCLVDTEEKVREAACVCLSEIPYQHFINKIATTELINTLFQLTREKHASIRKISIKTLGSYYASYMKVEKNTLSEIGTELKDSILSIPNQILSLVYINNKEITTLVDLAVFEDMLPILDLNPENRVERLVQFYRVLDAKGKEAFVAINKRQQQISKVLSTYIELSEAYNKSNTLENKDNSGTDDSNEIILKLDKIIEWLYVSFPEGWNTSYCFERFYRLNRARFFHLVKVCISSESDLATVKNSMKELLNKLADSKNIRIENERSMVTTTEMAENFKLLLLKASPIFYNLSIVEGLIKYSKEGENDYYSSANEILEQISSIIPDVYKSHLRALSNLIIDKGEQTTSKSNALKTVYHFVKKYPDLFPKEFSFIEALKNLAINGTPEEAKYSIKIIGLNDKKEVYCAGIMDSIYPLDLESTKLSTNLSSMAEIFVVDRLAILDKENELTPLVIKEFFLKNRNLDNHNVTDNTWITTTELNSHPTLYEKLIAIRLLVNNLKSLDKADLSESAKEEAKQKALPVIKLLMSFIGNNGEIINKNDPSWPTPDSYKLRLRLAAGLYMLKLAKIPIYSETMLLASIRRLTFLLIDEDYNVRARFLNSLQAKLGR

SEQ ID NO: 15446 - protein, 265 aa, Candida albicans
QRVINLMMVTKSRVSRSEDTMSLKFDKSILPTVKSQISNKELINRLIALHDELSNIDDSSVNLSNYTTDLVNKKLLSHTSMGVQAYLCCCLSDILRIYAPNAPYSDQQLSDVFKLFFKQFSRLSAKKDDPFYQQHVYLLKRLAEAKSTIIITDLPDLESLIVSIFTTFYNLAAKGFPVELETIITDILSEVLSEAEVVPHQILQLILQKFANHDPSKLLLNSGITSPEFNFSLAICENNIDRMSRLVAQYFSEILYDNTNHIEEE

SEQ ID NO: 15447 - protein, 192 aa, Candida albicans
ISQRVLSAMSSTKQDLPQARAPTLPSKTTPEQRYWRSYITPQLIKENHPITSIEFNPTTPNDFAIASATKIQVFSSKTRQVIKTFSRFKDVVYSGNYRYDGKLLVASDASGLVSIYDSYQPRNLLVSLTPSSHPTHVAKFHPTIGNQLITGSDDRMLRVYDISQTSNGPIIQFDNIDHEDYIRSVNVPHHGG

SEQ ID NO: 15448 - protein, 79 aa, Candida albicans
EDYIRSVNFIPGDSNLIVTGCYDGNVRILDVRDPHRVVAKFDQENPVEDILAVSSNTLVSAGGPYVKIWDLNRMSQFIN

SEQ ID NO: 15449 - protein, 184 aa, Candida albicans
  UNSURE (13): Identity of amino acid sequences at the above locations are unknown.
NESIHQLNRKEVXLINSTTCLSNTHTNGLMVGSLDSTIKVFDYTSTNWQVQFGWKFGSGVLSCGVSPINQKHFVAGLTSGLISIRTKKTEPKVKQGIKNDVSGGYARMMKGRDYTGEEEDHIIESSKIITNKTNKSVNELMLSYKKYLGASGSIDDIKPNDLKQEISQCLKAKEICGMLELLGV

SEQ ID NO: 15450 - protein, 419 aa, Candida albicans
FFLFFSFFKIPSSCYYFHINQLAFHPYFFGIPIYYLIMTFVPRKTFPNYNIPLNNFKGHHQKALSKFGHLAPQLDMILEVRDSRAPISTTNVLFDKVLPSKKKLILYSKKDLSILKPRLLEKWHKLKNEQYMFVDCRSKRDGKKIINEIKKLYDSMETPPPLGLRTMIIGMPNVGKSSLVNTLRYVGLSDGENAVSTKIRKVARTGGQPGVTRSTSEIIRLSRDPEIMVYDTPGVFLPTTKNAETMLSLALVGCINESFIDPVILADYLLYVLNLQDPTGKLYTDYIDHPTNNVYELLESIDQKRNVLQIDKRFDECGLANHWISKWKQGKSLKYRGLLDVAAIHEINAKDFGNLTNAERERIGLSNVQQRLQERFGDDGTSTSTHRKRTAKDREFDMKNRLSQLRLPTEPDRSQAYCV

SEQ ID NO: 15451 - protein, 290 aa, Candida albicans
  UNSURE (242): Identity of amino acid sequences at the above locations are unknown.
LGRVFFFQQSIKEVNYINQKVFSRKMIVRGKCLGRLVSKAVSLFSRPISVILAKSFATTTNLLQNSKDDSTEATIPWYMREENSSPVEVLNKIEVPELPENSPQSLQEFVTLLTAEYGLTDLEIFDLSQLPEDHPKSLEEQNEENYVILASGKSEKHIYKAAYELRLYIKHTYKHLPIIEGMSSNSISKVTRRRLAKRVRRGPPATASTFGIGANSWVSCGTGVDGIVIHLLSRERMESLNXEQLYSDEQENEESHSTPEIDQDRLFFGDRRRFHTSTRHFHFEYFKPYL

SEQ ID NO: 15452 - protein, 304 aa, Candida albicans
SNNLFPIFYHRFSTKANYPIMPVEELEDRVIITDPNDSTNRATILKFGATVVSWKNNNQEKLWLSEGAHLDGSKAVRGGIPLVFPVFGKQKDSNHPTFKLPQHGFARNSTWEFLGQTQESPITVQFGLGPENVDPETLKLWNYDFTLILTVSLTKDKLVTSIDVENTGKEAFEFNWLFHTYYRIHDITDTLVTNLIDQQCYDQLIGESYIEKAPVISFHEEFDRIYSKVSLEKSIQVVDKGQVLFNLHRKNLPDSVVWNPWTKKAEGMADFQPKSGFHQMVCVEPGHVNSMVSLPAGGKWSGGQ

SEQ ID NO: 15453 - protein, 663 aa, Candida albicans
ISNTTFFTRYHYQEQLIPLCFMRDSNYRAISSNKAAVTITASLYDRRALDVTSDKPLVNSLNFLTYLVSSLAKVRETLSLDGGIERLIEILHECHQTNSSNDLLFADQEKKLLAAWKWTLAFQSLVLIGTRGTEEIRQKVVKAGILPIIATVLDNYLSLHENTFHQASLRSTANTGNTTTTTTTTTSTTATPNIPTASVVDTTYYQTTPPDNPVENSVTTETTTPATENLFRHFQHPNQTQRPDAVGVRDGENTDRTILQEDYQNPIQIATAAIEATSISNVHPREANFNVDFNLTNDDYDDWTVEQLLKLIATNWMGNNETDRVNNTITSDIRRRYAIVTILNKLREEKQMETLHDEFINECDIDMDSNLQFLSDMYARDFEINKTCYNLKVFVRSFTDSGIVIPRDDDIVWSLQLLAYISKYPYLKDCLQNSHLVLDMSIRDKQLKLYLERQMKLKMKKMLAVRLRPTIVPKSRKQKSSYLETFHSSPSNSPQMVSDLNDDTFIMGNDKFGLCQTNDLTETAELGEEDDEEEVAEKGKNGEEVEYDDDYDDDEEPEACDDDSEDSISLKDLLDILIDQFEYLPKLYESMVECESILDDSEREVALFQIYNKMNKCIEVESRKLKDTIIGARLKTKRYLEKKWNYEEYKYLSSTTAARKTTL

SEQ ID NO: 15454 - protein, 193 aa, Candida albicans
STIGNHPNNPYRLIPPPINSNNILQMSSLDNDKTENFIQERLDSLHEIDCKVVTLLDQFSSIFQSFYTKSKEDFSQQTSDIYSTLSKVAIDLRKEIKIMDDNIGAYDKNDDNVMILPISNVDQKNTKLGRKRLDLELAELKRLISDEKQVETLENESNNEIQPKTESDTNQVETNENGNDINNKESEDIEMKE

SEQ ID NO: 15455 - protein, 557 aa, Candida albicans
NFYMNSRYLLRTHSRVLFRPRNTTTISATCANFISRRHVSQYNYNQTYAAYNQPKTPFWKKLVYATLGLGIISGYVYYMWWPKHTFPSSIAKFLRKGLWAESDRGEFDYQLALKYYLQALEHANEIGLDPLSDEYTGIQLKIGEMFERLNMLTDAAYIYNEIATLYLTVLTAPRDSPEGQRIKDRKHRRHLIQKDLRIAIKLVSLNPTNPSLAKAILITHLIIAQDEVNKLMGSSLSSSNKLNLVNKIDPNDKLSSTNTSNGAYTAVLDNDTIVITNNKTGEENRIKKTPEVWEPFTDEFFNAMDLLSAVCITSGDLAMATKVKIAMNESMLLADIEPSKMLLSQCNLGSLLYMQAEELEAQEISMTRKFSELSGIEYDQLLESHQKQMHLQHSETNPEDKTDSNSNPNSKLIMEKLRETVPILDQEAFATVTRSRSVCLQLAIKSYESVLQFAKSFPQDFVKQHNEINETVALATYGLGVINLHLSHYEKAERLLRESRVRAKSCDYGTLLPMIEKELEKLFNEKKSLTKDENDNSKLKKKKHSLHDIEMDITLNK

SEQ ID NO: 15456 - protein, 346 aa, Candida albicans
CFYTFNYSSIQFMLRNFLLSPRTFVRMSSTKSQLISQPFKMENTQMIRETARKFPRPNFISFDLFGTLYVPKKPVPQQYYEIAYHEFGINKSIQSIEEEFPIVYDEMLQSYPNYGKGHPKFDNCDSWWKELIIRLFQLDRHDDQALALCHRLIHHFTSEEAYSVYDDVVPTLQALQKQGVKLIVASNSDPRALTILESLKIKQYFHCSEHFHCSGVFLSYDSDYSKPTKAFFDEIALVEYRAHVDANYRSKNYPPGDFLSDCWHVGDSYNNDYIGAVRAGWNGVLLDRNHTSEFFKNVRKPQNDGCFLNENPETKRDGQTGNEMLILANNRVVITKLTQLLDIFKL

SEQ ID NO: 15457 - protein, 581 aa, Candida albicans
TTFDTQVLALKIMLTLPFINNGNKSNTGCSHLPGRLTALIVSILVALASGTPYLYGVYSPQFVKQVGLTTSDSATISLATNLGSGVGGLPGGLIIDHFGPQKSILLGSVCIFIGYFAMHKIYEAKYDNLLIICLAMVLAGFGSITSYFATLKASQSNFPKHRGAAGAFPVSAYGFAATIFSIISATYFKGNSGGLLEFLSIFCGSMTFLGSFFIHIYLDHHDDREMDPEMSSPEFVSSPSPNYYNIESASSRSPRIEEEISLLSEGNSVIEPPATTMSRQDSLQGSISFWGIGQRTPRESISLQESEANNIVESLRNENVPKQQQEEQLKDSNKLWLNLISVPEFLQKENGRIFAIHYYIVSLASGIGQMYIYSVGFIVTAQYYYGKNKIENLTTENHRFSRNDIHHDPNVDDTVQTLQALQVSVISIASFLGRLFSGFLSDYIYKKWHIQRLWIVPVTLVFLALGQYLTIQNVNDLHLVTLASALIGGSYGLIFGTYPAVIADRFGTRLFSTSWGLVCTGPLITLWILNKSFGKLYDANSDSDTGICYLGNGCYQGAFELSLVLCGMTSVVTLLLIYIQR

SEQ ID NO: 15458 - protein, 221 aa, Candida albicans
LYELPIMISRNVQRVFVLLSCTFLGLICGTLYLYSSYSPQLANQLHYSASDSSIIALCGTIGVAIAGPISGAVVDRKGYTVSLLIGGILIISSYIGLKRQFDYAWSNVQFSSFTIFLVGVGSTFINSACLKCCAVSFPSIRGVATSLPLALYGLSALFYSVIASVFYPGDTSNFLGFLVMSIIFIYLICFPSVYIADCEHKLKSASTFHKPSVTVNSTHHH

SEQ ID NO: 15459 - protein, 297 aa, Candida albicans
TLSTIMFARLVPRLQPQLLSKRVLTARYPMLTTTPIYHQTPMQIIKRNYVIVHRERKKEPVIRYLFYMLVASWVAIYFVANRVDKKKPPQQSFTEREFQLYEEETGLKRRNKLISHTMNSKYKFYVIPYVHDEEELKKVANFLQHKDENATVKIIDPAQLIEEQRKDEGMKYHYLLEDLDEQGRPYLPGLITAVIKQEIYKILNNREGTFDTNFIIKNYPQTTNEAIKFENDISDIQKCLILHYDMLNELPKNKTDEEQRAIKNVDGYFDSVGKSKTLVEKFDPMDKEFEEIMLEDI

SEQ ID NO: 15460 - protein, 60 aa, Candida albicans
TKIYTYIFIMSLVLLSKFCAHVKNCLNVTLSKTSVPYNRSNLQVAMALYQQVLSVLFQKE

SEQ ID NO: 15461 - protein, 123 aa, Candida albicans
  UNSURE (35),(37): Identity of amino acid sequences at the above locations are unknown.
LASSHGIISTSFISSIPKRITWGPNLKPTEVTPDXIXSRRLWIDLKYRNNQSVIRQLELISKPSKKIDLTTEEIKALASGLKVRNIPALQPAGCIFIKHDKDILEVQEAAKKGISGQALFRVR

SEQ ID NO: 15462 - protein, 535 aa, Candida albicans
TNKQTGIYSLYSNMFLSVLFMAPFTRAHPTIFTQYNGGLDDQQPVIKPPFRHSNGQETSDDDLVTFLIISSITFASLVVVILLSLVIFWVVKRSRQLSQDELDREEENQAYLELNSDEQELYFQSKEFLTNSPYLVGDLTLSQELSIQEKGITAFEFQKDVVLTNNDLMILNKYELNFFQNFECSTQTNLPIPMKNEVYYFESKIYSLPNPDETIISIGLSIKPYPWFRLPGRHPHSICYDSNGYRRHNQPFPFTNDPPFPKLVEGDVIGVGYRTRSGTVFFTRNGKKISESKLGGHVKNFKISNKGQLFPTIGANNVCSVHVNLGQMGFVFIEGNVKHWGYAPLEGNGPAPPVYNKYNSDILLERSEIDDDDLSERENDFPPDFWAINGSENEAARTVSPHALDQDKFSYNAYSEVNSNDERITLASLVPPVKPPSYNEELEEGNSSSTINPMLPEEQKQTEEDKKSNDRHSSEGVADAEDNQNIDAEVVENDEVINDATQAEPFDITAENSNTVEADSININQTADVDNDTPE

SEQ ID NO: 15463 - protein, 407 aa, Candida albicans
  UNSURE (396): Identity of amino acid sequences at the above locations are unknown.
HCLLATLFLSKNEVPCFSLTPEQTKDPIAFIESVMDVGKEYGAVKVKLPQDDVELFQTTNQINSDLFWFQTNKLLNNPPEDEVYMRLKFHHDLLEFLQSEDLVKYEDQENKRGSNASASSASQQTNKMPMIDKRPLDLYKLFQSVMIRGGFVEVINKKLWAQIGRELGYKGKIMTSLSSSLKSSYQKILYPYELYLREKQSILEAKEEELKHVQVKKENKIDFLVNHDDSNEDSQKNLNGKRGLDEDFSTNKRIKTEGYTAPLIIGSAKDFRRSVKSKLRKGYLLNSPLSIDVKQPNVFTIKQDEKKRRRQNEKVDISILPQTQLDSAIRYIANSQDDSRVKAAPKIASIYTLRQFMEKDIKFQEFLVQNNLIQFNNVNVTDRNLISPPMSREIIXSATGPGRIRDW

SEQ ID NO: 15464 - protein, 312 aa, Candida albicans
FPFRVMVTLETRGAISWGVLLYYVGVFPLDGRHYYKFLRVVLPTHLYEIASHIQMGHDHSHGHGHGPVSVQPDTHSHSHGQIDPSNITTHREIPNINAAWLAGGSIIAKELLYRKTMQIAVQTNSKVLVANAWHHRVDSLTAVVALFTVAGGVLFNVAWLDSIGGIGVSILIIKAGWDSLKEAWNELIDRGEKPGSELYNKIEGIINNELQMNNELKQFKLNQLSVLSSGANTNIHMNLSTTNKNLNLQTLNQYEKRLSDLIRQDDRFVRNIFVKFDQVEEEPEKVEAKKEEDDDDDEKEVNGSNDVHSHKH

SEQ ID NO: 15465 - protein, 202 aa, Candida albicans
EYICFSVNYMGVSRRYLYHTLSRMTQLTATTIKNKPIRNAGCLIIGDEILNGKILDTNSYNFARFCFNNLSIPLKRTIVCGDDEQDIINSLNILLKQDKLDLIITSGGLGSTHDDITYKVISDYFQLDYQLDQEVVDRMKSIRGDYLDKLNPEQLNAFYRMATLPVSPQPSSLAQNSTTTTPATTVEKYFIDVFTTGVEGPH

SEQ ID NO: 15466 - protein, 121 aa, Candida albicans
  UNSURE (2),(4),(11): Identity of amino acid sequences at the above locations are unknown.
PXSXIITGLSXGHQLMNDMEPMLKPRVISSDLIRRYVVTKSGETQLAPYLTNLQEKCDKKYGKGVLKLGSYPHMNLHINTISIIGQKLTSQDLDWIVKALIENIGGDAKEITQAQEDEYSK

SEQ ID NO: 15467 - protein, 899 aa, Candida albicans
VWDLEYDQLTIDVLYQRLFNDTQEFDFFTKRYEVIEQLLDYLIDIQKLSMNWIQNDDKNLIAISLHDLKTFSKLLNVIIIHGVYPPLNILRIGIQFEKRQLKNFSNNKNLIKIDKLPQTDFAYIEKLLTLIYTKLLRVLLIKSDVASLLLKGTGYTDFLVVAITLIVIPQFNSSDIDFAKIESIASTFELYQTYSLLLTTPSPAIFKKFVMSHLGSLHYSRPNGILTLIEFVLGLRDQEEINIEKFDNVANVVLHKPANVDTKSYFMSVGNQMYDLLININRPNVTSCVAYVLEKLWQRNKLVVTDFVLQRIWNNFNPPPKDEGILVTEAQLNNNINVILSLTKKGLEPDLYQAVIQPVLLPLWGYYTFLKQNGKEGGVALNILTSYFTLMKGIDDLGLPTIAKNLLYKHGENWKYEFGDNNLTQIVTEKPEFVSQSKESKINKFLNDLDFACELFVKVLEELDDSLIQQLFVKILNNWLNNDTQILGGEERDPFLMLLDLRLLEKIGEKFRENLATNPIDMLELVQSFLSSYKPNSKENEHSAEDSDDEMDDDELEFNLDQTITVLLQLLSAIISENDIILDNKGSELLSSIKKILSTNSQFQASSLKGSADALCTRIESLLSNNNEILPANESEAQKQILQRAITNLNDPLVPIRAHGLYLLRQLIEMKSSVITLDFAINLHLVQLKDPEPFIYLNVIKGLETLIEWNEPLVLDSLCKLYLQDDVELDEKLRIGEVILRYIQRAGQTFTGNSAKLIVETTLAVIRRAGNNRKDDRLRMSSMSLLGTCCKVNPLGMIDNLNYALDASIGILELETDKDQAIMRRAAIMLIYDLILGTSETDKVEFPQQYKSKVITVLRYVAETDNDLLVREQAQKVFATVEELIELAMELYKEENQVQ

SEQ ID NO: 15468 - protein, 778 aa, Candida albicans
YLTMTMDGSTPEEKRLKDIKFRQWGSYIGERQWATVREDYSDDGDAWSALTFDDSRSRAYRWGEDGLAGVSDRKQFVNVTMALWNGKDPILKEKLFGVTNSQGNHGEDVKEQYYYLDNTPTHSYMKYLYKYPQNEYPYKQLVEENQKRSRLEKEFEITDTDIFKNNEYFDVVMESAKGDAPDELYFRITAYNRSDKAASLHILPHCTLRNIWSWGADEYQEVKKPHVKQIDEYTVEVETQKFGKRYLVFAPSPGFKESDPDVEPQLIFTENETNTKKLYNQDDKSKYVKDAFHGYVVDGKQEVVNPEKQGTKAAAWFTFKDIPAGEYVTIRYKFTNDKSEVDEFELDNIISKRQAEADEFYWHVTPYPISDELRLIHRQGFAGLLWTKQFYYFVHNYWANGDPDTIKPPMNRANGRNKEWKHLYTDEILSLPDKWEYPFFAAWDSAFHCIPFAMIDPRFAWMQLDHLVREWYMHPNGQIPAYEWNFSDVNPPVHAWAAYRVFKIERKMYGVESLDYLESIFQKLLINFTWWVNRKDAEGKNVFEGGFLGLDNIGVFNRSEELPTGGSLEQADSTGWMAFYSLQMLNIALELAKTIPVYENIASKFFEHFIIIADAMTFRGGDGDESTKDALWDDKDKFYYDAIRYSDHHVESLHVRSLVGLIPLYASLTIEPDLLNRYPSFTKRLNWFLVHQKKMSERNIASMETIGVGERMLLSLVSKDRLLAILDRMLNEDEFLSEYGIRSLSKYHKDHPYVKEVNGRKIHRCLFVRRIRFRNVWW

SEQ ID NO: 15469 - protein, 320 aa, Candida albicans
MKMNSYLNMVLDLYQSIIRTILMLRKSTEEKFTVAYLSGESDSGMFGGNSNWRGPIWFPTNFLLVEALQRFYLYYGPDLKVECPKGSGDYLNLAQCAQEIQHRLIRIFLPDEESDRACNGGVDILNRDPLFKDYVPFYEYFDGDSGRGLGASHQTGWTSLVTKWIHDNAASNRVPRTPQTPKNRRRQSVFLHASEEANDDDEEELQKYVPKCGPMPGTLARRKSGKSLLNLTVNALDLGDEEGSATTKAAVCGQVGEGKSISEEELEKLHKVQSGASIDSNEAAQLDSDLLGQVRAAFKKFKSRTDEDEFEGDEFETRCS

SEQ ID NO: 15470 - protein, 210 aa, Candida albicans
  UNSURE (2): Identity of amino acid sequences at the above locations are unknown.
HXLLFFCHVYWLGILLIRVMYTNLIPSILYIALTIASSELLNSIQGTWQSQSERVITGPTFFDPQKELLEEPKLPGISYSFKNGYWELAQYIVMGNNRNHQCPQAMLIWQHGKYNLKRGKLVLIPNRNDGRQLISDPCLDNGKSEYKRFHNGETLEVDIRFDGYFGNWKLVLVDYLTGKKKQPMWLTLRNATMLPTGTITSTKRKYVKKE

SEQ ID NO: 15471 - protein, 339 aa, Candida albicans
  UNSURE (79),(83): Identity of amino acid sequences at the above locations are unknown.
TKPNATSQKFIGYTQGKIKRHKQSTRNKSRHFNRRNEYLQKSPESSILADDDFTDHQEQQQTTDRDNSTNLNMTTVTTXTPPXPRPRPPPQHAQEANVYKSPRKEAIMRYKQNHDNTFNQLFDIKENLKSKENDDKQSQLQQATGGNQVNSNHNNGNHNISLDLDEKVTLFKYKSLKILELVNQNNANGSLLAHGIFEIFQLHQGDVTYLSCGNNFIYPLLPKIKVFRINSNQFLLPLVNPERYWKIFINSEELNVINNLINVFQRNVQFISLHESENKNAPEPKLQFEFTDSINTKPKELESPPRNIYISNEIPDSPPSAPISPGHIQTTFHLSPQGR

SEQ ID NO: 15472 - protein, 207 aa, Candida albicans
PTHLLNGILVLCIRLNIPGLMNAFVDVNYTKSDKNYTLYRYVHTCSDFYSTESQLRTFEFKPLGEIPETLHIHNQDFRHFKIPNRDSYKNIVVVTAFFIDTAENLLDYLDVIKNLTLPSGNIERGYWINVGPLKYGTAAQVELNADELKDLRKNLGWKDYNSVYTIYDKLSAGDKTGLVGYLTDKESMWQGYYGLNMFASGREENKF

SEQ ID NO: 15473 - protein, 571 aa, Candida albicans
DYQLYRNGLICNNTVTHLYNTQESLISYTPSSKPNHDLQVFLTRFKSTSVSYSPRALIYDLRNGLGALNKYEYHETLPVDLNFSLLSTNTTAPAGAETGAGSSLESGYNLKKSRVEKNEYQQKLDQGVTDGSSLNVNNTKYWTDYNKLIYNPKSLTTVNNFVHNENNHESGYHYNFNSLKYDSFNIGQEEFKACNNGNGGYGYDDNDNNKSIENFRYFLEKTDRLQGLQLLTNLNDAWGGFTSEMLIDLIDEFFNNTSSDKQNLWIYGIMNSTKLSEKTQSIRTKLSFIKTLIELTKQLSLIFPMNLNNSKDESWHNNYSMLTDKYNSGSNWHQSSLYATFINSIWGLNNQLKNQISMTHLQNDIVKLNPNQKIINQIKIKQEKSGNGDKQNQLFGSDLNQFNLKDIVNLKDLSNLGKSSDTSATQREINLGISKNASTNTGNDAYHNFVQNRISSSTSQNEKMMKDKEQEQNGIINNYLNPYIDNIFQVETFPVDILKSSSNAINISTEFNVNDGLKSYLKPYIKLVSNIRNQHREYLDIIEYKEQLLEDLNNISQEYSYGYESDDEDYE

SEQ ID NO: 15474 - protein, 395 aa, Candida albicans
  UNSURE (376): Identity of amino acid sequences at the above locations are unknown.
FLYLHVEGAGKRLSRAHLQKSHSKIAQQIDDDFTNDSLTLTDITEKAFSSMKSFFNTNAASLISEVTRAVVQHNILNGTDLEWGVSFLELCITWIPVQLRFVSLSTLLATLGRINIEGNTKSNYNMQFQYARYLLGLLSSRVNMIGLSVSDIIQQLLSLQADLILKASDLDKSEISILTDIYSDCICSLTTHIYYFDQVPDSIQEILIKIDYILESSFVEDNNITSTGEQIQDLIIQLLDNISKIFLILKNKSSSINRNHVNLEHWDISLGLLAPQGDHDDNRKMIISTPQLINIQAKYLKVFDEFLNNELAVGNSKKSYDLLSKQSRLDPGSTAVEGVNKSDDLDNGKDFKKPDANQYITNQQNFISHFLMYIDXFFENYDSPNTQSVLLLGTV

SEQ ID NO: 15475 - protein, 86 aa, Candida albicans
FLQLPDPRMNLFQHKHQKLILQCYPAGKAVEQKPTSSELSKLIIPCLPSVSSIRKSDNFLKDQTLPEVCTNLLVISNSLSPYPGFF

SEQ ID NO: 15476 - protein, 1060 aa, Candida albicans
QHSIEMANPVKIGYYDPFGIYPLIKDELNKISPILSLHIRFHPSQPLKTIHDLSLEFTEEIPKKSESSTLENYNVYTRLMLIKIESLDKYRSQVRPLIKEWLKNLVFNEKVNGSSPSWMILLYVPSDAKDKQSTIIKMSHYDKLLKDFSNEGGKELAALFAESTSPTASVGAQNSKSTGYCFKFKQHEFELNEFLVQIKNLLGFTFNQKYHLNLDLITTSGDHENNSLTKYVATYNLAELFYDMKLFNDCINFFNRLSEQLNTLVENNPNLFIYKVDLPAKVFSNKFDFKKFYNNKCQHMHDVNSFTNVNLFELKCFIFFRQASTLEMLVNKNLNNSISLAELQISKLLRNLVLFLNDLLQVFQNEQALIEFEYSIIEYFLNLDIVNKLIEQATKLYEAEPANNNNSYQLKRLFESRGELKLLQRSSLIKLARENSIEIKGLDQVFEDVSLDEEEGPKQSKDSTEQVKLDLKHPKLLQAIQSKDSFVDEFTKLTEGILEDFMGCDRSKTIDVLSIDLAILNYEKGDYSECLQILHDSYDFFIQNGWNYLGGILLEIYYGCMEKTQSTNFEEILSTCLKLLSCLVANHTDINSFRLINNKLQIKKLFDRIEVYANKLDPTKKFERSLNQFFKTDILPYISADESTSRDKYLIRLKLKNPFSLGFVFKHVELIMVDEEGSEIVFHAENVEISDKIDNTIQLSTNNFILGSFSPYRLTIQFYNSLFLVLDYGEKELQMNHASFLSDTVIEHNGNNNDVFVYDGLTPMSVFKPRHEKTLLAYQNINKLTAQFCCANDLKLGSTEVVLKIKNGSNPIHDVRINLFSTTEGLTVVDPDLKVSKLDSHESQTFLIPYNFVRSVNKIINMRAKIEYKVDNEEQYSFQVSYNIDTALTISVTVQDIFKRDFIYSKFQVGTSNPKYPIRIINNDLTTESNYEIIKPSKFPSYDIIAFGEQPSNFFYKIKPKSNKVYLNDTLSLKVDYTNLQEECEEYVSQEIIHQLERIKLVKYWYLIKDVIVSKLTFDLNGFAVYKTIRFLNGLELNLLAERIILRHVKALSSARPSKQ

SEQ ID NO: 15477 - protein, 242 aa, Candida albicans
PRGEDEEADSKLIHSSGGVFGVLHGYSITEQLNSGWFILMTLFTTIQMLRINYFVATIKSQELYLYHGNESLATTINHFFDLALPLGGIFSIPFIGLILDNLTTLTALYILTGLSLFIGVAGLVSWLPATYAGIIVLVVYRPFYYTAVSDFCAKVFGYDNFGTVYGTIIAFSGVCNILQQVMDKATHEFFNMNPGPINTLLVVLTAVFGFALIIFVKSKEAHIKRKNLEMEAQDASNRPVPV

SEQ ID NO: 15478 - protein, 353 aa, Candida albicans
  UNSURE (278),(299),(311),(318),(329): Identity of amino acid sequences at the above locations are unknown.
LKLFFFHLFFSRNFKSSQLIMLPSEVSYSKRLIQCTCAIFWCLLSGGPIFGFAALKPILIKEHVYEYLCDVHTPIFTSFNSNNDNNDIIAKCTEQDLKLNMMFTVAAMLTNVSALAIGRILDVYGPKVCGLIGAFFLYLACFVFIYSKYLAGSIIDPYLLGYSFLALGGPFAFISSFQLSNSFPKSSGTILALITGAFDASSAVFLLYRIGYNASLGSFTLEKYFTLYLSVPTFIAVVQIFIMNSDSDQTEGTSKLCVNDEENHGHVASPVSSNDQEXTPLLSEPATRTRRESMGVCIXHPYEIEGKKFWXKHQLECXVVCTDTRHKDXSKNGWFGVDNMAQYYNECGEIKLF

SEQ ID NO: 15479 - protein, 179 aa, Candida albicans
  UNSURE (10),(11),(12),(15): Identity of amino acid sequences at the above locations are unknown.
YYASAREEHXXXTPXALSLKFASHIEKIQIFDGYLIGYTLLALAGPFVFISCFQLANCFPQNLGLILALLTGAFDSSSALFLFYRLYYTNVSPISIDKFFTLYSIVPISIFLCQMFIMPKDSYKTVGTLANIAETGIDETGKPLHSNLLTPEDQQQQQLQQRDNSATAAIVDVTEYYQP

SEQ ID NO: 15480 - protein, 168 aa, Candida albicans
KQINEVILQRYHDLVERRENDEKRKQEIDRKEMERQDALLAAKLLREEMGRFGKRTIRKATQTASKIKSSKSKSNTKRLAPNNAFNREMALSPELTNVIGVDKCSRPQVVKLLWAYIKDHNLQNPQDKRQIECDEKLQKLFKKSMLHYNVIHIYITRSIVDKNFTNQK

SEQ ID NO: 15481 - protein, 502 aa, Candida albicans
FFAFVVLLYFIFKFYFYIFFLLYSTAVDFPTSQHRDYQLQTKNLDNTLYSPMVSLQQLTISILLLFTASVQSLDINVDDKDSICSAAKYVVQGIWNYYEGLKYGGTVGMFAPPNYWWNAGEAFGGLVDFYTYCQSDNSTLEKLIYNGMYHQAGENYNYIPSNQSMTEGNDDQGVWGMAIMEAVERNFTEPESHSWLEMVQAVFNTMNARWDADNCGGGLRWQIFTWNSGYDYKNSISNGCLFHLAARLARYTGNSSVYVDTAEKVWKWMEDVGFLTEEDNGDVRIYDGAKITNNCSSVTDLRWSYTYGVFMAGCAYLYNFTGDDVWLTRTNEIVQASLSYFFANKIMQETTCQPQNKCNNDQRSFRCLFSRCLGLTTQLAPETKDRIREVLEASAEGAAKSCSGGSDGVTCGENWAIDKWDGVYGLGEQTSALEVMMALIVEPPLSVKTGGTNRTDYSAGTNSEDNANKNELTITGKDKAGAGVLTAIVLAVILGGAIWMIF

SEQ ID NO: 15482 - protein, 302 aa, Candida albicans
NMSKQIEKKPISFANIALGAGLNLAEVTTLGQPLEVIKTTMAANRSLTMPQAAKFVWSRGGILGFYQGLIPWAWIEASTKGAVLLFVSAEAEYQFKKLGMNNFVSGMGGGITGGLAQAYLTMGFCTCMKTVEITRSKQANTPGVPQQTSFQVFKEIYRKEGIRGINKGVNAVAIRQMTNWGSRFGFSRLAEESIRSLTGKSESQKLLAWEKIASSVIGGGLSAWNQPIEVIRVEMQSKTNDPNRPKNLSVAGAFKYIYQQNGIKGLYRGVTPRIGLGVWQTVFMVAFGDIFKRMLNTDGAGH

SEQ ID NO: 15483 - protein, 484 aa, Candida albicans
YDNEFIDLRVLISRFLGFIIQNQTNIPDNYYELANKVLENNFEIIQLEPNRLDLNYYTLKFYILVMDKRVSKFDEELIDIFINFNATCRNQATILVEQTIARVLRESPIEMKIVQSKKDSIFKLFTDSKSISVQRICTWYLRQIILLEQQDFVVEYQLSKNDEEMQARIPEELIKIVNHTLGHQEYEVFQYMWSWILILSYMEDITLKMKNEYIGQLLQNKELPILFDFVFEYLHIEDESLYIIDSGKPQDIENNVIPNYDLIETGKSESSTHELKLLATYLYFKCAQLCGSQVQLWFQEIRDKQFKNIVEKFTVKFISPILVKDIKQNVGKEIGKLQQNEVNIKIGTNQIKANIPVEEENISMRWSIPANYPLSNVAVEGPLCVGVKDNQWKAWLLASQKIISLTNGSIAKSIELFCKNVNLHFSGFEDCAICYSILHQDSSLPSKTCTTCSNKFHAACLYKWFKSSGSSTCPLCRSTFNFRR

SEQ ID NO: 15484 - protein, 123 aa, Candida albicans
MLIHSKESGRRKNLQKKKWNEKKNSLCLTITLIFFLVYNTMAKQYEITGDLGYNGFPVSLNYITHLPDISTLYNPEVVVIFKSLMKRDPKTKEKALNDLLTVSAIDDSTIIAWLPNVSKTCLG

SEQ ID NO: 15485 - protein, 362 aa, Candida albicans
  UNSURE (281): Identity of amino acid sequences at the above locations are unknown.
QYQLLTTPQLLHGFQMYPKLALDNSRSVRLLSHQIQANFLKIVGGKTYSKYLKSSMPIWLMGMFDTDKSVSSIAYKTLLQSFQGDSSKLNKTWSIFEEQIINLIGTIVSIETLETLSDRRYTSESEMVSKYDRALVCGINMLSKLPDETIVPILEEESLWDHLSTCLKEDNMDLVLFKNLLLLITNLSDENLQLVYKLVSKKFIKIKFKSNKISGSIIYSNVIIPFWQAIVRLTEFGINNNLKKNFWDLAGSKSSTRFYEYLKLGPCNLDPTYYSLIIKVXQDLQQKLDVVDFNSQEEYDYVINLLLKQYSTTMGSLQAGALNGALKNPDLFTVESTVLIDELILPVLRNLVTIKGSPLIKC

SEQ ID NO: 15486 - protein, 398 aa, Candida albicans
  UNSURE (377): Identity of amino acid sequences at the above locations are unknown.
LWRGWLCLGPLRNINWELIGNIKQIHVLGDYSVFSDSIIEELQNLADLLGDLDTFYIGDNKFRQLIDLTRLKLRSVVVEEIPIEATPKIEELLIGGNTHLPNFHKFNLTSLILPNNTQKYWSWIMENVFTLKNHVLQLTKFKFVFSLDMALNAKLVRLIDWEKITQLELILAYTPRNDDDYVIDCFNLIPPTPNLKKLSIVQGDTYPTHRENELFDLNVFNFLTNLLTICDLKYLSIKHSIPNIGNLEDGSEGNYYRRWEMFMLTLPKIINSHNIVLILPNLFQSFAGYEQYMNTVLFNGCKCKHCQIYLGDLDEFMMYHKYYDASTNAKRYKDMNALHLLSEVGQQLNYRMVQDELLTQLNHLSFPLVNTLWDFHXNTNNKPFKCYDIQTVDQGRVR

SEQ ID NO: 15487 - protein, 855 aa, Candida albicans
SPPMLLVPTELKSVKKSLIETKPPIENDVQQSLRYLLSHLNLKEENDKDRVLFNDALSICLLRYDQFNNTLESSNTLFDYILTHVNRNYAPLQNSLNSVLEKLVMFQNADIPLWIDMLMQQPLTKNLFVLLEKLLRKLPDRLFFILKYPDYPMQAMSMFTDNVANAISKTLIAIYENCENTESWYKSWSSIIDLQNDNVRTNVITHLLPGLLRVNPQAFPFLLADCKTNLKALVSILSMGQKLKLIKSLEVIDQKSLLECLVHADSAIRMDALQVLIGDKKEPLTKYIFQTIESNHLMEINLNEANHQDKFISAMHQFISGKLSDCLNGKFGETVQTETRQYFTRFKTLLVSHLETQNNFQQKMGAITILSQIHSKLENIFNPNVVKLLIENLFSNYKLVRESSLDLLLQCNNVSEYFSNHKALASKAFAILPRLAGRESEGAALAITFLAHHAQDLDSLMERLYSGLGKESGEHGYLQALATINNKLGICGDYRLQLEAAKQATKRMTDILSTERIAYSNEQEFVTSKEVVNYSWKVLQNANDLFLLLLKQRREADDVVECFSLVVEQLHNIKFRAAISSLYPTMIAIARLLDGKVTEYIKQEIQYIPTESKQLVTRRSGGLLYVIPALLIASERNKEVVDYVFDSLFQIASLPYESESKQDLPQVHAFNTLGQLFKESQLTSDSSPFTERALLLSLKHFNATNWSVRNCALMLFGHLEKKIFSGAKVNSKRFFARFKNIEDVFIDYLLCGQDQVVFPILIMLEKLEFANTSSKLKKAVTNLLSRASWKVRELSAKITAAMLEADEFREFVTTSLNTNTSMNALHGVVLVLKHRPITIHMDLGVWKLFRCQRVY

SEQ ID NO: 15488 - protein, 77 aa, Candida albicans
REFCQILYNVEPKIVDNKHAYDAPAISAKCPGVWFPADPMGLSEIEIEQLSPIVDISTKNATFNEKGKIVFLGKPPN

SEQ ID NO: 15489 - protein, 741 aa, Candida albicans
NKLNQKMAVAPSSVSTSTIISTLLANLALFGVFVGCFIVLRLKFKRIYSPKSSFDLVPEEKKPEPLPKDPFRWIFILLTKPDSFFLQQAGLDGLVFLRYIKTFGTLFLCALLMYIILLPVNATNVIHNKGFDQLSIANVKHPRRYYAHVLMGLVFNGIVIFVIYRELFFYNSLKNAVLSSPKYAKKLSCRTVLFQGVPDSLLDEKQAFKIFNGVKRVYVARTARELEYKVEKRAAMVTKLENAENKLMKMAVKSKLKADKKGIILEPVDEISSYVSEKKRPKMKVGGFFSSKVDTIRHCQEQIPILDKEVKKLQKKFRHSMPLNSIFVEFENQYYAQLAYQSTVHHNPMRMSPRFIGLEPKDIIHSNLRMFWWERITRRFLAFAAIVALVVFWAIPVAAVGTISNITFLTNKLPWLRWILKMPHALLGLVTGLLPTILLSLLMFLLPIIIRVFARISGEISAVGVEKWTQNAYFAFLMVNGFLVTALASSATATITEIIDKPTSAMSILANKLPLSSNFYISYLVLQGFSIAGGSLFQVVGLFLYYILGTLFDNTVRKKWNRFSGLGTVAWGTVFPIFTQLASITLAYSIISPLILVFAFASFFLVYVAYAHNITYCFVEGPDAFGSHYPRALFQTFCGIYLGEIVLLGIVVVGKGWGPIVIQVIVLLATIFAHVHLNLSFDHLLDVVPLDARRPFDGFSSTTSYTGTSEYESKVLNKKKRRANFEKELLKAQGEDSKLKG

SEQ ID NO: 15490 - protein, 197 aa, Candida albicans
  UNSURE (194): Identity of amino acid sequences at the above locations are unknown.
WKVFSGNGKDNNKDQMVCKRHLSNTQHRASSEKKIWIRTQTHLDQFIDKTITTSLNIMNASIYLQSFGWKEGEALKKGGLKKPILVKHKKDTKGLGHDTNDSDMWWEKLFDGQLKNLEVNNNNKNGGVSFETNEEKVVDAFQKSISPLYKMFVKGEGLAGTVGKTDHTKESHREISSSKALEDMEKLTNKDTFXGKH

SEQ ID NO: 15491 - protein, 234 aa, Candida albicans
  UNSURE (3): Identity of amino acid sequences at the above locations are unknown.
ELXWISADIVICGRHFGLKVFNEVYPEVTHVVCRDVSEGAGPTFKTRVARKLYPDTIKIVNPDWLFACLSNWTKVDEKDYLISTDDTKLWTVKENEITKYQKALEDRSALANATHIDSIESFDEYDLDEANQEVDDFLAGLSDDDEEEEEEEEDEEIENPESNNDDEEIYEQSTNGHDSFIKDAYSKKRNRDEEEVQLVKKQKIENGENGENENENDLDDLEKELLDGFDDLEE

SEQ ID NO: 15492 - protein, 367 aa, Candida albicans
GDHMSDLTPIKLPSSAPFPVVISSVLCKPGDTISKHKTIFKYKYWDYQDDPTSKEDPPKKIRVERLGTFESPIEGEIDQINIKPLQEVMHSDVDLLFVKEACPHTVQYSGLCALCGKSLEEEKDYSGYNYEDRATIEMSHDNTGLKISFDEAAKIEHNTTDRLIDERKLILVVDLDQTVIHATVDPTVGEWQLDPANPNYAAVKDVKTFCLEEEAIVPPGWTGPKLAPTKCTYYVKLRPGLLEFLEKMAEKYEMHIYTMATRNYALSIAKIIDPDGKYFGDRILSRDESGSLTHKNLKRLFPVDQSMVVIIDDRGDVWQWESNLIKVVPYDFFVGIGDINSSFLPKKNGQLTGPTKKIFTTARKIRM

SEQ ID NO: 15493 - protein, 319 aa, Candida albicans
REYIIVSWVFCISKVVINPKHRMPTSLNSELVREIHRDYIAKNFPSGHNNTINPQDLEILSTIRYDPNLSSVSPLTYDDITPQNFFLLPEHTSRLQFSMNFFHLLFGTTLDFEITESFLYKQLVQAMRKLKKSVLCSYKVRGLFKLDGSVTFELYEVPGRHNLLSGIFPDLGTFPEELEFLSHPDDEDGEDVNWKVYISDSPTLISPFTSFKTTKREVYNEARKLLPGTNPGQEEVVLFNTQNNVMEGSITNIAVKRESDGKWVTPLLSSGCLCGVTRHFLLRKNFIEEDNVTLEQLKPGTKVLLMNAIMGVFGGTIVG

SEQ ID NO: 15494 - protein, 131 aa, Candida albicans
SQNFHDLKDIFGQPINQTDMSNPTRSRNERPLDTIRGFEYAITGDVSFRDQLETNRLGWGFHEDFPYYNLNGQNNNNNNNAQEGVGNSFSRPVINFDEQPVYQAGNYSASSLQADQNNTKKKKRGLFGRKK

SEQ ID NO: 15495 - protein, 113 aa, Candida albicans
LVSLFIYLFIFTYSFSSPTHISHTSSSSFPVLLLCPPAPLDMAIFRSKSSANKKPQSANDIDIKISSHDAEHYKMHTANVHDPILSAVQEAQQFEQAIKRVDDDNPSGGRPSY

SEQ ID NO: 15496 - protein, 409 aa, Candida albicans
NQSYILSVFPYNPLEVTLFVLFYINIIPNLIMLFKSFVTFTVLANALAAPLAHQHHQHKEEKRAVHVVTTTNVVVVTIGNGDQTTTFAAPSVAAESSVSVSVNTEPPQNHPTTTQDVASASTYPSSTDGSAASSSAAASSSSQAGSEPSGGVGSGGAKGITYSPYSDNGGCKSESQIASEIAQLSGFDVIRLYGVDCSQVEAVLKAKTSSQKIFAGIFDVSSITSGIESLAEAVKSCGSWDDIYTVSIGNELVNAGSATPSQIKAYVEEGRKALKAAGYTGPVVSVDTFIAVINNPDLCDYSDYMAVNAHAFFDGHVVAENSGAWVLQQIQRVWTACGGKKNVLITETGWPSRGDSNGVAVPSKSNQQAAISSIKSSCGASALLFTAFNDLWKADGPYNAEKYWGIYSN

SEQ ID NO: 15497 - protein, 375 aa, Candida albicans
LISTMAKRKATESEPLPTKKPTKSVSETTISICIPSTVISLKNAYNLQQITNIIYQIAKACTIYKVAEIIVFDVPQSNNDKEDDKLTVVVGSKVKFVEDEPEKTLANPSKKSNVNGDKVSPSLLVASLLQFFITPPYFVKTMFSSHLNSKFKNILPKFTYAFKLPKITTLPFMQNNQVYKDFKEGMIIPRETPLMKKKNKKTKSDHKITVSKYVNIGEKEALKLNIKREIPIYSRVTVDLKNKTVVSPLQAYGVVGHKAAFGYHVRMASEFNKIFTQSPISDGYSSTIYVNCDDYFGNNNKISELDNLLTFKEATGNVLMVLGNYKDLQAGFKADTSNVFENIDSVAHLFDSKLNIPDGGRIEDAILISLAKVIE

SEQ ID NO: 15498 - protein, 377 aa, Candida albicans
YNNFKYHQSLYNQNMSQPINLAIVGTGIFATDNHLPTIQKIPGLKPYAAYNRTKSKAETFAQKANIALDKVYDSLEEIFEDKDVEFVDALLPVQFNVDAVKLAVKNNKPICFEKPIAANLDQAKEIVKLSESTDLPILVLENWAYLKAIDILKNEILPKIGDVVAFTYNATGPFNDANKYLATGWRLKPEHIGGFLSDGGVHQLALLTEVLGDVESVSGLTQQLKEQSGTDDVLFSTLKTAKGAIGTFTYGSAFGATDKSTFFKIFGTNGSATYDWSPSLPKPQITYATGATSGQASSKTTIEIDEVNTIEEEFKNFKDAGLHHGAGRIPASRPIPRPRNPTDHQRPPTPNAETTRRTPGTHGHSATRSSATPRKRG

SEQ ID NO: 15499 - protein, 381 aa, Candida albicans
LFALLIESPITNPYDMSQVFTSSTIPLTFESREHKEHHSIRNKPPLSPPESTDNETLQQPIWQCMLAGGFGGVVGDSAMHSLDTVKTRQQGFPYKVKYKHMIPAYSTILKEEGFFRGLYGGYTPAALGSFPSTAAFFGTYEYSKRVMINQWHVNETLAYFIAGILGDLASSIFYVPSEVLKTRLQLQGKYNNPYTKECGYNYRGLGNAIVTIAKTEGPKTFVFGYKETLFRDLPFSALQFSFYETFRQWAIYSNNGSDDLSISMELLTGAAAGGLAGTLTTPLDVIKTRIQTATNTSELSSSISTKQTITNPIIRLLNRNATLKALVSIYKHEGILGAFSGVGPRFIWTGIQSSIMLLLYQVALKQLDVLSDDKDRDKLES

SEQ ID NO: 15500 - protein, 398 aa, Candida albicans
GTNPKVNNLTQGFVQAKYDILWVKDINVWANPNILKNSVISLNGNLNMSRKMGQSRPVKLVHHVPLALSINNTTRSDDFIGGQDLEITAMTPVPSSESLNSQLVKRKLSPKSNNSLNVHPGFTYSKFSKKLGAELDEMFLHTSHSKFYVLLNNLAVAPCVNGKSNIYRRSDLDQSVRLIPHKDSPFFKDPKVRQDAGYYTSLGVGHAINFFARYIGVDNMIGIALWENTQGRTGLTGDVVVQPYSGSENNAVKDYIQRRVRWLRVRKYMVLLATLIEPTTESIICGIYGTYAISTVFFGTWFNKYWFVMHMLIWMLTDYVQYHTLINHTLDVKNITYLPNWLNESIPPKQRNCLQWGYIWILRELLALPIWIIAMIGHEIDWRGRPFRIKKDLTAEEM

SEQ ID NO: 15501 - protein, 167 aa, Candida albicans
GTFDLVSFINTVKYRNLLFFFLMVQEELSLFRITTGYFFLLWYIIILVAAYSGFFEILFNFRNRPILHTKQQANHQNDPESDDEEIYEGVTIIRPIKGIDPELTSCLESSFCQNYPRSKLQISFCVDDPNDPSIPIIQKLIAKYPTVDAQILTSESYNSQTKNSDEH

SEQ ID NO: 15502 - protein, 783 aa, Candida albicans
FISVVGTLKKKSQLKKERKKILPFQEKLYNNSPVILLTMATERDQEIIDFIDQGNYTYAQSLITKKLAKSPQKLFYHVLQNEIHLKSGQRELAIKKNLELLNRYPNDPLTIEKLSDFFSKMEMEKESSLVYENAIKKYPVSTETLCLSWFDNSIEKYDFKVFNRIFMYLNKNGKSRLHTLWYAFSFHLLLQEGETDKASLYNSLGKKLMEGLQPFENTQEIYVYTLFLSSKEIEQVLSGVTLPLDLELKLLYMKAMKENASFEALHAYTEKLLFKEKFDDFDTWKLWILSGKEIGKSFEELDQKLTLPTRNISLLKIELDILYSRNIETSVENYYLKFNTKLCCYADLSQYELPTSFIGSLKNSTSEENLITVVNNRKFVNQTDNWDVYERFSTKEGAEYDSNPVNELTLRTIVSDLDSSPQNTIKNIVLLKHLLEQDKYNYKLKLWLMKLYSQLNTNDLIFPIYNGLKIRMTQHETLNYYLTTTNPSKINLDAWVDIYRFYLTSKQEIKESIIQGFDNGVFNKLEGFINFSKRMQNSISLNFTVAKILQISTILGTDGYLNYFIHYLKTNEALIVSDYTDNRDFKSEWNGLEKIDCIDVPVNDVATKLKLLVYSIVFEDQDASRLLKVFNKITSNAKFSVFDNLLYKLYFNLLKITKTKLNPQETQSLYNYLQKNLKTDKLKILIPENLLSGELTQNLTNLVEFIKIVKLLAKRHPSSYMNQLVNLVKPFGKEFKNLKLVQRQHEIIDSMDFEPPISVDISQTKLEIKSSIEDCVVALLNSL

SEQ ID NO: 15503 - protein, 411 aa, Candida albicans
CQSIMSSVKYDAIIIGAGVIGPTIATAFARQGRKVLIVERDWSKPDRIVGELMQPAGIKALRELGMIKAINNIRAVDCTGYYIKYYDETITIPYPLKKDACITNPVKPVPDAVDGVNDKLDSDSTLNVDDWDFDERVRGAAFHHGDFLMNLRQICRDEPNVTAVEATVTKILRDPLDPNTVIGVQTKQPSGTVDYHAKLTISCDGIYSKFRKELSPTNVPTIGSYFIGLYLKNAELPAKGKGHVLLGGHAPALIYSVSPTETRVLCVYVSSKPPSAANDAVYKYLRDNILPAIPKETVPAFKEALEERKFRIMPNQYLSAMKQGSENHKGFILLGDSLNMRHPLTGGGMTVGLNDSVLLAKLLHPKFVEDFDDHQLIAKRLKTFHRKRKNLDAVINTLSILHQAVDGPNLQ

SEQ ID NO: 15504 - protein, 147 aa, Candida albicans
IHVLVKLSWQEYQGLPWVGFSDYLWHLWLMIHLLGTDAVKHISELPFKQQMKLQFTDMAKRSYSSAKNFGFIGMVYSGVECTIESLRAKHDIYNGVSAGCITGAGLAIKAGPQAALVGCAGFAAFSLAIDMYLNSDAAPPPKNDYDI

SEQ ID NO: 15505 - protein, 244 aa, Candida albicans
  UNSURE (4): Identity of amino acid sequences at the above locations are unknown.
LSEXCKNCIYITDSRNEQEIKDLKKSVELQERNHKLRKRKPKLKNSTESTKLATPDHTHLSDSISPVLRKKAKRSNKIDVEANTRVEDSLDPFKAFSYNSTLQTATNPSSPGPTIPPNSPAIQNLIHPAGSLEEQEFSPLKPQPHPENTTQETKSVEEIIRENGTELEVNSPSTFLTFLRDVNSLHNHNHHHQVGFLEDSGHNHVRGGHEIETDNDEDKIQTLDVDLDNPELREILTSPDFHAH

SEQ ID NO: 15506 - protein, 89 aa, Candida albicans
  UNSURE (45): Identity of amino acid sequences at the above locations are unknown.
GAGIGVLKKTDKSQLEKPSILLQEAKGETPQINSNTGTSSNAPPXTLADAPPVTLADAPLATLADALASALNKRKEKVAQSDDEEDDDW

SEQ ID NO: 15507 - protein, 666 aa, Candida albicans
VSRWIIVNRRKNAMLAHTTFLSFFLSLFHFNQSSTTTLSLISILLNLQYFILFRKQQLQQQQQQQQQQQRPTPYSPLKTTTMGILTTQDKEKVKRAIPKANNKIIDATVARLYIAYPDPTKWAYTGLVGAIALVDDLVGHTFFLKLVDIIGHRGVVWDQELYVNFEYNQDRKYFHTFEIEECFVGLLFEDTNDATHFYKRVTTRQKYGSSATVKNKSAIALKERIGSNKSYEIPGPRGEFMDVNTAQRQRRAKGVLYYDDVPPPEWRSLYAELEAAGITEDMIADNRQFIKDYISQQGGPLVGLEPPIPRKFQRKHEIEHSMAIAEPLTVSISSSSSNTTSKHKKAPPPPPPPPPSGPTSHQQQLQRQQSTTVDHHYPLNESKEPSYSPSPSPTSTSTSTPEPESHEITPAKPRFRLPPSTAIAPPVRNTSLPPNGLQFIDKPLPKVPLPLSPVSPQAPNHAYPTTTNTNTNTNTPFNHYVHQVPPPPPARATPPAPPPRARTNQLGLPPRNTLGLPPRTNNTQPPPAPPPRASRGAVPPPPPPPPRATRAPMQLQLQSSPQSSPISPPAQQQQQQQYPSIPPRENTSAIISSPPPAPPLPQQPRPTIATPQQQQQQLPQATTSSVASPAPPLPPQMNQTTQETPATTTTTTTTTTPSIPAPPPPP

SEQ ID NO: 15508 - protein, 469 aa, Candida albicans
SPYNTLTILSFILKSTHAYNTMSEKIVQSSNGEAATLTAVDYIQNQEELEKEARELMPYDPNECTYEMGELRQPLFACLTCSAENENQPIGVCYSCSIQCHLQHELVELFTKRSFVCDCGTTRMKNTKDGACKLRRHGKKESSGRKLSNSSATHSTYLELAAEDIPSSSNTYNQNYHGRFCGCKQVYNPLEETGHMIQCYFGFTCGEDWYHDRCVMGITFADEKANQKHGNSQEESVPDGTNIKTDISKAQLESADIDLIEKLQYFPKLETFDEFICWRCVTLFKDVFEDLDKHFPGVILSKLPRFSNTSTVEDWYAKREKLLEPCFKKIKIEESSGKLGEFHNQEYSLFLSNDFRFKLIDNYESLDHESKLYKFLLNNSFLFKDDPIFKPPEDDSEEDCYSSSNAGTGRALETLPRDKAIESIQAYDKIKSKLKDFFKPFAEQGKVVTEEEVRNFFGHIDDKNNDSGQ

SEQ ID NO: 15509 - protein, 340 aa, Candida albicans
RNWENVVKKGIRSWEERSKNVHLSHQNPKAVYFPMERSGSFRTTVKDATKRQRIAYTKRNKCAYRLVANLYPNEKDQKRKNKPDEPGHNEENSRISEMWVLRMINPQHNHAPDPINKKKRQKTSRTLVEKPINKPHHHHLLQQEQQQQQQQQQQQQQQQQQQQQQQHNANSQAQQQAAQLQQQMQQQLQASGLPTTPNYSELLGQLGQLSQQQSQQQQLHHIPQQRQRTQSQQLQQQPQQTPHGLDQPDAAVIAAIEASAAAAVASQGSPNVTAAAVAALQHTQGNEHDAQQQQDRGGNNGGAIDSNVDPSLDPNVDPNVQAHDHSHGLRNSYGKRSGFL

SEQ ID NO: 15510 - protein, 580 aa, Candida albicans
  UNSURE (578): Identity of amino acid sequences at the above locations are unknown.
SSSPHLFFKGCKTFPKMSNHEDDYSQNIDEQLLQNVDDSSTGNVRVKLEQIAHAAALSKSQQQQQQQQQLQQQQSSSGTPSSSSSSTGRRQKTRRGISTNDSSVVDADSVAEAAAAAEQYKQQYQQLQQQLHHAQQQHLAGLPQQQQQQQLGRLAQQLRQQHLGHVNSHSQFPPELTGGPTADELSEYNIQIPDPIIDSKLKIYPVTENTITAEGNLITRPYPEQVFNSRDELNEFIAEFARDNGFGVVIAHSNKKAIYYTCELGGRYRHKKNKKIDVTKQIDVGDGYMLDPDTKTKKLKCPFAMTASYKKSANAWTLRTTCNEHNHPQLDPLSNHPMLRKRSDELNVMILEMYKLGTKPSHIESKIKEEYPDVLIKREDIYNEIRGYKRKLKKQNSRFGFHNPSRISAAQYRKKAAAQAAAAQAAQAVAQVGTDGPNTADVDAVAAVAAAASANAFLQGAAGDQTATAVGYDQFQQQQQQQQQQQHQHQQHHQQLSQQQQQQQQQEEFQRQFVAATQAQAAAAAQQQLDESQYQHYQQQLQEHGLNDTDGTAAAAIAAVANASRQHHHYHTDNGDLXYG

SEQ ID NO: 15511 - protein, 179 aa, Candida albicans
  UNSURE (164),(177): Identity of amino acid sequences at the above locations are unknown.
TVKDATKRQRIAYTKRNKCAYRLVANLYPNEKDQKRKNKPDEPGHNEENSRISEMWVLRMINPQHNHAPDPINKKKRQKTSRTLVEKPINKPHHHHLLQQEQQQQQQQQQQQQQQQQQQQHNANSQAQQQAAQLQQQMQQQLQASGLPTTPNYSELLGQLGRPXQRPPQRPFHTRCXYC

SEQ ID NO: 15512 - protein, 403 aa, Candida albicans
  UNSURE (399),(400),(401): Identity of amino acid sequences at the above locations are unknown.
HFNLLNVPQMPSDTPKEAKLQIQSKKDEEPPRSILTKGPSSPPPTLNQDSNIVHPQPKHSPNTTSSQVQPQTQSSSTPSNQPATIKLSPQLSISLENRETVMAGGALLKEKQEPSDKSKPIITTTNTNTTNTTAASPLLDKDKNDSFANINYTLNPPKESQHHKAPSVHAHFYVEETLRPVRNRSRSGSASNNATSLSPAASPQHVDNPVFHKDAIKSQESIRATSVSSVGSTQSTPHSAAASANAPSSGTTGTVATATAAAPPPTTTTATGTGEQNANTDPRLPQDDGKFHVLLGVCGALSVAKVKLIVNKLFEIYTPEKISIQVILTKASENFILPETLSILENIKKVRIWTDIDEWTTWKIRLDPVLHIELRRWADILVVCPMTANTLSFSTEPGXXXNE

SEQ ID NO: 15513 - protein, 511 aa, Candida albicans
  UNSURE (479),(485),(504),(507),(508): Identity of amino acid sequences at the above locations are unknown.
LSIFFFEWTREINKLLGFKLANQIFLFNNIQNLTSTMDNDELTASVWDDAVSPSNNDDFGSNGLDNSRLHNSVVAPLSNQFSSLAMDDPFANPLGFGNDDQKGFQKYAKDEDEDEEDEDDNDYNKQSSYYNAVDEQTHELKKEERKEHSNEILSKLTHGAEDSDILESSIVKSPGKISSSGALFHDKGSPLKVISADAETTKSPTRLTKIKTTKFKATRPRKFSSKINVQHMNESSTNPLGPLSVDDNKENENSESNPQADFNGESIAKEAEAPLYDINNGPDSPQKPLLIKSKRPQANESDPQSNKLEITVGDPTKVGDLTTAHVVYTIKTVNKNLDSKFFPAVELVQVSRRYRDFRWIYHQLQNNHPGRIIPPPPSKQTFIGRFNENFIENRRLSLEKMLSKINHHPLLCNDPDIVMSLTSQDFVHESKERERLSGSGASLRNREYLDGNKDVVMSSNVAAAAATAAGTSGGCMSSXWSMFTXINRARFIFDDPRINIFDDXEYXXKQF

SEQ ID NO: 15514 - protein, 161 aa, Candida albicans
ELFLTFSSINFINNNIINLFNNMRFTPILRQIPKLKLSEVLVKAGDGVPTGLAGIYKHPNPRPALVTLYNETLKTLKENFPADSVYRQSTEALTQNRLMIVESEEIVENIENQIGGGLIEEIVIQAADELSLASQLGGLKVWEELEEKPLDDQWVYFGKKI

SEQ ID NO: 15515 - protein, 409 aa, Candida albicans
LIFFLTKLQESQLSISKTTTGMATLSQPQIALPKTKIATTFGLSKDLKSPISVKVCYLECTINNVSLVPLSTKFEDPIVFKKLSQIYKNSDLFVEIRVYDGKNNNLISTPVRTSYKAFNNKGRTWNQQLKLNIDYNQISIDAYLKFSICEIIDTKPSVFGVSYLSLFSHDSSTLRSGSHKIPVFMEDDPQYSKNIQYGTLTGLTDLEKRLIDYENGMYPRLNWLDKMVLPKVDATFLKTNNKDHDYYLYIELPQFEFPIVYSDIIYQIPTIEPITETTSKIPPDDTLNSNIIINSIDIPMATSHDPNIMKVYDPDFHLTANNHLNPNATTFDPVELKYRKLERDIDNNTILDKELKPTPQLRDELLRIMIKPSNAELTDNEKNMIWKFRYYFSKNKAGNDPSNKSVKSF

SEQ ID NO: 15516 - protein, 70 aa, Candida albicans
PKFLRSINWENDYELDHTFKEIIPFYWSVDKLQIGDALELLGDYFNPYTLGKPGNQDDPGRRKVKKISEE

SEQ ID NO: 15517 - protein, 533 aa, Candida albicans
  UNSURE (185): Identity of amino acid sequences at the above locations are unknown.
RILLYLLQLVQALKYEALIYEKSPPFCERSDQIEDNTSSTLKSPLADFLIERAVENENLGNFFYWYVKVENEDQLNNPHVDGPIKIYMDILNRYIELLKAHCHENRLPYYKHLKHQIWFIKKLTSLVELLRASFKKNEATAKKVEYLREYLANSGNELLKFPEPFPLPLDPSVMICGCYPEESSXFKSSLAPLKITLKTIEKKKHGHATSQLFGKRSRYGKYPLMFKIGDDLRQDQLVIQIIDLMDQLLKNENLDLKLTPYKILATSPISGLIQFVPNETLDSILSKTYPTSVTYSGGGETSDVPPSVSNNGILNYLRLHSQEQQSEEPISKSILSTNTSQSNTEIPVLPRQPKPTITSDLGVSPILMDNYVKSCAGYCVITYILGVGDRHLDNLLLSPNGKFWHADFGYILGRDPKPFPPLMKLPIQVIDGMGGLHHENYNVFKSYCFITYTTLRKNSNLILNLFQLMLDANIPDIQFDPLRVIEKVQDKFCLQMTEEEAILHVQNLINDSVNAFLPVVIDRLHSLAQYWRA

SEQ ID NO: 15518 - protein, 353 aa, Candida albicans
  UNSURE (225): Identity of amino acid sequences at the above locations are unknown.
IPIQQIVHLSLDPLGVGINSNLSPKNGKKRKSGSKVRGVFSSMFGKNKSTSSSSSSNSGLNSHSQEVNIKISTPFNAKHLAHVGIDDNGSYTGLPIEWERLLSATGITKKEQQQHPQAVMDIVAFYQDTSENPDDAAFKKFHFDNNKSSSSGWSNENTPPATPGGSNSGSGGGGGGAPSSPHRTPPSSIIEKNNVEQKVITPSQSMPTKTESKQLENQHPHEDNXTQYTPRTPTSHVQEGQFIPSRPAPKPPSTPLSSMSVSHKTPSSQSLPRSDSQSDIRSSTPKSHQDISPSKIKIRSISSKSLKSMRSRKSGDKFTHIAPAPPPPSLPSIPKSKSPSVLTTGLPNRRKGG

SEQ ID NO: 15519 - protein, 357 aa, Candida albicans
  UNSURE (44): Identity of amino acid sequences at the above locations are unknown.
VSHCRRKSNNLIETSEHGEIIDGTMESGFSDIDDSQQSHDNNNXNNNNESNPESSEADDEKTQGMPPRMPGTFNVKGLHQGDDSDNEKQYTELTKSINKRTSKDSYSPGTLESPGTLNALETNNVSPAVIEEEQHTLSLEDLSLSLQHQNENARLSAPRSAPPQVLTSKTSSFHDMSLVISSSTSVHKIPSNPTSTRGSHLSSYKSTLDPGKPAQAAAPPPPEIDIDNLLTKSELDLETDTLSSATNSPNLLRNDTLQGIPTRDDENIDDLPRQLSQNTSATSRNTSGTSTSTVVKNSRSGTSKLTSTSTAHNQTAAITPIIPSHNKCHQQVINTNSTNSSSFTRSVGGWHKFKSVS

SEQ ID NO: 15520 - protein, 213 aa, Candida albicans
SEYNSIVHKDNLYIIDVSQSVEPEHPMALDFLRMDIKNVNDFFSRSKINVYPERLIFRFITSEGHLLGIADNSDQELEKYLETLPLKTEDDQEVEDEIFRSLHLVRSLNNLDERDFQKFSEGKVDTMKDLVAMKEGEVASPGLQTANGNEVDSSEDEDNEGVSEEEEESSSEDDDDEEEEVDGISEKEWVEREQNAPRGKKHEHKDLHRTGPE

SEQ ID NO: 15521 - protein, 345 aa, Candida albicans
PLQIFGVARELMQFHSQTCGIVIGGADRRQEATKLAKGVNLLVATPGRLLDHLKNTQFVFSNLKALVIDEADRILEIGFEDEMKQIIKVLPNENRQSMLFSATQTTKVEDLARISLRPGPLYINVVPEKDVSTADGLEQGYVVCDSDKRFLLLFSFLKRNVKKKIIVFLSSCNSVKFYSELLNYIDLPVLDLHGKQKQQKRTNTFFEFCNAKQGILVCTDVAARGLDIPAVDWIVQFDPPDDPRDYIHRVGRTARGTQGKGKSLMFLTPSELGFLRYLKAAKVPLNEYEFPANKIANIQSQLTKLIKTNYLLNQSAKDGYRAYLQAYASHGLKILLSERTYTTRI

SEQ ID NO: 15522 - protein, 1270 aa, Candida albicans
TVYKNLEMGKYRKRFNEKARAGMLAKQAALKKARNKQFYRQDDEEETETTPDTTEIFNTQDSNSEILAPVTEEERLARKRALEQNLYSENSKKEKMSRAKKKRLDKYIDHQLKREEKKILLEKLAETKMDTSNFAALKELGKGKQTKKEEMIEALELERQGRADENTREVLYEERDVKDYDDSDEDGSIFKSFDDDRHLQDEEGEQRSTFVDNRPKKFGGQGSGFGFANIPVIKKDTTEIPKKKYSWRKRVEEEEKKRLKKEDDDDFASSSEDEEELDNSNADDMNTSEETVEADELRDLDVAEDSDSNEEESEHEINPEAGESAESEGDLSSEVEEEEDDDDDDDDEEEEEEESKLMKSKPRHSTTAASFKEWAEQQVRIMEGRDKNVLTPEVSEEIKKKYSKQTVRDEDVDHSSDEEGYIPINKEMQRRAFVVEVNRTDSIQQQRVLLPVFAEEHRIMEAVYHHDCIILCGETGSGKTTQVPQFLYEAGFGNLLHDLYPGMIGVTQPRRVAAVSMAERVGSELGDHGHRVGYQIRFDTTIKNEGKENGTALKFMTDGVLLREMMTDFLLAKYSAIIIDEAHERNINTDILIGMLTRVVKLRRKYHKENPQLYKPLKLIIMSATLRVSDFSENPALFKTPPPIINVQARQYPVSIHFNKKTNYDYLEEAFKKTCKIHRKLPEGGILIFLTGQNEITTLVKKLRQEFPFEKKSTIQYDENIDVKLSENVQQEVEDVDFSVQSGDAGILDDYEEGEENEEEEEGFEESIDSKESEVGPLYVLPLYSLLPTKQQMKVFEDPPPGSRICIVATNVAETSLTIPGIRYVVDCGRSKERKYNQENGVQSFEVDWVSKASANQRAGRAGRTGPGHCYRLYSSAVFEDFFPQFSVPEILRMPFESIVLSMKSMGIDQIANFPFPTPPDRFSLKKAEELLVILGALDKEQKQITDLGKKMSLFPLSPRFAKILIIGNQQECLSYIIAIVSALSVGDPFIGENELVGNMNDEARREFRTKFYHSRALFSKLDASSNCMMLLSAVCAYDHVPKEEQNGFLQKHYLRHKMMEEIQKLRKQVGNIVENMIMSADGLQLEQKVKLPIPNKKQVSAMKQMIASGFIDQVAIRGDLISSEVKVANKTSIINIPYCPVMPIEDGPFVYLHPNSLIAESGQIPSSYLVYQSLSTKGNISEDETKKVRMNPLVDISGKQLANIAKNSVLLTYSKPLGHPYAPKNLTPTKRECYVVPRFGAAIGSGGVGWDLPAINVIQEKRKGVWVNL

SEQ ID NO: 15523 - protein, 743 aa, Candida albicans
YQKEGNKKKIQIQFDEIKRYLFHYFTIPSMTVSTAINNRKRLSSGLSVTSKVFVRSRNGGALKIVREHYLRNDIPCYSTICQSCQDIIKPDAQGELPKFILSLNPTKTAKGEPHYLVLDTNIILHAIDLLENNQCFYDVIIPQTVLEEVKNRSFPIYQRLRNLVKSEDKRFIVFHNEYNEQTYINRNKNETINDRNDRAIRKVAQWYQTHLPSKIKTFFICNDKDNRNKAIKEGIDARSLVEYIESLPNADDLSDLIPQDDSTFENDKNSTTATAGLDDEETSFPEYYSNARIMAGIKNGTLYQGILNVSSYNYLQGEVLVPAFKKPLLIQGSKNLNRAFNSDSVIVELLPKDKWKEPSTTIIEEGAIGANDNAADGDDEEGGGGDVIEGTKSVISDKERILLAQEAIKVIGSKNEDKRLQPTAKIVGVMRRSWRYYVGQIAPSSVNLDDKTGHASRSCFVILMDPKLPKIRIRTRKAREYLGQRIVVVVDSWPINSRYPNGHFVRALGEIESAEAETEALLLEHDVEYRPFLKNVLDCLPKEGDNWVVPDITNNTEDPQLQKRVDLRDKLVCSIDPPNCVDIDDALHAKQLPNGNYEVGVHIADVTHFVKPNTPLDQEGASRGTSVYLVDKRIDMLPQLLGTNLCSLKPFVDRFAFSVIWEVDEDANIVNVNYMKSIIKSRQAFSYEQAQLRIDDPSQQDDLTKSMRILLKLSKKLKPKRLDAGALNLASPEVKVHMDSENF

SEQ ID NO: 15524 - protein, 304 aa, Candida albicans
HHLKLKYIWIVKISDPQEVEIKKLLETNSIVEEFMLFANISVARKIYDAYPQTAMIRRHAAPPATNFETLNDMLNVRKNGMSISLESSKALADSLDRCIDPNDKYFNTLVRIMSTRCMMAAEYFPSGSYGYPEFRHYGLAVDIYTHFTSPIRRYCDVVAHRQLAGAIGYENLDLSHRDKSKMEMIVRNINKRHRNAQFAGRSSIEYYVGQVMRNNESEHEGYIIKIFNNGIVVLVPKFGVEGLIKLENMGDVNSANYNEDKYELTFTDFKGNERTIAVFDKVKVDVKSVKDEISGKRKAQLMLK

SEQ ID NO: 15525 - protein, 525 aa, Candida albicans
PLILLILLVVLLVEYNFYYCTILSIWSDLFQSFFTSIMSGFFVSRVESHFSKNPIKYKPRSNSSHEANNNTTSNLINKFKPKKTSKGTDNELPNSIPEMIQTAIPEFSPKYSFFVNPLLSSGHTQTAYTALNKFENQHEVHYKREIITIENKPYTLPNGDQLYYDQWKGESTIALDYAVNLSLGPDLNHEQYKPESQTRPLPPRTEFKNPNEDLISDDEKPLLIILHGLSGGSYEAYLRAVIDKIIEPPFEFDAMVINSRGCANHTITSPQLYNGLWTNDVRYVINEIVSKRWPQKRVFLMGFSLGAAILANYLGQEGAHASPQIKGSVAIGCPWDFVDGSFQLRESVIGHYIYSPTMANNLLKLLNSHHILLANDLVKQYKEDPTRNEIKFLKQFDNEFTAKMFGLNSADEYYRKASPIQRLLNVRVPMVILSSLDDPVVGSRSLPYSEVNLNPYVSLITTSVGGHLGWFAINGDRWYVEPVCKLLTVLNQYDADKESIVELPVDISETSWKYDRLVNGMLVDQ

SEQ ID NO: 15526 - protein, 155 aa, Candida albicans
DGGYLDNLPVNEMKKRGVKHIIAVDVGSDDDRTPLNYGHTLLGFWVLLNRWNPFSSHPNIPTMMDIQMRLTYVSSVNALEEAKRTPGVYYLRPPIDPYATLDFGKFDEIYKVGLKYADDLFADWKSKGKFPRIAGLVEKKKDGEEKKILYRRNSI

SEQ ID NO: 15527 - protein, 148 aa, Candida albicans
ENQLLIFPFLFFFFRLSFFERVSGGGQHIERVFDNTNHKHQAIINHTSMSNPNESEPHTQPEINNASHIVKPEGSQTVNTGFICRWSDCTENTYNNLTSLVNHLNSKHIAQLPPGSNTKYICYWENCARYGLDQPSRSHPELPDRYIV

SEQ ID NO: 15528 - protein, 106 aa, Candida albicans
GGFSVSNPTIQRFFALHFLLPFILAALVCMHLMALHVHGSSNPVGITGNIDRLPMHPYFIFKDLITVFVFLLIFSLFVFYSPNTLGHPDNYIPGNPMVTPPSIVPE

SEQ ID NO: 15529 - protein, 231 aa, Candida albicans
SFIFFCNFSYFTSFNFQTKQPLSKMAMLTKSIHDEDHVGKKDPDTNPKTVQNVVSSRSPPNPAKDITEERNRTNWDLKEMHEFLEGGEAKSEQVLRLYQSIERDPILQTRPEQFDITQKEERELVATRINQMTKYMEIESAAKFRRRLQLMTIIDPSMGIRMLVNIGLFINCIKGNGTQKQYDFWAKSKEGAIIKQIHGSFGMTELGHGSNVAACETTFSPLPRGPAICGE

SEQ ID NO: 15530 - protein, 187 aa, Candida albicans
TGSNSSKVVLDNVADLDDIDKVIKAIEVAIIRLGQEAAFTVRKESLDFVGAELVQLSKLKAHHYLLSEYVRRVNEFDQKELVPYLLTIAKLYGATVVLDKFAGIFLTINVASTKAITDLAFIQIPKLCAEVRPNVVANTDSFQQSDMIVNAAIGKYDGDIYGNYFDLVKAQNPPSKTKAPYSVFTYR

SEQ ID NO: 15531 - protein, 665 aa, Candida albicans
YNMSTELQKEREQIKFNPKEVNYFLEGSKERSDIVSNLVEQMEKDPVLKVDASYYNLTKEEQREDTAKKIDRISRYFENEFPDQQAQRLSILGVFDPQVFTRIGVNLGLFVSCIRGSGTNSQFFYWTINKGVDKLRGIYGCFGMTELAHGSNVQGIETTATFDKETDEFVINTPHISATKWWIGGAAHSATHCTVYARLKVNGKDYGVKTFVVPLRDSNHDLMPGVTVGDIGAKMGRDGIDNGWIQFSNVRIPRFNMLQKYAKVSREGEVTMPPSEQLGYSALIGGRVTMMMDSYRMTSRFVTIALRYAIFRRQFKNKISGGDQETKLIDYPLHQKRLFPYLAAAYLFSQGALYLEQTMNETNERLDDAVSEGDKKKIDEAIVASKKLFVASGCLKSTCTWLTADAIDQARQACGGHGYSSYNGFGKAYSDWVVQCTWEGDNNMLAINVAKPMVKEILQEPEQKGLVIANVSDLNDPAKLDKAFEHALSGLARDIGAVAKDQGYDVTGPSLVLVSKLNAHKFLIDGFFKRITPEFAPILKPLGFLYADWIIETFSSVFLSYGVIAPEVIKKISSEHFPVLAKQIRPNVAGLTDAFNLSDMLTNAAIGRADGNVYDHYFETVKKLNPPENTKAPYSQALQDMLNRPSVEERQRGERSEEAAEILSS

SEQ ID NO: 15532 - protein, 79 aa, Candida albicans
YSFQLKNLKVKNKSNMVEKRIAIVGGGPSGIITLRSLLDEGFTSVTLFERKNKLGGCWNLTPPEQTNFDVFNEPEQNHD

SEQ ID NO: 15533 - protein, 305 aa, Candida albicans
RSMKQSAKNTIIPPMAPPFALQSKSSPLSTPPRLHSPWGVDRGLPISMSPIQSSLNQKFNNIALQTPLNSSFLINNDEATNFNNKNNKNNNNNSTATTTITNTILSTPQNVRYNSKKFHPPEELQELTSINAYPNGPKNVLNNLIYLYSDPVQGKIDINKFDLVIHVAKECDNMSLQYMNQVPNQREYVYIPWSHNSNISKDLFQITNKIDQFFTNGRKILIHCQCGVSRSACVVVAFYMKKFQLGVNEAYELLKNGDQTYIDACDRICPNMNLIFELMEFGDKLNNNEISTQQLLMNSPPTINL

SEQ ID NO: 15534 - protein, 303 aa, Candida albicans
TSKEQRGKYFSMTDNGLCRKFLGINVYQQANEIRLSLNDYIRRMIEELKLSVSETNPVSIPSDVNYEIFKVNENDDEKPCDQTKYRSLIGKLLFASNTIRFDIAYSVNSLSRFINDPKEKHWIAAVKVVKYLSGTQRYGICYNGNGDLNIYADSDWASTPSDRKSITGYIVTYAGAPISWRSKKQNVIALSTTEAEFMALTESIKEALWLIYIFRDINVILKLPIVIYEDNLLCQKLLENPRFHNRTKHIDLKYKFTKDHIEAGTIKVESTNSADNLADMLTKPLPKIKFKHLRWLAGLRPLD

SEQ ID NO: 15535 - protein, 337 aa, Candida albicans
  UNSURE (330): Identity of amino acid sequences at the above locations are unknown.
PNGNPQQIVIGNPSSMVEKKDNGIDYNRNTFQIEDLVVNFVGRDTVNRIIGLTNLKDIQKVVENINNRKIVIDSNVEADRNRKRMILQKFDFDTKSLISDLMKNGGSNYEKSKLINTRRGEKSRLATHWDDKLEKNLLKYNAELQKLDKTLMLLRKQAELIEARDAQIGGQSLNSTPVDNANSRGTPSSETDTAAGQSPKKNHLVNIPPQTNQLASQNETLQLSSIVTPSNRDSSNKIRSGPPLQTSQVPTSKRQRVIGMLGIELNEDALKISDRKHGLQNSVTPINNKIKNISLGALNTNNCKDRLGDLQTQFSLNQNITSGTMHDPIXLDLSDEE

SEQ ID NO: 15536 - protein, 153 aa, Candida albicans
QCEYLKAVINESLRLYPSVPHNFRTATRNTTLPRGGGPDGMSPIVVKKGQSVMYTVLVTHRDTKTYGADANEFRPERWFEPETRKLGWAYVPFNGGPRICLGQQFALTEASYVTVRLLQEFEHLTMDAETRYPHKLMNSLTLSLLDGANVEMY

SEQ ID NO: 15537 - protein, 548 aa, Candida albicans
YPTFHQYEKLQYQIQIQNSNPYLFIIMSVSDIVQEYITKWYVVIPTLFVVYQVVDFFYVRSLRSRLGAKAPTNNESDGYWGFHLPFLLVSKKAEGTIIDFAGERFKSIAHPEVPTFQFPIFTVKVISTVDPENIKAVLATQFNDFSLGTRHNQFAPLLGDGIFTLDGAGWKHSRSMLRPQFAREQVAHVKALEPHMQVLFKHIRKSGGRTFDLQELFFRFTVDSATEFLFGESVESLRDESIGMALEAVDFDGKKEFAEAFNFSQNYLASRAVMQQMYWLLNSSEFKSCNSKVHKFAEYYVNKALELSHEELEKQQGYVFLYELAKQTRDTKVLRDQLLNILVAGRDTTAGLLSFVFFELARNPRVFAKLREEVEEKFGVGEDARVEEISFESLKLCEYLKAVLNECLRLYPSVPQNFRVATKNTTLPRGGGSDGMSPILVRKGQTVMYSVYVTHRDTKVYGKDADEFRPERWFEPETRKLGWSFVPFNGGPRICLGQQFALTEASYVTVRLLQEFGHLTMDPNTDYPPKKMSHLTMSLYDGTNVEMY

SEQ ID NO: 15538 - protein, 223 aa, Candida albicans
TIWVNQTRDPQVLRDQALNILLAGRDTTAGLLSFAVFELARNPQVWKKLREEIIERYADGVTEISFETLKQCEYLKAVINETLRLYPSVPRNGRFANKNTTLPRGGGPDGMSPILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 15539 - protein, 315 aa, Candida albicans
LFKLIKFDSINSTIAMLEEISFESWYLYLIICGVLYFCTNYLYIQYLNKKLGAKLPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLNDLGEPNS

SEQ ID NO: 15540 - protein, 507 aa, Candida albicans
MLILLPIAVIAASIYYIAEYWKRESIKRKYDCQPVKQAPLVTWYDIFGIKALVDNSNLTKSGYFYQDIQRKLDNLDTTTMKTTALGKNQIITIEPENFRTMCSSADLNNWTIGTRPIALKPLLGNGIFSSEGESWKHSRIMLRPIFAKEHIKQITAMESYIQLLIKVIKLQQQGEGEFDLQHLFHCFTIDYATDFLFGESCDCLKLILGETSISTMSEEEKSKFAPNFDVMQYHMTKRLVFGYFSFLVNPPEFKNAVKHLHEFVFHFVDRAINFTDEELNDPSKNYVFLYQLAKQTKDRKVILDELLSVLLAGRNTTASLLSFMFFELAQNKPVWNKLKKEITEHFPDVESITFETIHNCEYLRWCIHESLRINPPVPINTRTANRDTVLPKGGGKGNNYPIFVRKGEQVIFPLFSSNRQERFFGPEPEKYIPERWANLPRNGGVAFGPFGTGPRLCLGQQLALVEASYVTIRLLQTFSQLDSNHTECRRLVGATMRLMDGCQVTLK

SEQ ID NO: 15541 - protein, 569 aa, Candida albicans
  UNSURE (352): Identity of amino acid sequences at the above locations are unknown.
VNTSGGKETVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRLSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDVPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEXRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 15542 - protein, 89 aa, Candida albicans
YMAFNIINIYLFNMQLALAAKYIGASIATLGLGGAAIGIALVFVALINGTSRNPSLRSTLFPQAILGFALSEACGLFCLMISFLLLYAV

SEQ ID NO: 15543 - protein, 116 aa, Candida albicans
SSTSILNLTTAAMGKTVSKLSKDDLRQLRQATYFDKRELQQWYKGFIRDCPLGQLSEEEFVKVYKQFFPFGDPTDYCHYLFRVFDLDNSKYIDFKEFIIALSITSSIHHGWTGPRH

SEQ ID NO: 15544 - protein, 304 aa, Candida albicans
YFSQFIHKMLPFAWPYPPEQKDGYWGIPTSTIDWCEENYVISTYIAEALNTTTNSVFIALATFAIYHAFHNKLEPRFIFTAFGFLLVGVGSWLFHMTLRYHFQLLDELPMIYATCIPFWSVFSEFKTPRQSILVAVGIFTAANLLTVIYLYFRNPTIHQAAYGILNGFIILRSIQLNVKYVHDKTARAQLHKTSIFGVGIFLLGYFLWNLDIHFCDFARATRREWGIPYGFVLEGHGWWHIFTGIGVYYSLVYEEYLRCFLTGTEKYFQFTWIWGLPVVYCIDKQGLERYRSVQKLAEEDKKHI

SEQ ID NO: 15545 - protein, 156 aa, Candida albicans
TMGSKLKSVGVLRDSRNKFHFFSSMSRLEKLKEKRREGQKPQQERKSFKTTPSEPRSHMDYTIEETENWHKKQRVDGSENVDKLAELTYYKDILAIKVDLQAYREGKAADPTELTTILAANTERKTKRKRHAKDADADSYINEKNKQFNMKLNRQK

SEQ ID NO: 15546 - protein, 297 aa, Candida albicans
SDIGPGRVIVKDNVFTNKNFIEKIEGSWIKDWSQLRQLIHRTVKTNNFKKVKPTESSDSTTTNTTTFDDLNVCFDGNKQPKKIHSLSLVDEKGEVADTTEAMLNAASNYMSGLYNKDTKVRHYIENYLAKFPKRLGDDDRSLLAKPITLEELTCELDEALGDKTPGEDGISMKCLKNLWGVCGPALVKEANKIRKTGNLPKDFQRNHNHINTKTCIKEINNVRPILLINCALRLISSVVNRRIQKAMINSKIWHNNQHGFIPRENYTRCPSKISPHNRCHQGVIPIATMPLFLIDFP

SEQ ID NO: 15547 - protein, 904 aa, Candida albicans
LHLRMLSNLTKSTPPHGLLVKLCYQSLKLPHKRLSSMKDQTNFCSMKMSTLRLMTTLNLRISTSPETMMTTWMRTQKKRTQKKRTQKTTTKCQLMRFRKMKSMTFKKRMRMINTNQLKITSLNCERTTNINGLKQLIENNDITLLQDLGKTTRSLLDIIQLPLTIIYSKLTAIVIHHKIDDLIKVTNQHTFELDPVAFPRVSDAVIRVNNKRKYHIINVYYPPNKFDEQRQLIRMIYRQLKNKNTPIIMGGDFNHILNPEIDRQFQVRHNYSETRTTEESLLRNTQLKLIDAYRCFEPQAINFTNHNQLNNRRIDRFHLSERLEKQLLSKDDAIRSTHERITIVLKFTNKPVIDMGKKRFMIKDYHIENPTFISNVLNSNPRDWAHLRQIIKRLTKKKRFPKVPRSTTLTADTFDDLRIRYNGKSKPKKHIFQTIRDVHGRKASNTKEILDIAHGYLSNLFNKSPHNRQQITSYLEDFTPNISPEQIATLDQPITLDELTKELKAKSNLSAPGEDGYGFRFIKSIWETCGPLLVNMGNHIRSTGNLPPDFKLILITLIPKTTKSDYISDTRPISVINVGLRLISAVMNNKLQQIMESHWDHDQHAFIKNRSIQDIVEKFAITWERVKRWTTYSFAMVLLDFSKAFDSLNHSYINAVLMKYKFPQSFINFCMAITSGHIGNIRINDKSSEPLRLLAGVRQGNPLSPTIFILCLEPFLAKLKHSIVGIPLEANIFVKVLAYADDVTVCLNNPKEQHILSNALNQFAKASGLEVNKNKTILLSRKIGLYKLPFQKHHADKPEIKYMGVPLSPKLKLTFLKNWTKNLHTAVNLDLPLQQRALGINTYLISKLHYQDTLASFKQSEINKIALQMNQCFRGVGEENLLALPNQGGFGLMDIRTQTTYNRC

SEQ ID NO: 15548 - protein, 154 aa, Candida albicans
KRAFCTTICVDCIHMPTPGLNDKYIIIARDEFSSWPEAISVPNISGAIVAKFLYESFITRYGYFTTLKTDGGPEFCNQVIATLVETYGIKHILGTPHYPQSHGFIERQHEGIINFLKKLPSTNPWYHHLSTALWVDRTQVRSRTGLTPQYLVHG

SEQ ID NO: 15549 - protein, 136 aa, Candida albicans
LVGLTDGIGTFNIDITPHGIEDPVRVPKVRFSYTINVPRHNIQLLYKIKSILGAGNIIKDTFKCKYIISNKKHLINIILPLFDKYPLLTYKYNRYKVFRESIIRYMDETKSIGDRISSIQIMCKASSANAEEASPV

SEQ ID NO: 15550 - protein, 211 aa, Candida albicans
ARSGLLRGEDVWNNQEESPPVTSTKSQQSVQPKQQPKQQPNTSIKTNYKPKVDPKLLLQRKKLLEEMCYKLNGSVRPLKEEVYRATIPVLPNTAPELWKLNGDIDLMLTVPQTYPMDKISVSLRNNFNENLVVKHCQEDQFEKVKIIKQYKKYEKNMNINVRSYDFGTENLTVILNYLTNNIDKFVLDAESFKKYNDTVKIFKAEMVSTEC

SEQ ID NO: 15551 - protein, 300 aa, Candida albicans
LNPAMATTKHRQSSISTQEDDTNLYSDVDEIFTKLDISQIHQLNKKYRNIIDDTKSNLHDLVGSKYRDLIKIAEDIGDIYQHSSDIDLKVQQLSYKPTKFISIYLDNYGKFDSYMRKQNALQSQKDSRSIIVRNVINKKLRKLDQKIKLGKSPLVHTSNFIYYAKVYHTIEKAFLDIIEKDNNINEKYYELKRNFKNYLEYEISAYNLPESILHANDKFKFNQRLNSKELIMNNPQVLLQDDLDLEFEEEDIEAEEEQDDTDEARNSENAFEVDEVVNSKLDSYDRNTLSSPTDLLIRVI

SEQ ID NO: 15552 - protein, 380 aa, Candida albicans
LFESMMLFFFAFFLSLLFVFVLVFLGSLAHWVVYIIPDIRALIREEQSRNQELNSRLFQAPLYIMTETSILSYKKPTSNKNSFPVPGSAPSTPILSHSGSPAPPTIQLPVSIDSPRSSTLTTTNVGASTRKVSARRKALQDFYHLNSNLDNATTDGNDTTHEGISKISNLNDIDNLIKTAPIEEILKIRNDLSAKLNSSNQTKKSIIYDNYYELIKLSNTLSDLSTSKPRKKSVSTGLKIFADDEDNGEDSGDKNLTELTKEGYVDQVLKELSEFASKEAPVFNGTFNDVLGKLKEQDESDNSGMIVLNDDKPTEKEESSEDIEKQISHINYILNLPLKTNINDTEREQAIEYIDKVILDNPDNEILSLQLGKIKHDITT

SEQ ID NO: 15553 - protein, 189 aa, Candida albicans
FVSKNCIKILTSAPFTKKNLPQLGKPRKHWKKKIPLFDSIYFNISSLSFLHQLIMKTNNYMWKLDLLESKFNKSTPRFPHTKKLLIASNHNHKLLKKIPKSPEDAQVEIEKIKSDIFQKKYHSAYSKLAKEVEKKTIPVDDKEFVSKLITSKLIKIIQSACLNSKELKTNPPTYIGQHLREIVIDKSKE

SEQ ID NO: 15554 - protein, 65 aa, Candida albicans
PGASMTVTWYFGVSNFHKAISMVIPLSLSAFNLSKTQAYLKEPLPNSAASFSNFSMVLLSIPPHL

SEQ ID NO: 15555 - protein, 183 aa, Candida albicans
LLSKSTSGLVKNSVIWLFIASNRCSSQFSLSILLTATHIFSSPKFLAKIVCSLVWPSNANPASNSPEIESSTNNAKSACDTPLIICGTKSLCPGASMAVNLVVSVSKSVAHISTVTPCDLSSSVWSITQASANDPLPAFYASLTSLLTVLASIIPKSYKSLPINVDFPASTCPITTKDLRGLA

SEQ ID NO: 15556 - protein, 65 aa, Candida albicans; identical to SEQ ID NO: 15554

SEQ ID NO: 15557 - protein, 209 aa, Candida albicans
AVSANIVDSNFETGSINCLDILFCVNSSNNHNKSGTPSPVTAEVGTIETYLDMFLFWKYNSEFKPCSARANLICSYLFSNSACTDLVCLANESLKELFGISFQSYKRSILFKATTNGAFLSLNNRIDSKVCCSKPCIISITKIAMLHNEEPRDLKLVKDSCPGVSIINKPGTSNVCFSYLAMTAVFCLIASTGKYVAPICCVIPPASPP

SEQ ID NO: 15558 - protein, 111 aa, Candida albicans
PCACLALNCDNTLIGLPPQFWIKVLGMTSKASATAWYGYCSIPSMVFAFSANLTLQAISVAPPPGDNEGSNMTFLVTAIASCKFLSISLRISLEAPLNNTVQACGFSHLTK

SEQ ID NO: 15559 - protein, 336 aa, Candida albicans
TNKMSYPTIPWPTFADLKQMLHGFWASKPTYTESQYPDLQDKVVIVTGGNTGLGYETVKSLAGSTKARIYVFSRNKEKTLAAIKQIQLEIAEEYNVSNSDIRFIQVDLSDLTTIKPAVEEFLKQEQRIDIIIHNAGIMGPPVGSKSKQGYELQWGTNVVGPHLLQRLLDPLFIKTSETNPPGFSRIVWVSSTAHLFAPQGGVFWDNVNYENLKLSQTQVRTTLYAQSKAGNLIQARTWSRKHNYPNVISSSLCPGYLYTDLIRNLNSFEQCFVKRLIYPRRYGAYTELYAAFSPDVKDGAHTIGFGVPSHARTDLTSEAVGDKTWAYLDKETDAYL

SEQ ID NO: 15560 - protein, 531 aa, Candida albicans
SMATTTKTKKKKLVYRQDPDGVFRLKKIDDNNSIKSVDLANKKKEVDNYLNELIDCSYSIVDDIPDKEIAREEEEEKIIHEIPNPPSTQPEPEPKPTTIKKVKPTTVNTSSKNLTIKPASTPPQPAVVITEKIAESKTSPPTPPTTLPEAQPPQEENKTQEQETPITKIPSPTDFVTHEETEENIVEEVIIPAKPSIMSTIHEFLRFHIPSFVFGIIATVIGTRYKDEIIYGAIGLTVLATGLAIVGVLGLCLCLHLGLVKQSDLKVLDRYIDILKFRATEERPQEKIVINEEVVAEPEPEPEPESQPVETSEEVEMEELAPAPAPQAEPEPEQYVVHDTEVIREIPIEPQPKLYQPKLKRNLHSKTTPILVKDPQETGYQPLEEPQPPKPRRKSSTIRVTPYVYEPREPRKYSVIPTSNTIPLPGDSPTKTTKHKLVHPKPMLQRIQTEPIKEVSRRNSKRSTGSASPTSTRSDPYYLLQNAPQHHQHQQQHIFKERTHEIPPQVFKTKDLPNLPHQAEELPFINRSKIS

SEQ ID NO: 15561 - protein, 266 aa, Candida albicans
ELQHLNKVKFRLYGDTTDANPAVVVSNHASLADCFVIHYLSRMSILGDDYSPMRQCEQFSLPIINFFSWFLVWRVPTVKILLHMLKSDENWELELKSLSFVFSRLLRSKFSEWVVLFPEVNIWTPNGAALQGQVSNKYFLPKFNHLLYPRFSAFFNIISILNQSKPHAYLNMYDITILYTRNGHGTISNQYKPPTLLDIFASAEPITVIVYVKIRSVSRIPTKRKKLEKYLEHLWIHKEKVISQLKAENDTHIQLRISKDNFSVAP

SEQ ID NO: 15562 - protein, 250 aa, Candida albicans
YLIMKSSINLHSHTIDLCTLEELRDPNLISRYPPLFQRKQNLIALDNSTKSIKRSKTVSTPITTNNRATNLTPIVSAPTSNYYQVQSTHTLNRRPCVESKESISNKRHRFVKFWKNISAKSNKMSRHECLIQSISKPVDYYCQQQQQHQPALSPDTCGSIFLNSLYPSKSRNTINIKPDDHMSYEDGRGYDMNNSTSNNNDGVDNLNYHDSEFDLSRRNTYISQMKFQPMSPPQELSAVNSIVIPPCGWK

SEQ ID NO: 15563 - protein, 155 aa, Candida albicans
SIYFFIWYDVPPKKKMLIISEFNPQLMHSDDSEDDYDHQSSHRNSSNGTTTFNQIITYKGQIFSLNDALLIIEACRLQKLPMVTRRLTGIERNKFIKPNTVFVWNETQCGMKRWTDGRLWSASKVYNGNFLVYKQWNKKTKREPRRRGIRWPSIS

SEQ ID NO: 15564 - protein, 328 aa, Candida albicans
MDYQDLLHKIIKEFHSLKEFKPWDSSVLYETLLRSVLTTLIELLGIDNPPSYLHLTTNNDSIGDLKIKYYGNALSKSINGHSMLQYLESKHVSILQAVVEIINTRSYRIKESYSAVFKDVSHLFEKLLKERYEAESNLEDYILQCLMYETQFYQGIVDNVLTADDTEKLASFLGTRLSEEDSMFSYRDIDYPLELNINNESLEKIYKIFLGVIGTKRFDIKEVASAVVGVYKRHQRIDHFEKLDSDEILGKFFRNILPQLFQSVTNKVFREFHKEVDDPPLDVLDQLDNIVDDFIAVGIEGVDLGFPALFRHYIKFMNEIFPHCGRGC

SEQ ID NO: 15565 - protein, 253 aa, Candida albicans
ENITLTLTIKFWILEDFVTPRFKHLVELISVKYNVEYEFISYKWPSFLRKQKTKERMIWGYKILFLDVLFPQDLNKIIFIDADQICRADLTELVNMDLEGAPYGFTPMCDSREEMEGFRFWKEGYWSDVLKDDLKYHISALFVVDLQKFRSIKAGDRLRAHYQKLSSDPNSLSNLDQDLPNNMQRLIKIFSLPQNWLWCETWCSDKSLEDAKMIDLCNNPLTRENKLDAAKRLIPEWIEYEQAIEPLVSISTE

SEQ ID NO: 15566 - protein, 849 aa, Candida albicans
THIWSPLPVMSSANYISDEVPPDMVSPHDHTPSKDEPLKHLDTVIALYDFPGTQSSHLPLNLGDTIHVLSKSATGWWDGVVMGNSGELQRGWFPHNYVRSVNYVQPVLKKLKDNKDLDSITAANTAANVVMPSLTNLIQKSLQESERNSPANSTRKNSVVSFASSETSMPSDSKYTQQQTNTNQNSPEYQLISLPSTRDHSTVEMQPPSQQSSISHTLTGFGIGDDEIIPMEVEEAEKLVEEYRLKYNKTVTWIPRTSTKGDIIFYCEQLDVYCESLPLILFDGEASLPNLEYPGSDVIMDPTPISVQGSQSMENVLDTREGSAAGSFDSTKRDSNVSMSTQSSGSSYHRFSRPFFSVDNLFYKHSSDIGTWNELKEQCNYILDLMLKAIKDQNRQFFSTHFSRLNTLVVALCAAVRLNQEDYIDTKYENTTRRKLKRVCASFAQIYINGILHLSVLHYSLEGFNEGRLFGYDMGKLNRSSSSSAFQSPASSLSTIRQGSDDSTRFAQKLSQDRNSEGNGDMNYINQLVYEIDNLRENVNSIVKIFLKLSANKKIKNSDYDSSDASDDEGEDRFDILPQVYPRFLVDEFNGGNWCNPFFSTKNTVLNVSGDDLKNRYHTKIIIDHSAYDSLSQYVDKIVDACENILEALDPKVQNTFYYNEMLRNERNTQILRLTYKSLYHCSAMVDLIESFDFTVFCSVKRHTGNAIDTEDESYENPSVWGDHYDYNLSFEYPVVLEFFCLKHELHDLVAKIIMATQSLTLEDPEVFKGLKEEDPLFYNREISKIPKEKAALLLSSILKEQLSFKDGGDISLNPDTLLSGYLVEIAKTTKTVLLITQQLIEERETIFN

SEQ ID NO: 15567 - protein, 402 aa, Candida albicans
VKIGELISLLIARFNIEPPEGLSYEEYNLWVSKKRNPIRLRVINIMKLLLEKNWSMSYYNEPVLRRWLTFAHSDQVQTYSLGNLLVNYLERLLRGERIYVERDPVIPNTKPPAPLTKGSSLLKKPRVMDIDYVELARQLTLREFKLYCKITKFACLAKVWGKKSGFSESIDSITQFIKASNQLTNFVGYMILRKADPKKRVQIIRYFIQVADKCRQYNNFSSMTAIISALYSSPIHRLKKTWEYMNADALSNLKNMNKLMNSSRNFNEYRDVLKFIGSEPCVPFFGVYLSDLTFVYHGNPDYLYNRTRQVNFAKRAKTSEIVSGIDRFKTTGYNFQEVPEIQKFLDAWFEKCPTIDEQYQISLNLEPREQAVGASNSNSTTNATTNINSFKPVLTSRSDHVA

SEQ ID NO: 15568 - protein, 248 aa, Candida albicans
QIVISNIVDHSTTGEIVPQNIKIIKKVLNGYVGFANLPKQWHRKSIRRGFSLNIMAIGESGLGKATLINTLFNRDIITLQHDSDEFDEGEEEDVSVKIKSTQAEIEEDGVKLKVSVITAPGFGESINNVEAWKPIVDEINSRFDSYLEAESRINRTAVVDNRVHAFLYFIEPTGHSLRALDIALMKQVHEKVNLIPVIAKSDTLTDEEILEFKHRILADISHQGIKIFKPTDFEYDEEESANTRLINR

SEQ ID NO: 15569 - protein, 120 aa, Candida albicans
THPDQAWQYYQPMLQKLSINDEPIPDPINTIVTDWTTKPYIRGSYSTMYTNDDPSDLIISLSGDFEDLGILEPYIKFAGEHTTSEGTGCVHGAYMSGIYAADCILENIFRNDVTGYTIIG

SEQ ID NO: 15570 - protein, 506 aa, Candida albicans
FTFILTVCHFHLIVMPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDSDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKYEEVFSPLVKNYAYFTDGSYTPEEVVQAEKYMLTILNFDLNYPNPMNFLRRISKADDYDVQSRTLGKYLLEITIVDYKFIGMRPSLCCALAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 15571 - protein, 468 aa, Candida albicans
LLIMFPNSPDAFHQVRMMQSLIKASNFKLQSMEFRCHSNNVCEYQMEMLHHLLSVEAKTLPSLSLIEQQPEIKLGMRPLLLDFLMEVITILSLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 15572 - protein, 217 aa, Candida albicans
IMTIESTNSFVVPSDTELIDVTPLGSTKLFQPIKVGNNVLPQRIAYVPTTRFRASKDHIPSDLQLNYYNARSQYPGTLIITEATFASERGGIDLHVPGIYNDAQAKSWKKINEAIHGNGSFSSVQLWYLGRVANAKDLKDSGLPLIAPSAVYWDENSEKLAKEAGNELRALTEEEIDHIVEVEYPNAAKHALETRFEYVEIPGGHGYLLGIVFKILP

SEQ ID NO: 15573 - protein, 414 aa, Candida albicans
SFNYYVQIMTVESTNSFVVPAGTKQIEIAPLGSTKLFQPIKVGKNILPHRVAHAPTTRFRAAKNHTPSDLQLEYYKTHSQYPGTLIITEATFTSEQGGMDLHVPGIYNDAQTKAWKKINDEIHANGSFSSMQLWYLGRVANPKDLKDAGLPLIGPSAVYWDEESEKLAKSVGNELRELTEKEIDHIVEVEYPNAAKRAIEAGFDYIEVHSAPGYFLDQFLNPASNKRTDKYGGSIENRARLLLRIIDKLIGIVGAEKLAVRLAPWSSFLGMEIEGEEIHSYILQQLQQRADNGQQLAYVSLIEPRVIGIFDASLEDQKGRSNEFAYKYWKGNFVRAGNYTYDAPEFKTLLHDLDNDRTIVGFARFFTSNPDLVEKLKLGKPLNHYDREEFYKYYNYGYNSYDESEKQVIGKPLV

SEQ ID NO: 15574 - protein, 307 aa, Candida albicans
RPVVRTNTGYPVQQTAQQRSGDKLQQVHSQQQQQQQQPLYQQYPPQSVGYLAGDVYNPQHQEYVQMNQLPNQHYNLQQRQQAQGQQLKLQLNEQNAMMSASTQQYPVQDFTNPYPNAQNPAEQQQQQQPLRTQSQQWDGYQSQPLYSAAGNTIPSSIQQQIPPQNLSPSEQQQVKQQQPLPPEQGTKKKPGRKPKLRKLSELSSETPQVPKTASSSSSSPTAVNSGKPITKRSRMGCLTCRQRKKRCCETRPRCTECTRLRLNCTWPKPGTEHKNKPKDQKDDENTIEHAEFGRIKVLRGIVEYRSK

SEQ ID NO: 15575 - protein, 693 aa, Candida albicans
LQQQRRQRVRYGPPHHVRRRPYHPILESLEFQTNRHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKLRVPTLKELTIMCRNAYDEEMFVQMEMHILSTLDWSIGHPTLEDCLQLAIDLNNLSNNTTNDIENKSVRPNRKSSISSAVTAVARFLCELSLYDKYFLSVPPSLIAITANLLSCSMLQIPHASITLKNLIEQEIMNPQQKKQKKAFSSNSSKTTTASYTHQNQLDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFCNKNNRTHESTSGLNSTCNTPTHISISSFAPPQPPPGSILKPKLTSINSTNSLKINKLTSNSNSSNINIHHGHHNTTQEKRYSHISIGSNSSSKYDGFSPIKSISTNGSLITNNGSLITNNGSFTNIVNNTNSSSPLMNQQQQQQVTQSSLYQHHHQYHQ

SEQ ID NO: 15576 - protein, 434 aa, Candida albicans
YQYSIMGCGASVPVDDDEIDLFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDADVAGGTDFLNDFVVKYSEENKNKRRLKSTGTTDIWGKDDDSNINSDAINQALELSLNKDSEQFTRLSIAEAIHKLWKLDSGIKKCFDRSNEFQLEGSADYYFDNVFNFADTNYLSTDLDILKGRIKTTGITETDFLIKSFQFKVLDAGGQRSERKKWIHCFEDITAVLFVLAISEYDQNLFEDERVNRMHEYIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 15577 - protein, 316 aa, Candida albicans
ILKIGDFHFTNRGKIFGVLRVQVKNTAILKQGEGLIKVECVLIQIQKAAGNIAFGTAYQTITNNGQICLRHQDFVPATKIKGTGCVTADEDTWIKLGNTILSVEPTHNFYLKDSKSSLIVHAVSSNQTFTVHGFGNGNKLGLTLPLTGNRDHFRFEYYPDTGILQLRAAALPQYFKIGKGYDSKLFRIVNLRGLKNAVTYDGPVPNNEIPAVCLIPCTNGPSAPESESDLNTPTTSSIETSSYSSAATESSVVSESSSAVDSLTSSSLSSKSESSDVVSSTTNIESSSTAIETTMNSESSTDAGSSSIRSSPPGWK

SEQ ID NO: 15578 - protein, 661 aa, Candida albicans
VTRWTGLLPNKRFFFILTCFRSVKKEIFRGRSPLHTLLEHQEKENQTHFCNWFTISSLQKQILIYTPQKTINSSNILSRFSQFQFFFITTNQSSIFHMQLFQNILVSIALLTQIVFAIEITENKVDRGTVTLNLSDITIYPGASWSIIDNAYTSFVGKLDVRDGAGLYISLTSHLLALQVSLTTLLHSITNNGVVSFDSRISRTSSSYDLQGVSFTNNGEMYFAASGEFSSSTALTSALWTNTGLLLFYQNQRTSGTVSLGMPLGSITNNGQICLNNQVYEQTTQIKGSGCFTANGDSTIYISNVLLAVSPKQNFYLTDKGSSMIVQAVSTTQTFNVYGFGEGNKIGLTIPLMGNLWNSAYAYDTTSGILTLRNLLLEQKFNIGTGYDPSKFQVVTDSGSGIPSTILGSVAYYGRVPERTLPKSCQIPCKPIPEAPGTTPTQYITTITKTNTAGNTVTESGVVNVLTDKGGSWFTTTSMFPAWSTAPSTATVFSSDTIMSTVEPDTTELASLTDIPIETSSVEELLSVMSNWEPSSAPTLSIETPVSSHHYYMQHSSFESSADINTVFSSESAFETASGYIVSMPSLISHSTMVPQSSVSALSVVSESLASAEPSFVVPSESFIFSASSAAPQPSSSTYSVSFTTQFETPSSAGSSLVTCC

SEQ ID NO: 15579 - protein, 977 aa, Candida albicans
IENHQKETNSNLYELKNYKFNQYPFLFSTKNFSRLSLSHHYKPIIIRNMKLFQNILISIALLTQLIFAIEIAENKVDRGSITLNLGDIIIYTGATWSIIDNAYTNFVGKLDVRADAGLYITLTSHLLALQVSLTTILHSITNNGIISFDSRISRTSSSYDLRGISFTNNGEMYFGSSGESSSSTSLTSALWSNTGLLLFFQNQRTSGTVNLGVSMGSITNDGQICLNNQVYEQTTQIKGSGCFTAKGDSTIYIANVVLAVSSKQNFYLTDKGSSMIVQAVSTTQTFNVYGFGDGNKIGLTLPLVGTIFNSAFTYDTASGILTLRNTLLEQKFNIGTGYEPSKFQVVTDSGSGTPSTVLGSVAYYGHVPTRTLPKSCQIPCKPIPKAPGTQPTEYTTTITKTNTAGNTVTETGVVNILTDKAGSWFTTTSIFPTLTTAIAAPTSTAMSTDLSSSVNIPVETSSNESSSITLASSESSAVQTSSIEIPVSSHISANQESSSIGESSVNGSTMISSESALESASEFTIAQSSDVESYSSSEHSITHESSAITSSSTTIETHVTESSVVVDSFTSDSLFVSETQDPKASSFSIVTPSDSIIVNESSIPELSTSVGAVSTSTSSSEISSNSYFPSETHISKVSSSAEPTFVTPSESIIINISEPAVSTDSVQPSTEPQPDMSSVIAESLISSTVSALEIELSSTMELSHSESLLAKQSETINQSESNYISETSAVPTAKSTISDSKLTSTWESSSLVNLESTYSVVMSESEITPIPVHTSESATESAAESSDIQTQFTSTWTTTKSDGSFVTESGVISQSGTSFTTIATFPPLYTSSDITTEFISTWTATNSDGSVTTEIGVVSQSGTSLTTIATFPPSSTESGITSEFISTWTTTSSDGSVATRSGVVIQSGTSLTTIATFPPMSTSSDIITEFTSTWTTTHSDGSITTESGIVSQSGTSFTTLTIFEPCHFISCAVIYCD

SEQ ID NO: 15580 - protein, 294 aa, Candida albicans
KSMFLYSQAIRFIIFLLPICLTFKITENRIDRGKLNFEIQDITIKSGAFWSIVDNSICTFFGSLMVEPQASLYVSLTSPILALQVAFVSILGVFHNQGNITFDSSASLTSATYRIITLTFRNTGRMFFSASGKFPNTMDIVASDWTNNGLLSFHQDQRTSGVVSLGSALGTITNNGQIKLSNQVYQQRTQISGSGCFVAINNSTIYISNSLLPVQITQSFYLADSTSSIIVDSFSATQTFNVYGFGNGNMIGLTLPLVGNYWYSSYTYDATTGILIMRNVFLEQIFTPRLENPT

SEQ ID NO: 15581 - protein, 97 aa, Candida albicans
  UNSURE (6),(7),(8),(9),(38): Identity of amino acid sequences at the above locations are unknown.
LIRREXXXXREISHTKFFCMGGCACVRGYYVSFEMSPXTIQHSNSTHHHQTLTTTVIILQIKFAEATRQTANDITWAAVVIVERDQIKYCMGKISFS

SEQ ID NO: 15582 - protein, 197 aa, Candida albicans
SYPQMFSSFHHIFFFFSLPRSISFHPKYIKYLLLTATTDVLVFILTKLVIVDWPNCFNNWSEVITRMSVDPTTSNNQTNNQELSNLSLQIDETSSSNVERKKRPLNLIPSLPPELPNARDSTSDNMIYIGEEFTEHLEQLEEMEDCFQLINEIFEIIQQREVYDNPEFEVVAKRLTLLRIEIENLVYSERNSTNPSQ

SEQ ID NO: 15583 - protein, 130 aa, Candida albicans
DEIGSSYDPQFDDYVNDPDGFESRLQEAMAMSSSPIISDEENENQEISNSNFQNGENFFSREEGRSIELLPSLPPPSHNTSVSTSRDTLNTTSRNTQNTTANTTEYDPEIDEPIRESLDIYHLLLSIKRR

SEQ ID NO: 15584 - protein, 78 aa, Candida albicans
ILVLNNGKAHWKNYNKMVKNNEASLDFLHRFTSGHFTHYKSNNKVCDLCKQPYTTTSLEHRYEKCPFAKLLWQKFAPH

SEQ ID NO: 15585 - protein, 114 aa, Candida albicans
ILVLNNGKAHWKNYNKMVKNNEASLEFLHRFTLGHFTHYKSNNEVCDLCKQPYTTTSLEHRYEKCPFAKLLWQKFAPTNMRNHFRYYIANLLLTLSQSQQLSKFIAAIAAMEQK

SEQ ID NO: 15586 - protein, 404 aa, Candida albicans
QFLIFPNFKHRGLMIDSVRNFLTVDSILEQIDIMALSKMNSLHWHLADSQSWPVALESYPHMIKDAYSNDEVYSKNDLKYIVDYARARGVRVIPEIDMPGHARAGWKQVDPTIVECADAFWTDAAVEPPPGQLNIESEKTYEVISNVYNELSDIFIDDVFHVGNDELQEKCYSAQLLPNNTVTDLLKRYLKKALPIFNKVNHRKLTMWDDVLLSDVSADKIPSNITLQVWHEISGVKNLTSRGYDVVVSLSDFLYLDCGNAGWVTNDPRYVETPENVDFNTGQGGSWCGPYKSYQRIYNFDFTANLTETEKNHVLGAEAALWSEQVDSTVLTTKIWPRTAALAELTWSGNKDSNGHHRGYEFTQRILNFREYLVKLGYGVSPLVPKYCLLNPHACDLYKNPPVY

SEQ ID NO: 15587 - protein, 333 aa, Candida albicans
KQMSKGKRAPYTRPCDSCSFRKVKCDMKTPCSRCVLNNLKCTNNRIRKKCGPKKIRDRTREAINNLSNKEDPKTNSFIPHFQLDKLQPCLETYQTWYYGIWPVLSISDLNMKITKRDVSAYALACALSAAILNQIDFISNNGTYCIPEDVKKLDFIGECIRARTFMNYQMTPTLETILTSFFLHVAEVNKGSKPAAIIYLREAITMAQIIGLHNESTYKLKPVAEAHRMRKIYFMLMVTERFMCIDDLIPVVLENSIKEFSLDDEQYSVLIDGFKELVKVFSIPLKAIFDRFIQMNDSISMPPETAGLLNKIQLELESICISPVAPDIQKAYI

SEQ ID NO: 15588 - protein, 858 aa, Candida albicans
DQCNSNMSTSQPSQQQNPEQVVNDIRQKIEKERKIIQGFNDVKRNTNNPEVIQKCKSKIIESQSMIDYYQETMNKLTRQMLRLNTNSSSRTASRSSVISEYKPSYSNFDLIKYECPSLGNKIQFMLQYLEFKLQVENKYSEANKKLSHLYLMDGDKSSSNAAEGGRAESDQRIQLLEKALKKYQVFSINDHEFDRDYEIMDSTKHSRKLLTGRLTVSITCIRDVDHIATALAKKRETVVVIKVDDLEKARTKPSKNDNWNEEMVIDVDKSHEIELAVMDKQNGIYVPVAVNWFSLFDLAEEIRKKKVAKDQGSSGWLPAANLPQTGGSGAGTGSSMTGGASYGATSPLPAHNDLRPSVSPSSDAKENKVLVSTWLSLEPGGQMLINLNFEKSITNGKQFRGPLGRHGAIRQKKEEVFEKHGHQFVQKQFYNIMSCALCGEFLRYTGYQCQDCKFLCHKKCYQKVVTKCISKSGSDYDAAQLNHRIPHRFEPITNHGTKWCCHCGYILPWGKKNVRKCTECGVMCHAQCTHLVPDFCGMSLQMANEILATIESTKVSPKKAQHQQSHAKPLPPKPPIESKPSMDSEETLHNEPSYKSLRPASVVHQDTNFVSKLPTTVQNKYQEPVELPPQQQNQVVPSTRRRGHGLTDLSFETGYGQQQHQHHRDVPQIVVEDHQHYNSNDNRDVEMEESKDEFDNFDYNNKYTENEILTDVQQDQVRSPFADQIQGVPETSHAKQQNQQVQQVQQQEELGHQRTHSSGKFGKSKRRKRKVGLDDFQFLAVLGKGNFGKVMLAESRHTLKLCAIKVLKKDFIVANDEARSVKSEKRVFLTANKEMHPFLLNLHCCFQTENRIYFVMES

SEQ ID NO: 15589 - protein, 90 aa, Candida albicans
  UNSURE (6),(11),(14),(42): Identity of amino acid sequences at the above locations are unknown.
LIGKEXDSSRXRGXPFTCTVGVVQVIKGWDISLTNNYGKGGXNLPKISKGTKAILTIPPNLAYGPRGIPPIIGPNETLVFEVELLGVNGQ

SEQ ID NO: 15590 - protein, 126 aa, Candida albicans
ITMSEELPQIEIVQEGDNTTFAKPGDTVTIHYDGKLTNGKEFDSSRKRGKPFTCTVGVGQVIKGWDISLTNNYGKGGANLPKISKGTKAILTIPPNLAYGPRGIPPIIGPNETLVFEVELLGVNGQ

SEQ ID NO: 15591 - protein, 466 aa, Candida albicans
TFITFFPNSATNLLKNFMIMEKLGFHKVSNSPSSPSQPKITHNRPIPHPQSPPLPQRPLSEPLKKQLLVDNSPGNDVVIANCVAVNAQDFQNIPDRAPVILDGVFVYSIAKDDRVRPGTIGLAGNMRTWGNGSLVQPVNVENYNIFHNGQQQQYLGAIDLLIDFRAKARANLNPINHDELVALFLKNYENQILQPTQVIYMEYTGIYFQIRVNNVQIIDVNTKDQLPSFKDSDDINTKGILIKSTDVGFYPYEGSIINLTKPKTLKQRMFGGSTPHRTSRRKQIINPDFKLEDLGIGGLDAEFQDIFRRAFNSRILPPELAEKLDYKHCKGLLLYGPPGTGKTLIARKLSKMLNGKEPKIVNGPEMLSKYVGASEENIRNLFKDAEAEYKLKGEDSDLHVIIFDELDSVFKQRGSGKSDGTGVGDNVVNQLLSKMDGVDQLNNILVIGMTNRLDLIDTALLRTWYI

SEQ ID NO: 15592 - protein, 347 aa, Candida albicans
TLSFHRLVKMSAHAYSTSTMTRTTRIDTQEATKHKDLPPVPSPLSLSSNPNPECLMESKSLGRKNFKKLSLDASPVKSTSGSLRSSDMMLIKEPTSLRQKRQRPPPILHLPTASSSATSTPTSNITGSSSASSIQFAQKSPGSGVIVSQTLSRPSSAGGIPSSGYSSLNVNQSNRNVDPGNVVSTDMILNQISNLDLTSMNHHRQHYQNSHHHLPTTNRRRQTVISSISPTKSSAASSPLEPQIQLLPASSQSPIATTSALKLNNKDLLTLKQLGSGNSGSVLKILHIPTQKTMAKKIIHIDLKSVIQTQIIRELRILHEMAISLISLKCYGSLFVTITPPLFLVWN

SEQ ID NO: 15593 - protein, 152 aa, Candida albicans
QVKLEEEKEAKKFIEHGEKFGKIITQLGDLKKVDKLTHEITSNIEEDHTKLIEEINQIKEKYNIKSWPTTESTVDLGLNEPIFSDEKEKRLYFIQYILNELMNNAKYEEIRKSIVESKLKKSMEEVSKSIQKNVVRRYLLDTRNECPVPLPQ

SEQ ID NO: 15594 - protein, 129 aa, Candida albicans
TTMSVEVDGFNASALFKELNEGLQDKSKAQEAIKGVNAVIVITLKNKEGKDQSWVLDLKKEGTLTKVEGSVPKGDVQLLLKDADFVKLANGKANGQKLFMNGKLKVKGNMMKATAIESVFKKLDPRPKL

SEQ ID NO: 15595 - protein, 161 aa, Candida albicans
AIFFTAILLLLSLPVLTAGVTLLLMDRNFNTGFYEVAAGGDPILYEHLFYVITLGIPCCYFISMYLHTNLLNVDIKEEGFIFTKFYQLYSKYYPNNPLPSEEFLTWFIGFFEGDGTFVIGKHEKYLTIIQPAINKHVLTYICSNLGIGNIDVHSKGNNTLS

SEQ ID NO: 15596 - protein, 61 aa, Candida albicans
LATLYGGELRLAVPMLFALGFLFLFTIGGLTGVMLSNASIDVAFHDKSKYHLRYKKYIILY

SEQ ID NO: 15597 - protein, 281 aa, Candida albicans
VLWLGDHLLPSIPEAISLLRSKNTQVIFVTNNSTKSRNDYLKKFEKLGIPDISKQEIFGSSYASAIFIDKILKLPKDKKVWVLGEKGIEQELHELGYTTVGGSDPDLISSGVDFDSNDPRLNKLDNDVGCVLCGLVFNLNYLKLSLTLQYLLKDKKTIPFIATNIDSTFPANGKLLIGAGSIIETVSFASGRQPEAICGKPNQSMMNSIKADFPDLGKTPKRGLMIGDRLNTDMKFGRDGGLDTLLVLTGIETEENVKLLNENETPTYYINKLGDFHELNN

SEQ ID NO: 15598 - protein, 188 aa, Candida albicans
TQTMVKSYNRYDQEKCFGVITSQANIVWLPPSETQSSTSMGRALTSGLEEILIWDIKTGEIMNRMSDGLTPGSSNASTTVPPSPVSYLTYHQETNIIAAGYTDGSIKIWDISSNSVIINFEGHNSSITQLKFDKNGTRLVSGSSDSSIIMWDLIGEVGMFKLKGHKGPITGLELLSEQHKYTASWRQC

SEQ ID NO: 15599 - protein, 488 aa, Candida albicans
ELKSQQCIETHLAHFNECWAMGINPTKDMLITSGNKDQVKVWSLDLSLEDGLKIGERGSFEKTSKSRSNEIAFKSLKYSSSSASLIQLFSIQNADRTMEIFRIRSEDEIKRGITKRTKRLKDKGLDEQEILESLQSSEISMLITPFTTMRTMAKIKSACWTNNIKKLDILMSLTNNSIEYHTIPVPETPKKAQSADLYSVKQHTIDLLGHRFDIRAMDISPQDNKLLATASNGELKIWNTRSYNVIRTFVLEGGYALCCKFLPGGTLIVVGFKNGDLELYDLATSSLVDRVEKAHSAITVGGAAPSNDDSAAIWSLDITPDGKTLVTGGNDKCVKFWNFKVEQDIIPGTNTTVSHLKFVHTQTLELNEDVLCVRISPDAKYLAISLLNNNVQVVFLDTLKLFLTLYGHRLPVLSIDISHDSKLIITSSADKNIKIWGLDFGDCHKSIFAHHDSIMNVRFIGDTHNFFSTGKDRLIKYWDGEQFDCFPR

SEQ ID NO: 15600 - protein, 235 aa, Candida albicans
PTNLLVNMHITDHGSDWLWAAFSVFLLLTIIHLLLFLYGNFRKPGVKNSLLVIPLFTNAVFSVFYFTYASNLGYAWQAVEFQHAGTGLRQIFYAKFVAWFVGWPAVLALFEIVTSTVLDRIEENPNIFKKFFLIFQTWLVKFIFVEIYVLGLLIGSIIFSTYKFGYFTFAVFFQLLLMVWVGRDLHRSFKSPSHSNIANFFLIFFYLVWILYPLAWGLSEGGNVIQPDSEAVFYG

SEQ ID NO: 15601 - protein, 420 aa, Candida albicans
  UNSURE (6): Identity of amino acid sequences at the above locations are unknown.
TKQFIXQPYSFPLMSSRRNKRPYKGLILKPKPIKPGSGFGTGTRSGLGTVSVTASPLALTSTTATTIISFQNGHTTYNVPNSGNVSPSTSSTSTNSLVTKKHIKKSLQNDFKLKSAVNTNNNDNEDNIPSNNGNNIFGVVGDLYDIFDANNFNEFEFLYSIYVPNKYLIKNNRKSIKHLLIHLPKIYHDSTANSSSSTTNTANNNQSTNINLSIHLFLSTIMVKFVNSWYLTKLNTANLQFLKLVYQLMVVFIKDVIARIESVDILLMIDQFGDILNTHLKQTVPTKYSDNNKYPYKFLEDYFSNQKPKLNTFDFDKLTLQVTNDYLKSNHIIFENFNSSSKNHDPSNEMLYYRLLVKNVLLASFKDRELSPSTSKITNDLIVHILSDIVIVKLIEKLSSQDFIFDKLNEILDGLLLLSS

SEQ ID NO: 15602 - protein, 181 aa, Candida albicans
IMLKSTVNNTRIKCGHIDQRRNYLFTTLAGTVLGSFLWSKNNVLASKMENGELHYHDPNLKFNKKLFNGKPPFERRTPDYPGHVPLYNFEKVLMFLGSSMGAFFHPEENKYIVALGESTAITPILQNLRHKMLSDPVGRTILREKPRMTFDSLNLNLLRSLTDNTIGEKYVNWVRQGACQS

SEQ ID NO: 15603 - protein, 163 aa, Candida albicans
LIIRLGKNMSIGLDKEHVSPDTRVAVRYIDNEELAYIYRRYRECHDFYHAITGLPIIIEGEIAVKVFEFANIGIPMSGLGALFAPLRLKSSQRQRLREIYYPWAIKNGLFSKPLINVYWEKILEKDVDEFRQEMGIQQPPDLRNMRKEYFARKKLEKQLQGGK

SEQ ID NO: 15604 - protein, 369 aa, Candida albicans
RPSAIIVPNLVNCSARFTSPTVLDRYAGLEGLDFIPVTTYRRGSYQQINLSAREIISLSKPDLSKLTDLSRDWSVLSVYGTEDEIIPKYDSANFANALNRGPLSHTLKLIPDADHNFYGHKEIKADDELHELNPYNLPLKNGKRVNYNYLVTDYIIDSLTPEMELQRFIATSRDIGRVARWKNVDGVSNFRDVGGWRVHAPTFKLDTIKGSANKNQNQDHLVYYVKPHFAFRCANIAGLTETGLQTLQNLGIKAIFDLRSDGEVKNDGYPDNLSKYGIERIHSPVFSNDDYSPQTIAIRYTNLMTCWSTYVNVYEDMLEFGINAYKTIFEYIRDVNQPFVFHCTAGKDRTGMLGMLILLLAGVDRNTIA

SEQ ID NO: 15605 - protein, 842 aa, Candida albicans
TMANSHRNTLKHDHKPFKSKHATKGQIKARIKGKVEKSSNSLGGSKLLKVVSKLERKNLSKQQRDNKILETKLTKKLFEGNSGAEKIVTIITLTNDLSAVDIANRLFNEQEDTSNESITRFDFGYPSVTNINIAKFKTNLKVIIPKQNNMISILDAAQVSDFVLLGISATEEIGENSFGETVLRALIAQGISTTIGVLPNIVLAYPKRNLQLDVKQSLQSFYHHFFPSRDGSSNRGSGTDSGGNKLYLLELDSDNSNCLRIICQKFPQLITWRDSRGWLVADKVEIFNPNGMPVENQQQMMVVEGMVRGVGFNVNRLVHLPGLGDFQLHKLEKLARKARGNSSRNHRGGMDIDTGNDGDAEETFLPNEQQELLDELNPDEGIDMGTMEDDDDFLNNDNFGVRSEGKIYFDNGNSNGTSSSSTGKKLVPRGTSEYQGRWFVDDVLDEDASDLEEQREGEGEEEEDANIVDDDMMVEDNMEADDITDSIHDSEMMHVDLSPEEESRQLEEYRSLAKDDLEFPDEIELHPNESAIERLKGFRGVKSLGNCDWDYDEYDPEAPSILKRLFQVSNYKATKNKVNKQFIKQTEITAGNRVRLYIIIPPGASNNVSSVIGSCSSVPFPVYELLEHEHKLGVCNFSFEAWQDYEKPIINKEQIIVQYGPRRQIIQPLYNQANNNPNNVHKLENFVHHNQGGGGAIIATAITPVLFTNSPTLFFKIHPDADDSSNSNGGSVEFVGKGTYLGSDAKRIMVQRVVLTGHPIKIHKRVVTIRYMFFNREDINYFKAVSLFTKNLGRVGFIKESLGTHGYFKANFDGKLTSPDVVAMNLYQPIWPEIFTAWKKFN

SEQ ID NO: 15606 - protein, 229 aa, Candida albicans
INLEPINQIIKELFPQRHFLGTLIYNPTTTWETLQTAELYGLKPELQNRFNEIKQEFIVRKKYQPFGGIRYIPTLPPLPSEYINNIIEIKIPFRHIILFKQDIANELITRELWGGASGIYTDDSDILQVLMHLGLFNNTIDLSIWNKKWTTKDLIKPLQSQLDNNDDGTNLGIDKDVYGDLSVEILLLPNLPKYYGFYQNGINSRSWLTSYHSGLSFAVYNVKWETRKT

SEQ ID NO: 15607 - protein, 128 aa, Candida albicans
VLLKILIEESFHDVKTADGTTMRIYVYHPKIPNYPKVKFPGVLVYSEIYQVTGPVSRFAKDIAGQGFIVACPSSYHNFVGPEPLAYDVEGTDIGNQYKIEKELKSYDEDTNLTIEYLLSLPTCNGKLG

SEQ ID NO: 15608 - protein, 152 aa, Candida albicans
FFFTEQQQKHPSSIIMAEEQRRQIEQLMGKENGSLIRRRDPEMTSSRVCRAFLVGTCPHDLFVGTKQDLGRCPNLHLQKHKLEYEHRTKKLGEKFPDIEYDYYKLLSKYVSDLDRNIHNAQLRLQHTPEEKAKIARVTKEFSQRAWQDPQWN

SEQ ID NO: 15609 - protein, 167 aa, Candida albicans
LTKIMLNLIDDVNNILNNKIVIRYKSKDIDAMNSIAMAYSNRSLKEFENSLLTYANELKSDAIIKNHFNALYDNLLEQNLLKIIESYSCVELSHISKVIGLNLQQVEGKLSQMILDKVFYGVLDQGNGWLIIYDEPRKDAAYEASLELVKNLSNVVDLLYEKASSLN

SEQ ID NO: 15610 - protein, 243 aa, Candida albicans
MSGESDKISTDQYGRRKWNVDLYEKEAKDRKNQSTQPTLATTTTTNQINDHSSSLEYIEHRNKLLNELINAVKQYSLINPQTSTSTTTFGKNKRFGFFCPICDVSFRDNLLLIDHLNSPQHVSKARQMNLGIDNNSAEQELLENGIRRASLQEVVLTMERLIAKSINEKSNSEDGKTGLTFNQRVEKRREYEDRKRSKRAERKQIQKQRKKQKTTSDDDKEKETNININNLMGFNSFGSTKLS

SEQ ID NO: 15611 - protein, 416 aa, Candida albicans
VIVFFSASFESGASLLPVRLNGLVWFGLLVDKKPLAHSPYLPAKFQHFFLFVCPSIYFLFTSLPLSPSQTHTHDMFNQPPKILRIKRKRHQDPLQALILEDRRSVKRSKPSSPVTSPRLSPTTTTPVTTTPLENHNYVFKLARTDESDKVNAHDESIIQTILSESQTGIDENNLSEPTKRNFVIPKHQTEEDIEIPNELSDMLDSFLSLEKNNDTKRRKRGRRNTSEESSRPTQLVNAENDNVEEEETQYVYDVYHLTDSEPMTSANHPLTQIGYIRFFEDENETNLLMNDEEDETKPNVLTDDEDSNAESFYQNDYPSDEDAGAFSEQDSLEEENEGYVPHDGVGFKGDNEYFDYEELENLDAEDNYYEEEEEADYEDESSGFKRNQFFKSDIDDPIAIHRDKVFSKLENMINNK

SEQ ID NO: 15612 - protein, 767 aa, Candida albicans
  UNSURE (764): Identity of amino acid sequences at the above locations are unknown.
TITSLPRILRQQKPARGPPWLFMNQSFLMNLTRLLKKKAQLEIELERLKQLEKLSKKAAIRSPIQKDSGSVNSYSGTDDTSKKNSSKDDLSKKLSRYVTDEDDAGYDLQYSASGGDESPPPPPPPKHITPNKTYGYVRDDHFNKPTPRVPFDADDFRISTNSQGVIDEEAYLKLSLKQEELKNSIKSLQSDVLNLSELSATSAGSFLRHKYEKDLQASQLGLSHISVEERHEEEPDKTSDVMETVFQDKKPKQSNIFKKLLRKNHDDVHPIERTIQKQEQIDWATFKSDINRMNSLTSHDKQSRTKRVVRQDGSIIVKPLDFISEINTNETVGPEDDDIDLENVQYSKIETFMLNYDLSYDLNELISDISIKFHSSVINQVRCILVHLCKFDIIEETSKILQQKPKLSEVQHSGKATIFQINYIFKKILDALKIPCEVVLGFWKKPNEFYHNEQYVINHCWLSVLVDNNFRIMDIYNFKNASVCNLRQEKLNEFYFLAEPLSLVSTHIPCIIDLQHVVPPIDPNIAFYLPRTYSGFYKNGLAFKNFNNALTRINDLEIFELELEIPTTVELFTLVKTARATTNELSLCQIKWVNHKRVAKIKAVLPEKESVGVLQIFAGPKGLQKHFDNIHELAIVIPLSHEGTSKPTKFVQRFPTVQSQKNDLYIIKPQTSKIVVNNMYNFEIEQYPSKGLNSGSGLMNQDFKLVIESPSGKYFKLNKEDNSKPYGLYSLNIKCQEMGLYRGLVIGDSGTSWYVFAQWECISXTVA

SEQ ID NO: 15613 - protein, 287 aa, Candida albicans
SMSLPPLSSPVPQVKTTQNGKSPDATVHLLAGAIAGLVSAVTLQPFDLLKTRLQQQQLTTKQEVRTTLTKELKKLTRVKDLWRGTLPSTLRTSIGAGLYFTTLSKMRTSWGEYKQSKDSSINLKSNSSILPKLTAMENLTTGFIARGIVGYITMPITIIKTRFESNLYNYNSMYEGILGIYLDDKKQQQQIRNPSINKGVGGGGGGGSWKNLVKGSVPTLARDCPYAGLYVLTYETFKNDLIPLIIPNSSLSLSSSSSSSLSSSSSLFVFNDNNRSSIINSTAAVLD

SEQ ID NO: 15614 - protein, 193 aa, Candida albicans
HCTKHTFPPYNCILLEMFKRFALNSAKCLSKPACTRQLIYPQTRFITKTLPTVASALRPIGSIRAYSLSTEGEAIDDKIDKLTDNEYAKVSNEYLENLSDLLEELNEDFEQVDSELSQGVLTLTLPPNGTYVINKQPPNKQIWLSSPISGPKRYDLIGGKWVTLRDGSSLTSLLEEEISTAIGQEFKFETVEQ

SEQ ID NO: 15615 - protein, 663 aa, Candida albicans
INNKHHVIGFFFSSPNLFPFSSTLLYYILVLFLILQLIEIMNTGIENDFKYLHSRNLQQLPNNNTKNPSQNIPYNYPSSDEDIEDEYYSDDESQNQLDYEINQLINQQNEKQFKNKFKQLENQSLQRFKSQWDAIIDKYSKIDDSTQSDEIDIVTGELITNNGHLDKLNQNHNQKGDITKMDIWRQDYGQQLENWRQRDFRMKKQAKQRKNEQRQILKKLDLFNKPIYGYPKFEKLEENDFLKQSPTKNKVPSGIESDESPTKKRRVFTDKKVVSKNSNYLEFLDDDDEEVENKSLYTKTVIAHGKLYKRESDNVLYGSSADTFSPYIDRQSFRPESNELQSEDSQDYESNLSSDISDDEYDDETYQSIIINDKKYSPKFKEHFDESETESISETPQPQTSSEETPGLSSQTEEISPSPHPESSFDDEYLIIEEPYYFLDVKSLPLPTIFNCAFIKCHYCTGNKKLYELHLLQSHSSTLAEMGYPINLNSQNAAYENSNTDSDKENHKIEFTRDITDVDLDKLYQVFPKTYKLPPQKEALTCGKELANGQTCQKFYLVQEQLDQHQEAGDECSDKRQVLFCPILGCGYLTDGGYKEWREHMITANHSQEETAEKETKKENLEKLISRPIATRKVSVKVPKFTETDFKVSFIDQGYESIDELFN

SEQ ID NO: 15616 - protein, 529 aa, Candida albicans
GRSKCFWTMDRSWVVGCAIKGGCLVSYGTCCGSLIFFCGPHDWPNIYQKIEFNFFFFSSSPPPTTFTTTNNMSREDPIKAEKDFSATLDEQFPLIEKISDYKQALDKYLVLEKQTRQSSDLASSKRVLNKIVTALVDNNDWEYLNDLITILSKKHGQLKSSIQAFIKDVIDNLDKLDENNKQQLELKMKLIETIRTVTDKKIFVEVERAIVSRQLAKIYLNKLNDLDKAVEILCDLQVETYSLMPFSDKIEYILEQIQLTLQKGDYGQAKILSRKILLKSLKNFAKADEFKATYLKYLIDINVFDYDYISIVKNLLLLIEIPLIKESAEYKEYLVLVIYYIILSTYDPHQNDLINKIKSNPIFTKNVDANIVKLLDVFTTNELIHWSNIESLYKTSFANSKIFADEKNYKNLQKRIIEHNLRVINKFYQSIRLDRLAQLLQLSVDEAELYVSELVNQGMIVAKINRPQGLVKFDKTKHIEGSDPRTSDNHINAVLNDWCYDIEKLLEEVDAIGHLINKEEMMYGIKQKS

SEQ ID NO: 15617 - protein, 69 aa, Candida albicans
HGQNKPWRMFFKNLSCPNWIGGLDIYNQGGQILAHWNEQVGPVLAVCTLHPSQNWAVGGSASGKVYLFE

SEQ ID NO: 15618 - protein, 176 aa, Candida albicans
YPRFDPLDIKICHNRITSMSFHPSTTNRIVVGGDTTGNVGIWLVDEQNNDTKEEEEDDDDDEPSISILQLHGRNVSKIMTPTFSPEKIYTSSYDGSIRVLDLNKLTSTELLYLNEPGAREDIALGVSDINQCQDSSVIFMTTLDGEFYQHDTRTPFNTRQRHHLASQDRHRSGKSA

SEQ ID NO: 15619 - protein, 106 aa, Candida albicans
TSKFYIMSNILSVFNPPPSRPYPPSPDELRSECLPCTAIQSIVAIGGGLYLSSPNQFKDKTTGKIDVTKNPLWWQRLVRGAGIILFGLGAYRAGEVVQILYRKRFG

SEQ ID NO: 15620 - protein, 93 aa, Candida albicans
IVVAEFPTNRTKKKSLATRVRERKQKKILEDFSFNRQPQIAHLITMTTMSRRYTPNIIITGTPGCGKSSHSLSLVSQLNQTLGKETTIHFKAL

SEQ ID NO: 15621 - protein, 219 aa, Candida albicans
FLNSIKLLVKRRRFISKHFNISEIAKERDCIESYDAKLDTSIVDEDKLLDSLEPDLEKGGVVVDWHCCDIFPERLIDLVVVLRTDNSNLFDRLKTRNYNDLKLQENLDCEIMEVILQEAKDSYIPDIVIELRSDTAEEMDENVDRISSWVETWIEDHPDGVSNELNKQYNPDDSSDEGDDNSDSDEYELEEDEQEEEEEREEYDEETNEEMEHTEDIAQ

SEQ ID NO: 15622 - protein, 141 aa, Candida albicans
HIYLDISIYPLIMAYSTGRGGAGNIHSNKNKTSENNVLTPQKSTTFSPQQSNDDGSTPLQKVTSQNKRVYYSTGRGGAGNIKTSDQLPSPTLIPQGSNTPHLHTAKVSTGRGGYGNMVNNDDPELTIILHECRWRTSIIKR

SEQ ID NO: 15623 - protein, 205 aa, Candida albicans
NSEPNMSGTLPFIEDSTGEKFKRQKYKEQSFVELKERGSRDTKEHTPTTALSYDEVNDDLDELVALRGEGRYFGVTDPDDESGISRQSLGPLCANCYKRGHTRAKCTVVICHKCGAIDDHYESQCPTTIICSRCGEKGHIVLQCKSKIRKRQYCRTCDSFKHGDENCPSIWRSYITKLPSQGENEESSVLPRIYCYNCASNEHFG

SEQ ID NO: 15624 - protein, 413 aa, Candida albicans
GFAMPNNVSTVPAQGMNKNHTAIPSSLLTALSKQQDKLYILHLEKDLIKFIKNSVLGNIKQPEYIIQAQYLKNSYYRLLSHQLCQYYNLQHWNNTFNEIIVTPIPNFDYQQFIKAIESSDNNEGGEFVKIVSVAHKYKSENTATTTNNNTNTDAPEQPNKPAPIKKLMVRKIINKPVSDPTPGQAPGTPESEVSDLTKELDESKLILEDTGLSTPISESSENTTNNIESQRASKEALYMKLREEIFENNNEEEEEEEEEEEDGDYGTTDSQESNNRSYKTHNNFIKGRNHGNYSGYKTTPYQQQQLQHQPPMYNTIPMPVPYQFSPNSQGPPIPGMIYSPYYQPMMYGYAPNYPGAPTNNNNVVPAPKYDKETERRILNNPYIILPNDTKNGKNNNYSNKHTKHKKQFTNSNI

SEQ ID NO: 15625 - protein, 370 aa, Candida albicans
SAKKTITLRQHITAMDSNMKKKISSHITSNQSISNLNQKPFLTATMSEATDKQEQVSAETPLERDLKSKQQSIAATKRKQYRDDKSQIRKQARFEVSTTPEPEQSDSSATTATITELPKKRYYRQRAHSNPFSDHRLEYPKSPESMDWSNLYPKQYDISKVEIADIGCGYGGLMIKLGPQFPKSLILGLEIRVQVTQYVEDRIIALRKNQEIINGKKKKESGGGTGDGDDNDYSYQNIAVLRGNAMKFLPNFFVKGQLSKMFFCFPDPHFKQRKHKARIITNTLLSEYAYVLREGGVVYTITDVEDLHNWMVKHLDEHPLFERLSKEWEDQDKCVEIMYNATEEGQKVTRNKGSKWVACYKRLPSPDDCE

SEQ ID NO: 15626 - protein, 267 aa, Candida albicans
RTNQNKKKRKSNRESDYNPSSSFSLPFYSSHEKESIIFFYGPINLVFISLLIPETITTMSDTAKLSKKERKALSFRKSKEERDAEKEEKLERKRKAEEEKQEDVKDTEQDSLEQPRKKRKTRRGKKGKGVNGGKGPRFILFVGNLPYDIQQAELISHFKNSNPDRIRIRPDKGIAFLEFDNDTQEIQSKMELALRMHHTEIRNRKINVELTVGGGGNSEARIQKLKEKNEKVLEERKKRVDEGKKKKPASKPVVPLNVHPSRAALIN

SEQ ID NO: 15627 - protein, 76 aa, Candida albicans
QFQDLIMEFKSSFEDIDLSVDLHPPTNIFIDVRVLKDGGEVTTEYGSFNLIKDSQFFVRKSDVERLIQQGYLEEII

SEQ ID NO: 15628 - protein, 174 aa, Candida albicans
TYVKLKKNFFLEPLLIFVLVGGSQSQSLQQRRCKTNNSEKKNGQNYQLSTTTTTTISIHQILPYLNILEIIQKKKMSNSSSNPSKNEYFIKQRDLLIQEISNNLSIVQTNLETLNRSLHELKQIGKEFDDVARLWSTFYDGMNGMNHQTRENTRDENNKISSSDTEDENNNNKI

SEQ ID NO: 15629 - protein, 114 aa, Candida albicans
TIHYSQELTMDQTKPGFLDQFLLEDISRHCPHQFLSFHQCMTLPQPDPNQCFQQQVDLTKCIKTSVPSFAKIQNECFGKMQAYEACLKMNKSNTKSCSHELQNLRNCAFGTIDK

SEQ ID NO: 15630 - protein, 174 aa, Candida albicans
FYRIPHGESAADVYDRVASFMESLFRQFRSDDFPNILVLVSHGIWSRVFIMKWFKWSYEEFESLKNVPHCKYLVMKKDDETQKYHLKTRLLTWDDVEDDDLDVGQCLLDDDEVYKLIQDQKDTVNSTRNKDKIIEEMYRKAQGPESKYTDYKEKVVSRFKVDNQSVVNSTESFH

SEQ ID NO: 15631 - protein, 265 aa, Candida albicans
DPTISTTMNWTSLVYLWFIFKSIFADLTSHQLKSKVVFLDTTILDEVARSYLGSEDGNVTHGNYEILSIANGANDGNITSYLCQLPRTKKMAPTKPKPTMSVHELKSRAIDLISESFVEGTSCVFSFNLHANYWTIGYCHGINVIQFHENLDDFISGIHKPHSPNHVYTLGNFLKQTLPLEFEFDTKERTISQRLLGEVCDLTGEPRTIDTIYRCDHILEIVELTEIRTCQYELHINVPKLCLLPEFKRTNLEEGVSEILCTRIE

SEQ ID NO: 15632 - protein, 123 aa, Candida albicans
SSSCYMYVLKQCLQFCDCLILNTNMSMLDTIDKKSHEIKQEDEIIDSIEELVEELPDTSPRYVILSYPFKLDDGRLKTPLVMLYWIPPTSGQESRMLYAGAVEQFRDKAGVSKYVLQVILPFS

SEQ ID NO: 15633 - protein, 203 aa, Candida albicans
LANTNKLPTRNKQQELHHSYSYMTELLSNQFTRNLTIQDFDECIILESKGFPPEQRCSPENCQYRLSVASKFCLGLFETTPLGDSKLIGHILATKISTERITEAGMGKKIEGVENSGHFENSRNIGIHSVVIDPEYRGVHLGHIFLTKYIEYIRQFKLTDKILIINKESLIPFYLKVGFENLGLTDCRFAGLIDYDMVYKLSS

SEQ ID NO: 15634 - protein, 190 aa, Candida albicans
LKIPVSETVKEQSNETVPEPKPAKEQKREFPELTTEEIDNLYIKSIKSVNNIELPTPASTFMSYVNKNVPSSITMKKTSWKKASKFLKEMAKLNYIKVKGKDEELSIIQLNTTTSESNATPKTKSKPTSNASPNILKVIPLYKPTKNLRLFFNKLDAEYDEYFTAAAAKSLLESYIKKFSLVADDPKLIK

SEQ ID NO: 15635 - protein, 162 aa, Candida albicans
KHIPVMFKKPAQIKPSSNIKTSERKRLLSCIADAYSLPLEELTKEETEKILPSTIKKASFVSFEKVSGSIYFDENEVPVWFHTRDSDIYPTIFTLMKYPTILPTIATHPHVLGVLAKGADLMLPGTVPPFDKRAVKGAIVGIVSHDNPHKVFTRRWKDRTCV

SEQ ID NO: 15636 - protein, 299 aa, Candida albicans
  UNSURE (3),(4): Identity of amino acid sequences at the above locations are unknown.
PAXXQKHELPELTTEEIDNLFIKSIKSVNNIELPTPASTFMSYVNKNVPSSIIMKKTSWKKASKFLKEMAKLNYIKVKGKDEELSIIQLNITTSESNATPKTKSKPTSTSNASPNTLKVIPLYKPTKNLRLFFNKLDAEYDEYFTAAAAKSLLESYIKKFSLVADDPKLIKPDAELGTKTEMPRDQLLKHFLTKFSPYYQINNSVVYKGTPPKIEIVTELKIGRKVVTRVSNYEKFEIKTETLAKELRNKCSGSSTIVDNDVQVQGPHGKLIIDILKEKGVPVSYINFEDKTKKKKNKK

SEQ ID NO: 15637 - protein, 109 aa, Candida albicans
EYTMPPKGWRKNADGQYPQPSSKENELISIDDILFPRTTIQKLAKNIISDDENNAGQMTIAKDSLLALQRSATVFVSHLLFQAKHISKGSKSENCLGTRHVGSIRKSRI

SEQ ID NO: 15638 - protein, 446 aa, Candida albicans
LKGNCCLVLLVNAQYIIMGYPEELEKIKELLEEASATCNFKYMLITQGISPTTDVAFTYSKHFTHEEVNDYRVVFGRSFTSIRPVLNRTYTLKLSRSSDNWDAITRQLHDLFNSLNQGVCKEIAKLWIRILAPNKQKHFPYSKKDVVPNWWPRDVVHTEPDHLRKEDRIKVLINVVTNKNFKFRDVDTKSIKTKVEHTEAIIHEIIYIAYLAGLFYFGHDRDNETYDILSSNDRKLLEQDEIEFEVSDFRYFGNEGISQSKIKDEYLNENLFRLKGGNTEPTKQSTKQSNKVKKPRKLSKKSSTKALAKVKLDLLDPQENFDLRITPEAQPRSQLPLQLPQSTPKDPAPEFEFPFQDTASKSDLMMHTQGDEMSLDPTFDPNTGYHIVPNTAPDYMQNYFNMNNDNYVDPAAAYIPDPSETSQYISQGVKKKWEDKLDSLFEEDFG

SEQ ID NO: 15639 - protein, 150 aa, Candida albicans
TNLLTNMVALKQFSTATTIWFMVVKKELTLIIEYLYNSITSGTNSDIYSRYLLTTATTSKWPLYDKFYQAVKEDPAKLKFKFHIMYGQFDFMNSEAGEKLVKLLNENKVGAKYYEISEGGHNLYIDNPFDTNQKIFEIVLQDATKANNND

SEQ ID NO: 15640 - protein, 391 aa, Candida albicans
NLAMGVFGRGAVSRISIRSIHLRNTTNFVVPENYKPNRSLLKQLPWKAGLDIWWKSLSPNRLSDLQKDLVEFMLPSHLQENQRIIKEFKKTTIDDKGNYINEVGFKIINNKDKPTKHLVFIHGYGASLGCFARNFQIINKFKDTDYNYHVHFLDNLTFGLSSNPRVNNDTINYWRIPATAIVKLFDKTPTDSKKLYRKYYKLIEGYQLDPENFEKYRSYFTPILKDLENFYCSAIEKWRLNNDIESIDYLVGHSFGGYWCGSYALKYPENVNNLVLLSPVGIERHVQAVTNTDPISDRIEVPTLDPTSYKFLSRLPILSKKHILSWYYKLPHLPRLLPFLGPWGAQLYFKMWMGKLYKINKLIDKHGGAQAIFNSNNDLVYGSEERAHTYN

SEQ ID NO: 15641 - protein, 147 aa, Candida albicans
  UNSURE (17),(31): Identity of amino acid sequences at the above locations are unknown.
NMWRLSHFKPATRIWFXVSEEGLTTYEWKYXRIHSPGGINSDIKQQLFINKFQQQAKWRWYDKFYQAVKEDRAKLKFKFHIMYGQFDFMNYEVGEKLVKLLNENKVGAKYYEISEVGHNLYIDNPFDTNQKIFEIVLQDATKANNND

SEQ ID NO: 15642 - protein, 892 aa, Candida albicans
HLIGKWPKFHGQHLHFVKPSWCIYTWYQKALLWDLKRPSSNAIASILHSHNRALSDINFHPFDPEILATCAVDSFIMSGDMRVPRKPVAKWAEWRAGASQVKWNHENPNEIALCHDSSFYIWDTRKGALLVVKIEKAHEKKINGIDFTQGLKNIVTCSNDNKVKFWNLQSDEASNYISNFNYFDSAQNSPIRPSVVIETDFPIARARNLPFGSDKACGIMPLAGGNNSIHIVNYDDAYRDYLQEKTTQILSSQPVYSFKGHRGPIKDFLWRTRHECYEGFDSRKKWKDYQLVTWSSKDYDLKLWQHDDRIYKGVNYDPTFFNVFKDELDSETSRPETPRAEHVYKYDTFCCEPRITIDDITKTNGGDLLSAMTLSLIAEKHKLANTEFTQLNHLNWISGVRMGHNDSAERKNSSSSFEDDGPTNLGEEVSIVGHKFPKIRFEKISVSTGELVISLRGPLPTLESTSMDRKDSVESNENNNAESAVSLRDKSIISEGDKDTEKMSHKERENLHTESNIEKSKEEFTTDQKLVFIRLEIGFPKAYPFLEQVSSEQFKSAKKFSKLQKQNQIKFNIEETHELSTSTKNIMQENLDNIAQFYTNKYQRFCLEPCLRYLMGEKVELDDDLMIEGNQNGTDSGDSEFIQEVGDEAWVDDLINQQPDIPTYSSGEEEEGETGLADLIPAHDRTLYQTTDSEIKDDETHLGRVNGKVPTVDSTPLPNGCGAIWSPTGQLVCFFIPKSKADGDAQEDNESKAFQKFNIFKFTDGGFSLPHHQKSESIGSESGTQDDCDSDNSSEDDNDNRSVSSSSSDGSFAKDWDEMLLNDAPRVRVQGLFKTTLGLGNYLDHESSLKSSLNRLTSNGGTASNYKSSLKGDRQNFTDAIQLSNIKYCAYI

SEQ ID NO: 15643 - protein, 376 aa, Candida albicans
KSRFYWNTHPFGSSWLIKEIFDYFERKLNVQMLAMMACILYENPKNLKVASELMNVPVHTPYQALPPPPIVSLSACNSTIFGLSYGKTTVSEDTGYDHRNSALLGTIKESLAPPATAYARSITSSVGAESIANGSPDKFRVLKKNFALKSHSLGPSNNSHSSLNDSLLESNVSTPERNMRIPSLEKKSKGIVLRKPYPLKKFRPKPTPTVSIEMQNIEELDVYEDINSRSLLSSIDKDKLVKYREIYAEMLYNWQLPVGRIKLLKFNYPELEKTELTTKDIHKCSIGFKKRSQQHPHQNLLNPITTIYSKFPNSWNTSKRQLLKYCNLCQLAVTKNFTLCTVCEHIMHTACAREWWTTDNSECASGCGCRCLERSF

SEQ ID NO: 15644 - protein, 452 aa, Candida albicans
SGNFHPFYPIEKNIFISNGLLDYIDLSEFSYSSDVPSISPKFFQQPENEEKVLFFDRDPQIFEKIYNHLQGYLIHIENDHIFMNLWLDCFYFGLKNLQKNLNKHDYFAIIGNERFRIPKSLINMPGNNPNFFTINFDRLLIDNINIIERNNMLRPPPQTFPPVSNRSSKLFADLLEFFRGNHLVIMNDEHRQLLIKEARYYRFLELEQRLIKFKITFRNEIVINLNDISRKGLQNPSTSYNIELPLTYYRPYIKDEMTRDLIFELNAKDFDCQSEIKLILNKSTKLPTLKVTNKACHKLHQVFKDYFSQVLKDDKGLLFFVGFTNSKTFINGKEMNSNWVNDILGIEEEEEEEDKEGEEEEDKQQEAKNKDGSNKEVNKKRKVSKEDKSDKTMTTNKSLETNDPPSLSPGDIIEICLSRSLWKVMMRGPLARLHAVTLEGFTRSNDTLIDFL

SEQ ID NO: 15645 - protein, 240 aa, Candida albicans
NIFFFCFSVCLFRNGSMHDMLPTPTVKNIDYDEVYEPSEDSFLLLDCFEKEKDYLQSKFKTVVPLVTEIGTGSGIVTTFVAKHIVPNGIFLTTDINPHACETVLQTVKHNNDIGSSNCLLDSTQMDLTSAIKEREVDLLIFNPPYVPSSEIPEIPRTNNDPVWLDLALVGGEDGMVITWKVLNNLTNVLSKSGVAYILFCARNKPETVTSIMQLKGWNVEVVINRKAGWEVLSVLKFTRI

SEQ ID NO: 15646 - protein, 195 aa, Candida albicans
RHSLNLIVKYPPTYPEVIPQLSIKLGESPEDKDNYDNGDSDEGDSDDDDDDDENADLKLALNMAETIEFDPKTDLNDTLMNKLLEESELNLGIPMIFNLITILKEELENLFNEKLNIKQCEFDEQQKIKELNEQKKFHGTKVTKQLWLNWRNNFRKEMKYELYDKQRFENMHKGKLTGKQIFEKGLANQNDDDEQ

SEQ ID NO: 15647 - protein, 110 aa, Candida albicans
YYHFISNMSTNHRPQLESKRGKVIKIKDTIQHARGLPQQTSIKYRQDIKNEKTINKFDDLQKHDNNKITSLESISPPTKKLKIESTKEITTEPLNQEIDKHSIFTRVEVR

SEQ ID NO: 15648 - protein, 313 aa, Candida albicans
SRTMSIYSRSVSLVRCYSSAQTAMKKPFQGPLFLNPHAWKGLPADQVFELHKIRKEYMGDAYNPTDEERTAILSTISSLVPNKPPLDYAFEIENFKERLMNNTPMQDRGKPQKLSNQYVINSGAVPHQRRRIEQLTRKIAYEAPLLAKYRQPYTPRPRTEAPIRLTYNSDFTDDTSSAHNRKVALKVSLRDLNLNPKQQHKFKVLAGDKFNHDEDTFQLKSERYPEAAQNVNWLVDTFNKLLTEAKDLSKDDYSDIPLSKSHMKILAKKAVPSFPEHWKKPEDAPIKRHDIVKKLVAATEKAKDNEYIRKISP

SEQ ID NO: 15649 - protein, 229 aa, Candida albicans
TTIADTTPKEDPLPDTTYDIFYRRMNKNEKQMSNEERIKNLWELDTLQSQLERLTQYDWIRSLPDITVIKDMKDYDELERKKELTIKEIERLLQKHENWRKRKEVHSQEMKEWYGGSDSEYDVPIEELRERRKLEKRQRYGPVIRLNLGNDYCLVIDPLATPKIEKCEEPPKPKGKPITKLEDVEDISQIDIQTKDNILFGTNFEDIPTYRNGFQLPLHMRRMMHKQAK

SEQ ID NO: 15650 - protein, 139 aa, Candida albicans
SEQFMMSLKFNIELDFDIEEEIRKIMTLSPMSTPTSTFSPTDSISTVATEPDTKPNLDTISYVKSLMIDSSKLLGLYSTLKNTYLKLCKEYNYLLTKFNDNEKAKLQLIQENEELKQAMAELLQDRSSKKRRKSRKALA

SEQ ID NO: 15651 - protein, 305 aa, Candida albicans
TMVQITEVKENQSSRESRTAAHTHIKGLGLNEQGIAKPIEGGFVGQNEAREACGIIVDLIKSKKMSGKAVLIAGPPATGKTALALAISQELGPKVPFCPIVGSELYSAEVKKTLALMENFRRAIGLRIKETKEVYEGEVIELTPEEAENPLGGYGKTISHVIVGLKSAKGTKTLRLDPVIYESIQKERVTIGDVIYIEANTGAVKRVGRSDAYATEFDLEAEEYVPLPKGEVHKKKEIVQDVTLHDLDVANARPQGGQDVLSMMGQLLIPKKTEITDKLRTEVNKVVSKYIEQGVAELVPGVFVY

SEQ ID NO: 15652 - protein, 176 aa, Candida albicans
TKLFPNTLNKVLLNWCLVFLFIDEVNMLDMEIFTYLNRALESSIDPIVVLASNRGLTTVRGSDDGVKAPHGCPPDLIDRLLIVRTLPYNQEEIKTIIGKRASLEGLTLTDDALEKLSKQGLTTSLRYAVQLLTPAGVLSTTAGRSEITVQDIEECEFLFLDSRRSTKVLQETKTFL

SEQ ID NO: 15653 - protein, 387 aa, Candida albicans
EFVCLLLLSTSKYNTQRKTNRYYWNHKLYTPIMTANILDNKTFIDTVLSIQSTQNDKELHWYIINIILPDLPQIIETLQICSNLLMYNSPQEPDSKQCIEKGPSIKLPLSLTNQQDSVNGIITRDGPYITDLNLTVKNHYFNKHFHKLRLIKPMVLEQLVNVLNLIKDSIGILQNLQSIDKELTLLSEKEENEHTIKHDQLICDFKKLLVNIHDSKTNLQLPSDPNLVFPLQVTDGENFEPQLLDRIAVDFYLSQNQVCIDLKSLHRITEKPWCEIDANGKSFVDKLKEEMKNKRLSIGDKSTSDAINQNNNTNIFSNMMSHLLLRHKYDTMDYITRCITYNNMVVVVNKKFEVSTEDPILISCFTKLDSLESIINGYISSLNSFSM

SEQ ID NO: 15654 - protein, 350 aa, Candida albicans
NNIAMVVNNPNNWHWVDKNCLPWSVDYFKDKLINLKVTDGTNNVHISEVSSVEGDVDVSQRKGKVISLFDIKIVLTFKGNTAKDDNVSGSITIPELTYDSEVDGLQFDISIYNETAENSGITDLIKKQLIPQLRTALMKFGPDLIEINSKDIQLSQDKVTSTYTKANQSSTIAATADHPKSELKPVEKKTETHSTSNIARKVVSEKDSSTVPKYNTTTLHLEPSFNTSAEQIYLTLLDEARIGAWTRSAPVIEKFPPKEGSEFKFFGGSVSGKFLKLVPNEQIVELWRLDDWKAGHFAQLDMKLVQSSGETKLVVKFSGIPIGEEERVKNNFEERYIRSIKITFGFGAVL

SEQ ID NO: 15655 - protein, 404 aa, Candida albicans
KRHTPRHTAIVMSLINKQWSSISTELVQDPQNFELWQSLIEAAEWNEKRGINKSTSEEELNVLRTSYNSFLEKFPFQFKYWIRYAEWEFKLGNTSTAEQIYLRGLNTQLSHCIELWISYLNFKINTINDNISEILQKFEAARDLIGFHFFGFEFYELYLSFLDNYKNDNNEFEKKYYILLRIILEIPIYHYGIFYKKWFDLIDNLSKDEKLAKQIAPYIAPANEIATLASKKNTSIFNELKKRFTDAYIATQYHSFELYEFEKKLIPKNNKNPQQDNDLRSRQELDAWMSYIDYLEIKQYPIKFIELVYYRFLYNARNYPQTWSKFADYYIYHAKFNKARKILTDGVKYVDDYKLLIKLVDLEIFLKNYQRAINLLISYIQYNSNVPIPIRDKVHQVKQLIDQK

SEQ ID NO: 15656 - protein, 293 aa, Candida albicans
  UNSURE (283),(284): Identity of amino acid sequences at the above locations are unknown.
TMSTTQDSKKTTGTYKRSRVSRGGKQQNTAFRGSGGAEPRKGYKKNSNFDENSPSITTTTTIKQQIEEIPEDEQCIICAERIKYAALTPCNHTTCHKCTFRQRSLYERNTCLICRSENDKIIITELIDKDYDEISADQITGFDEKYRIEFTQDYVQKDTLALLENTCSICRQQQTFPEFKQLIDHAKEIHGKYYCIICSKFKKAFIPELPLYSYKQLQRHQSEGDGNGTGTGTGNDTETGFKGHPECKHCHGKRFYSEDELNVHIRDRHERCHICDQSNPIKXXNPGHGKILL

SEQ ID NO: 15657 - protein, 222 aa, Candida albicans
WIWETDPETLEEFECVAVLNDHSQDVKNVSWHPSMNILASSSYDDTIRIYQQDIAGDEWSCVGILNGHEGTVWCSKFESLKSPIADSSVLRLVSASDDLSVRIWVAKREQEDEEQAKLELPSSIRHTNEMVWEVESVLPSVHKYPVYSVAWSALTGKIASAGSDGKIVVYSETEKGKWVIDSIHEGAHGVHEINCVIWAQLDDENEILVSAGDDGYVNLWKI

SEQ ID NO: 15658 - protein, 72 aa, Candida albicans
TSIPRSFYNSIPHTPLIMNSEKIIEVIIAIFLPPVAVFMKCGATTPLWINLVLCIFIWFPAILHALYVVLKD

SEQ ID NO: 15659 - protein, 226 aa, Candida albicans
QFLPLLQDDCIENKFDAFESEEIDWIELKQQLPQDPLNQGTSYLHGEIMVIQGPTMEKRLLDMAAFAVGLSRSTRLSILETQLEDYLHLTKKNSEILANGKQITTTEHEFLKITGQLFLLRGKLNLYSELIDTPDLYWSEPTLEKIYYSISKILDINSRISILNRKLDYATEEQRAFLSVLNEKKGTRLEWIIIWLILIEVCFEIFHFYEKYEEKQNKRLNVKEDR

SEQ ID NO: 15660 - protein, 243 aa, Candida albicans
RIGLFTSLCEHERLTNIQLGLYSTVIPLSVIIIVALISTCPPKYKLYNTWVSSIGLLLSVLITSFVTNIVKNWFGRLRPDFLDRCQPANDTPKDKLVSIEVCTTDNLDRLADGFRTTPSGHSSISFAGLFYLTLFLLGQSQANNGKTSSWRTMISFIPWLMACYIALSRTQDYRHHFIDVFVGSCLGLIIAIWQYFRLFPWFGGNQANDSFNNRIMIEEIKRKEEIKQDENNYRRISDISTNV

SEQ ID NO: 15661 - protein, 296 aa, Candida albicans
TFDINNRYHLSAMTFLNPSSIVKYTQSNQFHDFIPDWIVATVTVLFFFLVAETALPFQRQFSLDDLTISHPFAIKERVSGILCIEIAAFVPLFVILTSLLVKYQQGAFSSHQQALHCLQISVLGLIISLSLNGVITDILKIWIARPRPDFLERCGPAPGTPLHELVDVNVCTAPLGKALLIDGMKSTPSGHSSISFGGLFYLTLWLLGQFKLFQNRESPQYVYKYFLAFSPLSLATYIALSRTQDYRHHFTDIVLGGAIGISFAWWSYHHYFNKLVSEESHKPIDSETLTELLLPH

SEQ ID NO: 15662 - protein, 128 aa, Candida albicans
TFNHLPRTTGNRMIHTIKRHTNCASIRKRFFSYSTINSQVQLTFFTKDNCMLCSNAKFILYDALKSPKLKNMPIKLTTIDIMDPKNQEAFDKYCYDVPVLHVDRPNQAKPVKFMHYFYEDKLLEEFTK

SEQ ID NO: 15663 - protein, 378 aa, Candida albicans
FNRKTRNQTQNKKRKNIFVGVSFISQYPPLKPFQNNIPIMSLLKRKIPLDEIEDFIAEEEEEEEQNDDGSYEEDNEFVGPSGTATPLDESEIQHVVNQVVRLFLSRELNGRTTRPDVIRKHIKHNLGRKITTEKLIQQANIILTEVYGLKIEEVPTIKREDKKSLKSRKVTSDKNPYIVTSSLLSKSRAILGELWNKNLAKNVKKIDIGGNKFFLPKYSITSVPGSHYELVKTGIMLVIISHIILNENHVSESALLKTLHKFGISSNLNVKNSNFNLNSQELLKELVNKDYILKNVIKGRTELENIFDYSIGQRSLVEFSPQGVFDYIKVIYGNKFDSTIAERALVTIERAYGVALNNTEENNEREGSTEANSQEGSE

SEQ ID NO: 15664 - protein, 361 aa, Candida albicans
RGYNKKKKKNDEKKKIKNKQISSSKVMSFSATAFKFKLDTLLDTQESIVSISQWVLFHQKYYKESAKIWLNYITQDSITPAKRLSLLYLCNDVVQQARRKNKPEFINEFNKVLPDALSKNYGNLNPKVDRLLNVWEERKIFTEDEIANMKASLEAEPKPLESIDIAPQLKQINDLFVHLNKLNDINQENLTQMGIQSKTYLYPQEPETLPPAPVYLSKLYMLEKLGNVCINNVEEIKETRMKINSELDSLFNLIIDGTKTDDSKIANINEKIQKAKETIRDVNLTSMEAGSDDDDFPGYLSDSEEEEETKKRRLSQTPSGGSTPSKRVAFSEDVEVFEDPDENKEESVSVDVMSLLSKLVD

SEQ ID NO: 15665 - protein, 159 aa, Candida albicans
KASENGRQTADTELSTECKSPAKEFSTRQSHRVRPARLVFYDTKGGPSGTGLSYKCFECIDEVIRATFTRVKNCKCVWGCPLCVVSSACKEQMRVLSRPAALLILASFLGMNLSQLKDDLPIGPEPDIPELETETIMYANATVRFSPNVQILNVLRRRT

SEQ ID NO: 15666 - protein, 178 aa, Candida albicans
NCIMNLIDMLSKDPPSSLYNPELEENIQNNEISNGISISESQDNIILDNNSNGNINNNNNNDINININNSNPPSIIYLPTPLTELQKSFVEMTLHLFSSELLNEVRSKRLKTSIDNLLDSSTTIEESDIIVNQNKISLCFEQLSIICDHPSLLIEHFIPKKMLLLETNERQLNLSGKL

SEQ ID NO: 15667 - protein, 187 aa, Candida albicans
TINNMAMRTRAEKRMRKFLIEQLKTRQQNGARIAQGKKSEHELIKNNLGPQVFVFRNLFSGQVLYSQVPAYHENQINQQFLSPNWQNRKPSRRQDLWKIMCVVNFNNYEYAIAAYKGLVDLRKTRDVVQKTEANEMRKKNDEGNIWYSGQFRPTYTQEAVADLTHVIDEFELEGHKIFWANEWHRGE

SEQ ID NO: 15668 - protein, 279 aa, Candida albicans
SPGNIVIVGWIHLFTLRNELDESTSVKTPKKRSFAKYSEVTSAADAQLNSRRNQILTKWSAKVANSSGRNAMNANKFKTINQSFEQQVNNNLSDMDRLIKRTKLNRRNVTPIGYTTKEEDDHENGNKNKSIDEDDDDIPEDTSVRKKTQGLENDYIFDDEDFYRVLLNDLVDKKVQTSDPTSGITISLRAAQKSNKLKNNVDTKASKGRKLRYHVQEPIANFETSRGSWRWNDDQIDEFFASLLGQKVNMNEIDDEQEEEQENDDNDIIPEDNGIQLFG

SEQ ID NO: 15669 - protein, 226 aa, Candida albicans
GIMILEESKDNAIFQHHDGGSENESEDEDTGLRNEHYVESSKSKLRQQNEGVNLGEKYVGNVTSRSKLYDDEDDKQPTEASSGEELDAESAEEEEDEESEDVADDDEDDQESDRSSSSDAENDEDENISHKRELLKQLMSKERSHIVNRLSQSATNDALKGYSIQQQNKTFEKIIDVRLKFQKSVTSSNMLPINTSTYSETKSEDSDELVTKAKKQLYIFTRGEIK

SEQ ID NO: 15670 - protein, 462 aa, Candida albicans
QYFFMANKRRPKKTRAPYRRYVYKSNNYLADSDEDEEFEDETEQLETTIQATNNARFKGAINVQSIYVLSDQIRYQGKMWPWSKFEKVDILQCALQGHNPLYAHTKVEDEPTQGLMKFPAEIFVHIFEILNAWGKLKPKYMRVCKLFYLLILPIIYRQPQLKATNFFNFVEAISSNKSLGQYIHSLDLSYIIQSGKNAFVAKLMKRAGKNLEILVAPQTSFGLGPLIALKNCLNLKVLDLRLVSETLNLEELFKSIRNLTELTQLSFPRSSVEIHDYQLINWPPKLTFLRLSGGISDDFLYQLEFPPLITQLEFAHCPSISDLGFRQILYRIGANLKTLKVQYPMPGLKKNSLDQVSVYCPNLRVLEISVDYVSSMFFDEQYLGYMDYPRPLRTLYINSSGMLGTLTRLDPIDLAVALNDGRLPHLKHIQCTAKLGWDPLSDALGYIADELDERKGGIYIGY

SEQ ID NO: 15671 - protein, 268 aa, Candida albicans
IRRALFNSDIRSHTTTIASSVETDHEDNNNGAFIGDDGGGGGDDIHGDIHSDGNNDGGDNNSLTKHVSHQYTRHLHNSTPSLRATHNLSSDSNLCPVCATNLLKLYIADIHSHAQDKTYLQKISNEDYEKFKEFHINQCLTNFDFDTNHSNRFSPDNLKTLKNKMLVYNIPPIPKPMYENIESGSNSLPIEKANKLEEIKGDAYDDEDEDDDEEEEEEDNECVICLESLNPGDKVGRLECLCVFHYKCIKDWFNKKGYGECPVHFLHK

SEQ ID NO: 15672 - protein, 226 aa, Candida albicans
DNDDPNEQILGLRFDLYSNYTKCFQQHHYGILRKLPFEKNDSIFYNWIVYKHTLPSYIPVDEYSKILNENDNENDNGNQNNSLFKFVESIQFTLTKTQYKLDKFNQLLRFNKNQFGLDKDEAIFINLDCDLLGQRIFLNLSHNSQSQIKKTQMMGVELICSNDLIEVIHFNNFPDIIHSNQLLICQTILQNSKINDLIKNFRKVIQILVKYKVIEYTDIVFTKVED

SEQ ID NO: 15673 - protein, 489 aa, Candida albicans
IESLLSFLWTMVPPKKDAFADLFQSASSGNSTSSLNLKLNNLSLSERQKLQQQQQQQQQQQRQQAFQQPTKNNLLQSQSQNNSVNSSWSNIDILTPSRTASPVSNSGNSELGVSLHQTGILSAQPEDPFLIFLESKSQNLSSKSDPTPVNRDNSKSAEISLLDDDFTDFFQESKSASKSVASPSILSQTSEAESHLTVLHSKRASNRANEQKDFVVAELVDIGFSVEDANEAINKRGLDLQKCVNYIMSKNSGNSNTDMVENGGSVLGQRSEGIKLNELGTDLVKKANSFYNFSKRAVMQNLEQFSGPRSNNDNIPAWMKTKEKYESDAMEKKYGGEEYGTDEENINQKDIERFMKQQRERNRDRSRARFENWIDGKPKQSHPSSKESSPELPQRPLNSNRHGIMSSQKREPPRRNVQQKASIELPQRPARKSQVTAPPERPTSINHHASDPVSVDSSVNSTTPDEDLLGLGTSGTSNGRNAPAPGFFS

SEQ ID NO: 15674 - protein, 319 aa, Candida albicans
IGNWRKGQKKGNSPELLVIVPNRPKKKKFSKPRNQALFLKKSESIAYTMLRRTISRQFQRSQSTSTKGFWSDFSKRSPSLRIQNENIRKGLFEGIDEQGPASIKNSNIREIYHSPIAIDETFSEAYKILEADASKKYGRLEKLQEEYTKIEDKSSTKANSIKREIEELQIETELRNPEVLYNIEYNSADVIDKSQPIYRKLLKEKWKEHDLLLTMQRLEQLHVIPDTLPTLVPEADVKVKFSHNVEHEFRDWIAPGSILPTFAVEKPPVVQVQEFDKVEGNERLYTVLLVNPDTPDLEKNSFSTTLHYACPQHGEEGPS

SEQ ID NO: 15675 - protein, 204 aa, Candida albicans
ARMPPPRGEDVNDEKLVVINEENKIFEFFINDKDGQLLTPWSKRNSEFLPRQFISLQDKPEGMFIQQKQEKLWIYGSTWLSFFDLSMNIPISKIYKNTSTSKKRNHDGLSMNEEIGELEDETEEIIEASLKQSEIDRLRHQIQTEDKDNQNNVDKTKKPFWITEKYRPIMKVANFGGNDDIIVVERPYSSLQTGPAFDLPKIKV

SEQ ID NO: 15676 - protein, 204 aa, Candida albicans
RHYLIYTIITLHTLIYYYSSSVRKKKKFFFSILKPYNKETQIFNLFLSQTNKNIYTKKFLIMDIHRCRFVDYTPHTITSLAFSHKSLLTSLPTADVRLAVGRSNGDIEIWNPRHNWTHELTLPGSKGRSIEGLCWSYNEQDPLEPPRLFSIGGSTYITEWDLSTGRPLINYDCNAGIIWCIDINPQNDRLTVGCVFTTGLEGSA

SEQ ID NO: 15677 - protein, 186 aa, Candida albicans
RGSFGPPCGARRSLEYDLICQRQDARVLSVKWANNEHVIGGCADGRIRSWSSEGETKGRLVATMKVDKAKTESTLVWSLTVLPNKKQFVSGDSTGSIKIWDLTRFTLLQTFKIHDADVLCLVHDVKEEKIFSAGVDRKIHQFDLLNSKNSSKWTHSFNRLLHSNDVRSLAIFENKNYNLLVSGGVE

SEQ ID NO: 15678 - protein, 121 aa, Candida albicans
VISTPSLDTPQEPEIPKDPFEAITPIDHLEPTEQPFTRIQIRFPNGKRLVRKLNPDAKVKSIFEWLKYVLQNDFQEYGLNSPDDRFILSNSSNKAFKFIDSLDKTIEEANLKNASILLEQD

SEQ ID NO: 15679 - protein, 329 aa, Candida albicans
INNQVLLDQSDIFGNRHQGVFHQRFDFQQRMMPGFDDYNDDNNNDDRIEEIDDDDNDDIEYHDSHDIQVLDSDDDEQGHYNGAVGGITGRRRQLRQNRHQELSSTQRRLANLFRPPFDIISVLNLDEAKYQGRQLKKWILINIQDSLEFQCQVLNRDFWSNERIKQIVKQNFIFLQYQTDSVNGQSYVNFYHVDTFPHIAILDPLTGERVHKWTDGQVPLVNEWIEQTYKFLDSFSLIPGSKNPLVHHDVKIDPTSLSEEQQIELAMKQSIIDNNVDNNNNTSYKSGNTIDDAIELDSDSDSAIPDESSQLHHWTLHKNQKYQKIHLKL

SEQ ID NO: 15680 - protein, 263 aa, Candida albicans
CISNQLAKQYKHTSNKYHYYIIIMNRLVLRVLSKYTRFSLPRLQFQNIRFSHSFPLRDYQQKAIDLILESSNSGVKRQAIEMATGSGKTVVFSHLIPLLKQKGTRALVLAHTQELITQSRDKINKVNPDLKVGIEMGKVRSKPDDDVVVASVMSLARSNRLERFNPNEFKTIIIDECHHAVAPSYLKILKHFHADTKDTDVHVIGFTATLARTDKQKLGTVFDKIVFQRSLPTMIENKELAEFKISNVNIKDLNLKNVPNKVV

SEQ ID NO: 15681 - protein, 353 aa, Candida albicans
NKQHSILVYILERKRNRLQSERVANSHPLIMVANCFTPRVLVKYMKYKLSPIQSWYSKRLIHSFALRDYQQEAIDSILEASESGVKRQAIEMATGSGKTVVFSHLIPLLKGKGTKTLVLEHTQELIAQSYDKITRINPDLRVGIEMAESRARLNDDVIVASVQSLATNKRFTKFNPDDFKTIIIDECHHAVAPTYQKILKHFKADTKNTNINVIGFTATLARADKQMLKAVFDRIVFQRSLATMIFNKELALFKASKLYFKRLNLSNVKMKGKDYDPKALYNAVLKAGINEHLLLAYMELEKEYKSTLIFCINVEHCREVCALLQKQGVDARYVISETSNSECEYSPRPRRSA

SEQ ID NO: 15682 - protein, 612 aa, Candida albicans
NFTTMSSRALRRLERQKLENELSISPEPERNGNDESDFDDSPISKPKANAFALLNDGDNETDDEENSDNDNKEDESTEQTRATPKQPNEPPKNKNNKKKQQQKKATTNKKKQQNKIVDEYGDDEFDKILEQMRIKDDQTTTLSVTNQKTLINVYDFEEELDEITTPTPDFDSNFKAFTTNRLKQSLSLLSIKSVGSLDQDNEYKNLFGNLSMNTIEDANSTTSMGMSPEMLQQFKRLAKLTRGWGGKDRRGIPGTTRKLILSKIEDDWLPTTLKPLNMEEIKPDDYVKFLDYKEDTADLEELQLKINKEVNLGVKYFQFSKINNIKERVANTRFYASVVMSPDPESLMQQLQQYPYHVETLLQVAMVLLRQGDNKSTSNALVERALFAFDRSLHKGFHELLYQASNGLARLPYERFMNRQFYLCLFRYITALGERSTFYTALAYCKLLLSLSPAEDPLGVRYFIDFYALMSEEWKYMVQFAESPLVTTYTRWYTPGIAFSTVLAHLKLNQEEKARGALKKAFEAHPYTAYKLYKQIGLSNDLSLSEGSFKIDTEVEIATETYLVRCTIMWNDQSHRQFLHDELEKLSSDWKLQNSNNGVFSSILGSFGFTDN

SEQ ID NO: 15683 - protein, 92 aa, Candida albicans
HIKMGKAKKTRKFAAVKRTLNTKKDQRLTQNNANNNNTNKKKGGGGVVDDPELTRSFPQVSSALFFKYNESIKPPYQVLIDSSPRRGKSALA

SEQ ID NO: 15684 - protein, 93 aa, Candida albicans
  UNSURE (82): Identity of amino acid sequences at the above locations are unknown.
TNQPPIMLKWVQSGLSAVAGTAKPEYGPDAIQPITKRIFDTNNGKIYRATETKDLEWLSPNYTNVETQTFYFNDLSHGDYGXAQNIPSQSSWG

SEQ ID NO: 15685 - protein, 159 aa, Candida albicans
TMSFDEGRNNSLDQVVSQDNTKDKDNHNDLLPQPSGQVSTSSPQKDNTPPSPTPSNDDPDPLELKKLSLNYDYLMYKIKDYINTLTEQTYQSILSKQYQINQEYLHDQLNLFDNYETIDEMLKTISQLEMEFLKLDQLEVFIEDFKQRLNVLEHEFDKL

SEQ ID NO: 15686 - protein, 254 aa, Candida albicans
RLYAYHAQQWLEQAHRAQLTTKRRISPLGVGPESVQRGNRKLRWASMFDAMRKAMKKREIAAAKVNHRKSTAELQANQNVTEPKPNSDRIPTPAELSRLKFERDKTLHENHINQQATRARMVQAVAKPAPPPPPPPKPVKRPTTPNGTPLTNEQIQHLLQMQKHRRMLQQQQQQQQQQQQQQQRRIHFPPAQVSKVINDIQQQNPGLSKDQVTKLAAQYLASLLQQGYGVPSSPVPPHQKNQTASPMSGSPNNA

SEQ ID NO: 15687 - protein, 212 aa, Candida albicans
SSHGGCGWLVFLFTKKKKKKKCTKKFLILINHFFLHCVKTTSRHKMGKRRVDEESDSDIDVSSTDSETELESTQQQQQQQEGATTIQETVDVDFDFFDLNPQIDFHATKNFLRQLFGDDNGEFNLSEIADLILRENSVGTSIKTERMESDPFAILSVINLTNNLNVAVIKQLIEYFLNKTKSKTEFHIILKKLLTNPSDPTRNLDIYTGINN

SEQ ID NO: 15688 - protein, 193 aa, Candida albicans
AGFQPVVKTMEITFDPGLNDKLGNNAEEEDKEETTIEAYRRKEKERRQKRLAKFKESKQTEEVANSQEGSADKSSKNRKNSKKGKSMPDMDEKSKAELELILMDNQEGNNNEHFSMKEVIKSEKDKKNKKNKKGKKIDQEMVQDGFVANLDDPRFKEVFESHDYAIDPTNSEFKKTETMKKILKERSARNKDK

SEQ ID NO: 15689 - protein, 473 aa, Candida albicans
QVIYNLKIMAKNNNNNKDSSNPRKPITQDERFKSVHNDPRFKMPKLKNLRVKVDDRFSKDELKKLNAGALGKKVKIDRYGRKIKKESDDLSKFYEHEEDSKEEQSSDDSSEGEESDDDLQALTEKLQQEEQFLDRARGEGLVSSSEDEESSLSSSDSDSDEENEGVVEDEEESDIEIEETKPEDTEPTCAFAVVNMDWDNIRAVDLMATFVSFVPKGGAIKSVTIYPSEFGKERMQKEEIEGPPRELFKSKKKKEEDSDSEDIESDVDVNDADNLAKITRKLYEEDDGKEDYDSKALRRYQLQRLRYYYAVVKCDSVETARLIYQNCDGTEYESTANIFDLRYVPDDMEFDDDEAKDTCSKIPSSYRPDSTFVTDALQHSKVKLTWDETPKERLTLSSRPLSQKEIEENDFKAYLASDSDESEVEKDSSIKDKYQSLLGNTLTKFGKEENDDDVDMEIPFDPVFTHDAARTIV

SEQ ID NO: 15690 - protein, 200 aa, Candida albicans
PPVTSPVWHIGILSLFAGHPINFWQWLYNLLAIITLPVYVSALINLKTKPRNLRKISLATIVYVLDTFIGSLYTLYFIYFWFSLEEGSVKSTGADLSSSTLSSQSASAARELFITLGTTISVTFIRLYFTLVILSFAKALLKQNRMEARYNDVQNGTSSRSLEQEEEDEVANATGYFGEFRKAIFDLEVRSKEYLDDLFN

SEQ ID NO: 15691 - protein, 345 aa, Candida albicans
LETSTMSTTGLQRRRGAKQSTPKPRNSDSFDESRSPASPNKPDHKIGYDDKDIKDPSTLKQPLLTLMEEVLLMGLKDKEGYLSFWNDNISYALRGCILLELTFRNKITLVNDPARRRFELSDRLVEVIDAEPTGEVLLDEALKIMKNDESNLSVTNWIDLLSGETWNLMKINYQLKQVRERLAKGLVDKGILRTERKNFFLFDMATHPVADKLSKEYIKNRILSMLVLRNVDLDTVSNEQFPADTSFRYLRTVSLVCGAYAANVLENVLLSLNYEKRDQAFARADELLADFSEFPFNLSHQSPLGLGLNLGQEVGDEIEKSSASELQLELIAAVLSVFARMDSIL

SEQ ID NO: 15692 - protein, 137 aa, Candida albicans
CQCFFLIHNIWTSTELGNRRLDKAYTELSKTNNPDVDGKIFLFFLVNSLGKFCGIAEMKSAIDFTTALNIWCEQTRWKGISPVEWLLIKDVPNKFSQHLKIPANDYKPVTNSRDTQEIPFDIGISMLKIVSSFKSND

SEQ ID NO: 15693 - protein, 619 aa, Candida albicans
LRYTPMSVVNDDFKPLLIQWVEEEAINATKRGSKMVDLYNKILFQLRGYELPICDLKTLKLIKYVGDKTANQLRKKIAKHCKENELTLPRGFMDVAEKHRLDLEESNLTLSTSTIKTTNKRAKTSSKSKPKYVPKHRSGGFAILIALYLYDKDRNGMTKERIIAGATPYCDRSFSNNAASKEFYSAWSSAKTLENHNLISTTGRSPKIYFLTDEGVSLAQQLKTAIGLSSPPEGSKKDDRNMIMEQSFDNGIRLDTSFELSSPAGRAMLSSSPIRRISNPVHSNRAIQKMLEKELRNGETPPSLQHDAGNRIYDGIKYEVWRKEDYEVIVYMDNREIRSRADRDHFQTRLQTLGVKCEVKPLSSGDVLWVGRNTSTGTEAVLNYLCERKRLDDLCDSIKDGRFQEQKNRMKKTGIKHCYYLVEDMVSYQDKVYDLMDSIQSSLTQTMTTARLYLRRFKDIDETTAFIASNTKVIENLKSNLIVIKPQDIKNQQDYLNILLKFRNKFEKTQPHQDNPDYECVQLFSRFQDMLGNTNQMTVKEMFILMLMTIRGVSLEKAVVIQNRFPTPKSLLEYYHTEHATTDTNIKRDLMMNEFKDQIGNKKIGKALLEKIYNVWGKP

SEQ ID NO: 15694 - protein, 681 aa, Candida albicans
ASRHLDFQFFFFQVNPIFFYSIRSFLKKLLFFLLSFTITHPFLRIMSGPIICSKFDQSGNYLATGMVALDSHQVKVQSITSSQASLNTSFTLEKSNKLVNLAWIPSDSIQLLALCLSKGSILIYSPQTNEIVLELISSANVSILDFHYSTTTRTGWSCDIEGNVYEWDLNSYLLVDSFKVNEYIESVDSINRISTVMFNSQPHLLLGSNAVYLFNIKQRELVKTFPGHIQPVNSITALNNDMFLTSAKGDRFVNLYQLDKTATKAVFVGLSSVSSLSVSIKDDKSVLVIINEEGDIEIFNNPLADAKSQVSTPVPKKKRKQVGVSSRSFNASIKLSRPEPEIKSPQDTHLFINAVSTEDNLITFTWLENSTIPFFDTLKWIDETGSLLLESAKVLLKSKPNLKVTQHLTNGHDVAAPKLYTEGHTIVSDGSNIRDLEFQDHQEDEEDTEESLAEKLERLAMDQTSQQKSRRRKLEEARSGVSLSIVLTQSLKNNDQALLETVLSNRDPITIQNTISRLDPYSCVTFLDKLSEKIQRQPTRFDQVSFWLKWILVIHGPTMASLPNLSIKLSSLRAVLNKKAEELPRLLELQGRLKLMDDSAALRNEFSAEEIAEDLEERSDIEYNEEIDDAKYVGVISDDESMDDVDDFDDLDDEEEEEEEEEEDGIPDAANLDDREDSDLE

SEQ ID NO: 15695 - protein, 218 aa, Candida albicans
ISICNMSESEKMYISYNNIHQLCQEIAPKIKEFKPDLIIAIGGGGFIPARMLRSFLKEPGQPNVRIMAIILSLYEEIESENGIEKPGTQVVRTQWIDYHQSKIDLVGKNVLIIDEVDDTRTTLHYAVSELKKDVEEQSKAKGADPKDTKFGIFVLHDKQKQKKAELPDDIMKTGNYFAARSVPDSWIAYPWESTDIVYHQMKAEEQGNDVFLPSSTLE

SEQ ID NO: 15696 - protein, 587 aa, Candida albicans
FSSRPYTTSFSSYLFSLLIIFVLSLPHSLPPLPYDIDPLMGPSQVNKRQHQLQHLVVHLEKSKTHLKHLGRQRKLMGSFYLLAGKYHDAFQNFIESLTSLKKSDDFLWLASALEGVAVSIVLMQFIGTAYQLPNQTMNPVLQVSKIRGSIDTATVRKTSIDSNVSSPRNSINGSNGFGFNALTSAIPDFNNLPVQELLKIITSRVVYYFSMSTNDIENMVPDIVYVESILRRIKLLIGIHFSSSMEDIVKGTITPTPNGSFPKIEIIDEIDKIFLLQITDLNIVDQCRIYSALATMYADLGLMRKNAFILRLLISAILPHLSSGELPAQSIKEVLENVFVLYDICDEPESFSEAARFHGQSNWTSLQIQLLRLALKVAENLNDQELLLKLCTLLLTRYTHCLPTDDQIKLKNKVDLALKSNGGLSIPYWDPFLVRKVKFVNSKPRGNLIPMKETLNSNNSLQPFFDPYTKKESDKAFVPTLVKDDISQLKVTLQNPFAFEVEIHEITIVSEGAQIETIKSLIRPLESITSKPSSTMPNGNIVNNKLRGHPGKKSSSTTLVVHPGVSHTTSTNSASTFVLAPKSMEKC

SEQ ID NO: 15697 - protein, 199 aa, Candida albicans
  UNSURE (185): Identity of amino acid sequences at the above locations are unknown.
YMWDKYNFITPAKVRVLLVPINDCTPSNFQRYLHLIQTNVGEVRLLDIRENNKLHYFNSVTSPQGRIFPEFITSSIDNELIFLHDFDPFRKTFIVLGVGPYGQDPSTALVELKKKYNTAIVHNVILFDTPEDKLNEQVPEVFFHNGTTSHLTALETIFCDISGNFLEKLDAYASAYANITLRSPXSITDSHVLTKTINL

SEQ ID NO: 15698 - protein, 391 aa, Candida albicans
  UNSURE (384): Identity of amino acid sequences at the above locations are unknown.
QCPTNNIPVLQLNRYRLVSRIGDIHKKAYQLHVVVCVSSKRQLFFFGNFFFFFFFLSSPLTTMANTIVENIQRIPPVTRFFTLASVMTCLAITSFDALPGLFCNYHTLSNDFAGIYKVYQKGNSFNTAKAIALQVINSYKFLTSTLIPSDVLSSQRWNALMDIYFFYTFSNHLEAYGGKFNGNFPDYLWYAITCGTMVNVFALFYNAFFDPMPIFPHDCLLACLTYTWSRANKNAKINLMGIVPIKAYYLPLGNILIKLILRGPSGLVDTIIGILSGYLYLCIQLNTLPVYNLLPDAYGKNTEQHTDARRVGILRYVDNGGSQYEYIGDSIYDKGYWKAPKFFYNLLGYPSKNSVRTTAFDSTPRNEESATTGYSWFGSVARLXHGDREPR

SEQ ID NO: 15699 - protein, 272 aa, Candida albicans
TYSIMAGFKKNREILTGGKKYIQQKQKKHLVDEVVFDKESRHEYLTGFHKRKLQRQKKAQEFHKEQERLAKIEERKQLKQERERDLQNQLQQFKKTAQEIAAINNDIGFDQSDDNNDNDNENEEWSGFQEDEEGEGEEVTDEDDEDKEKPLKGILHHTEIYKQDPSLSNITNNGAIIDDETTVVVESLDNPNAVDTEEKLQQLAKLNNVNLDKSDQILEKSIERAKNYAVICGVAKPNPIKQKKKKFRYLTKAERRENVRKEKSKSKSKGKK

SEQ ID NO: 15700 - protein, 337 aa, Candida albicans
NTFSCFCNEPSLYVMSVKQETRPLTIPLVTNPEVATTLSKFTFQNLDDLNDPKKAYLLPLATIALIDLNAFFAQVEQIRLNLTNQDPVVCAQWNSVIAVSYASRKFGITRMDTIASCKSKCPNVIIAHAAVYKKGESHWAYVEGLPAINKHKVSLDPYRRESRKILRVIGKSFDLTEKASVDECYIDLGREIYKRLIDLFPQLSRGSRDNPENSYANLPLIPPTLPLNLKWEGEIINTEKEKSEDNDIVSPPVIEDWDDICFIIGSQILLEVRKDIFEELGYTTSAGLARTKQVAKLAAGFKKPDAQTIIRNSAINSFLTNFSFIEASLKFSPNKTD

SEQ ID NO: 15701 - protein, 480 aa, Candida albicans
NGFEIWGCMEISSKAFVATHIAEINAVMNMSRRSMLANSLSEVDLDEDEITVEDMEQAEEKDDDSKIMQMNEEELKKISTHHVLKFTKSQKTTIELLQIMSLGHESLYGYKAQLGQLTHRQTLSVLNILSPLINNWGRKYKEFLVPSSTTTNNKLVKLAPNLPQHWLDPESKICREIADTIERETFIIEFNYVKLYIYSLALNQSPKSMLEKGTKIKLDELSKSAKYIEQAFHAANETLNAAHRIHRFKMLRFMPVRLLTRFIRAAAFIVRCHLTMTAQENISLSVSKITIDEIIKSTHRAAMTLRECSPDELHLLSRYSTILMVLYSEMKSKRNRKEEVDDENNESAVVTETVMQDNSSGNALEPKQVPGGSTVNASGTHFLSASSGASNNGIPGMGQSTATQQSQPSHTPVGLTPGTYNNSHNNSGPAAINTGQMEMNENSSFPSVPPPVEDFDFDFNIDELLGDGFQNIVDLWSFLN

SEQ ID NO: 15702 - protein, 525 aa, Candida albicans
LFHRENWALIYWFVAIKKKFIVELVLMSIVEPEVAESTGGDAPQTSVKSPEPSYQQLSQAQGKYKRNYRACLNCRLRKVKCDLGPVDNPHDGKCARCLPERKDCVFVESKRGVKPNVVNGKRKRQRASSRAMSRLETQSPDSNNVSSTTSTIASQNDNTNVPLINMSINNIMQKLPGVESILPKDNTKNPPHSAFSNPSTSSPSSSLSSMPMGQPPQLPPISNKPSIQNQLLLANSKSLSNEFATMESALVFLANAAGEIAKADERDNIDAQSKYDQIEASLSGANSHRVSIDEPMNHQQQQEQLHPHYQQKLQQNHHHHKPPQQELHHLQPLNIPNNAPESFTNNHRIQTEQSNIPPYIKPTTSRRMFVPPAESGNAVRPKGSNKLSSIDYIGPAPRGILTEDEAKRLINLFFATMHPYFPHIPKFLHSPKVLSNYPILLCAILTISSRYHPFETDMTNQTNGNGAVPRHIEVHDRLWLYVQRLISQTVWAEASTRSIGTVFAFLLFTEWNPRAIHWTVVRLCK

SEQ ID NO: 15703 - protein, 186 aa, Candida albicans
VLPASWGEDEIMSTDNLFEDIEQDNNPSFYGNPSILNDPYRPIQPPPPQQQQQQHQENESKQSHTKSPKPPLQSIHSGTSNAHPQLQPQHKHKHNTLLNNGYPNELVNSTIGLSNRILELLNDSQLQVDIINSEKLVNSSVIVYTIELSSPTTKIVVKRRYSEFKSLRDNLLKLFPTLIIPPIPEK

SEQ ID NO: 15704 - protein, 422 aa, Candida albicans
TTLKINNNMSPMDIDTEVSTVLATIRLKSDNSELNNIIYQLEDFYERKLWHQLTQVLDQIYYTLDSTIITSNLKNRLYNLFIKQFQLKLNPIKVVDYLLESFENDPKETLSTLLTLKKDFINDLKRSHNYRVTDDDNDDNEEEEEENQDEELKQLIQDDEAVIYVKLQIARYYLKLHQLNKAEDILIDVAPKFESLNNNLNSKINSAYYLEKTEHAKILNNYNDSYSNGLLYLSSVTNLTDEEKNKLRYELCIAALLGDKIYNFGELILHDIFQEISQPSSSTTSSQYNWLYQLIINLNAGNVDNFNHWLSIAIKKAPILEQHQIFLKEKLTIMALLELVSADKKLSFDIISEKTNTPIDQVELIIIKTMSLHLIEGYINQDQQYVVVSWIQPRILNLDQVKNLIQNVEHLSKNISLVCKNF

SEQ ID NO: 15705 - protein, 269 aa, Candida albicans
AKMEDISEEQEFKYGEHSLQKIKVFKYSSTNASTYIYIHGGAWRDPSNTFDEMRPVLGIPNANLIGINYRLSPEIKHPEHLIDILRALRFVKQNFDVSQITLLGHSVGATMILQLLHYRQIIRDGLKHTHKDDLSSLDNLFAYVNDNVLLLQVIFLDGIYDVVELLKEYPDYASFVDDAFVSNKHFADSTQLSSANESLDLPFSLVSKDTKFLIYQSLEDDLLSMKQTHLLIDYLSSKNQGFTLHVGNWGKHEEIFGKYREIVFSGNVP

SEQ ID NO: 15706 - protein, 905 aa, Candida albicans
  UNSURE (9),(883): Identity of amino acid sequences at the above locations are unknown.
ILDLPGVVXIATTNSKDFENLMDVYLSSVFEPQLNHTDFLQEGWRIENQNVHDISSKLEFKGVVYNEMKGQYSNSAYYFYIKFLESIYPSLNNSGGDPKKIVDLLYEGLLEFHLKNYHPSNAKTFTYGKLPLEDSLSKISKYYESFEKKVSSVDVKQPIFSTDKSEIFDVTIPGPVDTMNGKETSEQYCTSITWNLGNPLDPNMQYDIFKWKILSSLLFDGHNSPFYQELIESGYGDDFSANTGLDSTTALLSFTVGLNYLTKQKVDNFNEKVMEIINNKIIPELSNEESSSYHGRIDAILHQIEIGFKRHKPDFGFGLLSSIVPSWVNGVDPIDTLQVEKILSHFKEDYKQNGLRIFKELLEKTLCNPHSQKFKFTMEPREDFTKQLVKDENLMIEKRVSELTEDNKKAIYEQNLELAKLQLEDQNTEVLPTLTIDDIPKRGDFYAIDLGQVNKKVVHERVVDTNGLVYANALKDISYLPTKLYKYLPLFNNCLTNLAGTENTPITELETKIQMLTGGITFSSKISTDPYNIEQLKLQYVLSGMALKEKSSSVYDLWLEILTTTKFDTSDEVLEKLSVLIKNMGQNQINNIADRGHSYAAAVSSLKLTPLKYISDIVSGLSQVQFVMELNSKLESEGKEYLAKEIIPILQEIQKYVLQGEFRYRLVGNQEIIVENEKLIEKFDKDISSNRPTLSLTVTDGLLALLNSFNYNHTSENVLVNLPFQVGYSSLGKIGSSYSSKDGASLQILSQLYSFKNLHSKIRESNGAYGGGLTYDGLNGTLNFYSYRDPNPVKSIQTFRDSLLYGLDANWNDKDLQEAKLRVFQSVDAPINISSQGASAFFENIDDYLRQERRENFLGTTLKDLRDVTEKYLVDNQNNLVTXIGDNEILNVDNKWQIKNFKYRC

SEQ ID NO: 15707 - protein, 153 aa, Candida albicans
TTLSIMLKTRLKQSRAISRVVRRYACSHPISPNLDKYPVGLKLHGYEVTQTSPIPEFSLTAVSLKHTESGATHLHLDSPNDSNNVFVIAFKTNPPDNTGVPHILEHTTLCGSKKFPVRDPFFKMTNRSLSNFMNAMTELPVFTTKLEGTRLRK

SEQ ID NO: 15708 - protein, 380 aa, Candida albicans
  UNSURE (359): Identity of amino acid sequences at the above locations are unknown.
LCTMLSPQDRQDKLVRATDLDALSCKYSINRNLYLNPPDEFVKDLVESYQRYLQYCVGYTGLSSSRALKGLFQEKKMPIINRGSYLRTRAIDQVVNKFIGEFKDRCQIVSLGSGSDTRAFQIFKSHANVIYHEIDFPESAKVKKLAILQNPVIRELVGTNETLPLINNKEQFESYSSELHTEKYHLHGIDLRTLKKPDSQIKGFQPEVPTLVISECVLCYLSPDEYQRTMNYWTEIADQNYMGFLIYEPMSLNDQFGETMTLNLQSRGLNLQTFSKYPDLISRKKFLEESCHLKNLRLTDMSYIGGYKVRQDGREWIDHKEMGRNNQLEMIDEIEEIRLLVEHYCLDLWGVYRRENLEXQRHRHLGAGSYWYFIVDVVDG

SEQ ID NO: 15709 - protein, 240 aa, Candida albicans
KKIFGYVGLITFVIGVPVLYVVDLLEIEKFQFPPPNNTILASIFINGIFSVISDYTSVLAMLLTSPLVVSLTLTSVIPITIFIDYLVLISTGNSVKTNFVYVFGIVCILVAVVLVNVNITSENDLIEEVIEHALEEAIRNDEVMSPVLSPLLSPRNNATNVLGLQLLPHASPISISLFSPKLKSKHPLRISHFNLNENDETEPTFNANHEPLYGITSSPPNIVVVQGKNHQYQIKRNIDE

SEQ ID NO: 15710 - protein, 203 aa, Candida albicans
SPAYTGNQEILFMPNTPLLLIRSPRFDRLSPRITTTTATTTDPNGIVDIINQQEIQNYKLGIILLVIALATWIIGSELVNAVLKGDDYEKPWLFAVITGSCFSINLLPDIILLKHWEVFGQTQIEEDLPLLQTKSKEKNEDVSELTPKEVCILAFQIAVIYYPYNVLGMSALKFTSALNQTVMGSTTSMFTLIVGSNTQDRKL

SEQ ID NO: 15711 - protein, 145 aa, Candida albicans
VGNEKVRASCLDCDVLIINNYLFDGQLNDEVGKLLYGLRPGTKIVSLRNFISPRYRATFDTVFDFLSVEKHEMSDIMSVSWTANKVPYYISTVEETIPREYLSREETKETSGKSKSVSPVGEIENVAAAMMTPPTDSSESEIIKN

SEQ ID NO: 15712 - protein, 730 aa, Candida albicans
HRLQTYPHISMAAHPSLWYRDKDSLRIGGVARYTIEYTRLDPTIKRIYFRLKNIEKSSIRAIHLLSGPFILYCHVVPCNYNPRKPFHPENVQKNTEVVFENQIKPNQAFNVSLLLNSNSLKGKDDKGYDIFQWEIEIVSQIVITKKTEVVYDFMIGDDLHFMKKLGQSIIQQTLTSLGTKIDMNEGTKPTIVDKAIDEIHNDSHKIYNTQLKVSKLTTDDIWSNEPKDPKKPVHLVIVTHGIFSNLTADMSYIKDQLELRVKENILVRGYRYNAGRTERGVKKLGTNVANYITDLIENSLYQYDKISFIGHSLGRVVQLYAIKYILMTKGPDYFERMRIKPVNFIGMASPFLGILNEMNFLISWVLDMGTLGKTGRDLTLLKRLPAWSDISIGESKKRDSFKPVLETLPEDPLQKFLAQFEQLVVYANAMNDGIVPLRTSALLYLDYEALGDVSELKKSKHMHVHPELEEADHKIQVNRSRDTVLEVPEEANQMVQDIQDAAKSTDNSQSTESSETMGKNHVISKYKEFLNLNFLEHNSNNHKPKLTKRQRKYKNFSVRGTDYNVFNDVLPEDHSFQSEETNSTQDSQTIVVPPRASAIESAINTLICPIPSNEFLINPELRQHVIFHDKYYQFNKSSQEEGNLNKHLKVEWFASVLLRYHSKWKLEKQKQIADKYHNACGWRKVLVNLPPDAHNNIVVRRRFANGYGWGVVDHLCDLFRVSEHKCKNYW

SEQ ID NO: 15713 - protein, 221 aa, Candida albicans
VKIELVSTTYLDTSSTTFFPPQNYIMAEKIRYYLEQSVPELEDLKIKGLFDKNEITMVMRRRTDFEHRITGRGCKPKDFLRYTEFETNLEKLRKKRYNRLSKVGMIETKPSISDWAGTRRIMFIFDRATRRYPGETELWSQYLKFAKSNGAIKVIYKVYSRLLQLQPRNINAWLSAAKYEFETNGNAKGARVLFQRGLRLNLESLELWLNYALFELTYFSK

SEQ ID NO: 15714 - protein, 489 aa, Candida albicans
RIPRTRQHIFNMNKEISDKFVTLTSESDGQPLIYPVSNNDIMPHNLMDTGPSLQTRELFEAWRPFIPQVQMHTYLMGAYYFQEVIPNQLAVLSLNTMYWFDSNPMVDDCDNKGDPGYKLFEWLGYVLKEMRARNMKVWLCGHVPPNEKNYDTTCLRKYIAWTHEYRDVIVGGLYGHMNLDHFIPLDSVQAYKSIQKDFKDEFKQKSVFSVEDEDDLALEDSNLYKALDENFSDKFFRVTGGVPNNKVTYLETLREELYAPLKGKKKSGEHFERYSIAHVTASIIPTFNPGMRVWEYNITDLEDKLQQVKFEPWDKFFAGVERMIEVQSNYVDEKDNDEMNWQEMDDITIERKKKHKKKNRKKKKDHTFPKPMPENLPLGPAYIEQTFTPERYVQYYADLESINKGKKEFDYEIEYSTDDSLYGLKALTVEEWIKFGRKLGEPVKDLKNNVNKGKKKKNNGKKYKKLQQIWNAYLKHAFISSDYEHKGYG

SEQ ID NO: 15715 - protein, 401 aa, Candida albicans
FEKFKLTKDILKERKAVDFENIWMNIAQLFPKSILFISDFIMLVSYKEFYDEMLDYTPKIKWPIEDKELFGINLYIIALLLQTGKPHIHRRDIMLNAQTLINPDIISTDTVNEKFFPSLLLVLERMMILLEEPEHEMAPELPFTIQKKKEFDVATKEFKAKTFDLLVKLEVKDNLESAYGLARVLVLYARDKSYADRLAGSQILKDLLKLVRTNVKRKTVIEALRTSVILIFRYCFETSRMAENIMNIEVTALFNNPIRQIKDLHACLRESAPLVFRDIDMAVGVICNNILLEGYTGEESYLSKIAIRKRKNDELLQDVEMSEPEESKPLVSTTIINQLLSELMSAIKTDWLSDPSTVEEKKDTKKSTVDLFANEKFSYVCFLLKTIAELVGSYKQAKLDF

SEQ ID NO: 15716 - protein, 448 aa, Candida albicans
RPIPMVKTCAQDEFEVDDAGEEDVFEDADDARPSGSGRSSSAATTRAQKKPAGKVYFSPLVDKQGIAALIRLLFSPLTISQREHIYHALQYMCYNKQSRIEIMSLMIAILNDCFTNNRPAQKVYTQVCNKAGGNKDSKQQYKLPVGATQISVGIQIVEAVDYLLERNNHLKYFLLTEHENTFILRKDKKSASKESKFPINYMLKILDNKLVTDDQTLLDILARVFQVASRALHALKNSANADDKDDDKENEKEKEKDKPHAPPPPVIPDSNYRLIIKILTGNDCSNTTFRRTISAMQNFSVLPNAQKLFSLELSDKASELGQTIITDLNNLTKELVSGGGSDSKSFSKFSAHWSDQAKLLRILTALDYMFENKEKNKEKGKEDEIEELTDLYKKLALGSLWDALSETLRVLEEKPQLHNIANALLPLIEALMVVCKHSKVRELPIKDI

SEQ ID NO: 15717 - protein, 236 aa, Candida albicans
FLPSGPLLHILPEVLGAIRKNKEGINKVKDKKLIQVFFKSFYNLNNAKELVRTELSTNLGCSLDELGRHYTSLKPIILQRLLELIENMSEYVNQRLPGIEFYTSDSGSLFSGKGDDSPVKVENGKEITSWENEDSAYLLDNVFNFLGGLLQDSGQWGTDVIQKISFKSWIKLLTLRNAPWDYSMSNGIVSFMGILKYFDDEKREYGLPVIIEELDKTLKLDSVYSYIFTTRLEGTA

SEQ ID NO: 15718 - protein, 261 aa, Candida albicans
RHSSLVSRDVYFAAIRALECISFKKVWGAELIRTMGGNVSHGILFQCLRHIWKMVKDQKEDYFEEGYIHFFNLIGNLISNKSLVPKLTAGGILDDLMPFLNLPTKYRWSCSAAVHLITMYLASAKDSLDEFVTNDGFTLLIGNIRREVDFALENPEFGGGAPKDAIVYYSITLRQANYIRNLMKLVADLIQSDLGDRLRNLFDSPLLESFNKVLTHPHVFGPSILAATIDSVFFIIHNEPTAFSILKEAKVIDTILDNNER

SEQ ID NO: 15719 - protein, 324 aa, Candida albicans
  UNSURE (314): Identity of amino acid sequences at the above locations are unknown.
IRFNMIVGKRDHHQRMEMAKPLRSLIDKLTTCDINELPQYLQENFKWQRPRGDLIHWIPLLNRFDEIFEQKIEKYGLDKDNVKLLLVSPEDERLIVSCLQFTYILLDHCFDKQVYSSSERIYALINSSSLEIRLRALEVGIVLAEKFVQTTSSRFSAPKPVRNKVLEIAKSFPPLVPIDSTLKQLAENKKNNNHRDTDEKPSIIGDHYNFVYTLDPEKKYPSKWKSINYQYYKSVPNTPTLNKNASKLKSNDKKKEDTVTEGLHIFHLPEESVRKLTVQQLFEKGMEVLPPESWFCFGIHAQMIKSLRLYIFIXARPDHNIPKE

SEQ ID NO: 15720 - protein, 174 aa, Candida albicans
GRFKKKRSVGVRRDQVFLDSYRSLFFKPKDEFRNSKLEINFKGEQGIDAGGVTREWYQVLSRQMFNPDYALFTPVVSDETTFHPNRTSYINPEHLSFFKFIGRIIGKAIYDNCFLDCHFSRAVYNRILGKPQSLKDMETLDLEYFKSLMWMLENDITDVITEDFSVETDDYGEH

SEQ ID NO: 15721 - protein, 408 aa, Candida albicans
WKLMIWSKEYLKKNYIKLLVPICVVLVLAYLNYAINYAVGYKLVYVHHSHAVAIILWVLLGFFQLELLVYWVLIFLVGPGKSPVFPPIDLYGENNKGLIPLPDLFFCDEKGFPYYCSNSNSIKLERSFFSKDVGYNVIKFDHYCIWIGQPIGQDNYLFFMKFMMGFLAFFIIVLIYCARFTRESIQQGEIDHNFIVLFVMSGFWIIMIGCLFGIHLRYVSINMTTLDEITINQRKRYNRWKDARKNPNMPSWMKTKNPPRKETGRRYVNVKHKTGRAIVRYYIDERPFDMGFRRNWINLVFNGNRNHGKDDEFYTLWRLAAAFVVFIIPFIDIPFSFRGKLQVKDDVEQELHEQENLLAKYTVYSSVVNDKFMNMIDEKLKKNSYSAPGYLVETTPQNNQSTIDKDSI

SEQ ID NO: 15722 - protein, 485 aa, Candida albicans
NFFFDSTNPLISSKPSLIYYPFSFLSFHPHTPLINMSELHDLCKFPTRPIDQSYIDKLTQYLKDGIPATYTIEEAYNYINNIEEEPTTTTTPLHLICSHAPFDITKEEQEIISTMVEKLFEYGAGWSFTDINNQTPGCILISRRRERENKEEDGKWMNDVYQQIIDAGVRAELLLRKVNEFEEIEFIEEDDEQEEKEEEDIPQLVKDEQEIKEEAKQEQTTTTDIKPVVIDDAPDAPSQNQQSYLNTKLEYINDALITKDDKDGVMMAWENDIMKLASDTITSSASSASDSELEQEVNILNIGFGMGIIDAMIQSKLKSHPNAKHYICEAHPDVLQKMKIDGWYEKPNVIILEGRWQDKLNGLLSSSSSSEASVFFDGIYYDTFLEHYQDMLELFDIIVGLLKPHGIFSFFNGLGADRQIIYEVYKNLLIIDLENYGLNCQFKEFNVPNEKFWNKLQDKSIWDDVKRSYWSCPIYYHPIIKFIDY

SEQ ID NO: 15723 - protein, 227 aa, Candida albicans
WIHFRKLKKMHMFLLEALDNIINLVLNGKPPSMEQQQDFENSFQELREIYRDLQQALSISESQPSKFNLSDIDISNRKSILSDLNDQIQHLEKKWNQKQYRDVTTMSNRISQDGQEDEDIDPFSADSAMTSYQQQELIQEQDLQLDDIHQTMMNLNQQAAIMGDELEEQGFMLDELDYEMDNVDNKLQRGMKSINIFLERNKETASNWCIGILVVVLCVLLVLLLIA

SEQ ID NO: 15724 - protein, 149 aa, Candida albicans
FSFQLNWQQHFRQQNQLSINIMETPIPNQDTAKENLETHANESIDNSDQTENKPTNGSVDEKPQSSNPMEIDTKEESTKSQINTPVPNENSQLPMHEIVGGSSVRRYLNQHLTKTLLEGLKEVAQIKPEDPLKYLGEYLISKSNKSKKE

SEQ ID NO: 15725 - protein, 79 aa, Candida albicans
NMSSSHPDTQVLRPYYDHDTFNAGYSVIFKKGVGIIEPKTNRPVTSNISEKLINQSINENQGIIRNLFKHGGTVGDQCY

SEQ ID NO: 15726 - protein, 565 aa, Candida albicans
VRGFCSTMSRFDQLYKYGLYRIIRPMFRTILVYVSGRIHTWVALDWILSKFIEDGDHVIIIASINPCLLSGTNKDRSRRATSITIMSLSPAKIGSQSSVIRGNTLSPQRSRTDEPQSTRQDSIDPFIRLKEKSRPENIVKIAHNLMDYVMKVINPKIIARITVELVEGDTKEVLQDMYRLYEPNLVCTGAKPNARMGAPLRSWQSSKLTDRLIKNFPLPVIAVPAVNMCQFEYNLQNKLNGTIDAKEVDQQNQLNALNNIMETSEINNKAGDESESGDDDENDARSITSSVSISSDESYDSFIEVADVYLEHKQDLRKNLQHLQQSQPINENYYSDMVKLISDESVELCEEIISIQPNFIGNGAKLAREITGSNSFGNVPYKTKSMLEPQHNDSTSNGNDNGSGNNNKPSLSFKELKEQLKLNKIKTELAVDTPVSGSTSSLGTGTEPTSSSSPPQKPDLQPPSIKIDVPSPSPTTTTTSSGLPPSSSSETSLRFGNLEKPSIERRKKPSMLHKCLSHSDDSVDRPKLEARKSHPDVLEHIRDEIKPSSKDKKTKKKKKKFLGIF

SEQ ID NO: 15727 - protein, 625 aa, Candida albicans
NNSNLFLNKMEQVSSILSNILSVEEGTTQSHPQSKTLLNRSSIDESLETLSKKPQRRSKDFDFSSFWKTSDKEQDTTNGEDRKNDFETIGDKTSKKTLSNSLELEGNATTVPLPAPSSSSSAQYMADKLMEKVISMMISNEVVDEQTSKILQDRIEMQKQRPPLSIALMQNNSNELHRRNSDMYIFIDHVQKFFSWQDPFYTVAWLLIITHLILNPYLFTVLPLVQLITSTLVPHYLMIYPPDGVANQEYLEVNPKPSDKPLNLYKVPKPVPLFSREFFMNFTDTQNFMTLNIKLFDFTVWLTSDYLYFKNEQITSGIYVICIAMIFGNLYLLPYIVPFLLNHFIIVQLYFIFNIWAITAILHPYPRGLLLEWIYKEDTRLNVQHFVNKIEDKLTKFIAKTPTLEQSITNTDLQHATKDIGSSNEILEDNDTKYVEIYELQKLNTKNKMWEAVGFTPNFYTTNDVIRRYNSAIQELEQNDKSHTHSNEDPQEPHKLPLLKRDTLSEISPPQNYKFIPSEKWKIDYDISTWVENNLIQDLVIIDDDEKWAYDVITETNQDQKQEIEGKQLDKAINEMTMNEIEKFTDLTKSTEFFRRRRWIRKVTRMNYKDLKEESVPISSISAWV

SEQ ID NO: 15728 - protein, 172 aa, Candida albicans
FLQASRRFQECQDHNLKLGNQKILILCGKDQKQSLFDPASHITEDDPMFYELKKLPKLGVTQDLVEIVEDKEETESANIVLKTEAPTGLYLPNGNKKICMISGTEVKYFDPSTGIPYSSVEAYKILKSIEQGQIPWLSLTNESNDTGNVELYLGCRDGTARHAQGVPEGFDG

SEQ ID NO: 15729 - protein, 125 aa, Candida albicans [sequence omitted]

SEQ ID NO: 15730 - protein, 307 aa, Candida albicans
RSPMNTFKEYSENQLSILKNAVQTLEDEKKFLNNELISKTASKKRKTEPLNKIATSTLANEEKYLPLRPLKEVKTGTNDSVVATQNETQGKPIQKVIKLLSDSSLLIDQLWNHSIVGSKRTSFEYLNKICIDFDLKLNSGLKIVKRTSISSSIVEFLMMNKNNRLDKLIEIFTISTIQLVEKLLQEKYILAIPFILSLVDCSLSFRPAALTKSLIVQILKRVSKITESLLFLLNSNLDEDDLANYHDVPYQVMVLEKFIFVECLDLMERLVTLTTTFDIEFIKNVWQNRILPQNIITPCLPDNSEKI

SEQ ID NO: 15731 - protein, 86 aa, Candida albicans
RKLPQELRYLGDQYVKKEFKDHKKIDNPLHIVGFLTEWQDYLKQIDGGSWLHGKLSKDDLDKMSPEQIGQLHELMEATKKIGEESI

SEQ ID NO: 15732 - protein, 183 aa, Candida albicans
KISCSWRNKKERKKEKSNSLSQITVNYSYTIYFNMSKDDKDLEEIWKLFQDSNEDVQKRRKEITKSIQKDTSLNEYPGLVSMMTALDELIACFALGGQVKNYYRYGTYDSCTRQREKFWFAIKHGSFREQEERPLEESSERELTNRIKVQEFYKKRFLEDKAKGSSEDIWNKREELLSNPFKK

SEQ ID NO: 15733 - protein, 293 aa, Candida albicans
TKEKLNIQLEICSKTITPFKYQFESMFTFAKKLVDRFEGSSALDSTSNDSYFKNATAINNKGYALRVLNVIPHSTAHQKGFESWFDYIIRINNHELPMLYPSLSNFSYSINDDGTINYGGNTTQEQAAAVNFELLMQEINTLAKHEQDLVVDVWNAKGGIVRQISLPLSKYEPTDSSNNSDESVHQLFVNNFKQLGLTLESQHLTTATYVWRILATHQGSPAFMSQLVPYSDYIIGCDSAYPTDTNGKGLLTKGGESLLSKTVLNYYNYHYSISNEDNIPFFTTGWKDHARGA

SEQ ID NO: 15734 - protein, 913 aa, Candida albicans
THFTPFTTNTRQLVPPLASYIENPDDEENSQFPLLIKISPEFNKLKLHVSIKPVVGFESRSLIIVKSRGVTDVDVLKNQLYDDNTQDKPMTELSKLEYRKLPIEENNHSFQKIIINDFFDPKIVNNTKLNISLWEHDSTSNEFRHFLNFSVWIDKLAPVETPINRSLFSLATKGQPLEEKSPESKLFSLGDFRKEFKIDIEDGPEFRKTLTRLENNIPWAKKIYSNLVDEFRVLESNVRRVTTSKIKVMDTIDQIVDLESTSLLKEFGFKLDFHIVFKAMFEPFEKNLNFFFENVCDHKLLNKIYANIGFTQIDSSAVYLELQKKFEADSKEYYSWLNKYLSNEKERPELKLLAERKVFELSKFDYLNSLTKVTNNQYVNEVLENFFKFLNLKYDPRYPRLLDYHSFKDKKSNQNLLGDNYQIYMNVLLRFNSERYQFRQMIEACQTNEELTNLIRCNRLNHKLVSTSSSSPSTSTASPHNLVTSSIDEFIITKENWDLIFNDSKPPDNEIGPDDSEKSGILFTLGGQKKQGWHKEWVVLKKGQLIEYADWRKGRTPINKPIEIALANVKAITHDKRQFCFEVLTSTGSKHVFQAFDNDDRNKWVKALHNAGQLINTKRLEQAHAKSLSQEGRKKTIGKLITEFKDKPIIPGQDRSISPISLTSKAPPIEKDYLQMVRSAPDSDNSICIDCGSAELVEWISINTLTCFCINCASCHRNIGSHITRIRSLKMDKFENETELLLKYINNRVVNSYLEENLPSKEKITCDVDNETRLNFIRNKYQLKKYKSIIPDIDNLLIKAIQKINVPDALKYILCGADINLNIQINIPNRNEYLVITLFEYSLRKYIEIKEEHDRELGYKPKKLFIISELLILNGCKVSQHIKDLQKEDLGLTDAAVEYWKIRSLKLSGGKAS

SEQ ID NO: 15735 - protein, 473 aa, Candida albicans
TLLLLNIIKTLHIMDFIGEIIEHETEAPKEPTPKPTIGGFPELKKLKEKKVSRWRQKQQQEQSTTSPKTTEIRSEASKIHQENIEKMAQMSEEEILQEREELLKGLDPKLIESLIGRSKKREATDHEHNGHAHEHAEGYHGWIGSMKTSEGLTDLSQLDKEDVDRALGISSLSLSEPEGGSNTKKVAFDDNIKTVKFEDLDDGIELDPNGWEDVTDVNELVPNNDHIAPDDYQINPDSDEEGLNNTVHFTKPKQPDLDINDPDFFDKLHEKYYPDLPKETEKLSWMTQPMPKQLSTVYESISDMRFDFKGDLIELSAEGEEPKDSSFEIPTYMGLHHHSENPHMAGYTLGELAHLARSTLAGQRCLSIQTLGRILHKLGLHKYSILPKTDSDDQSFTDEIKQLSLDFEDMMWDLIDQLRIIETITEAADEKKTRNLSVRNYAIEALWLYRTGGGRTEITKQTEEDLIAQAVQK

SEQ ID NO: 15736 - protein, 572 aa, Candida albicans
VINPFPSLSIPFILPFLQMPVFEKKDTVHTNVPSPRPSTNSHTSSTYIPRYRLSITTNEDINLQSIDPGTVKIDCSGAFIANDDLLRDTAPEITDEINNSSSSTSGTPPLSNTSSDLEDDTEESEFDTEENGGGLSDSSSTTVEDDENQLQQLQQQPLYGGVITKNNITLPQHNDEIIHISVDIGGTLTKLVYFTKSSSNRKNSSRKTTGGGGGGKLHFQDFQTENFKNEAMKFMIKLIQKSINKSNINPPITYIMATGGGAHKFYNLMKKTFKKHKLPMKIIAKDEMECLIKGLDWLITKIPQEIFTYDLTELTTKFEPIQSKKEIYPYLLVNIGSGVSMVKVTKPGPEGFERIGGSSLGGGTLWGLLSLLTDAKDYNEMLEMAQNGDNENIDLLVGDIYGTNYNKIGLKANHIASSFAKVFKKLRKFNSSTNSNNNNNSDNDSDGKFKKLTAAEKLAQFKQEDIARSLLFSISNNIGQIAYLHALRFNLKRIYFGGSYISGHMQTIHTLSYAVNFWSKGEMQSYFLRHEGYLGSVGAFMMVPAPILEENGNSSNENNHTNNVKIANGVQH

SEQ ID NO: 15737 - protein, 158 aa, Candida albicans
IIVALKNMKKASDLDPHDYDIFFGSADHGTLFDYPHAKDLHKIATTVYNKGGVVSAVCHGPAIFANLNDPKTGEPLIKGKKITGFTDIGEDILGVTDIMKKGNLLTIKQVAEKEGATYIEPEGPWDNFTVTDGRIVTGVNPQSAVKTAEDVIAAFECN

SEQ ID NO: 15738 - protein, 125 aa, Candida albicans
TTTIPLEMFKKFTREDVHSRSNIKSSVQRGLKSKFVGVYPDIEQGIDNLIPKKSQVVVVKCEDKIQLYAVEQNDEQDIVMFQHFSDDLVPTLKTVHKYPECFPRVQVDRGAIKFVLRGANIMCPE

SEQ ID NO: 15739 - protein, 174 aa, Candida albicans
KTLPYTTKQMSDLLHKLNFKIADASPEYKQRRKIQMIRFFTASAVTIFALRFAYRATVSRQYIPTLFQGNHSPPLSYNFTTDAAVAVGTGTLLCGSVTGMTVFGLCWILDVSNIKEFGWRMKSMLGGWELEKKLSEAPMDEESSYIQDSLNDILDGKYDFENDTEEVAGELKTN

SEQ ID NO: 15740 - protein, 237 aa, Candida albicans
VTNISSPSELFRKAAKILSSFIKPNQIAGPDQIIPPRILKNAKGLAIITVLKAGFLFSGRAGSGVIVARLPDGSWSAPSAIVTAGAGVGGQIGAELTDFVFVLNTKAAVDTFAQMGSVTLGTNVSIAAGPLGRSAEAAGTATVGSVSAVFAYSKTKGLFAGVSLEGSAIVERREANRKFYGSNCKARNILAGQVDIPPACEALMRVLDSRVFSNKLPYDEDDLSSATGIEVPRPEGT

SEQ ID NO: 15741 - protein, 445 aa, Candida albicans
YIFDMGLLSSLLCCSIESKDDNDDKVHRPSTSNGIATTTSNKSNAAVTSASLKGNSSRNNQQDKAKKINTTTTKTTKANTTIIPTTNTSKLQSKNTPTRHGKDANTNENNSDLTKDNDIDVMGDEDEDEEDEVDALKPSKKDLLDDDQSINEIETIANTNDESNNNTPKSSNDTTKTDTNNTKINTSDIITQVPENGGAYTTTNSSNNYQKESRNLVHKNETRNGEDEDEEVDEDEDDDEDDESLEDLTRLQDGQAFNPETGYLLGKKDKNFGNKKCLILDLDETLVHSSFKYLRNADFVIPVEIDNQIHHVYVVKRPGVDEFLQKMGKLYEVVVFTASVLKYGDPLLDKLDIYNSVHHRLFRDSCYNYQGNFIKNLSQIGRPLEDTIIIDNSPASYIFHPDHSIPISSWFSDLHDNELLDLIPFLEDLAKPIVDDVGLVLDISL

SEQ ID NO: 15742 - protein, 435 aa, Candida albicans
KIIVNSLKGSFYQLATSAYGKYLLIKLLHYGSKESRAIIVDELHGKLRKLMRHKEGAYVVEDLYVLYSTSEQRQQMIREFWGSQYAVFRDSGKGKTVLDITRELAEKKQLIMSNLYGTIKASVEKGSTGFQILHAAMKEYVTVLKDDIDANDSAIRDFIDLLGEQFAELVHTQEGSDVACNLIALANAKERKVIIRGLKTHTNELIKNEYGNIVLITLFMTVDDTVLISKSFGAEIFTSELVPQLIQDKFSRRPILYLLKGLDGKYFAPNVKNALLGYEELAYKKTSKKDKEQRKSELLERSILPIYKALLDEESIVKLLQVNIAAQVITELILTSTNVEDVNKNLRPQLADIIFQKTICGDVLEDYHLLNKAPFASRLVKSLIQGNEFKFDNESKKLVKTGQSASPGIGSEFAERVADEINVEDSSPRHGAGRI

SEQ ID NO: 15743 - protein, 945 aa, Candida albicans
TINFWSKHFVTKKTPNMLSETIWSSGHNSPIQNNLLLASTTTNNISQYKSVIDQVDPDVNRLFANSKSFDRLSSSTGPGTTGHTSGLTSGTDRRLSFNDGSDIIESDFFGFKRGALSAITAPVVGNGNNGRHHNQVTNKNFGTASISGGIANRHPPQDSFLQKFSSVADATREIELGRLSLDDRNNGNNQVSSVNEIKMVNTSAFTSPHGSLNENLNMPVPTRGGSRHQSISEKIDNYNNNSPIQTAAALSINSDLNSDTVNINSTTTNSNHDATKNQGNYSHNFWNPAAATSFTPVGAIPTPNYFIDANGLPIPPLPMPPQGFYPPRGGNASNSGGANSISPPPPFMIPSPPPPFLDPSVYSMMYGGNFPPPPPPPPSQQQQQQQPSQQQQPSHSNQDKKANETNSKSKETKYSDTESHEEDNEKQDNYHGPGPVPGPGPGPGPIGVGLMNRQFSPASFMFHPFNPYSMYQLSPPLVPPEAALGGMASPPPPPPLPQQQQPQQQSAPSSQGKSTSGVSGSSTSTSTSHHSQSKHHHHHNNNNNNNNNNNSSGSTPGVGSKRKGNFKGKNNTTNGGGNHIYRSPLLEEVRSNPKPYQLKDIYGHAIEFTKDQHGSRFIQQKLPEATEEEKETIFNEIWEISYELMTDVFGNYVIQKYFEYGTTTQKQVLLESMIGHIHELSLQMYGCRVVQRALEAIDNEGQLRIIEELKDHILICCKDQNGNHVIQKSIEKIKPFSQIRYILTSLDNQIYHLSTHPYGCRVIQRLLEYSDIDDQKLILSQLNNFLYYLILDQYGNYVIQHILENGTQEEKEPILEIVLGSVVQFSKHKFASNVIEKCIKFGDINQRKRILHEVMLGNETILGDDDIDGEPVKEDSPLALMVKDQFGNYVIQKLVEAFDGDERKLLIIKIKKCLSLSSNNLASIRNIRNIIDHVSESNLDLKVES

SEQ ID NO: 15744 - protein, 374 aa, Candida albicans
RQEVNTSKRLESLRKQMKEHDLGIYIVPSEDQHQSEYVSAYDQKRSFISGFSGSAGIAIITRDMNSVGDTFEGTAALSTDGRYFTQAVDELDFNWILLKQGAKDEPNWKEWTIKQAVQLSLDSGSTVRIGVDPTLITYKLYKEFQSILDKELAKNEKVKIEFTAVKENLINKIWEQFEELPSRNFREIKSLDINFTGRNVQDKLADVKKHLTGDIKGIVISALDEVAWLLNLRGLDIQYNPVFYSFVILTEESTTLYIGENRLLEDIVESLKTAGITIEPYESFYSSLTTVSTKLSESNKKFYIPDNANWEVVRNLKCEFSQGLSPVDELKAIKNNVESERAKIAHLKDGRALIKFFAWLEQQVIEKQELIDEI

SEQ ID NO: 15745 - protein, 105 aa, Candida albicans
  UNSURE (17),(72): Identity of amino acid sequences at the above locations are unknown.
TISWSLKKKKIFRITMXHVKYIQLDRNLPNFTGLSYETISSTGANATILHYGPTKNEHLIIDPTKPYLIDSXAHYLEGSTDITRTYKLGYQGWTDRDKLYNPLVP

SEQ ID NO: 15746 - protein, 254 aa, Candida albicans
KRIQAARRHFVGLSFDTISATGANGAVIHYKPTKGQCSTINPRKLYLNDSGSQFLEGTTDVTRTVHFQKPSAEEITNYTLVLKGNIALSTLRFPQNTTGNLIDAIARQYLWKYGLNYAHGTSHGVGAYLNVHEGPIGIGPRPNAAAYALKAGNLISNEPGYYQEGDYGIRIENVMFIKESDLRYDGKAYLEFETVTKVPYCRRLIDIHLLNDEEISWINEYHADIWNSFHENFDKNSYTYKWLKRETEPLVKSK

SEQ ID NO: 15747 - protein, 474 aa, Candida albicans
LILRRGTEKKKTLVQTNKFFLKRRQFKNQIEYQFLLLFACFPFIMSAFAALKNNPFGESIFNNTSNGDNHSRDDVEEDEVVQYIANSSDEDDDDDDDDNDNDQGNEDNNLFPLEISAPEDTSIYSTPAPILNSRITQSNYTPNESNLKFSDNHVTITLNPSEYIIISGQCNLKIIKGSIKINQCHCLTSEDNKSYNIIALQSQSLPIISHYTTPEMEEDGVTSVSIIQLENSFSGIENISQIEPAFKNLISGQPNVEEPSLFKNYSFDIVLTETNGGYGLDINSYWINELNLLKSNKDDPTPKIIMIIGNKNTGKSTFCKSLINELLLTNPNRPVSYLEIDPGQSEYSTPYALSLSEIVQAQFGLAALPHKNNNIVKSRVEHYFGFTSAVNAPTRYVEIIEELFNHYQTKFSQRNHLIINTPGWVKGYGKELLNQITKIINPDKLILLSNNLNQEYPDNANILQDLTYQSLSII

SEQ ID NO: 15748 - protein, 328 aa, Candida albicans
ILVKHNLQSTMPFVQSLRNLTSSTESKIKSATNNEPLGPYNHELTELASLTFSKKHLSIIISIITKRLKPVLDICPTTMNSTGMKRSNTSKLSSTIHRTHSFPRRSKTLPSPDTPSDVNTLKYKQVLDDKVYLSLLKALTVILYLLQNGSVQFIDWLLKDYKLIISPLLRISYPSTYKEPIRHKVNKIISLLEAPEDLNNYRINIHKLRTDMLVPGLKRTSLDGVDLLQVEQEHSTREQQQQQAPRRPATPPLLRLRSISEHHSHTEDEYINSNDVYNSSNTAADFSFTNNMDGILKQPSRYQPITTGSSPPNTSPTITNPHQLPPIF

SEQ ID NO: 15749 - protein, 256 aa, Candida albicans
YKFFNIQKLHLFINQSSTIKLFVMAKRKSKQQDLEKKKKLKQSQDEQLSTGLFNNVGQGQHQGDDDDEEGDEIDWDNQEMDYELIPRKITTKKTIEALPIKKSDGTIERVVREVEEEEEEEEEEEPEEEPELENDVENEPSKQENKENKEEGDIDTDDTLTPQEKLIQTKEEIAELGSKLIEDPEENIVCLTRLRKMSESKNFMTSQLSILALIPIFKSLAPSYKIRPLTDTEKREKVSREIAKLRNFEQNLVINY

SEQ ID NO: 15750 - protein, 78 aa, Candida albicans
IDMVKILKDYGTPKERISGEGNYILGIERQNKDKDVELERSNSGAATLWENVLLDKHYSIMIKDGSRSLMKNSKANTN

SEQ ID NO: 15751 - protein, 219 aa, Candida albicans
NRGPQDQQDYPIFIKSLRVLETLLKDDAEHGDITFDIIKIMTKSIKDKKFRVDESVVNVFLSISLLEDYDPNNNNNNKDDHHNTTLKPKLKKKDRIHLSKKERKARKERKEIEEEIQKAEQAITVEQREKYQAQVLKMVLTLYLEILKAGSSSSQLIDGDGKKTKNDASLLMGAVLEGLSRFGQMSNLDLLGDFLEVLREIMTDIIEEHKQSGDNDNDN

SEQ ID NO: 15752 - protein, 172 aa, Candida albicans
  UNSURE (170): Identity of amino acid sequences at the above locations are unknown.
NLDNLSKYINSRFKNMLPKGVKKDKKKNNKNNKKGKKGDDDSNKDAESENKEERKFIAIVSMSAIRACDIHRATKDLVGSSLKLINKNKLHIDLKLVESTRSRVLCCTPGRLSKVLNSEESGLSKDEIKIVIIDNSYLDTKKQNIWDIKETFEALTDVFTTGLAGSAHKXWP

SEQ ID NO: 15753 - protein, 573 aa, Candida albicans
KKKRACNEPTTNNHFKVSKFESILPDLFTVYEHTNKDVLTNEILPVDFYQENPMKIVSSLQSHTTTDVTSIKNKYKNGQYSTPYQLFHDIKAVASILLNKEENGSLQYKELDFFYKFSTELLLREVGNLIKFNNETGEIKTELETQLDEDFTKIITNYNISNGEVITYISTTEEPEPQSSSVLYQHHQHKEEPTKKTQPLFSSVISKSELDNRASIVPSPYGLAQVVPSIKDSLSENTLETLSPIANRIPSPLDQPTNILHDFFHPTWYTISVPAWLTYTSQTIKPANLNTNQELEDGVGASTKTKLSILKNRDNDYSTKPTNIWGPGNYYRSFAPSRNLSGSIVGNKLKANVWLQHIGMTEIAELKESFVENKNETNPLDNDTVVGKEDAGEGKSSKENGAEPTNGHQASEKTQQPSSRQAINIANIIKWDPTKVEELNYLKEHKQDLVNPQKLQKMISISLLKLNKLRQQRYSRSDVRNPLAPQHEENILYNRVVKLISIAIQLFNVNPGCFSYQFSKSIPVLVSEFSGTLPGIPPTKAIVNNGTTATTKLNRLPNLKGPSAYRKRPTRFA

SEQ ID NO: 15754 - protein, 222 aa, Candida albicans
KKKIQKKNILFLITKMTEIPTIIETSETESFSERAHVPDDTASLDDLFADLKKESRSLPTVKDFKSIEKSIQSLPRINANLETALQKKPIRIHDPVIPPKKKTTETSDERWFNMKQPEMTPEIKRDLQIIKQRSALDPKRHYKKDKWEIPKFFQMGTIIEGNTEFYSSRLKRKERGKTMVEELLHDDTTKKYFKRKYHEIQQTKTSGRKGFYKKVKNARKKY

SEQ ID NO: 15755 - protein, 140 aa, Candida albicans
GSFQPPWVKTGQYYCIQCAKYFENQISLDRHTKSKIHKRRVKSLNERPYTPLEAEAAAGVNMEKFIASVEKYKQLENDKQENKHEYDKLINQKKDNLDAIITGIPSEEFQQQQQQQQQEELQDANQRTVSNDQEEVMMID

SEQ ID NO: 15756 - protein, 457 aa, Candida albicans
LEISYDNMSSVNNANISIMLNPTTSDSLSSLDQQAISLFEQAIKKESQGLMSDAVDLYRKSFKINEQVDKLYRSIHLPNALHKLQNERGKNYITKVDEHKVAKINVDKLLDSFRHVEAVAPDLLNGELSGFEGEMTIKFANMNINHHHHHHDMVAAAVVSPLVHLPNDIWTYILEILIHCSPESWFKMSTTCKKFAYLGFGQSTIWREICQLIYPYQKYEENQFYLQNPTLTSSIDDSDLPIPLNQLQILPQYNDSWKFMLHNRPFIKFLGCYISVVNYYSEGGKAEFSNAWSNPVKTITYYRYLRFYRDGTVVKVLSVLPPDQVVPILLTHNKVLPSSISELGKPIFLHDENKESHKIYLGKWTISSTGEIHIIIENGSVSYLTFHYWFQIKSLGHINKHAKLTWVRYNSVRKPTQTITADGEETIDDRVGEIMEFSIRNEKAFKFLRVKSYTHTN

SEQ ID NO: 15757 - protein, 386 aa, Candida albicans
RPIQEDPKYILPKQVNTYPATLPERKQNIEYILNILTKKQPNITNPKLKAIDIEYEIAKKSTNATYKTVFRQEVFKLTKPTKLPSQLLPQQERLKKLDQEAKELKILKEMVVSRKTLIAFGYIMEPPESIPNEKITRICNRCGTEFRLDQQLQPIVCEFHHGKKQRGKYICCMSNVDGQPCSKAKNHVYLLNTPEEKQALLPYQFTKELFTTTSTSTKSKSRVLGIDCEMGFTTKGFELMRITAIDYFTSKTVLDIFIKPIGEIVDFNTRYSGIHELTDDFLSWEQLMEKLGEIMDSETILIGHGLENDMNAMRLIHENIIDTSILFPNKWKTGPTRRWSLKDLAFEFLSRRIQTGEHDSCEDSIAAIDIVKYFVKKRLQSIGSSS

SEQ ID NO: 15758 - protein, 819 aa, Candida albicans
LTPIITRNHYHFLLIIVILKMSSDNSLMESESLFISTPQKLQKRQSFGSSGCDLRPLRLTKQRNRNSIISNSSNSPSGTPTTPSFDSPSRKGSLPTNEEFHCRPIRLGRNASTHSEDRHNSISSIKKLTLDNNINSKLSEIKKSIDEELLTTDSHSSHLSKRQQIDSQRRKSDSSNSSKRKSIQIKNLPITSTTTRNSSKRASQSQYDDMIFAICLVDFHHQRGPEIQWWKSNYHPDYKQGLFKNIPFQALPDGSHLFEETFSNFNLVYDFDQKQSIDDFNDVNNFKGDPRHLKTLFGCSCVRQVKTSDLTEEERERNKDITRSIVQKAIVVITRKQPIFTKIKDKLSIIAKSYFQQETFDNFEILDNLFENLNGQFKLVDNEMHTELEQEEENYVNLNLKSTVAKFRSRFLIIFKSLLLEKKVLIYSNNNLEALTQFQNNMLSLMPNLINNLDDSGCPLIEYAETNGPLSKPQSLNTTNRVSMLRFFGLPLQIFNTKNSFWNPYLPLQQLDELAVNSFMIGCSNLLFVNQATSYGIDVLINLDTNEVTYPKNLYATEDLQLSALDKKFIHHLVNCDQTTTKHDDFIGSDDYIRYKFEDYLNSLISTMRYNQYSERFGQPPPGFNEASHITEFNMKFIESWKKTQNFKIWNMMADEFIFNFIEPKHTALDLKDEPYSINKNISNFFNSFKAKTTAITNTSSMNDQTIKAHKFIEDDDQDEDKDEDKDKDKEEEDDDDEYNDENEDTVDELVAGFEKVVPLTEDKSMGTPSSPIIPSTPKTPKSITPTTSKSTTPTTTASTETIGKRLSTWTIGWGFGKK

SEQ ID NO: 15759 - protein, 440 aa, Candida albicans
ETTRFIYVYLIEFLQNLVCKTMILVLSPAMRKKSCLGPTHKKKNLDRCDNYITGLHIINILLLLYSSHYIDSLELIYPMNETSNRDHQVTSKEILDVAFEKSKSKFTTPRQTIQDTEELQSYQQTKRKEFEQHINKNRLNLGQWTRYAKWEIENNHDFPRARSILERALDVNIQHVPFWIQYIQLELSHKNINHARNLMERAINTLPRVNKLWFLYVQTEEMLKNYPMVRAVFERWLDWHPDTSAWDAYINFEARYEEKENVRTIFKKYVHEFPNAGTWYKWIKYEMENNRDDVNTVRAVFESAVDTLLSNKLEENDDDEEFATIISSWTSWEVSCGEASRANEIFKLLLDNKTNKLEISDKTKSSIYTAFVEFEKNFGNKDSIEQSVLIKRRIKYEQEIQNDPYDYDSWWKYMTLLQNSLNKSDLENAFKKVTGNVVHD

SEQ ID NO: 15760 - protein, 565 aa, Candida albicans
FRAHLSFLFPLILQFNAQMDTQAEINADLISSIIPFPNLTDLSNTTSDFDNDIQILLDWLSPYIPATSLTKYQDCGSPLLLLRVQEPSQRVKSAIRGCLKDEINQIQFIELYINTINEKVSQFFESIVTKNLKFIEYVNIIKILLHYYNSQFEYLNLSDNVYKKFQAKLSFIITCNLLNEQSSFRAKMNQFFEESLYVRATLSNPLSSITLNLIDIISTLASIGMSDLLNEIVIKLSIDKIKHFTNTYSRNVWNKPLLSTINNFIQNEIYPNFYIVISYTTSSNLTDSMNNVYLYELVRIAHDELINLRIQEIYSMVLQYPESQVGLNELHHCLLKVKFNLKQYELTLLSCAIDHSVNIQAAQRTELVNSFIDYCHKNILHAGANTIDVITTYIKTIKSFLIVDPKGVLLDKVVRPIRQYLKTREDIIIKLVHGLLDISPNNELIELARELRHPSNKYRSKHDHSKDVLEDLLDLNWQPDPIDALPDFKKGKVSDIIESLISIFDSKDIFIDEFTRLFGDSLIKLKDYNVEEIELNLNLLKSRFGKQNFATLDVMIREHKGKGNI

SEQ ID NO: 15761 - protein, 260 aa, Candida albicans
MICLSRNTRNTNFNTSVLSHLYWSSILENINTDANNFKVPKEIEDKFQLFKDKFAQEKYGRTLELLPSLGLVTLQLEFKKSGPRVFKVTPDKASIISLFNEKEDELSVSYIAQTLNMSEYMVSNGLAYWVKEGVLTELTKTLYIVNDDDDEEEEEGNVFPEKAESSKHGIDSATSNLTSVKSGMEDKFSEIAIIESYIVTILQNITLINFERMKTLLNLMVPKDKLDFANVSESLLEEYLDSLVENSKIAFQNGNYSLPK

SEQ ID NO: 15762 - protein, 309 aa, Candida albicans
QTTCQMSKLLTSFKSSKTQLRQQFCELTGTSNTTATKYLESVRYDLARAIDNYYNKHPNKAQVTKKPVKVKIDDRLIQIFDKYKDSEDPNKIDIEGTLTYLGDLGISPDQIESLSLALLLKSPKTGVFTRENFLHIWQYYQCFDIGAMSEFITRFNKDLVNNIGGFKDISTVSDDENKLVPLKFQDLYNFTFKFSLETESQKFLDLDTAIEYWKLLLPIITETYSKDNKLDEEFKNHVNERVEQWFKFLTDTEYMTKKSISYDSWSMFYLFFKEIVLIDPIKFKDYDEMAAWPSVVDEFLEYLHDFELL

SEQ ID NO: 15763 - protein, 675 aa, Candida albicans
EKPIFQFLCNYIQVITKVWCLYCVLIRSQMSEDVGDLRRPTNNQHRPKMKFIGLISGGKDSFFNIYHCISQGHELVALGNLYPEKSDEIDSFMFQTVGHDVIEYYSQCLDVPLYRQPILGKSTNQNLEYLVTENDEIEDLYKLLSKIVDAHPEIEGVSCGAILSHYQRTRVENVCDRLGLTSLTYLWQRNQYDLMKEMCESGLDARIIKVAAIGLTKNHLGKSISELFPALVKLNLMYEVHICGEGGEFETIVLDCPFFKKKKLVITQQEIVEHSSDVFYLRIKVELADKNVTSDYKPLESLPLLEDEFQDIADSCPKADISLSGLLIDSQRIVPKIDVTPTETTLYISNLTSMKSTIEDQKKDIFQQLDKLLGDHNLTFNDIQHITLLLSDMSNFAKVNKFYGTFFKDIYLPPSRICIETEVESIQLSCIVLKHIQPKTGIHIRSRSYWGPQNIGPYSQSIVNTQSSYKTATLSGQIPLIPATMDISNKSIAFDSALSLQHLVRVKNLVNVKQLALVVCFITDESYVPIVRSCWTDLENKGNLVIVTVRGLPRGAKVEWGGLSFEDITGIYDNFASDSEDESDDDSVSQFDNFDESCICQVGKKGEFSVVTLFTSDSDVVKSLFTFKGYRQLICHPKDYIEIKGDYLPVNTVYDYKGKNHKYAVIWKIEVHRKN

SEQ ID NO: 15764 - protein, 753 aa, Candida albicans
STTIVNCILLQTTKNFEFKMGLRDLKNVFKRKEYDRPPAPPPPGSQPNEEPIRDSNPAPTSTQPVNGKDILSNPIATGEPPSLFKRVKHQQQPIGCCCDEKDAPIHTNNFYNNLTTGDQTMPIWPLPYSMWYLIDPDQDHGIAFNHTDASQRVFGREPDAPVAQYYFNPPKIKSFVLSAENFNGNKLTLSDHRALSVTATLQKGDSKIIFPIVQGMGFITAIYENAKPVIASQVGVQEFKKQNKIGNFQKYTAMLFNQVTWSIYSTNELSLKDPNHIVGNGPGIIQIARGNSKYYDDTAGGYIDHAELSASADGDRGEYKFSYSIKGQSRSGKTLVWALPHHQEVITNVKPTDLNLDSPTKGVMKSYVTNELVMQEQLPVDIMWDPWATFATKAKYSDNAKEIIKEAAIEEVKQDVVGMADIDSMYTSGKILDKFAHIAYVCHFILQDESLTNEVVPKLKQAIEIFAQNKQKFPLVYDCSWKGLISSAEPGADFGNSNYNDHHFHYGYHVHAIAILSHIDQDWLHANNDLIFNYANTLIRDIASPQADQYFPQFRSFDFFHGHSWAHGIFPSGDGKDNESSSEMYHFARAIKLYGNVIGDKNMQHRGDLMLAIMKRSVNMYMLYTRDNKIQPPNFIGNKVSGILFENKIDYATYFGRGTIGDEWIHGIHMLPITPVSSYFRSSKFVKEEWDEKLGAIVDQIPDGWKGILMLNKALFDPKSAWDWFARKDWDPVLIDNGMSRTWSLAYIAGIMN

SEQ ID NO: 15765 - protein, 575 aa, Candida albicans
SNQVMTIDITTTKSVGAGRGSTALSSSYYSSSGEDTIKHGRLDSIDESTLNQEGCALTSTISNSSNNSNNNSNNHTSYFNKRRKSKASAEHFNTVYHQYNKCFQNYYHCYQYLKPNCQYVTSVKPSVNHWQLRDLLKFNQSNNQVYYTKDDAIYSCDLDSFNVNEYIKFNYYPRCFDHVDDYIVTGGLLTTSSKMFSLNLQNLTYDSPNATTNTSGSTNYYNNNTINSLSSASIRRVSKGLFSFYNPELKQLNTVKVGEMINNDVTLYKSSNNHFQSYICNNDTFLYCLDINQSEFKCLNKINCEPNTSLNNVVKNPQSEKILTATGDSSLIFLIDPTMGKVVKTIDSKQDSGFTCAYHSSGMVFNTVHQNGVSLIYDLRMMKDVVQIHSTRPGHQSGAFRAAKFSNDLNDLLIISEHVGRVHIIDLRKLNNVDDHQVIVLPAALNEYIDNDEADPDKQREQLEFNKPLVYDYLYAKNNKLFNTSQHSSSLMLSTSSSSSSTSTSSAMVNISYSPTSRCEDLYQQSSRHLHGELELLGIEFTDDSKILIGCQDSGMLVWDVNSIARRSIGSCDFV

SEQ ID NO: 15766 - protein, 129 aa, Candida albicans
KDYRGKNKSRELFTYSAVTHYKLIPSARRTIKGVFPVFQQGPILPIILELETGTKNQIRDHIIQKFGVPLLNDDNFSDFKLNSEIPKEFNSKLYKSNQIALHSGLVIMENNGTSQQFLFPVNNVYDREL

SEQ ID NO: 15767 - protein, 153 aa, Candida albicans
KDYRGKNKSRELFTYSAVTHYKLIPSARRTIKGVFPVFQQGPILPIILELETGRKNQIRDHIIQKFGVPLLNDDNFSDFKLNSEIPKDVNSKLYKSNQIALHSGLVIMENNGISQQFLFPVNNAYDRELWGSFVNEKGEFIDEIRNGLINFKI

SEQ ID NO: 15768 - protein, 86 aa, Candida albicans
VLTPASFLITISVSTSNYSLAQFGAILHDLKCIGVIHRQGKDAAVQPLQEAYYYMPENDEDRERTTLVSNIKGHGGLRSCRKTHKQ

SEQ ID NO: 15769 - protein, 289 aa, Candida albicans
LFLIEYSLTSLFFYIENPLLITMSELKNGTTEPKKNETTQLDSKSKSTSTNKSSVPPASLVPVQPTALTSRDKTTQRLIVVLSQACLETYKMNSGGPGGDRFALLNCDDHQGLLRKMGRDIAEARPDITHQCLLTLLDSPINKAGRLQVYIQTARGVLIEVNPSVRIPRTFKRFSGLMVQLLHKLSIRSENSKEVLLKVIKNPITDHLPTKCRKVTLSFDAELKRVQDYVTTLDENESICVFVGAMARGKDNFADEFVDEKIGLSDYPLSASVACSKFCHGCEELWGIY

SEQ ID NO: 15770 - protein, 339 aa, Candida albicans
FSLQEAYTGALLSARGSRLSDIRTILAEKRFDHEDWVSIRYGSGMAWKRCFAVVEPSTLKKKVFTPGRILFYENEQKKKKQLMAMVTNATAVAAIYPQSHLLIDHSTMLKMEGYINFTSPSLSTKVSKKSASDFKHTSLFLMPEQHSSVPGFDTLIRFLVPLLDSFGLYGRPKRLKANRNDTDSLLFGLPTLPHVHYLELNDVLDLTRGDFLSWDLKTWIDNIKGILKTKIDRGYEGCGSQRGIKGAVTSLSSPVTSTGSPRFASGQGFSSRLTSSSSSQPRQNQQTPQQRKPPPPGPELKPAGKSFDKNVNDLHIGVSNDNLLSADKMKNNHKSVQLA

SEQ ID NO: 15771 - protein, 273 aa, Candida albicans
KVQSMVKLFFNTVLQHRYWAVLRAETLSIYSSSTNLYFPVLVIDIKKCLYTEIIDKEKLNREAISPVNRGTYSPNGGLSGTATPRASTLENTASELNSMLSGDSYSPTEDNVETTASTVWFKLVTKKKTYKFSCDSSFSARQWCNNITKLIFQHNNANSNGEVLIKIPISKIAEYNKRALFSEEEEEDRTLDATMNDIPLNVTIKYLDDNDNERKRDKLKRKYKGEEPTIEEVHFLFPKSGVEFFETFDKLVNPVVLDNDYLSSRHELELSRP

SEQ ID NO: 15772 - protein, 338 aa, Candida albicans
PLQGSINLFSGSPNVSGDEGTDADNENPEHRTTYHSLSGRVNHDDDDEDVAKLEDIVGFFTGLLNTTTVCAGLGSLNNLKKHYLDEFIKKSALNPLRPQNYGPETSSKLNNNSIEELLNNGDTSLEKVRKMSLYDFDEHTSDSEEEDSADEEEELIAENLKPGKSGKARNHPRDSRTTATLITTQITRTETATTATPTPTPTSSVDTDVTDVTEPIGKVTTEIPEEQLQGLNPLQKSVVKNLDPHHVREGVLIKVKNSETPLKNDRQELLEKIQLRLKIADKLQRVFDLSDEDTFCGNYSAWLIKDVLLQGHVYLTKDAVPYFSSLTELPGSALIVWG

SEQ ID NO: 15773 - protein, 169 aa, Candida albicans
RWSFQPAWWKTKEGFRPEPYQWGSNFEVELYKTRMEYSDSENREIQQYDNLIDIKFAEKKIEMARVRMFEDRLMAASGLDVPIILEDSPFFKTELRPSTSYNITLLTIGSRGDVQPYIALGKGLVKEGHNVTIATHAEFGDWIKTFGLGFKEIAGDPAELMSFMVTHNS

SEQ ID NO: 15774 - protein, 253 aa, Candida albicans
NHGMSILKKTEKKKKEAKLQEAKRKAELKAKEDAEKAKKDAKRKELEQFDQLDERTRKELLKKAELNADLNNAADLFGGLGVADDNDDDDFDINEHPRERITKQQLAAAAASKRPALTKDTPLEEHPLFQPTNKQEYEKLRQTVGTSLTRLNEDSSLLYASSLAVDLIRDLSQPLSVENLRIVLSTLHVVIHEHDRQERQARLKKAGGTATGGAGKKKAKPLARPNVGGGFKKDAFDDMDDGQFDDLDDDDFM

SEQ ID NO: 15775 - protein, 208 aa, Candida albicans
RLKGIVFLFIFVMVLYLENKHQFKFDFETTSLAYFNRYPNPYAKHVLSIDTIESYIDNQGQLCTTRLIVKTGRLPNFIKPILGNSLNSWIIEKTIINRHDKTLISYTSNLDHRKFIRVEEYLKYSGHQEDNDNGDGRGLTNLESKVKFSSNLFGFKQKIEQWSHQKFSTNIKNSREGLQYVMMKLKQRSNGLLLQERKLKPKPPSQCD

SEQ ID NO: 15776 - protein, 291 aa, Candida albicans
KKMLLLLLLLSRTIKHNSIPIKKPLFTFTPTSTSTSRSISISTSSTCNIIRYYHSQDHININTIDNNNKIDDQILTTAIKYIPEYGFQSQCITKAIKELKYPDSMNSLFTFKKSESNQSLELQLMIHWLKLQRYNLEKYIEKNPTPGSSSSSSTLYEDRLIELINVRLSYNKPILNQLKTTGISQLILPYNLTQGLNELYLLSDDLAFYLGDESNDFSWYSKRLSIASIYVSSELFMLNDNTKDFELTQRFIKQRVYDLKKLSDGYNNIEQWLGFNGISFINLIKSQLTRG

SEQ ID NO: 15777 - protein, 545 aa, Candida albicans
LDKVFTLPPNKKGLYHYIRIFEIMSNLVRSIKNVAGGYSSAQRVVRNATSNDPTGPTTFDMEEISSFTYQSQTEFMEVMDMLDRRLNDKGKNWRHVAKSLTVLDYLVRYGSDKCVLWAKDNLYIIKTLREFVHFDETNNDQGAIIRVKAKELVSLLRDDERLKQERANAKKNKRYRSYDDDDGDGGDDFDSDRRRRNRDERPRRDEPYDAELQRALELSRITAEEEQNRNREEENDPELEAAIKLSLEEEEMRKQNNNLLDLNDETPPQQPQYYLATGFYQQQPQFYAQQPQSQQFQQYDMFGNPIQNPMDTGLYNQQAYYQQQQQQQQQQQFQPNQFTGFNYGQPQQPQAQPEPLQPLKTGSNNPFAMSSGSDNTNKPPTQSLNSLAEQQQQQQQQQPQFFTQPTTAPLKQQNTSSSRFNETHELNDLLTQGTGLDTFGNTGDTRIPHQHTKTQNFINSSGTGYKQTGNEPIRLSSNAKRNPFLNTGIGYQGATQQQVPQQQVPQINPAYTGYGFGNAQPQQHQQYQQQQQSRNGNDGPSLIDI

SEQ ID NO: 15778 - protein, 353 aa, Candida albicans
RRQRQQKNIQEGFFFLESFLFFCNLFITNQYDCFTVQMTERDYTTFETIDLTSEEVLQCSYSNWSKLFPGKTFPSKIIKPLPSTFLDYLASESIRLPSNTNNKKITVLEADSDNEYSDWDDEEDQQQDAEHNDNVFSQFQDIQDKIDASIQEMGGAVFTKLNWSSPKDAKWIMPGNTIKCQNVSDVYLLLNSSDHIGDDLDNPFLEVQQKEMIPEKVDYELVLTKWQEINPAYEFRVFVKDHRIIGISQRDNNKYEFLQGLKLELNEKITQFVEDHVIPKLKSDTQLSKYIVDVYVSKNAIYIIDINPFSRKSDSCLFTWVELLDKKDNHDNHHELRLVENQNFAKECSESQV

SEQ ID NO: 15779 - protein, 72 aa, Candida albicans
HWILPAPCVKTDDEPDEWDQRIINTGCHKENLKLQLCHADTGDWRQCTKELQAFKECWDKNKNNERTLTVDN

SEQ ID NO: 15780 - protein, 230 aa, Candida albicans
QALKLKKKSISASHTAQLVLHKESQLLYYTTLLYPMAASDAHNNNKKRSNRRRKKRRTEDFSSSSESSSSSSSESDHEDLDEPEKEILKQDINIDDIDIESDNENSALTNDKGNKLIPQNLSITEKQQLSTVPFTTTSISNITNDNQIKNIPNINEISKNLDQKKTQLNNEFLKIMTTEFGDDLDELRKKPDFTEKSLVILAKTLQLGVNMFDIDVLNGLIQESGNTSNQ

SEQ ID NO: 15781 - protein, 97 aa, Candida albicans
SKKMLVKLPLEIQIKLLLMVPNSNLKFVNSHFYLLYNDLYYHKIVNTFGEATVKVIIKILPWLKPYIKSLDVFRKQARLIIVKRLQLGRVTYNCSQP

SEQ ID NO: 15782 - protein, 325 aa, Candida albicans
KSQITSFISFAPPNNTYKYNTKNKKLEYYCSFYTVLFTMKILTRQYHTIRSNYRKLQHIHFPGISSFQHGLNIQQLLVDANLDYKSLEFKYRRIQRQRQQISTNTNDSSLLALKNKIENLQPLPTILTFEFDNVYAGGLRLKSEVSPNDLEGFKRIGGQYFQLERGGQVTWHGKGQLVAYLILDLKCFVKLSTKCYINNVLLKSIQNLLKKTYHLDSVVGVENPGVWIKDNKSKLLSESLKISSVGVRIRHGITEYGIALNINPDLKYLNTFEMCGLKNKRATSIHKQLSHLPVPSVEHVGKLFVDEVALALEMNSVEHINANSL

SEQ ID NO: 15783 - protein, 332 aa, Candida albicans
YFDTFIESAKKKILVVISENIIDSPNTPIAMPLKELVSQFSFTRVLKSDSQTKTISILGKIDNKDAIVTIEKSHFNTGSDLDLQKLITELSLINSNDVYYWSTATLFQEVLELPGAKLNLIYPATETHIRKYDDQKLHYVRETPEMYQKYVIPYIETMKGDRLKWVYNILFEGKESETFVYHDKSPTGFVLLPDMKWDGKNLDTLYLCCIVNRLDISCVRDLNDSHIDYLTNLQKIVKEVTVNKYGIKPDQLRVFLHYQPSYYHFHLHIVNVQHPGLGDGIAIGKAILLDDAIDNLKLDGQYYTKKTIGFVLGENHGLWQIEGYRDLHFKQN

SEQ ID NO: 15784 - protein, 271 aa, Candida albicans
MKKRLVLFDDSDDNSETESDKLKLKSRKKQFKIPEYPQPPSFPVNEQNEDYMKYQLQDDKHEEPTESAIDKKDCSLFLNPSTSIGLSIMERMGFKIGNALGNSATAIKEPIEVSLKSGRQGLGGGFKPLQYKQEDVENLKLNLANSYKQRIELRDLKKIMKLCFELSGEYDKYLEGEDITEVNSLWQPYVKIYVLKQQSAAVGSVKAKFNAVETLQLFEREVENTEQTLSDLLNYLRGTHNYCWYCGLKYNDQNNLLANCPGKTRDIHLTI

SEQ ID NO: 15785 - protein, 400 aa, Candida albicans
TENFYERCRKSISISNDTIVPKALSEFLIKVSELSPRLILRQMTSISQLLDNSNQTLRCSVVEACGNIVVDILKNSTKDQGEDEDADYYRHQVAKLLNLLEERFLDQNPYVRTKAFQALSKVADLKVKLTERRQKMMMLAVRSLEDRSTLVRRNAIKLMSKLILNHQFQGSHGTQLALTFWKQKLEDAEAELMKYIPADVQAGPEQQSDTSDVEDDGDELDKVEQENNLNGQAEATKKDEPTMDIDKEDVLEEGDREGESDIVANTSSFNDNLPDATVLARVKLTANYYKDAVDFVEAVQHGTDVISGLLFSKNRNEAIDAMDFLVLADAYGVENSHVGIRKMLHLVWMKGSSDEGKSVPAHLIDCYKSLFLIAPNSASKIEKATYIAKNLILHHRSKTR

SEQ ID NO: 15786 - protein, 87 aa, Candida albicans
FPLPMDFSLSSYFNAFDVDKDYQIEFSDVDSKLESITDSLANNPESLNFNQELLEDLIELTHGFRELEEKKRHQLSSPSGNGQMPAN

SEQ ID NO: 15787 - protein, 324 aa, Candida albicans
  UNSURE (42): Identity of amino acid sequences at the above locations are unknown.
GIIFKPTNLFKDPNVAYNTLEELSETLVLTISIINQLENEQXEEGEAEANKAQKKISKISKIFYDEIIDQIKLLFSSIIELNQELIIIINNENEKDKTNEDGEDNDDDDDAGRLISVGKIWSNCDSLDQLLNEGDLGLLTTKIKQSISLLDDGFEEFVTWANNPEEIEDDPFGFSDDEEEEEEEEQDDDNDNDSLHSIIDTKELSEFANKWVKKIELIKLLISSFKKSSLPPPLKANPNSILGNTIDEINNLQSNLVQLIDNFIIDLMIDRNIHDDEIIRYTNRIINQAIKLSELAMIIYNHQPLTNYEKKLKWYETFINKISL

SEQ ID NO: 15788 - protein, 282 aa, Candida albicans
KKKIDHYHNLFNHLKSMVKSIAVFGGNGFLGRKICEVGVRRGYDVTSFSRHGEPPEAVVHQPWVAKVNWEQADIFQPLTYQDKLKNYSTIVHSIGILFENQSYKKAMNSNFNFLSDIQNLANNIMGSNPMQKDNVKSTYAAIQRDSAVVLADNYIKSKAEPPRNFVYVSADKVPPLVPEEYITTKREAEFELSCKKGLRSIFLRPGAMYDETHEGGLTTRDVLLRGLRFGVGLKECIVGKHIAGDLVRPVVSTEQVAESLYDALDDKEFEGVVTVEQIQSKK

SEQ ID NO: 15789 - protein, 491 aa, Candida albicans
VKVSPNFHFHPMHLPSQTEQQQQQNPTFPPSPEPDCKDKKRLSLPTRLKQKQTGEVENGGIDFVLSPFKLTPSQPSYPNDDLSVFPETNNGKASVIKRYSATKPTHSRYNSHDLVPIKVEFEKLESGVRSTSVPEKSLKELLTCETIDENTGHFESIRMSKYRNGTLFALNGYGHDTNNNNEEEGDNDYDDKPANTSKNFSEMDISSKRSSYLNSDEKTKQEIMKLKFELRSLKLHNEKLLSFIGFELQKQRNNLKKLSKKQSARLLASSSKNIEYSDAKLIEKSRDLLINKKRVLRSVSINTGFKDRFPIKNIGIIAPNSEPAYVNHYDDSHNDYEDDFIIDDDSHDFLDMNSLSHNDKMIKKFASQVFNNTKALYEYDLDSDFENTSHWVLEEGEEENEHADEEENNSTSNTSGSGSSSEEEQMGVFSQIKHMVIGGDKTVNKSKKKRSKRDDQHLVDDGLKFKFLTIALGIVIIGLKLTPHNNQNITR

SEQ ID NO: 15790 - protein, 207 aa, Candida albicans
  UNSURE (1): Identity of amino acid sequences at the above locations are unknown.
XTPQISQQRDAESYTKQIEEKDVLINELKSSLDPSAWDPEQPQTATNISELNRYKLERLELNNKLLYLEQENVKLKDQFAEFEPFMDHQIGELDKFQKVIKVQEEQIDKLSNQVKDQEALHKQIYDWKSKFESLSLEFENYRAIHNDDDISDGEVELQDDDRSILSSAKSRKDISSQLGNLVSLWNQKHASSSSRDSTDRRWQIHVR

SEQ ID NO: 15791 - protein, 274 aa, Candida albicans
AVPSSPVGEDDVTTPCLNHLKRIRKVDDHLEVIIYPYESDEQCASIMELSRKFPEEFSIDNLEVKEVPQNAPPTKELTQQWSNGYWPITWKGNPNHQFLNSVEIDIEQEKQMINTLLDSLADAAVSQDSTFNFLGTLIASKEDDRIEIHTICIASDINNDPQGHSVMEAISKIAEREVMNRKSNQSERGYLCNDMLVYTTHEPCVMCCMALVHSRIGRIIYLKPEKSSGGLESHYQLGDRDGLNWKFEIWRWLGVDELARLDRINENRCPCIEY

SEQ ID NO: 15792 - protein, 267 aa, Candida albicans
RHIGLRKVKTTIDTQYHNLNILSSSRHLSNCKSLVDKTKTIALQKGNILEVCRSQIYDVVGSVKDARGNLHLYKRKRGVFQGFSLLSIFCDILYSAMVHDCFQFLWKSKQDFLFVRLVDDFLLVTPDSNIYDQVHNILSGKILESYGAFVNKDKTVVVNQTTTKPSIYFVGLEVNTTDLSIKRNSGLISLVTTNFRTFKTLVKYLKTFYQLNLEGFLLDCSFGVLENVLENMGILLKLVLREFQTKFNSIVQYDTFQCYQFIKFLLN

SEQ ID NO: 15793 - protein, 186 aa, Candida albicans
PNNSMPAYHSTFLAEEQNQSINSGIRTIGNLSLLPFHTNFRGPIYSENNSDYDIIEEVLDLFRANSFFKNFEIKGNSDRLLIYGILFINQCLTKLTKFTNSQEATKILINLSVDNFHLPGDIGFPLNSLYVSPANKSEYELLKNYLTQFRQELSDRLIKRIYHDDPNIPSKHWLAFTKRKFMNKSL

SEQ ID NO: 15794 - protein, 95 aa, Candida albicans
DPSSPVVNTEPQDEYPPEQKDAEFARLKRERDELLVRFFETTRKWIESTNPQVSDRYLKDKIDLNIALSRNYIQLDPYVRNRGIYDRDHTLSIGH

SEQ ID NO: 15795 - protein, 244 aa, Candida albicans
TDCTHFTYIDINIFIIFFPTLDIFEVFSLLYIHIAVPTLVKPTTMSFMPSGSNPETASFTCNTCGVKFINAELQRQHMKTEWHRYNLKRRVAGLPSITAGVFAEKILTLKHLAKNENEDEYGFYVATRKKKTNGERQLTKKFLKSQKNRGRTEEVKLTIDGGREASPAASLTSDFSEFSLGDSDFHEVESIVTGSEINYTEESDFTDLEGELLSEEEEDDEEDAEGAANDTSSPEVWKGSAAPT

SEQ ID NO: 15796 - protein, 265 aa, Candida albicans
DSAGLSEAMESILITHCFYCGLNNREIQNNIKHMFNKHGLYIPERSYLVDPSGLLEYLSEVISLDYECLVCGFEGKNLESVRQHIASKGHCKIPYETKEEKLAISQFYDFSVEDEPKTQAKESTKKHVEFSDEAPSTIVVEYENQPGDNERGTGDNGINDNYELVYIDQSGVELTTPARYRIGHRSMQRYYKQNLRSPREPTVAQTTQALVDTRLAPGLSPYYATKQEMDTRRTVYKTRNYVERKRYKTRRANYHKHYRDEILGT

SEQ ID NO: 15797 - protein, 332 aa, Candida albicans
TRSICVLITNHTLEHIELYLAQNDSDSPCPVCGSNPISTVPINRMLPVELKNFFIPTPQQIDLLTSSGKFQYCSLVDRINYYRSTISKMNEKLKKQKEFLYAAKEEITQLSKYKLQVQELTNEIDLLRKQLQSTARPDTFDLSNDNENEKSGEFENNIFTRELSPTQTALHTFINKVHRESLQKVIPTSKPDTDDRNGSTRRRSFFAESTKLGEINSRSISSSNESSNSLNSLKRFSFESPKKKYLQNPIGKRSATSQLATRITANMKLGVPVSASNALSRSYQNGYVNKVSRDPTLTRTMRRASEASPYFKGLNYKYKNSSHDHHQHQYKR

SEQ ID NO: 15798 - protein, 337 aa, Candida albicans
LWKLLFFLASLLPTWRNLKKSQRLLHFFFSLSSPAMTNNSKSLPIPVPKKEDAKLNSLNIPKSISQPLSPLSTPTPITEKAMASIAPMLESFSPKTHAEDSVSRLNSISSSAGQVSDDDLVQPITAENLSNIKSYSNSFVDGARISRTVSNTSNASRKSHAEVSKLPKIGTIGVCAMDAKALSKPCRRILNRLIETGEFETVIFGDKVILDEAIENWPTCDFLISFFSTGFSLDKAISYVNYRKPYMINDLVFQKALWDRRVVLSILNHANVPSPERLEISRDGGPHLDSQLLERLKEIGMSDEKLEKLTNQNEPDWEMVDEDTFRVVFTRRMEGQR

SEQ ID NO: 15799 - protein, 393 aa, Candida albicans
GRGSSSPVAKTTGLPKMPQPFEVIKRVCELMNFYHQIMNYNFETKNVQEFQINWCCGEDPFLFKERWDKLFQEFISVEKTHPSKISELYDTMKYDALHNRHFLQKIFSYDPNDKVLLSRLTETCGSTVNSSGLVSEYPINILAMNNFKLPESASTSANNSSSNLNSNSAAGSLGWVLSGAATTMKCESKDTSASPQTPFDHPTFARLRELYRLSKVLFDFICPQEYGIKDEEKLDIGLLTSLPLAKQILSDIYDMKKNDRPALVNYFTKESHIYTLLNIIYGSQLPMKIARNALPELDYLSQIVFELYEAEDPSSPTGKKHSIRLSLSPGCHTQDPLDVQLDDDHYIGCIPRISLTRHLDMDLVTQRLKSRFSRVSLPKKFTPVNITGPLNSK

SEQ ID NO: 15800 - protein, 231 aa, Candida albicans
  UNSURE (29),(44): Identity of amino acid sequences at the above locations are unknown.
SQFEQKAQKWVFKGMVTVIRHADRTRKQXFKYSFRSPVFISLLXGHREEVIIRAVPDLQVVLETVKIAEAKGLEDLNKLKQLRIALEKKMDFPGTKIQLKPTLNAENPEVVDKVQLILKWGGEPTHSAKHQATDVGEQMRQNLQLLNREALDDVKVYTSSERRVIASAQYFSASLLSIDEPLADDFLIVRKDLLDDSNAAKDLMDKVKKKLKPLLREGAEAPSSPRDEIRV

SEQ ID NO: 15801 - protein, 160 aa, Candida albicans
IEMASNLLECRMFPLYDPIFNEKDNEILKDFTIEKEFTSDSSKTLYFLPHASLELTEEVLNTNQPKYFLANDVIAHTDRLTKKKLADNYPTLSIIVHLLGENKVDDGFTRVSRKRFKEPVITYDIDSVYFDKVQISRYLHTNKNDAWGTSFTDLAYHYIS

SEQ ID NO: 15802 - protein, 346 aa, Candida albicans
NDSGSNTKNIAIDWVCKICSFNNHLAADYKLNENELPKCTSCGIRPSKSYLMQILDSAQNNIPIREDSPASMTPEPESVSPNNDNQCPKCTFINHPALRYCEICGTELKSSNNNNNNNNTKLFKVTQSLSNVSINSNPLNLKLETGEELYTNNQPYIKLSFRKGGESKFYQEVCKVLDDIKWQILEEKGGINKNAVKLVDNSSTVNNNNTASGGGGGGIHALERLGELQRKQNEMILTTSLDDLEQLMFKYQDLIKLSTSFNKLIKQPPSTTSGVVIPALSIKKSSPLYHQELSRHISEFSINFKLTQKTSMISSQDLFAEYNRFLIRNQGFGSELINCDDFKCAI

SEQ ID NO: 15803 - protein, 365 aa, Candida albicans
QPIKEEEGKKTKMAKKGKSSKSTPEPTQTLASTNTKSKKKKDVTPTPSTIATQATTPKPQRGLAIGDNFGWTGKLPVTLLNEHCQKQKWGKCQYDMSKKAKGFVGIVTLTWENPKTKELIPIKFYPNYSPKETTNEARHMVATFVLHRINYIKNMKMLLPIIFRDYWNELEDERLKLLKENKELHDKRYNTNPFTVYLQQRENEEKKAKERQIKEQNELKTKKPTISLGTKSSTNSATSATTKPLKIESDTRKFPKKVWEQAPFIDIPSDIRTSIEHSIRNHIDWVNTDQDLLINNPSMAKTASEKLSALGFRESHIKESFNYSSRFSESLEWLLFHIPEDDLPQSFVKTDKDSKVQLKISQNLE

SEQ ID NO: 15804 - protein, 128 aa, Candida albicans
  UNSURE (63): Identity of amino acid sequences at the above locations are unknown.
RKAREQYRQLAAQPPSPMFPMLLKDAYVAYRSSHHTTKLYVRDLTPTSTFATLLFGGDFSYDXNITLGQTSPGIVIDNWLPIRTWCKNGVLIKHLRRLIDSVIDEKLSNPESPLDEDIFKVIERIINL

SEQ ID NO: 15805 - protein, 242 aa, Candida albicans
RMANAGFDQDEILEVYNANNNDEHKTCVELTKMLLPQPLESLAEPESQEIWNEEIEGLEMTGIPVKHEKNVATIKLEHNFLNVKIFKSENYPNEIPGIHIVVSKNEYTLANYIKLAIVRELLKYLTDHIGQCMIYTIFEWLNDHVNKIIENPGPLMTTEKVTKKVVVSQKGNKKDHNKSVTFISDKDIELVKESYKKRKHSDEFKEMLIQRSKLPAFAKQESLMTAINSGSVTLITGRNWVR

SEQ ID NO: 15806 - protein, 118 aa, Candida albicans
NFINCISQIMASSKSLKFHAGKVQYDEETNRCTPLQHKGVISIKPSAEETDFLDFTWTPKQDQTQATPGNIEKDEFLLIPGDVTIKHMKSCYTGRVFALTSLSSGAKYLYWLQDVGDI

SEQ ID NO: 15807 - protein, 621 aa, Candida albicans
  UNSURE (380): Identity of amino acid sequences at the above locations are unknown.
TNISLQNYTIKSINLVTKKQTSMPGNVHNSDFLFKKSDSFNEFNTKNTMSMGSMMMAAIYDEYSDIEEEDQEEEEEAEEKQADQPNSQPFYEGKLNDDTSDNFQKYGIGAKLLMKMGYQKGKGLGVNQEGIINPIETKLRPKGLGVGAVKEKADNNYSDSDKDDLAIDFENKSTKTTASSLSDKLYDTILRFEKLNVNIPSHVKHFLDQRLSLLDESFVLKAEVLLGSLNDIYGEVTKIIDRENIIDYLIKELEKTNESTAIENLQKINQILRTFSSSEITYEEASKMILTDFKLEPSAALAYLSLRRDQLEQLTDVAFSDLSCQKEKVIPILHSIRNEFRQFSTEVSTAHLDKYLYNKYSKIIKKILYCAPTDDEDEYXDILNHEVLLSVLSLWESSPISVFQDKRMTQLATNIIVPYLRSELNILENDNSTMYSLPEYLLDYIAIFCNDELGTFEQVFTEYVDRYQNFLDVEAPSSLWNFLTLERKVEQVFTIIDEFNHNWAPAVTKFLPRKIEKFYNTFFRSFAKWLEGILFGGADDDITRVDNAFVLLKYVEHKDLLSLLQFRIFNRWLQTFLQSFTNEPHNVPKWYSFWYSYFANKLQECDNITSETINWYLNKAW

SEQ ID NO: 15808 - protein, 117 aa, Candida albicans
QSKMATTIDPTDYVEVENGTLAFSDPKQQAKFELGVCMAIYKWEELTTAVDNLWGGPKSAEKRDWISGIIIDLFAESKIVDIQLIEETLLYAMVDEFDTQIDNDSALEIGNLIVKLY

SEQ ID NO: 15809 - protein, 190 aa, Candida albicans
LKSLRQRIFNDQMSGTGNSLTTSEIKLITEYAETQVAGSPQYCISSLWTWCYGNYETYTVVGKDGEIYTKKKNEVLTCTDKSSYVFDYINQLESIGLEIILAYAYQSSTFTTTLYEKQVSSRNAKFQLAFNGIIFTCCAQFVNLICLFVIYSNRGSSRDLSKIPSLVLHVVTLISLASSLSIIIRLAMIT

SEQ ID NO: 15810 - protein, 112 aa, Candida albicans
QLLAMGFFTSSGEEVTFAPNKGQRVVCWEKRDGFFECLSKNYIDNSLDSKELDKVNKQCGTEKKEFEQNCATSWVKYFQEKRYNDLVRQRYIDKLESEGAQPLPFKIEGVKK

SEQ ID NO: 15811 - protein, 602 aa, Candida albicans
SISIAYSIILVTVMSSESNGSASKRRKVLEPSKFRPGFIRKVRVWNFTTYSYTEFNLSPTLNMIIGPNGSGKSTLVASICIGLAGSINLIKRKNLKSMIKTGQEKSSVEITIENYEGHSPIVIKREFTAKESNWTVNNKRATESKIKDIRTKFNIQLDNLCHFLPQERVAEFAGLSPEKLLMETERTLGDGHLLIMHEDLIAKDNESQQLGNKIKDIEGRLAKLHEDRSKLEEEARKLEEYDRKSEEVDNHRLLIPYAKYQDLKNQRTHLKRLRDEAKHKLRTFQANFKPLENDIANAEKSINEESEKYSHLKDSLKLTLNEINQHKSTQKQVTTEISELRANLKSYQTRAEQKKKELEEIKKEIAELQEKQRGLPQVDPEEMQNLSTELTSKRHELRDLEEQFQEVNSQRSDIGRELTHLTEQLRGAEKRLLTKDKLDMLVSDARQNGRSYRLRDEAFDVHKRLRNEPEYEGRYFEAPVISCNVPDINYAAAAEKIIDNNTLFAFTVTNQSDFDFLSKFSQQTNTNTPLRMVNSVVNPTHEYSKHQLREFGFEGYLSDYIVGPKEVLSMLYSTSKIHTIPVSKHQLSSEQVRRLTNVSGND

SEQ ID NO: 15812 - protein, 481 aa, Candida albicans
  UNSURE (208): Identity of amino acid sequences at the above locations are unknown.
FKYVLLAALWTTIQRSKYGSQQAFYITEKIGRSQYFGVQGLSQEAKDAINAEISKFKEKIEQKKRAYEGHRNNIDSFNERLTEIKHYIHDIKRKQLELQEISKRAGQLQTKIELKKEREQKLEKDSKRDYSLKIRMFEQKIDEKYLASGELFASLSNSVLELCEKENQMKLKKLEIIGYKNKKLTAESLLDELGARQEKLKNDYNRYXREYDEITQSEAFKEIERQNEAYTDEERSRLADLAQVYVENGTFTEATIRLKIDLLEDELSLLTTADRGSIDALKQKLQDIQLAETNLPLLQTEKERLDTRIKGIQEEYEGELTLLVNKISLAFNKRFTKVASDGRVQLAKLERFKDWKLQILVKFRQESELKVLDHQSQSGGERAVSTIFFIMSLQGLTDAPFRIVDEINQGMDPKNEQMAHRYLVHTACQNSKSQYFLVTPKLLTGLYYHPDMVVHCIFTGPYITDNEEKRDNSMGMLDFAV

SEQ ID NO: 15813 - protein, 457 aa, Candida albicans
EKMSSFANLFGKSTKVDENIEQLFKNTRDGPVSKDELVKKQRTVIKIPKVTAPKQQTNENESTLNQSADESDEEEEEYNDESNEGDDSDDAEQTEPTSKNDDENENLEAQYFDKLLSEQNEEQDESKESSEAKSSKVAEERTKTKVATTVDLKEKELEKADRTVFVGNVPADVITSKIIAKNFKNLFKHYGKIDSIRYRSISFDEHLPRKVAFAKKNLHKSRDSVNAYIVYKEKPASIAAKELNATVFEDHHLRVDHVSHPAPKDNKRTIFVGNLDFEEKEETLWKYFNSKLDQDVESVRIIRDSKTNLGKGFALVQFKDTLSVNKALLLNDKPLETGTQKKGRKLRISRAKSNAKPSLMSPNHFDNQKKKFAAGKSQQKLNDNQKTKIGRAQSTLGKADRSTVGKAKRIILEGQRATKGEAIKGIKGSKKGKKVKKPRIRERSTKFKEERKTMNKV

SEQ ID NO: 15814 - protein, 702 aa, Candida albicans
KTMSEVSNKSQENKELLYADTDAPIVVLYALKHFEALSSKNAKKYAHYLSRASFEGTRAVLRSVSPESEPIFDMILAIHGKLGTPKSVEEYQQKLAPLTKQDVQHYLEYTLQFLDNAGNYKSFGDKKFIPRLESETFDKLIKIVDDAKVSELYSKVKEALFSTEKGLLGYAEAGHLSNYYPNSETITKQEIDLVNQLLAENGIMPENTRVEKKSDSEFIVHVASSETTNKTTYYPKDKLTSKDDKITVTFQFGDHHEQFQKIVENLTKALPYVANETQEKLLKYYIESFSTGSMNAHKQSQIEWVKDLKPEVESNIGFIETYRDPSGVRGEWEGLVAMVNHERTAKFSKLVENAGTFIKELPWDKIYEKDTFTPPDFTSLEVLTFAGSGIPAGINIPNYDDVRLNYGFKNVSLGNVLSANPKNPKQKEVITFIGDDLQDEFKKWRDEAFEVQVGLHELLGHGTGKLLQETSPGKFNFDNNDDRIKSWYGPNDTWSSLFGTTSGSYEECRAELVALYLILKKPEQVFPIFDIEKKDEQTIVKFISALLMIRAGLIGLEFWDPSSSKWGQPHMQARFAIMKQLHKANVFKFEYSNPDYSDLEIVVDKTKLTDGTAVDALGEFLSNLHIFKSTGNVKQGLEYYLNKSQVDPEYSRFRDAVLKQKKPRKMVIQANTFFNESTDDIDVVEYEESEIGMIQSYYDRNV

SEQ ID NO: 15815 - protein, 249 aa, Candida albicans
LNHLIYHHVQLKIISPRQEQSPIIYNNNNSNSKTYKNIMTLWMEIPIILMPLKEKRFFHQQIIMLMMKNLNKKECPEARKPTHHVVDDNDDDDGFYDITGEPVIVQPPLVRAKSVKNSIKRPSRHTKSSKDKHNHNSNDSENHHNGKTHHGSSNSKKHRNNKKSRGTNGGGGLKPFSYTTLISLLESMNGTIIGEEFNQLNIPIKEKQLIEKIIDSLSRLTSDMILDQQRYEVGIDRLEKCLRVLEGFM

SEQ ID NO: 15816 - protein, 157 aa, Candida albicans
KTMLSKSYRAISKRSFSQSLVVFANYGKPQNPPIDTEIKLKIQPIVRTGETIEVKRARLLYQSRKRGILESDLLLSRFADKYLKTMTMEELDEYDKLLDEADWDIYYWATKNYKITPLPDKWKDSKILKEIQKIANNDEKVIMRMPELKLEPESNTK

SEQ ID NO: 15817 - protein, 294 aa, Candida albicans
LHIYRLNSNMAKLSQNWKKLSSKIQDKPKNGSVKKPTLKGKISKKVKASISEKLSTTNNTTTTTTTTTSTTDVVPIASSTKPTATPLEYTLWTQNHTINVSHIPKTPKPLPLSRNDSRKLDPGKYVAIDCEFVGIGKDGEESALARISIINYYGVVLLDTYVRPQERVTDWRTWVSGIQSYHMQDAIDFKTAQLKTMELINNKILVGHAVNNDLDILFLSHPKSMIRDTCKFPKFREIAGGKSPSLKKLIKHFIQVDIQIGQHSSVEDARATMLLFRLFKREIEQSMRNRNKRQ

SEQ ID NO: 15818 - protein, 286 aa, Candida albicans
VIIKIVENFPFQQQKQPQRQLQVQEKEIRSSQKLLSSRGLDNRIKEMEDLFEQYQTSDTLDNWCEVEIKSEKLLVTIKESSYLNVEVYYDELISLYPFLDVNHSDNLSRFTGKTKPNVSNDDRFYLGIIMLNSIFRGYALYEQEFDFILREELKNLKQSNNPIIPSNGGNSKMLKYFGKKSSSLIKNSTSSNQSSPATSTNTSIVDVPIEKSTSNIGDNSNNGTSSLYTIVNEFINTPEDVYENSVNFDYGDTIMKLLQINKKIYWDKYNVPVNIFTTGLEGSAIG

SEQ ID NO: 15819 - protein, 262 aa, Candida albicans
WRIFQAVVKTSILGVDEITTSISKTNKETNNGIADLRYYPIIRGDIHFPKDLLITIFEYSSDLGNYRDLFSFEYQDLLNLSHHTNNNFNDSSTNNTITFNTSSSSSSFSFSSSSLPYQLIQDLRLMVPKWIGQPILFNKHPIKESPKITFQLTEVDYNQLPSYLKIGGKSNKKIKKLPELESSIKLTSHNMLRVLKILNYLVEKFANTTKEMKDKNLIPSDWLVLQCKGQELNNDLTLQTIKTKIWKSSSDIELQFRRKYDK

SEQ ID NO: 15820 - protein, 60 aa, Candida albicans
  UNSURE (9): Identity of amino acid sequences at the above locations are unknown.
TLDFPARRXKNKYIEMNGRHVLVTSHVYELLCKWFENDGDWETAFNKVLPPRKIKLKSPS

SEQ ID NO: 15821 - protein, 226 aa, Candida albicans
  UNSURE (3),(23): Identity of amino acid sequences at the above locations are unknown.
MTXQTLEATVVNNSPAPTIPKIXREKPTPEEIEERRKLKQLEVVPEGFSRKQWKRELKKQRWQDTKQEYLEVQREKKRLARQRKRERLKDLDENDELRKAQPIPSRQISTNNVSVIIDCDFDELMHEKEIVSLSNQIKACYSAMRHCTYKLPIQITSFNKRLKQRFEAQLHDYHLWQGNISFTDRSLTEYVTGAPNSESKDNDGNSNSNTTNSTDTVFTTGWKEPP

SEQ ID NO: 15822 - protein, 364 aa, Candida albicans
PSSMRKGAYWSNIDSSTNQYIDNDDISKLLQKDTPTTDFPLFIHFEHFKSQFVTIQLVMSSKTIDGNLLSYMSVMEEIFSLSIEIPKEDGSVEYIPYEKVIADINRDLIEHQLDNGFDDQFLELITVKIKFEIKNYQKAINWLYNITNHVKFEMNRIRIIIEKIINSLPEKKRNDELMMHSSQCRHLFNENSLRKAQDSIYTESFYKNLLEKIDNQDNGFEEIEKDLNKFKQQLFQLDNIKVIILGDVTKLKNPVSSWNRFINPPPPRPTTTKTSSKIIPFKDLPKSYQYRSSLGESCHGEAFVVNIPSADSTHLTSITKIPHGNYLDEDIFRIALATELLTVMEGTILGKPIKGAGVNLWEFI

SEQ ID NO: 15823 - protein, 211 aa, Candida albicans
KNMHREFPPQNFICIFTIWLLLYSCFFFLWLGKFFFTTLNKRFLILITTIHHHCQSPIISLFNRLIGKKLLDGVTHITMTKFNSPFIKQTSFEVDYAPTHITKWKSQRTGLQLTYINQPSPIVNGYFAVATEIFDSSGAPHTLEHLIFMGSKKFPYKGLLDNLGNRLYSSTNAWTAVDQTVYTLRTAGWEGFKTLLPIYLDHLINPTLTAS

SEQ ID NO: 15824 - protein, 265 aa, Candida albicans
FNNELLSSTNMGTFKRPFVDSKHDEPLEEVIVKEVEFPENDETIGELSISWIGPVCNDTLTNLAVDMVGAYFFDSRISIFNKNLIEIEHPLATEVYYDTDDFYRTALNFNFGGVPTENLQELDTKIKQLLKEQTTPNKIELEYMKQIIEQQKLKFIANVENSASLFSEMATLEFIYGATDGSDLSKWTKDLKEFEILMDWTLEQWSQLIDTFFVQNKSATILGKPSSKLNESMKLQNKQILEDIKTKYGEAKLADLQLNLEAAQS

SEQ ID NO: 15825 - protein, 197 aa, Candida albicans
STNSVRQAVVKTSVLPSEFLKLYPYRLRFYSTNDLFSKDEIDKSKKWLESFTHTQIPTHLFDISYSRSSGPGGQKVNNTSSKATVSLQPGLWLDPRICFWIPQPIQAQLKSKGIRYETKGGGLLIQSDTSRNREHNTELCFQRLVEEIKSKVYFASEVSQEDKEKWQELEEDYKERKKFNKKKQSDKKKNRSKKFDW

SEQ ID NO: 15826 - protein, 474 aa, Candida albicans
YKMVKSNLELLFFDLATQKNLYEKIYHAMDLSLANPIMKDYLIHLALTFPKFRIAELEALADLYNIDVDLSSHNEDSTFLVVSLENDEQARQLISRSVMSFGIYELWGYGETYDKLHEDVRAKSADKFEKYKDVSFKFDFKNFRGRPSNKGKVRIIESFSYLPFEGKIDLKNPDEIFTVVEEYKYNDRAKSESPIHIWFTRQLQLSERSNGLVETYDLKKRNYIGTTSFEAELSLVTCNLAQIAPGKITYDPFTGTGSFLVAAAHFGGYPIGSDIDVRMLNGRGNDKNVKSNFKQYGTSGNFIDVLTMDFTHNALRKDFQIDSIVCDPPYGVREGLRVLGAKNEEKAAGREHDVFDGEIAYLRREFIPPKKPYLLANLLEDLLQFASERLPVGGRLAFWMPTANDNFEETQIPQHERLELLHCLEQLFNQWSRRLLVYVKRDVSYKGITSNGLKEKNIRDFRVRYFKRFIDKNE

SEQ ID NO: 15827 - protein, 115 aa, Candida albicans
LTMCCRHVCSLEQLLPQSRKYLHDHGFTTVQSFNVLKKLVSWAVDKKDAQENGILGLNTHQREEIGLKARRLIDESRVHALKSILNDKYKVEIFWYVQKDVTLENVCLSISRRTK

SEQ ID NO: 15828 - protein, 311 aa, Candida albicans
  UNSURE (262): Identity of amino acid sequences at the above locations are unknown.
GEYLDAIFANKSIYLTTMTILETKKRKLDQNVLTCEYILPRKNRRCKMLRKKDAKYCSEHLIHDENFNGERIACPFSSSHTVWKKDLKQHMKKCNDRPKENTNSCYELDFNKLLNNAENFELANEEKEENTELMEKYIHVLQKIEFEPLEFRILHHEGLETRLQEKTNQKHPIQQNSIIANMDLMGLLSNSFLYLEFGAGKGELLRYLNQCILQQKTECSCTYGFGLIDRGKNRLKADSKIISDSETLQTKPQIKGSKIDIXDLNLDKFLVDLKIDKVVAISKHLCGAATDLTLKLILNSTLLLNDQFGVP

SEQ ID NO: 15829 - protein, 312 aa, Candida albicans
LNSNNYIYIYIERETIMSTNNTTTNNEDLISSLYPPPPPYYKFFTKDNLQKLSTWQENNQTTTVSSEVKLEEENTDPDSNNLEENSIPPGELRFLIPPKQPEGPQYRGYGNIWLFEDKLPNLKDSQWEQLYNTSTSTSTSTSTANTNIITNTDTDINGNQEVDAGDSTGDENLTSETKIKELHKLMDSLLLNFLELIGILSIDPIKYDKKIHDINLILININHLLNTYRPHQSRESLIMLLKNQIDYKFLEIDQINKKCLDIKSKIKNLINERITVVSDGTTTNTTTTTKTTGLGDDDSIDKKEQLKQDIIN

SEQ ID NO: 15830 - protein, 530 aa, Candida albicans
SMTSTPKLDANQLARQRKKLEKDRRKKVYDDQQVQGTNNSSIVSKRSVEKLYTQVLQPELGEWFQYFVPKGKRRSPAINRGYWIRMELIRQMVIRIIKANSPNVRINVVNLGCGFDPLAFQLLSLFKNQYNLNFIDIDYPDLVNNNYNMIQQSDEIKQLIRDPGIKSTDLFVMETDNYQLVGCDLKNLAYYKEILPKLVSRNVDPHPTSINIFIAEVSLAYMKPQFANPVIEISSQVNNSHFLILEQIMPDGATNAFATKMLYHFQHLRSPIQCVETYPTEKLQLQRFKRYYKHAEIKNLYGNWKFLIDYQMQKNISTIEEFDEWEEFIIFCQHYVIVHATHMDQLIYDDESSEEQKNEKAFSEMSLDSSVAISHDDRFNDEQLQLKFPAIASFKDKIYVNGGLKQTRNDENLEIDLQTGVITKLDQTENLPTARMCHTLTNLGENLVLIGGRSRPGVFFKDVYMFDTAKKWTRLADLPVGRSRHATVKISDHEVLIFGGLDASSSTTGDELFLLCNTNTNSYTPVKPIG

SEQ ID NO: 15831 - protein, 122 aa, Candida albicans
RERKEKISAKKKKILHQTEPHLIMYFTKHIHISVMSDTIILPGDKLLIDEDIFTVKTTIGPGIYKKPKTQELIPSAAGTLHYERAKSSSQQLIYIESNSKRYIPHTNDYAIGIITGAISLAP

SEQ ID NO: 15832 - protein, 655 aa, Candida albicans
  UNSURE (397),(451): Identity of amino acid sequences at the above locations are unknown.
IIRIAKYGIIKSPLEFHTKPLQLYYFAYVTISTTDSEFNKLKKSLNGVLFMGMKLIISLAKPNYLERWKKSNSKDKDKEGGRSNNNQIKQLEQLRRDKIVESRLEKIQEYKTNYPTNKFTSNLITCYNAGFNQPEISILEHTTNNISANTKNPPPKHRLIGSKSYGALTQPNKFNQNRFLYRSGKGIVIRGVHRKTPRLNLKLKQQTLRILINGELKIFKNYKTKLWGIEKNKTIRDLTWKYINGEWRSGDDHIIEKVTCGISSGQQAENYSKDNIIIDKEDNSGNKLSSIDNDNDNDNDKEEIDKNKSILASMFDSYDFDKPIELEETGNEIHGSGGKVATAAADDDDDDDDEIEVDSKGRKKAKHYDYEIEGKISEDEPEEEDNDAEKINTVDIXSANQIIENYKQSSSFVPTKETYYDEDDESNEIELDEFNNNYTTEAIKSNYDQDXPDLNVEREDNDDDEEEEFIPTFGAPKPNTNNTETLRALFDPTTSNTTIQPTSIADNGSFKLGLQDDDEDLDTDKQLDNLKQQELYKKLQKQRQEQQQQQQEEETNNQQLLSSNKKFGLFWCHFDSPFLSTQSQFSKLGGGGGNGKIKLPGEEEEEVEGKDDKDQDEDEESLYEKWFWSMRGDISRECKRRKRDLLRTIRKKKKN

SEQ ID NO: 15833 - protein, 275 aa, Candida albicans
SPTYYIMRQKRAKAYKKQMSVYVHAFKFREPYQIIVDNELITTCQSASFDINKGFTRTIQAENKPMITQCCIQALYDTKNQPAIDIAKSFERRKCNHREAIDPSQCIESIVNIKGQNKHRYIVASQDLQLRKKLRKIPGVPLIYMNRSVMVMEPISDVSNQYNMNYESKKLTGGLNDIEAGKLEKQNEGEDGDGDELEVKKKKRKGPKEPNPLSVKKKKTDNATAANTNQEQKKKPNRRKRHGKSKAEEKEDQEQEQVNEATTNEDAQEAITATE

SEQ ID NO: 15834 - protein, 207 aa, Candida albicans
QMKYIIEHMEEGFSEWVILEYTQIIKDIGKDNLILTSLPPSTTEKDIPKRLLELGLQWTTKECVDIDGGIDKSKVCLLDPAAETDLTPQDKSKFDYFVFGGILGSHPRIDRTGLLREKYGFSGRRLGSLQMTTDTAIRTTQRIIENGVAFEDIKFLDYPEIKYNKYESTEMPFRYVTDNEGNPILPEGMLELIKNDAEQSIDDLLIE

SEQ ID NO: 15835 - protein, 237 aa, Candida albicans
DNQQITFLFLYVIKHSIIMKVLLATFSNLSGYTTLRRSWSLQYTFLRLFSISPASRSAKETTTLQTVKHKVRWFYALDVPISKPEWYKYEKVKEPESFIPFSEYDSKQLEREFSKTERNLVEVNEDKLFQVDLKNFELSPIYWDGPIYEVRRGLWFNSDGMPLKAELTKEIEEGFQRLKPYTYESANEEQIKTTKSNKEKISTFNKLKQDTQTEIKIDLDKQKDVIRLSNGELVLYF

SEQ ID NO: 15836 - protein, 507 aa, Candida albicans
IQPVSLLGVNHIQRGYSEELKESFFDKLSKNPLPGISDAFKEDFGSIIGGKKDSNKTNEDEMSDVNELDDINMQKYLESDYDLETSKSKSNREIDHLVFCIHGIGQVLGTKYESVNFTHSINVLRNTMKGVFEQNEEYQKLANSNSEEHDNTNNRIQVLPISWRHRIGFNPQQEFNAQLPSRLPTLSQINVEGILALRDVVGDVVLDVLLFYQPRYLKEIMSTVTSELNRVYKLYLEKNPDFKGKVHILGHSLGSAIAFDILSKQSSSLDGPLKIDKDLAFDVNSLFLVGSPVGMFKLLEEKNIVGRDSKSFVPSQDDTFASPKCVNLYNIFHPCDPVAYRIEPLASPSFGNYKPVDIQFAVKGLNTQFKELSNFGDEISEKISFATKWLTSSKSDGTEKTIEERANKENALGDIIKGVVMSDETDQDQKGLKKKVILGGALSKMTSLNMTGRMDYSLPLGVFDVSLVSAISAHISYFEDENTAGFILKELLANRSTPVEETTVTSK

SEQ ID NO: 15837 - protein, 303 aa, Candida albicans
KPGTFAIEDEQLQQQDASKSRDFPTESAKETIINRLRNIPHEELKEILTNQLDLEIQLKHRELNISDNEIGKIESQMLMLRKFFDIPNDKKLNNEPTDFTTKYFDILQKSLTSTYDNFKQLPEAPPQLNPSYLDGNKSGASPVSQPVHSYRTRSTTSSLRPSATSIASGIRNPSLGCLYRRTDGVVVRLTCPNCQRSNFSSAQGFLNHSRIAHSKEYTSQDAAALKCGDILPEIKQDLTGEASIKMLVERGLDPTRNLNVNEFLFGRINTATTSTGEQNSATDGSSTMNLSSSNARKLEGEKR

SEQ ID NO: 15838 - protein, 326 aa, Candida albicans
SIMAKKSEELNVVSSEPLDSIDDSSKKDTTVSTDDKESTTTSEDNKQEKTEESKPEEKKEESKPTDTTSETKPETKSEAKIEAKTEPKKDRKSVSFKKEIDSTEEVPINEDEQDESVPPPQPPRPKDPTQEIIDDMKQAFPNIEEKYIIATLIASQGNPDPAFNALLYISDPTFKPEIPVYKPPALASSTGPVGTGGGGRNQKELTDDELLARKLQKEFELEDERNRRNRRRSSHERQRVEQQRQRQHRRGDDDDELDDSPDEFEQIKETFTQGLEEAKSTLNGWVSNIATRFEGNNDGNNPPQRRNDNPKLFGALGGSSFNDNKR

SEQ ID NO: 15839 - protein, 248 aa, Candida albicans
VHSCPLFYITFLSTKFTLTTTTTTTTMDLASITEWTPTTTPTSTTLSTIAATYVPALQSKLSNAIDTLTSKGSTIDIVDYISVSRIIRGAQASLSIISAQQVLATATNINTATATATDVQLQAQIQAQAQAIQIIWQATENLLDLAWEMNVYAIPKLNRVANILFLVIFAITFVMTCLMWIKSRYWWFNVSWTCGTALEFLGFLGRVLSFDDMTKFDYYLLQLITLTLSPVFLMAGIYFLLWCNWYLT

SEQ ID NO: 15840 - protein, 352 aa, Candida albicans
KKDRLMNTMDLAVITEWTPTSTATSTTLSTIAATYAPALQSKISGAVHTLTSKGSTIANMDYISASRIIRGAQASLSIISAEHVLETATATDVQAQATQIIWQATENLLDLAWEENVYDIPRLNRTANILFLVLFAITFVIACLMWIKSRYWWFNVAWTCGTALEFLGYLGRVLSFSDMKKFDYYLLQLIALTLSPVFLMAGIYFLFGQLVVIHGRQYSWLKPLHYSYIFITCDVVSLVIQAVGGGMTAIAAQEYDDVDPGTYTMIAGIAFQVFSMSVFLLCWLVFCWNIYFRDISVNESKPSPYQKKSFMTFIKLLLNGDDANMYKLKVLDIYYNLSYKDFFKQQPLAGIM

SEQ ID NO: 15841 - protein, 454 aa, Candida albicans
ETFLGVPVHSHPSTMSEILNYLSSWTPTSTHTSTTLSSIGTSHVSKLSQTVASVISQATTETDWYNLRSLSQAYRGAQASLTIISAEKVLATATDSQVQSRATQAIFEATLNLKDLSMEQNIYGYELNRAANIIYLVVYAIIFGYTLLMCIKSKYWWYNVTFVCGYGLEFVGFLGRVLSFNDTSNMSHYIMQSVALTIAPAFIMAGVYFLFGQLVVIHGRQYSVLKPMWYSYFFITADVVSLLIQAAGGGIASVASSNHKDSSVGTNIMIAGIAAQVVAMTIFLVFWFEFLNRLYFKNSRSDLIVDCPYGRRSISNYFKLLLNVKSVRGHRHTHLEKYYNEKFASIRQIPLFDYMVLAMTIAVIVVYIRCVYRVAELAEGWGGYLFTHEPYLMILDAAMIAIAGLIFIPFHPVWVFGKNNIVKLATIKKNLDENEKNQDVEYNGLHPRGWKVPR

SEQ ID NO: 15842 - protein, 501 aa, Candida albicans
  UNSURE (284),(308),(317),(344): Identity of amino acid sequences at the above locations are unknown.
FTLIMDGVSLLNQYLPSWTPTSLPTSTSISTINPTNTAGLALTLLELQNAIQTETNTISLYFLSRAARGVAASYTIISGQQYLATATATQDFPEVTSAMVNATLSLKQLEWKANLYAINLSVPFNAFFAAMFGVTLICLLGIGFSTKTKYFTICLACGTILEVIGYVARTLAHYSWSDPNLFLCQIVSLTVAPAFIMAGVYYLLSQMIIIHGEQYAILKPIMVSIIFIFCDVVSLFVQASGGAAAAVSLRLFKDTELGTYIMVVELDSQVVSKTLYLNFQFDFXYRSFVTANSNIKYSFTTYCLLLIXTKKGRLLRXDLEPFYDVGYIHIRHRSLFNYMPLVIXISVGFIYIRCIYRVIELSEGWRGYLITHEEYIFALDALMVLLTCITYVFFHPGLVFGKQMTAQISVSANKSESAADHESHCGNSRMYNYSKNHSNSPQSSHDEKFIMDQRQKYYNPYFLPTKFSQYNSHSCPSSETYTYSSYNSKLETKSESSWQNS

SEQ ID NO: 15843 - protein, 423 aa, Candida albicans
AIMAKRTLRLAKAAKAKKQKKEQEHQEISASPDEESSSSNQLTIELPEEIDANDEISQLKGLHKTYLQSERDNELLVNGIIHECDRLLRENDSENKQPLPAVFHAIYAIALAELSKFHTEELDKVKEFFIAALERVELGLEKNPNDINLLVAKTKILLDQILLQYIAPLTLESDVKELDKEIDELLDAALSVYESVEARAKELKDYSIFDDSETLDILEALDDILDIVDNFGKENQGDDGSDEDDEEDDDEEEKSVELAETHPLYKIKNSDKYDQWWRDHTHLYLDNLEKLENGSPELKREVCHRLGQSYLQESEVPYLVFTTLKYDNEYDGIEELEGLTEKEAQKISQELITKALDYLKQAKDEEDPETWVSIAEAMISLGNLYEVDSKEQEDLYLEAEKILKRANNVTNGKFQEELDNLLP

SEQ ID NO: 15844 - protein, 186 aa, Candida albicans
TMKVTIRLYTESSFSVTIPDNATVDDMKQSIKVGLPADITLPHDFKVIYNGSKLQPYYDELQSFGMKSAEDNSYTVIVMSDNVDTPPITPQQSVESLAKSSTTTTTTTTTNATIKKTKKKSRCAFHNCNSAPLRMVGTCTHCQGKFCAKHRLLEDHMCTGLQYCKDNAHEKNAMKLQSERTIANRV

SEQ ID NO: 15845 - protein, 470 aa, Candida albicans
INGIMSETKNIESLISDAGPLITQPATTLQQYATAYYTTPGVHSELKDEYARQQLAIWGDSLKIKQPKQEYIDRVVKFAKLTGDYSVLSVNDLHIVALAYELECLNNGEDNLRSFPGEVLKNQQAENENGSNKMSNIIGDDDGFVVATKRRGGRRQREKAELRKKGLLPTFSPKPKGGLETEEPNELSNDKTIDETPQTDLIKGVDVQEQESQEEPVSESNTVGLDEITEEYNEDDDDGEWITPENLQEEIIKDKNEQVQESNTNGPLIKVALATGDFACQNVAMQIGIKLLNAMSGKQITRVRNYMYRCHACFRLTPMSKDGRPKHFCPKCGGNTLLRCAVSVDNKTGKITPHLKQNFQWIRRGERYSLPSPLSKNQKKLQGNGGYQHNKENRHKSLQTPLILNEDQKEYQRALKNDEWERKQQDKMLQEWIGGGSADNFVSPFGNTIRNSGVKVGRGRYANSSKKKRK

SEQ ID NO: 15846 - protein, 300 aa, Candida albicans
SVNTVSLLSFPRRIYYHKLQDCFMNYLTTIQLYESKKNVINDIQLWSTNKTLKLPTITSCKPISYIKYASLPFYLVYCCPIIVYTDDLDTSDYFKTKLVETPLLSNGKSGGVGGGGIGLLCKVDVNTFLVFYYEDNVKMLVLKFSKFIETLPQLDIPSIPKDTLLDLKPSKRIRTNTKIIDKIIEKKKQRLNLFIANPNTTKVNISSGSLILTNQDQINTAINKIIFSGLRIRGLSSNVASSLNDKLTIKEIHQMTFKATQFALRKHNYSFNKRETKKPLRLNDLQDIIENLLQLFVDIE

SEQ ID NO: 15847 - protein, 360 aa, Candida albicans
YQSILSCSTTTMEESNDYPSCSLQNSFISTLDHLPCDIVRSLWLIQSCNLKIDKYKQELNELLEKYATTTTTLTNEESYFLKRIVELKKRIEYLSRETIQESRSMNNQLITHKLNLLEEMNQLKKIEISKHNLIDDIEMKELRQQLKTHYNEHPLVSQMEAVQEQKDLIISSNDKSQTNDKNGGSSDSSSNTNGILKNKIKDEPEKSKLKLILRIPKQDKVIKPKNKKIVKKVQKKPTERNTVISKDNKKSKTLRKKVPQLIELKEEPEKEEEQEDTTLYCFCKQPSFGNMISCDNESSCPNGEWFHYKCVGILNRVVALKYTTGKESWYCSENCKSMALQAKQSKKQKNGKRRKRRSHW

SEQ ID NO: 15848 - protein, 119 aa, Candida albicans
SIMEDTSLVDDKINLAILYFKSQNYEKALSTYNVLINQLKNLPRSTIKQIRKSYNLLETPLVGPAIHPKLGSLLDQRAATYEKLNQLASALKDGRELIKLEPIGCKGYLRTGKILYSLE

SEQ ID NO: 15849 - protein, 233 aa, Candida albicans
  UNSURE (227),(233): Identity of amino acid sequences at the above locations are unknown.
LKYRRTTTMPPKKKVNQPADKAKAKAKAKSAEDKSFGLKNKNKSKKVQQQINQMKAGIDGGLAKKKEAEAKRKAEEKKAQEEAKKEAAALFGIQQQKVPFGVDPKSILCEFFKQGLCTKGNKCKFSHDPNVGRKVVKKDLYTDSRQEEKENDTMDNWDEEKLRKVILSKHGNPKTTTEKVCKFFIEAVENGKYGWFWVCPNGGNECKYKHSLPPGFVLKTKEQKKLXRLAAEX

SEQ ID NO: 15850 - protein, 409 aa, Candida albicans
LSQTFIDFCKTMSDSSSLDLGLVIYSAVKPIFKIYFIITIGVYLAKGNIVSVSTCRDISDTVVTAIMPCLIFNNIVSNLKSSDIKNIGIIIFTSALLFTFGGLLAYGIHIITKSPKRWLGGLISVGIFPNISDLPIAYLQTFAKGGVIFTTAQGEKGVAYVCIFLMAMVMCQFSFGLFRLIEYDFRDELKVDEEHKVCSDSESSTRNQPEHEKVNNSSPVGVGADKSRTTQNGSNSDSDSIISQAVASDRLDIEEEEEDQHNQFLKTRAEQAHKSRSGLSSVHSEGSAVRRRTSNASELSVPYTITLVLSRTSDLRRQRSQNVQDVINEYSEFDALRSNEVQRTRTATSEIAVEPSVKAESKVKNYLKQLYKNVTTPSSLFINYINSHCNGSTTQSIVCQLKFLYAKCS

SEQ ID NO: 15851 - protein, 214 aa, Candida albicans
YIQDDSSFPPGLLSYKLLPELINQYKQLSKSPTADPGRQETLSTILNLTIKFGIKLEADEFNKTIKPIIIDSFALADRSIRLVLLTHLPDYQQFLTETDIQYKIFNQLITGCQDTNFMIRETTLKSITIVIDKISVKQVNQELLRILAKSQMDPKPSIRVNTVILIIKISLKIYKSSKNNVLITALAKSLRDTYIPCQMTALQGFESLIDECSL

SEQ ID NO: 15852 - protein, 239 aa, Candida albicans
SIHNKKRQLNKSLSIFNQHLSPVNLWKMTEDILDKQTYVSSTSLQFLLQELVPTSIRVSHKLLDPTVSTFAEESEQTRIDQQLSTIKSDFPGTVNVLDSPLLDNDEVTIRVESYGYSLGLKIAEVLLYKSSGNKVVDILDIMKFVCRDVWKCLYNKQMDNLRTNHRGTFVLVDNNYKLISLLNSSKGMQETLSKAKVYLWFPCGVIRGILMSFGIEANVSAEITQFPAVVFNIHTSINN

SEQ ID NO: 15853 - protein, 898 aa, Candida albicans
  UNSURE (219),(246): Identity of amino acid sequences at the above locations are unknown.
IMEITGLEDTLKSPEIESNDGNKKVGNNLYSTTPSSLFNVLTGNQNTKKNTSTSKIRKDKDQLYGGDEKVVNGTTEKLENRPTSLTSKDIFRIYREKDKQKYTLPDDQEPPVHHQPHETHQAFPKDMICNSLEILDFTADIESKIFANKKSTTVKDLFNNFRPKKVVTIKLSPQILKNISPNPSNINLSKDSSTLPDSRPAFTAQDILQRRKHILPVHXTEKAATKIDSQLHISDIGRKIYGSKPXFSVQDILKRERNDHQIIKPQPVPRPTYFITLKVNSKHLAEIKQYDNPLITKGNKSNTKGKTGASLFASMMQASKSATKLESMQQLKNTIILPKALKREEFHIYEKEVLNPRKLLLEERNRNVRCDVDTKIFESFTDLFTRELTSRYHYQIKDKIDLRQYALSKLPNLSRSPALEFVFDMIGQPKQGMWTETFKPQKMNQLLIHKQNKNDIYNWISNSFLKLKSQAPIKNIKQKIKQRRQESFIVYDYEDEETEEEVYSPFLILQGSCGSGKSTAVFTAMNELDGFVHEINTGQNRGRKDIFANLKELCTTEVVRDTKEFHRGVILLEDVNVLFEQDKTFWLVVQEVINISKRPIVLTCEEIWNIPKNLIEFAQHDESIIFMDDYVILKNLVVDYLWLCCLVYNCDVARDILVEIIDDNWNGHNFDIRGCLMNCQIMCPNRPESLTVVTRVSDSSTKKAWENINDVSHLLDINSCCDVIGVKSISQLAHTLQLNELDDVYWVDDSRNHTLPYELNIGKKLNHKLEGFELDFSVPERKFLMNDLRYEANRFIGSRMKYFSNSEFRRSTRSGGGESNAHLDTIGIPDTSFLNHIANSSFILDLLPMARLWSQFQNNIDQLEKEVLAEGKPSIKRFLRYRDFCHKTTLDATMNRDL

SEQ ID NO: 15854 - protein, 278 aa, Candida albicans
KPMAAPTAIRKSTEKSGINEQIQENSTLQSNQALDQNNDDEDMLIDTNAIPTTTVEDQDQSEPSNSLTIQQGETTELQLDESGKPKFSAASKSNMKVKLESRKVAVPPHRMTPLKNVWSKIYPPLVEHLKLQVRMNLKTKTVELRTNKYTTDVGALQKGADFVKAFTLGFDVDDAIALLRLDDLYIETFEIKDVKTLTGDHLSRAIGRIAGKDGKTKFAIENATRTRIVLADSKIHILGGFTHIRMAREAVVSLILGSPPGKVYGNLRTVASRMKERY

SEQ ID NO: 15855 - protein, 186 aa, Candida albicans
WFLPQVKNWNIGKINYIMDTLYKHLIYLINNFNLEDSTTIIKNERSVGIIPNSGCRILREQLEEMVLSCSRKLNTVLTSSSNFADSTEALCVDDIKVCAFNGGSDVWVDIGDKALGVESLQKYICHDETVDHVCPIGKSESLHIGDQFASLGANDFKARLSACTVWIASPRETVAILDDLIDFIEG

SEQ ID NO: 15856 - protein, 205 aa, Candida albicans
VISSIIIIFYICFLNYNLSNSVLHTFSNRAIQKDNHIFLIMTSRYRVEYALKSHRRDEFIEWIKGLLATPFVLHADDSHADAQIVAENCQARYYEIFKDVESLVKQTIFLDELNELDPKKKSISRLRTLVPSLGKFFTELPLADAFLLEDERRAISKRRLVSPSFNDVRMILNTAQIMALTNIYKQTEYNINGISWQNHNSNNKS

SEQ ID NO: 15857 - protein, 164 aa, Candida albicans
GERGFFQPPWSKTCLNETKDKIIMISSSKHKNRWIVPKGGNELDESELETAVRETWEEAGVEGIIIKKLPVVLDSRGSLAPVIKGEFDPDVATPKSEFHFFELQVDQLSTSWPEMKKRLRRWCTYSEAKHELLKLKRPELVDALNMSSILKDTIDDEDPKQDNY

SEQ ID NO: 15858 - protein, 341 aa, Candida albicans
LRPKLLNQVLPERDMSDKLARTIQRFQAKIDSGSFYEAHQTLRTITNRYVKAKQYKEARDLLYQGSTILLKNKEFASASDLINYLIQIYDEEGILVSDKDAKLKLIDLISNLPNNDPSLSDLAKSSLSWSKKSPGCEKFGDCELHHLFGSKFLKFVEYGASQHDTELENGKVVLDPEERAKVFAIAELHLVLGTFESVPLYINYLVKYAKANPEVDPGVFLGRAIVNYSYLKNIKFVKEAQDIFLKEIEVTNKETLKSDFQFYQNYPVLNFLQLLVITLQKEHTSNSQKFVKLYEQYRGTLQQYELLAPVEYLGKIYFNVNIGNSNQQGNMLANIMSGLFK

SEQ ID NO: 15859 - protein, 536 aa, Candida albicans
FFNHFTMSSSSSTPQATGLQMSDSIKSSTDRLLYRKNDIVSAKLSSDNGIYLSGQPLQHQPKHEESILDTLSACYKTPDTTESDFIPFKNILNVESIAGSVDEADEVGNSNLLEITYALPFLDLNHDLKIDKIKVDIESGPEIPPSLAQFILTESYGKSIIRPSILVLINPHGGQGHAKTIYKNKILPILQAARANVTYFETKYHGHATEIARELDVNDYDIIVCCSGDGIPHEVINGFYLRPDKGLLAFNKIAVTQLPCGSGNALSLSTHGSKNASVATLYMLKAHKTKLDLMAITQGTGSEKITKLSFLSQCYGIIADSDIGTEHLRWLGPIRFELGVIQKVFSGAKYPCDLFVKYKYDNNSEILNHVNDYLSNNDTENELPIVTEENLQITSPDLDQPVPNDWRHIPQEISHNLNILYVGKMPFVSADTQFFPAALPNDGSMDMIVTDSNNSVWKLTSILLAVESGKHIDDEKVHHTKVLSYRLIPNIKDDSIHYISIDGEDFPFEPFQVEILPGVLTGLLQDGNFVETSFTK

SEQ ID NO: 15860 - protein, 335 aa, Candida albicans
  UNSURE (292): Identity of amino acid sequences at the above locations are unknown.
SKTRKKLIIFNFMLPFKKADSPFKSNPVSRVGSSTRLNQLGNIKSNPTTPNAALYVTSSLNPLKNLPTNAANVKLRLQTQKDLDAFKQLPMVQKVNEYERLLNELSEAVSQFKNDELQEKIGQIITCNDVLKQQIEDLNKHRNYSYEVDKLSDRNKILEENSKFILKELVSYRNELKKLPKLPKSDKMVNRNVDVDDILKYAFKLAKFTKAPATVANMPFQIHPNNYVWPAEDSLRRGMLAQASLQAEEIIRHELGETDKENPNEVKTESKVDRDDDDDDEREDVGISNENXSDEQRSKPPAASEHDTSKRKEEQNQQPVDLNLDLFDPDDEYSD

SEQ ID NO: 15861 - protein, 475 aa, Candida albicans
  UNSURE (409): Identity of amino acid sequences at the above locations are unknown.
IMHPVLVFIIYLAPVLQVGNMQADAIFKEELENRARLRSSDLINLQKQKDSISRDLVVSQVAIEKFKKNIGTLSKALTQAVSLGNHADVQKLRQAIQTQTELSKAPKMKLNKCQEILIKIETMISLTKRELEVIYQRVRNVGHLANSAFNPYEAQIVADRQRVRVDESEIKDLIDNIRPDEDLEEGLEPTPPELKVNLLKHQRMGLTWMKRMEASKAKGGILADDMGLGKTIQTLALMMVSKGSNLIVAPVSLLRQWVAEIESKTKSDVFLSVGIYHGDDKKKMKDFDLMKEYDIVLVSYTTLVQEWKKHFSEDLKEHQHERNYFPNRSRGGKSYVSPFFSRESQFHRIILDEAQAIKNKQALASKAMTYLRAQYRFCLTGTPMQNGIEELYPLLRFLKIQPYCSEEKXRADILTPIKSKTDLYDEYDVKESMKKIQVLLKSMLLLRTRDSLIDGVPILNLPEKTVLSDYVTLEK

SEQ ID NO: 15862 - protein, 456 aa, Candida albicans
NQLNISKKMFPGQGRHTYGGQQSNYSNQQQGYDQGYNQGYGQAYGQEYNQGYDRPSGPPPGQGQYNRPSGPPPGPPPGQGQYNRPSGPPPSQQGQYNRPSGPPPGQYGNNQTRGSGNEQNYGNMHGSGHYSRPPTDSQSFGVENYNYQYSNCSGRKKALLIGINYIGTKNELRGPINDVNNVEQFLLANGYSSDNIVKLTDDQRVQRAIPTRQNILDAIQWLVKDARPNDALFFHYSGHGGQTEDQPDEYGNYDEDDGYDEVIYPLDFETNGFIIDDLLHTMMVKTLPQGCRLTALFDSCHSGSVLDLPYMYSTKGVLKEPNVMKEAGAGLLQSAMAYATGDRSRMLLGLGGVVKTFMNQGKAEKANEYSKQTNTAPCDAISLSGCKDDQTSADSKENGTATGAMSYAFLTVMSQNPNQSYLSLLQNMREILLAKYSQKPQLSASHPIDTNLQFIF

SEQ ID NO: 15863 - protein, 278 aa, Candida albicans
LSIMSTSPKLSEITIPKTSLIISNLNKEDFVKPSSSQDSQSTKLISKNLALVDQIKLKVLNFEDDIASHISHWSNLPFLSRVIVIFQNETTAKKIFEFLTKELAKFDDHYSYIKIHLQENLLQKSKSSDNLHDCQNEKLNVTKSLNNFRNFHNDPKNEFTSEYVEPEPAKFNVYNDLANLGIDLSQYNSAEQLEELKQLQQDQNQDQNQKEVKNSRDGNSHLNTNSLPVQLGRRKSTTKTLFKPELKLNTTAKPGLLNEKQKEQDFVSSPTITLDETF

SEQ ID NO: 15864 - protein, 106 aa, Candida albicans
LHQSLQMTKTSHLIILPCHSIWKSGPNLGETRDEWHLVDFQIEGYDHLAFKQQILTSLQQLQQDPESYLIISGGETKLDAGPISESLSYYLLASKLCQNDLSILSR

SEQ ID NO: 15865 - protein, 269 aa, Candida albicans
PNPFVSHTLAMSFRDAFQKYIDHPERHDIVLFHDQNVIIIKDMFPKSTRHLLVIPRNRQVTKNHPLDAFCTDYPEFTGHELYNMVLGYVEKAKDLIIDELFRYSNVNDKSQLLEFRNTCIKAGVHSIPSLNNLHVHVITQDFHSPRMRNKKHYNSFTTKFFVPFEELNPELNESYCRRTSQPFSETELSQNSNSDCNSNTQYIVHERSTQVMEKLIKTTPFKCTSCSKTFGNLMVKLKAHLHEEYTKKYASFIVPNILIPNGVCAPCTK

SEQ ID NO: 15866 - protein, 125 aa, Candida albicans
RINLASKFPELKICDIPAQRCIENYPESNCPTLIIYHDTNVVKQFITLTQLGGNATTLKDVETALADLNVIGFHDKRLIINNDEDEDLEQARKLRFAKKSITDGNRNNEKDKDDDDDEDDDDFYD

SEQ ID NO: 15867 - protein, 285 aa, Candida albicans
SRPSMSRGKTIRPSYYDEEESSQDELSHTLSKGRSNIGSQSDDEEMSKISFGALNRAQSKLNKHNQKHKTQEDNYKSSEEEFFDSGSDSDGPPEETSSKDTKKKKNKHAPSESSSKRPVSRIRDIPGLPSRKQQTLHTDIRFDAAYGKADLAKARKDYAFLDEYRKQEIANMESLLKDKKSRLNDDEREEIKLQLQSLKSRMDTLKNRDLENNILSNYKKQQMESFKEGKVNKPYFLKRSDKRKILQKAKFDSMKPKQREKAMERKRKKRLGKEFRQLEFKPTNR

SEQ ID NO: 15868 - protein, 218 aa, Candida albicans
RQILIIFITPMSKALSCYAFESLLFKLNLESNKIPLSKYFETLHESFTALPSRAPLFITWNKNHQLRGCIGTFSPLPIESGVSRYALHAALQDPRFFPISTSEVESLEVSVTLLDNFVTIDNPLDWEIGVNGLKISFQLNNEHYSGTFLPSVAEEENWDKLTTLHYLLKKADYPVSQKNVSQFYEKGLNEGWLELTRYDGLKNRLDYNECIRIRNQVE

SEQ ID NO: 15869 - protein, 210 aa, Candida albicans
CGSSSAVGEDEYKPVTVDKPIPNTYDLGNLATFDPNPLDNEKLLSKDESIKEDHLQSVTRDNVQLLINQILSLPVKTTTETHGSSTGQNSTMTLIQLPEPTTILPREKPIPKAKPLTKWQQFAARKGIKPKAKDGKMVYDEDTGEWVPKWGYKGKNKLIDDQWLVEVDDKVKNTEDELIDPRTLKRAERKKLIKKNELQHKRNLRNQGAV

SEQ ID NO: 15870 - protein, 810 aa, Candida albicans
  UNSURE (25): Identity of amino acid sequences at the above locations are unknown.
PPMNHFSKKNELDLINICARAWHIXYPTRAVALYSAAQSADALVDFPLDTALKKSTPVNIIASEKLFHLCKQMVEDGNLDWDEKTIWSIEDQNEWVNDLSESYSQVFNALKENLQLIFNETVKPKFGPYLQFLGDYIESDALFPLMEETNLPKKWEKRLTKSLMKVAGGRYGEYLASLPRNGSVNVIHIINVCDSLIADIKKLQKRYKNPLLGFLNVARTVASITTGMFASDAEATLNYIKTILQNNDERIPYADALEVYQLLNEIRDIHNQVTPAGSVFKFDLEKFFYPYLEAWVNESDEKVHGIVNEALKKDNYEPIDLDEDDKRSSHTILDIFAIIKQYVMTIKKQNWNDENQINNVYTVLLKSISNGALFYSDQVSKKIIQELQPPAPEPTEEEIPESKKNWLHEVKNVVSNIQNFKRPEPEVVYNFEATTCVALNNLSAMMNQLTKLEDWIDVETLSATSSSPKQYLSHVFSIRIVRGENLRASKDAMWGKINPYVAAVDLNGKRLLTRTRTIDHNPDPEWDEEFEITIPPEQSSLDISVVVWDDRFGQHQLCGKAFLELNPRRFSTSGIPEEITLDLDFQGKVVLEVAVESEILDAKFVMGRAFRALMRAQERSIKLIVEKFSGFIQSCFSRANLKSVCAKGQPSREEFEQSIQNLCDYLNMNLSILKGFLMNEIFMKTMVATWKNVVSAADELMLPKLSKAKINTESGGTSWQSVSSKLATVSLSSIGILGIDGPLSINEIETVLGWLNFLCTFFHHEGNGPPMEDLKTDQYLSLLLVPALYDQTDEYLIEEVERLSTAYVQM

SEQ ID NO: 15871 - protein, 309 aa, Candida albicans
FLKLQHQYRHTMKSRNSPSVDLPRSRRVLSMASTSTIQISHLGPEPASKEELYKYVLKVILLEYSNEARFRTPILESIKQTTRPSSNRSSMVFDQKIPQYALKNLKTQLQLIMTNKKQVDEKFRRSLLRIYGELLDPNLENEVRKIDFLIPKFAAFANQELKKVSQMNDDEITDTVFEQTRQFVDFLIEIVTAKKDYDPALISQLKARKDSFQTSNAKLQPESNQNVKYPTKSYRISDMNKSFVDLLKKIFDVDDTKLQQDVFKYKDIALAKPLHHDVQELAKIQVNLDNFSSDTALQQWKERQEHIKS

SEQ ID NO: 15872 - protein, 247 aa, Candida albicans
FSAIPDCQQYLSYCSKNSINTGSTVFRGTLYELHVKAFFEKYLNCENLIKNGGAYDNGVDIIGKWNLSPFYNEQEREYEYDTKPIKLSSKSILKYSQESKFNIASNPISLINDIQVLIQCKNVKKKPDAKIIRELSGILDFHKFNKKSTFMFIVTPYPCTPQAVVQLDTTNHAIIHFMISPLTNNSVKITRNQDNDDNDNDYSGDSFFNLDSWKGGDLKLVYMNRQARKLLSGLNMEQKLKLILFID

SEQ ID NO: 15873 - protein, 135 aa, Candida albicans
RKILKEELSKDKSYIRMPKIERSGYFEKLLDTRLKQKGIIIDNNTGTTTKKTNLGMVQNNLKIYNPKVELTYKDELGNVLNTKQAYKQLSHKYHGTGLDKNKKKQEQLKKKQQQRGSKSTNISTTSTTVTERVIN

SEQ ID NO: 15874 - protein, 170 aa, Candida albicans
RAGSITTTMRIWTTEWLGRSNQKSELLKMKISIEERILKEELSKDKSYIRMPKIERSGYFEKLLDTRLKQKGIIIDNNTGTTTKKTNLGMVQNNLKIYNPKVELTYKDELGNVLNTKQAYKQLSHKYHGTGLDKNKKKQEQLKKQQQQQRGSKSTNTSTTSTTVTERVIN

SEQ ID NO: 15875 - protein, 535 aa, Candida albicans
TSHPFYSRSFFLLDVYSFQLLNMSEEISLSLEETNKLRIKAGLSPIPTTSSQLNEKVREVISLSIEETNKLRQKIGLPLLPTTTTTNISSDSTEYKNYEDYERERLQNLKNNQLIERINNAKFNSNKRKFLTNETIIDNAEDLDTDDWLNNLGESTESSKPHKKQKTTIVKSNQNDTGPTTTIIGHTTKELQSLGNNEILTLKDTDLINDDDEDGTGSILMNQDLSNKAKLKRNLAERKEAENIKFNGRHYRRNNKEEEEEEEEEFNDIDGLLTNNKVIMSGSTIDLSSNTAKPPPPPKDKKKNMMAITNLFEDLDNVTLSNNNNIKSNVPIKMKKIKKKKDNNKKKSNKLKLLDDTIKPVELLVESNIGNDDDIDDIENQLSNSISNLRTKKLQTRLEFTPEQLAEEISANKRWEFERKLEQENLKNNNNNNNVYNDTIGFLNNLETNILSESGEVEVTANINEESADDDDEDDVQQQEVESKQTNPGVYPIVEEKPQEDEAPKFSGGLAETLKFLTSRNILEPESLTTTNERI

SEQ ID NO: 15876 - protein, 169 aa, Candida albicans
  UNSURE (4),(9),(12): Identity of amino acid sequences at the above locations are unknown.
YYFXGRALXREXDGHSSSSPSTPIMALQQQLIDESIPDYSPDVTTTLPPNNSKCLKIEWKGQPMDLSNDPNLNKLTHPAEILLASILRSPVAVYLDSKRILFYEKVSRLRQGKGFRRTDAQKACTIDVNKASRLFAASEKFGWLIDELFEKYLLILIWILLMKVVILFF

SEQ ID NO: 15877 - protein, 166 aa, Candida albicans
  UNSURE (144): Identity of amino acid sequences at the above locations are unknown.
TKTFIPFISTYFNRYIFFFIPTILHMSKPFQPISDVINTSPKNKSQSFNEIYGEPENFLEIEVKNPLTHGYGLNLFTDYEIVCRTNIPAFKKRESRIQRRYSDFVAFRKILEQETTRVIIPPLPGKIFLNLNKFNDLNIEKRRXGLEKILIVVSGQSMAPNRIGIR

SEQ ID NO: 15878 - protein, 477 aa, Candida albicans
TIYTTRALQERERKDSLMITPLLKYKQAHRQNAHKDIEKIYKDNTQIDSAINKCNLDVVKDYGDDNSFNATPNTTSLSVTKTNNLNRESKMEHEQSANNPRPISFFDQTQSDYECCDLRNKFNIPYSVLKYNLTPESCSRSIVDTDNDLQFSFTPEMNLDEVTHQSQDHHTKDTATSIPNQDNSNKHTYQEEHIGAFSGYFAIPKLTINIPNRVQDDEDRLKYISNVPTICYQNHFEIEDSTFIFGGLCASEVNSFEHLGLPPNADLEKVQIYFPFELPPFVNTRLLTNPFMEPNPYFLQYNATRGSVTYLDTALMQEFPKNIIGMASTRISSRHFFFYGGFQIENKSLRPNKNGDCWIVEKAIILNEDGYIIDTTTLKFSKVKLTRNNKSIKAGRIGMGICSNIHEPADSVLDSNFINGNHLSAAVFDTESKGSSKQFNNRTEGYAKEKTVLNPLVPLEGSHSIRDLHHGAGRIRA

SEQ ID NO: 15879 - protein, 605 aa, Candida albicans [sequence omitted]

SEQ ID NO: 15880 - protein, 201 aa, Candida albicans
MKQRITGLDLQILTSELSKELSNYRLQNIYNVASNSRQYLFKFSIPDSKKVVVLEYGNRIHLTDFERPTTQQPTNFVTKLRKHLKTRRLSGIKQISNDRILVLEFSDGKYYLVLEFFSAGNILLLDESQRILPLQRLVSAKQENDRYAVNEEYKMFDKSLFQQDFHYEKRLYDLDEVESWIQTHKLKLSQNSDNKKAKVFF

SEQ ID NO: 15881 - protein, 182 aa, Candida albicans
AWSFHCVVKTGFAIVVDNKKKELEEIRLAQKASAKENTAQEQRVDESSESDDNEDDGGEDADSPDTDTVSVDANGEEKPVIVQQLPRGKRSKLKKIAAKYRDQDEEERKLRMDALGTLKQVEERLSKTQIENLEKSESVKKQQQKEVILERKKKQKERELQKYLLGDDNNDEETNNESHIVN

SEQ ID NO: 15882 - protein, 411 aa, Candida albicans
  UNSURE (6),(8): Identity of amino acid sequences at the above locations are unknown.
PFISKXFXPKPGRIKILLGFGLSIRTWNSFFSNIESNKFFYERLNSQKENAARRLEKARSERDKQIDSLVAQQRLNAKKGELIQYHSELVEECRSYVQLFIDQQMDWTNIETVISFEQKKKNELAQHIQLPLNLKENKIKVLLEDFDDYEEITESASATETGSETETESESESSSESESDNDEDKIPVKRTQRKTNTKEKPKRKTIPTWIDLSQSAFANARSYFDSKKTAETKQVKVENSTSMALKNAERKITQDLTRSLKQENDTLKEIRPKYWFEKFFWFVSSEGYLCLAGKDASQTDMIYYRHFSDNDSIVSADMEGSLKVFIKNPLKGEALPPSTLMQAGIFAMSASSAWNGKVTTSAWVLHGTEISKRDFDGSIVPEGEFNYLVQKEYLPPAQSLFSTDRRPSVTK

SEQ ID NO: 15883 - protein, 104 aa, Candida albicans
TSNRDKRLYHIYTMDESFYFALLRISIAQILKANGFDKCKPSTLNVMTDLYLQTFQNAIRESLKCSNMRTNSNSPELQDITQALINISIFKANEATKIHDEYYE

SEQ ID NO: 15884 - protein, 404 aa, Candida albicans
LRRNFTLFFTNQFDQVLISIYSTILSLPTTTPFLGKIPPSGLVSKVANETIKELIRVTSASKNTPIYDQFNIINLDCLRSHEYQPIILQLIRKRLLEICHSKNNSVNKLPESTSILLNSTVTRNSSVSNLSLSDMNLMNYNNSNQNNTAVNLARSRSSSINLRKQSLTRNNSNNWLHVGNINNLRPSGNPDFNMSTDSLQSFQDFVPQSIINRTSNGSGNANVTNNSNNLVSSSSNVGQLNSMMMDYHITPPTSHKGSISSTNLPYNIVHNPCTSDSEEFQFLQRSRSSSRGNNLPQALNINTDMSNLQALNSLQGNSGNSKYVQPGLSLDSPFLSATTPGDEYFSGPLFANPSNNLTTAVISAGSNSVENAEAGGDTSKANLPNQYSLSEKKRDSLKMKRGIH

SEQ ID NO: 15885 - protein, 115 aa, Candida albicans
PLYLGVLSLLDNTLYVYDSMQIDDDEISEIQLKKLVQKLQSCNTIVHGKLKVRHLKCDQQQNFDDCGVYVIMITCYLINQLLHQDEMSLDISRVKFNPLDARLHIMKLISRLIKE

SEQ ID NO: 15886 - protein, 491 aa, Candida albicans
MIQSTNNPLISTQRIEINDEYEPENNLECSHKPTDSNIFRLFYNILKYLKVYILSTLFRRIEPSNRHLQLEENKEEDDEYINLSSEASSDIEIIAVNYKPTNDFHLINKTTRIQDNSILIDDTEETPFNIANNDSTTDLLRQLAKDRLKNRKTVTTQYGTDLTISKPIKYSSLRYQQWPVTQAETTTSTPEENFDHQPTLLDIEPITNKYQESILNYYVPTKPLSINSYSVIDNVISNFYIDKISSIYHKSHETLQQLITKERIDSQSKIKTLPSEQLNQVLKIWSTNSRQLIIENYLIEIYTHDLHTLKDSNWLNDNIIDYYFNLIMKANPNVFGWTTHFYTTLVQRGYQGVARWAKRKKINVFTMEKILTPINIGNMHWALAVIDNIKKTITYYDSLGGTHNSGNPQAVQTLAHYMKEEAKRLGVMGNEYKLIPHMEAPQQKNGSDCGVFTCTAARYISANKPLSYSQNDMKIIRRRMVYEILDNRLLD

SEQ ID NO: 15887 - protein, 169 aa, Candida albicans
VMEELKLDRSTKFLVISIENISKSRLNQLEEWKQLDNPNKSSVDRLNRKIITEVNLNNDDEDNDESGRPSRANTQDTYKLYLEDVSTKKITQAYENEPLRFLRTENTGTPLPIKLGGRLTVLKGALIYNGVLLLTNKNCEYHGIHADDASYVSILNDGVIKKQIELLQL

SEQ ID NO: 15888 - protein, 82 aa, Candida albicans
MESESGTHQVKNMAYKTPPSTYKALVDHVEYISLMNGWLVHNEMLRIPSTRNAAIMSCKKIPVLTNEPEHIKIIRLLDIIAL

SEQ ID NO: 15889 - protein, 336 aa, Candida albicans
TYLYITFVSLSNMEHSDKNFLTANVSKLGPCWVPIYESPVGFNVQHFEAAMLNIIHQPNINSTVIMRADILRENVFDPDEGDTTFTSKIANEIPEFQTDDDSKLLLRDLKDIKVRQIPDVPDIQFTKRHEIVRRVIPRNPFKDYIINQTCLMLTDNKKNSLVVYIPHIDSVEETPYYLPPVYGIGILYNDFKVSVHYLPFGFETPNGKEFTLLKSMTEQDRPIRIALRLLSTATKHSQGRKAGYEKRVNHDLVVPQTNFQNQYITLKKKYLDYFMNNWGESTDPRKHVFEDIAIAAFIIEYWKLNSFEPEKFEFRDLGCGNRLLVSSTTGARRSRA

SEQ ID NO: 15890 - protein, 171 aa, Candida albicans
PENSIIVKKWEGQPDEYLISLIPFLEYLATQPVKDVRPILNSYKDKSNIVAEFAERENKLREQWRKDHGGNNGKPNAGNFIAKLLGIPVPEPKMPLDIIREHGQLQYEHFQKYLQENAHKFLEEEQKLKDEFGKVTLNKLITEGAPNAEEIAKVQQQRALEEAQKQQEGHK

SEQ ID NO: 15891 - protein, 185 aa, Candida albicans
VFPAAWSNTKYTSTSYRLIHQYQMLIKVFTDDQTKFQLLQKEFLPGLLSDMSNFLDLLLSKFNDSYPHAVSRIKNGLPATIEQINGNQPTSASARLVAEITGNFITCMDAVKLNYKSKEQLHPLLSDLVVNLNELNEELQFTGKSKLVNWLIKINNLQTELTQEEADSFLNDLDIAYKGFYTTLE

SEQ ID NO: 15892 - protein, 132 aa, Candida albicans
KISIDYPEDLIFHNPNDISILYNKFPYYFEPNVKHICIWSKLKIPVDKNSEVGDISVMTKKLINRYLEKTFVAKGISWDQIVWFKNWLSLQSVRSISHIHVILKDVDDKFVDELISGGSGEVLTLDDYRNLE

SEQ ID NO: 15893 - protein, 421 aa, Candida albicans
GQVVFFFFQKNTTWKELKIVCVCVCVCLSYFFLFSCNQSKSLSHRSTVRQTKPRVMTDEQLESKTSKGKQNRNRNIDNDNENDNDNEDDKFQTEQVYDVEDEIQDWKFLNKSTIPKRGTKEFEPDGTNYQISALEQSQQTMFQAINNVRGHHTTKKLIGIWMIDEHDQYCFIPQIRGNYFKDLGKAINIGKFQGMKLNSLETIYLAERGSLIVYLGNQEYSDWLYNSAEVEENEDGDKNVLFDVESNLIALDLEYLYSLLTIPLANYQVYAYLKRLGYIIQEYKVQDDVMDKTLLSSSPTKDPKKLELLVQFTLWPREWGIMAYPLFHSLHFKTKHYFKYTDVFKNLKLNFKPIESDPNESNINITFNVWKPSPSFSKKTPPPPDFQLCVVDSSKNTDFLKLPQIQRLFFQLSPPPSQQQD

SEQ ID NO: 15894 - protein, 481 aa, Candida albicans
THYIMPVQKNKVPEKERFIQCCGDISLELVASLKSSKDINLNGLITRYAKKYKLKQQPRLTDIISSIPDQHKKYLIPKLKAKPVRTASGIAVVAVMCKPHRCPHIAYTGNICVYCPGGPDSDFEYSTQSYTGYEPTSMRAIRARYDPYEQARGRVDQLRQLGHSIDKVEYIIMGGTFMSLPIDYRENFITQLHNALTGFNGNNIDEAIEFSQQLQTKCVGITIETRPDYCTETHLSDMLKYGCTRLEIGVQSVYEDVARDTNRGHTVKAVCETFAVAKDAGYKVVSHMMPDLPNVGMERDLEQFKEYFENPEFRTDGLKLYPTLVIRGTGLYELWKQGLYKSYNANALIDLVARIMALVPPWTRIYRVQRDIPMPLVTSGVENGNLRELALARMKDFGTSCRDVRTREVGIQEVHHKVVPDQVELIRRDYYANGGWETFLSYEDPKQDILIGLLRLRKASKKSTHRKDCFSSPRARDASRR

SEQ ID NO: 15895 - protein, 335 aa, Candida albicans
RHKILQTKKKLYREKEKKKNLISSPIFFLKRILHNYHHYNHQQLQIEMQLSWKDIPPVPTSNDMLDIVLNRTQRKTPTVIRPGFKITRIRAFYMRKVKFTAEGFTEKFTDLLLGFPNINDVHPFHRDLMDTLYEKNHYKVSLAAVSKAKTLIEQVSRDYNRLLKFGQSLYQCKQLKRAALGIMATIVKKLKDPFVYLEQVRQHLGRLPSIDPNTRTLLICGYPNVGKSSFLKCITKADVEVQPYAFTTKSLYVGHFDYKYIRFQAIDTPGILDRPTEKMNNIEMRSIYAIAHLRSCVLYFMDLSEQCGFSIEAQVKLFHSIKPLFANKSSYGSNE

SEQ ID NO: 15896 - protein, 189 aa, Candida albicans
TTNFWKRKKDRLVQEGFYDSDSDIEDEDAEEIREKAQWIRNKQKTMIIEGRNRKSLKNKAIMPRDQIKKTFGDMEKHMYNIGHDTEKLRETVGKKSSDKAMSGVEILKRSQGIKASKLAKKKAAANQSDRLNDGLNDGALRSQAERLAKIQRRERNRMARQGEGDRHSTAALPKHLFSGKRGIGSTDRR

SEQ ID NO: 15897 - protein, 171 aa, Candida albicans
GGRNQEDHVWCEYYSLSSKRWIHLDPCEGVYDEPLLYCNNWGKRMSYVIGFNYNYMIDLSDKYIVPEKQIPKNSIVNVQNVNFVISYLNGINQLKHFKRIEQQQQQQEVDVNEQRNLAFLKLYHNFLVPYNKEINQLKPELTKTTPSTDLPLGRQSGSTEWTKSRGENGES

SEQ ID NO: 15898 - protein, 496 aa, Candida albicans
RSHLVENKILKRRVCLIISEWVSIQCSRELRVSIYKLLLNFLQPENKINDKIVKISAVQTLCAVVDDWDFSKTDFQPFLNDFVKLIIGLLDEFKFTESKLYILNTLAKVIEKCNPLVDYQTLLDILQIIPPNWETTENEQIIKTSLLRLLRSLVVSLNENSMETHQIAIPLIKACCSENLDVYLLVSEDGYDLWLALLQFCPVTQNLNSELVELFQLIPVGLRNSTEILPTILSIIRSYALYAPDVFSEDLASEIFQVIGNYLSKMRDDAYAIFIALMDILLINPRDEMIDRIVSSGLFNSMVRYVLDDSMSNFLIARMYLLFSRIAMKEYFLKILDVTSVDLKLFFERWLEYYNHNGNPRNKKINLLGLLSVLSYSVPQKIEVLWELSPKIIKNTLFFLEEVNEDTNGRCDSYNSNLIYDDIDDYAYLDPDIKANGEKLRYHALLDQFDRVYSVNLLLLLKECMGGLRQQLGDTDFNNFIQLNDSYTIEKLREIM

SEQ ID NO: 15899 - protein, 214 aa, Candida albicans
LAIWREMWFVGNNLVATKQMMIIWNRIINTLSTVKIGRAHHAMQAKAAIVVNVLVRWYSKFFTMWTSNLDFTIMQICYLCLKHLRRIIPEGFDQPHKDQDIVEFLNNTIDHLQMIVLEHDKFNTDLLERYVKCYSKLYVSLIKTNPTSFILLPCCEQILTTFLSILEQKAEVIYNSSEDNDFWEILALRSFSILKKVLAYIYRAVRPHHSLVVR

SEQ ID NO: 15900 - protein, 428 aa, Candida albicans
IKKNNSISYNLIASLFVSVKNTMDPDTTQYDKVKGEWSENLIDIKSNLKRSKPSHSIPSKRVKHDVDSSPLVEESNEEIARQYKKFINAPKYDLNSEELFCVCRRPDLGEMMVACDGCEEWFHFKCMKINEKYSNLIAKYYCKFCEWKGEGNSQWKRKCRLENCNEPIGERSKYCSKEHGIEFIKLLLLESKTNSTDSPSLQNLDAHFIKDVLNYVSGDFDKLQQMGSSFPELEVVKNYKNDNTALDGFPETVKIDLQRTNEKLDALSKQVTKQEQVLKALVNTKDNIKHLNERLTNIVYEDLSLDKQTSKKKKGARGKKKIDICFCDKGDQLIVQLITDSETIFDDLLKVIKARVFENGEAEEEDMDWFMNDLCIKDKKKCVRHSGWWNLYYDEAGRNLEQLQSKLEETMEQKESILRNYSISVYES

SEQ ID NO: 15901 - protein, 333 aa, Candida albicans
RKLGAFQPPVVKTNTIQGVKKTDLLRLIQLNGGKFKSEDKYVNRLEQDGIVNGSSQDLWDDTDNNEKKKIPDFMKSTAEVTKASVVPKTLKVNPIKITSNELTDKKIHAGKSYNPSLESWKELINQEYDIEYKRELTRQQIEEHRNKIKELMITLDDNMLSDSDDDEDDEDNDKVEEEEQLNANGEKDYSLSINKPNKIKIKTKTKRNKELKHKERVKLEQEIKDLKKQLKDLSNLDEILEKQAVKDQSQPNEKKRKRREKLFKYSLVETPLEVKLSDELSGNLKNLKPEGNLYYDQMLSLQSSGKIESRVPVNKKRKYTKKITEKWTYKDFK

SEQ ID NO: 15902 - protein, 342 aa, Candida albicans
TPSMYDANNEHSADDKLTARELSPQSVPINLEANKITKKRKKKKKSRKKKTKNQNIGDSELDRIEQDTQITPQVERDDFPAPLPYDYDPLSYNQFVSPSDTSHENSKRYRGELLTHTIDTLPAPVKKFWKRRYALFEKFDEGIYLSSELWYSVTAESIAKYTANLFRDLLPNATSGLDLCCGGGGNTIQFAKIFDNIGALDINPINLYCTKNNCKVYGVQDNVWTIEADWNEVSELKDGNVNTEWIPEGIRRSENEETLQFDFVFSSPPWGGTSYNRKVFDLNSMEPFPITRMLQQIKRYTNNVGLYLPRLLNLEQLQEAALKTFGEEGRCRVVHIRSDARI

SEQ ID NO: 15903 - protein, 391 aa, Candida albicans
LQLIQIYIQFQTMAASEESTLVDEYPIKSILNQISPWFIVDETKYGGRGCFAPKVIPQHTVIHLCQTPIGSTLSKPFKKEVCSQCYTYTYGETMKFKISKTEGKHVYSLFFCSEECKSTFTHQDINRVLVENLLAVEKNYLAGLSKPEIEAMEPKNFADDYVKEWDKVASWETKLESLKPSKRQNQIFRIDDNEYLEIKYVIGVLFNMYKVHCNDHIPHFDYPNLDKNEANKVELLLFDLLYSSEFEKVKRYPYLLYSYINIYKFIKLTCTPELQAFIDSTTIRSIIGKNLSNAFGIWSEVTDPSEDKEFLGFGVYPSASFFNHSCSPNIVKTRNNSEMVFTTSKDIEIGEELCISYGNYTDEPVELRQKQLKEWFFDCACTKCQTELKTT

SEQ ID NO: 15904 - protein, 244 aa, Candida albicans
TRVSSIKARMAKLSIGQEQIYKSFQQLPKTRHDIIATPELFSMEVYKFPTLNGIMITLHGSFDEVAQPEVDGSASSAPSGPRGGSRYHSGPKHKRIPLSKKSFDRTFVVIPGPNGSMIVASDTLLIRPYTSDFPWKVQKLPSNPTAATPGVSATSTPSPLPPTTITTPQLAPPGTGPTTADLPADIKARLNQIQQELLVKILLETKLNINYGIMLCEQSNWDYQQASVNFKNSAASLPSDAFVQ

SEQ ID NO: 15905 - protein, 321 aa, Candida albicans
SSILVFSFSFFSFWNMSYRGRGGGYNNNRGQFSSGPHQHQQNVDSFVAANQYPIEIMGWNGASLGECINFISRKCKVIVSNYSVDSNSGVLKGYVKNESQANTLLNWSGVKFAGQSLRFSKGVSNISNQMGGGASTGSQSTIETISQFLKARYQPEIKMLNLSNVKQDPTLTAQGFFGSLSVSSKFFPALMKVASDLKLDVDSIDLSNNELQDLQTLTSMAQTFPKLQNLSLQNNNFTKIKVFETWRHKLNFLRELILFNNPIVQTNDPAEIQTIKLELMKSFPRLVVLSGEILRNEQVLIANLSFPFESPETMFFQDEDS

SEQ ID NO: 15906 - protein, 170 aa, Candida albicans
YTITIVLYQLKETTVMLTTILIILIILYFARNIYNEFINNPSSPLDVSTEKESTIVEGKFTPISLTKYNGKDSPKIFIAVKNRVFDVTQGGAFYGPGGPYENFAGRDASRGLAKNSFDPDVLTDINEPIDTLTDLTAVEKESLDGWEEHFENRYKVVGTLHENGTVEEKS

SEQ ID NO: 15907 - protein, 479 aa, Candida albicans
MSRKSGRRGYNSDTSTASNRGSGSREPREEEIVDLEEEEEEEEDLIEEEGGEDEEDEITRCICGQDELTNDSINPELSTFLKRTYKIEIDQGLFIQCEKCSVWQHGYCVGLFESHDVPDEYWCESCKPEFHILVNNDGYSKRTLYKPVNDKRKKLEQMTFKNNETSHSTRRRGGKNERNTPQQDTSSNIKDKRKERRHHHHHHNIDEDDDEYNEQLKRALRESARESGVKLSESESNERGNGNSVKREDNKSDGNNSSGREGSRGNGSRKRETSRRENADNSDSKRLKVEQSDHPSGSELNENSEQELGSGSEGSRSKRRGVAGAGAGAGSTKTTRKKKSTPPRLSTNNNNNNNKKQDDSSNETNSLGPTKEELIQQPSKPRYVNDKSSIFELRKRTIAILEWLGRSQVELQEEKQQKLELFSFISDDDEKEGSSNSSKENANADALALKETFDENLLLMEQLTERILAWQDTFGKYAV

SEQ ID NO: 15908 - protein, 493 aa, Candida albicans
QFFIMVEDSILLVDNSQPVESSYSTNPPVASGSTSSSRPTPTDTVQFPIKLINWSLDPQNQTIITTPILLQEINGPCPLIALCNTLLLNNDIRTNSFILDEGEDEDKGVDQLKFEALNNFKTNIINKYHSLGKIDLQQVLEYIGDLLLIHTENITDWNRNHQNYNNSSQKEFTIDELLLKLPLLHTGLNVNPILISGDFEYDLATQLFELFELKFKHGWIIDPINQHGHHHQEEEGNSQDSQNSQNSQIWTNQEYGKLVNLFDQLENFDKIQDYLLLDQQQDKEVLGNKLLIEKWLNLNQTQLTLQGLNKLNDELDINQFIIFFRNNHFNTLFKKSNQEFYILLTDSSFVNSNKSSKIIWQSLNSVSGKDDLFFMGDFTPVLDIDQDLPNVNTSKLGGDIYSQDQNPDYLLLKQLQEEEDQKYAERLQNNYNNKSRQSKSKSKSSSTTKSSLSLNLNPLDPTTTTTTITEKLNSKEVINKDEKKKKKLNCTIV

SEQ ID NO: 15909 - protein, 497 aa, Candida albicans
KHKLTALSEMVFEAEIGLNKHKLMWSKSIASLSNIAEAITFTINKDSISLSATNTSKTSYAQIYFKKTFFNKLSVDFNNILPEGYDDGKQQNEKPSYSFLINSRHMATLFKSLDSSGMKHLSFRINWSRNAPINLRYKLFIEIHTKKLVVKKFQASYTPATKQNLYIASIYKDTLYKQREEEDDLHDKTRINHIMIDQLIPKQFLEMVPASAEDFKIDIKSERILFCGYTKQIIKDRDYLKQPMAVTVTISLDELTDSNLLLSNSDQEPIRKQINFGMRDFKNFLNLANFFTTPSSSSERLDENYVTTANNDYFHIFFRNPGDPILFDLQNYQHTEVQFIQITSEDKSELHSKEIDAELIRKGLTIEAPIPQKIQSNETATTTASTSTTKTKTTTPSLTRLTTNTVFGKPSITKKRGKHRLINKDQVSQGTINDDFDDGVTYGQEPEPERDRDRANYAETDYSNSSEDESKEPPFKKHAFDEELGPTQLNNKPKSIF

SEQ ID NO: 15910 - protein, 80 aa, Candida albicans
KTGQIKKSDFKAFMYTGIKDYIVYSNQEFMPIGSYNGQNGLFMDKSLLSGVSYSCDTFGNEILNSSPQNAKFGSFQNKRD

SEQ ID NO: 15911 - protein, 360 aa, Candida albicans
NPVKKLLIRKYNLTLMSFLFRRSTEQPRVNEEETNKEIKDEPQHQQQEKEDDNSKQEKLLSDSVNEKPKEQPKPVKRRGTFFGNILGNGSKNSSSASLNSSHSSVSSLSKFPPLGPLTLTGYKESTHHRLLDLELANNIRNVIPARFQLFDNWELVYSLEQHGISLNTLYRNSNPEHQLRLLKKQKAAEKGFADSIVKNMVVGDTSRPRYSFEPKRSQSYVLVIKDNHNNKFGAYLSENLKPMEHRRYYGNGECFLWKCEKYDPSKLDHAVDKRATQEIRFKAFMYTGINDNIIYSNHDFIAIGSSNGQNGLFIDKSLLSGVSYSCDTFGNEILNSSPQNAKFGSFKIKGLEVWRIGTLE

SEQ ID NO: 15912 - protein, 200 aa, Candida albicans
GLTKEQELGPDLKRVLAQAEECNRKAAEYVFRENNEDSGPDEIDLHGLYVKEAEWILERRIYYAVKTNQLHLNVIVGKGLHSANGVAKIKPAVDELCDQVGLNHYIDKKNSGVLVIDLKGVNLDRLPSSWAQGTNNVAPPQQAYHGTGQPLYQQQQQHQGQQSHNQYQQQQHQGGQQDIKTGNDLVDMVLKIVCGCLNSK

SEQ ID NO: 15913 - protein, 184 aa, Candida albicans
PFSMRPLTEEETKVVFEKLANYIGRNISFLIDNPENPHVFRLQKDRVYYVQESIAKFATSVSRQQLMSLGTCFGKFTKTGKFRLHITSLPYLAQYAKFKIWIKQNGEMPFLYGNHVLKAHIGRMSDDIPEHAGVIIYSMNDIPLGFGASAKSTAEARNLPPTGIVAFRQGDIGEYLREEDTLFT

SEQ ID NO: 15914 - protein, 242 aa, Candida albicans
HRCLYINNLMRLTAQVINEAPEILNPEGKLTLLLRDLQITELENLAITQNKYQVIDLSNNDLISLGNIPKRFNNLQCLLLSNNNISYIDDESFPLDNHITSITLFNNNIYQFQKSFKDKFPKLETLILLGNPITEMENYRYFIIWLIPSLKVLDFKKVKQAERKTSEDMFGTNRDEFNSLAQQMFKNENTEIKLDGKSDRQVKNFVKKMTDEERQQLLKKLETATSIEEIERIENDLKEGAV

SEQ ID NO: 15915 - protein, 91 aa, Candida albicans
GTKPRNINQLLIQQNTTLNFYQENWILDQVIQQAESSRGAETTYLEKLQKMSSNPYDETKWGDELKDLEQSWLLQGNKGDEFAMLQCGCSS

SEQ ID NO: 15916 - protein, 155 aa, Candida albicans
LNNNFIEIMSAQPFSAENADNLEEIEMQFAVKAVQQAETYWSLLEKIPGSKLKLTKHDDDIFNQLLEDFPEFKEPSNVAVIREEDMKSTSGKARWRAFCEKFNEIEDYNFGTLLRLKANEEYSQDGTMFAVRIQFYAIEIARNRYGLNDWISKKE

SEQ ID NO: 15917 - protein, 527 aa, Candida albicans
LVYGHTAMNVGSILNDDPPSSGNANGNDDNTKIIKSPTAYHKPSVHERHSITSMLNDTPSDSTPTKKPEPTISPEFRKPSISLLTSPSVAHKPPPLPPSLSLVGSSEHSSARSSPAITKRNSIANIIDAYEEPATKTEKKAELNSPKINQLTPVPKLEEHENDTNKVEKVVDSAPEPKPKKEPQPVFDDQDDDLTKIKKLKQSKKPRRYETPPIWAQRWVPPNRQKEETNVDDGNEAITRLSEKPVFDYTTTRSVDLECSITGMIPPSSITRKIAEWVYANFSNVEEKSKRNVELELKFGKIIDKRSGNRIDLNVVTECIFTDHSSVFFDMQVEEVAWKEITKFLDELEKSFQEGKKGRKFKTLESDNTDSFYQLGRKGEHPKRIRVTKDNLLSPPRLVAIQKERVADLYIHNPGSLFDLRLSMSLEIPVPQGNIESIITKNKPEMVREKKRISYTHPPTITKFDLTRVIGNKTEDKYEVELEAGVMEIFAAIDKIQKGVDNLRLEELIEVFLNNARTLNNRLNKIC

SEQ ID NO: 15918 - protein, 245 aa, Candida albicans
SNVEEKSKRNVELELKFGKIIDKRSGYRIDLNVVTECIFTDHSSVFLDMQVEEVAWKEITKFLDELEKSFQEGKKGRKFKTLESDNTDSFYQLGRKGEHPKRIRVTKDNLLSPPRLVAIQKERVADLYIHNPGSLFDLRLSMSLEIPVPQGNIESIITKNKPEMVREKKRISYTHPPTITKFDLTRVIGNKTEDKYEVELEAGVMEIFAAIDKIQKGVDNLRLEELIEVFLNNARTLNNRLNKIC

SEQ ID NO: 15919 - protein, 243 aa, Candida albicans
IYTKYFQEAFQTIMDFQSDYEKIDLSKQDFQYVFNNILQAIMAKLNLHLPAAQNDPLKEQVSTILEEFLINTFDNSKYSILADGLDLQNVLIHDILSLKTLENVEKIDSEITIQLRKIFQEFEQETVDVTKLRRDLPKQASEMYNDIIKQTDGEVSEIINMIEQQSQEYQKVQQAHNNTDDRFEKIIESMDFSQINQNYNDHLQLLNETNKNLPSLKIEFEKYNRTVQFLEDAYQQQLKEMDG

SEQ ID NO: 15920 - protein, 507 aa, Candida albicans
NYTLYCLINMATNTISTTKVTTTTTDVTGLSLIAAHSHISGLGLDDNLQPKENAQGMVGQLSARKAAGVILKMVEAGKIAGRAVLIAGPPSTGKTAIAMGLSQSLGNQVPFTALAASEVFSLELSKTEALTQAFRKSIGIKIKEETEIIEGEVVEIQIDRTITGGHKQGKLTIKTTDMETIYELGNKMIEGLTKEKVLAGDVISIDKASGKITKLGRSFTRARDYDAMGPETKFVQCPEGELQKRKEVVHTISLHEIDVINSRQQGFLALFSGDTGEIRPEVRDQINTKVAEWKEEGKAEIVPGVLFIDEVHMLDIECFSFINRALEDEFSPIVIMATNRGVSRIRGTDYKSPHGMPMDLLDRSITIHTTSYTADEIRTILSIRATEEEVELSGDALALLTKIGQETSLRYAANLISVSQQIALKKKNNTVDLQDIKRAYMLFLDSDRSVQYLEENADQYIDDYGRVTIGQESTDGSTQPQAKQQEVAQPEATQPQSQPEDDKMETD

SEQ ID NO: 15921 - protein, 92 aa, Candida albicans
EIQSRIRRLLAGEEQSYLLSGGDDCQALVWDINNLSNATNGSTNGSNHSGTIIDTPVLAYSEDLEINNVCWRQNQGDWMGVVSGKGFPTLLI

SEQ ID NO: 15922 - protein, 502 aa, Candida albicans
  UNSURE (495): Identity of amino acid sequences at the above locations are unknown.
KNFMDWYNNRSRRSSITTGQPTQSNPAFHGIINSNNSTTASSSLSSSSNSYSSSSMINPNKYPTQQQQQQQHGNIPSPLNLSSQQTMGRNLSPVSQTNSPIVTIPPTPLERNSYYFSEFPLYACDWTCLNNGQMDCIAVGSYKETFANKLEIVHGSNYENEFNMENSLSPGTDNSFNYNNKNNTNAYYEDEEIASRDEGFCFQKVCDVTLDYPITHLQWDPLMLLYGSSGVERLATSSEVLRLYKVANNGNDSYSLQQTHVLANNTASCSSTSSNSNNSSGSSSARTIEDVNTFPPVTSFDWNKTDPNVLITSSVDTTCTVWDLHRSPGRTAINEEMLDTATVKTQLIAHDSEVFDVKFLHKSTNVFASVGNDGSMRVFDLRSLEHSTIIYEPSPSAYSSATASASASTSAANHSLSATFNSKALLTLSTSNVDQHHLAAVGVNSNQIIIIDMRMPGLPVVIIDASLGGMNNSLINLIKWHPTSNYLLSGGDDCXEFSPTQP

SEQ ID NO: 15923 - protein, 552 aa, Candida albicans
PQTTMSSPVLPNRRSIQVCLRLDESPNEDVQELTTIQNTFDKSTSNYLLQSKHNQLSIKFQDKNNQTKDSINSSAENIKKTFQDIKSIAGGFGDVFEIDWEFWSLVVNDYDHVVNHELDKLNQCIISGIPKEFRGIIWQLVAKSKDSQLEDFYRQLKLESSIHEKGIKRDLTRTSFFTNVEAVSKSDELFNVIKAYSLYDPDVGYTQGMIFIAVPLIMNMNESECFCLLVTLMKEYGLRDLFCPEMKGLHVLLYEFDRLLESYSPVLYNHLVKQGIKSSMYASQWFLTFFAYKFPLDIVLRIYDIIVTQGMESILKFAVNLMIQNESNLLALSFDKLLEFLKDKLFNVYIAEAFIKDDKGKKRFSLLRCATSTPATYYKLDELVQDSMQVNVDPVELTKYAKEFESIYSKERAKVDDIKGMRLANGNLRHRIKELQSQYSALNRDHVDIVQKMVDLKITLPDLVNENEDLKHTIEKLEKDVEELESKTQPANDVLPSEIEDQIQQLFVINAQEVEKSANLEEELNSLLEQEEKLTKLIKQANRNSTWFKWNK

SEQ ID NO: 15924 - protein, 205 aa, Candida albicans
SMRHRFPLGGSRNGHGLYSSGKSGRRKKKILIMTEKSSQFQFPISLSSPKLKTVNTPRISKLRSSIMFRLIPRLKPIIPSINRISLSVKPQPSTSQHCHTLRAFHTSPISLHGHLKKPNPGEELHITFITKDGKQLTYEVAEGDNILDIAQAHNLDMEGACGGSCACSTCHVIVDPEYYDRLEEPDDDENDMLDLAFVSHGWKSS

SEQ ID NO: 15925 - protein, 650 aa, Candida albicans
VYNNLTTYLKVIMAKKDKKSKEAKKARAAEKQKKSAAKAELKDKKLAKKLGEADDDEDDDIDAILEKYAKEQLEFTEIKIEICDHHPTKRLNPTMVSNPLHNKRELILFGGENTDGGHSKFYNDLYTYSIDNDTWRKISSKNSPLPRSSHAMCSHPSGIILMFGGEFSSPKQSTFYHYGDTWILDADTKEWQKIDSKKGPSARSGHRLAVWKNYIILHGGFRDLGTMTTYLNDVWLFDVTEFKWTQVEFPPNHPIPDARSGHSLLPCSEGAVIYGGYTKIKAKKGLQKGKVLNDCWILKMKSDPKAVRFERRKKQGTLPSPRVGCSLVYHKNRGMLFGGVYDFEESEETLDSEFYNQLYTYHIESNRWYNLHLKPQRKKNKETIKEKTRDEDLEEILNSILAKANLNDNDNDGEEEEIDNEEMNKIEQLKQLEKIDEPEKDVMEYPIMNQLPHPRFNATTCVVDDVLYIYGGIFERGEQEFNLDSLYDIDLGRLDGVKVFWEDLSELEKSEANSDEEEDDEDDDDEEEGDEDEVDNILEDELEEEEDEEDEEEETEEEFPDARSWLPHPKPFESLRAFYSRTGAQFLEWAISSNRDARGKDLKKAAFDMCEDRFWERREAVSVAEDNLEEMGGVGEVVEKDTSKATSKRR

SEQ ID NO: 15926 - protein, 297 aa, Candida albicans
RAKPLTSNPSESFNLLQRDVFQITKVLEDINLYLNDLLMIFNNVEQASKNVVDVLDWYFEGKSLLQDLLRNIENIDSIISQLLLVVESSNNHESIGNNLLAIFEEISDLVLDVKKSLIMFKKYLDISINYREIIDSVIKSLSNEIEDCIKCILKLKELKLASPKNVLPNFTLQSIISKMKINDLSSGTFSFKSMRLPTFSDLDEKLYNDYLELESKIDPLRTSLSIVPLRIDDFNTMCAGQFFVKSRENVLDAYEVLILKWNMLLKEKNSYKKDNINVKWNEICEYLIEEIVKNVAD

SEQ ID NO: 15927 - protein, 525 aa, Candida albicans
LCVCLFVQFFSNHLTTNFKLFSCKITKQDEKYSDNQQASSNFKNNGFRFSFFILLLLIHFFVWIHLQRMELINQSNNSLSTGLHTAWLLATLGSKPSIRSKLIKKSTINYLLIPELCHELLASTNSTINDAQDKDAIIYEPHTPGNNIRYVSNIMHGISILYQTKINYLMNDLIYIESRLKCHYQNSYNDIVDLSSGSLIKTCLVPSMAKKRAIQYLSDDPAFSIQLGLVAPFTEETDEIAKRRKLDILQKDNDDFPLVNGNGGGLVDQLNFHSMTFTLHPQLDNLFEAEDHSSLNNGNNIGLSTDSEVIPDFEFDNNGDIVGIAGENLLLDSRSPTRELIHNEQADALNVTFDDNDVHEVNPIPLNQTTSISNDLNFYTTTDTPLPNSTQRPIPQQALGMEKLPFRKLLIDNHTRIDSDSMIHFVMNYESRMNTVMEPVKSVDEVVNNIYGVVDAATPFTRFVNKVTLPNTNNNNHNNSVEQSFFTRTASILQKTEETGNENTEEGRNNMNIRNYGYGARDTRS

SEQ ID NO: 15928 - protein, 262 aa, Candida albicans
INNSITYLNLLNRTNYIMATRTQFENSNEVGVFSNLTNSYCLVAVGGSENFYSAFEAELGDVIPIVHTTIAGTRIVGRMTSGNRRGLLVPTQTTDQELMHLRNSLPDSIKIQRVEERLSALGNVICCNDYVALVHPDIERETEELIADVLGVEVFRQTIAGNVLVGSYCSLSNQGGLVHPQTSIQDQEELSSLLQVPLVAGTVNRGSSVVGAGMVVNDWLSVAGLDTTAPELSVIESIFRLQDAQPDAIGGNLRDTLIETYS

SEQ ID NO: 15929 - protein, 80 aa, Candida albicans
DSYKIDQDDQHEPLQEKPNSSGNHHHHHHSQHIAKFDPKKWLDQTCYYIHYQGWNSKWDEWVGIDRIMEYNEENEFVKLE

SEQ ID NO: 15930 - protein, 389 aa, Candida albicans
KQHNLQHIMSETNNPASSNDKKPVVFAVPSSSTRRGINAVHVNSAREMVRLHTQGRNPPAARQANVPSIPSRVVEASHAPTKKATDSMPSKFPNIQIPLHHDETECKNPQCQHCGQIIIPSPQSSYPIQDKPCISVNGWSVFTTKKPILNSLELDHLAETKFEFPLPEMIFGNNNVRIRNDVTGGTIEFNAIDALSSLDPNCPLKVSCHEEWLKSRRSKHASLKQEQSLKKDLSEFTENLDGLKPYDWTYSTNYKGTLQNLDLKSSTLHEIPIDKLTKPDPILFFDEAILFEDELADNGISILSYKIRVMPTCLLLLCRFFLRIDDVIFRVRDTRCYIDFETNTLTREYKVQEQEYDKVMSLVKVKNNKDPKKLFRDSNWVQSEHTCSQ

SEQ ID NO: 15931 - protein, 337 aa, Candida albicans
IMPIPRSFIFEPELEQLLKRDENGCVSCPSSAGSCPSCPSGQQCQLSSRTCNSCPKYYCASVSSKKGSPIGGIVGGVIGGVAFLALVGAVLYYFLIYRKKHPLILDEDFENYEDDEDFLEDETSGYALSKLTSNNGNGLDVSSPGYDSSSGNVVSPVSASNVNTTNGSSSNGPNTTVSLTSVGNTSVERAAGPGVGSGAAIVARKQIAGNSVSAAKRRQMKRLSSYESFTRPKASGNNKAKQQQLQARRARQQRIIRQANQQTQQQPQQQLPFNQYLQPSNRNSVATSFSNASNILPIAYIPGVTVRPTKNNTRSIYSYDTDSLFSDLNTIVFQQTG

SEQ ID NO: 15932 - protein, 322 aa, Candida albicans
QLDSIQLKSTRMSKLVRRTILPAITIVLIVFFVVLESSKKPNDSLYDAGSHIFDSISHLSFVDGQLIEQKPPNQPFTNEQLKQIDSTPDNSLQPTKQEDEEKKTLKEKEEEEKQLDPCTVFNPISKGFIDLSGLSSLSNEGKALPWVSKGYDSGKNYTIGVCSSPFKKHHSEINEIQDNLNSSLIGAYYVDPESKKYVSMGKYSTVPKFRGRKLTLTYENGSYCDIIDKNTNQRLRKSTILTFTCDREMSARALVSYIGQANECTYFFEVRSHHACPTAAKANNLAAVWIFLFIFLAAVFVYFSGGLLYRQMKQASTTRSKV

SEQ ID NO: 15933 - protein, 150 aa, Candida albicans
KIMGSVFLPHLKTAWHVDQAILSEDDRVVVIRFGREEETQCMIMDEILFSISEKIKNFAVVYLVNLDKVPDFNQMYELDQNPLEPFTIMFFYRNKHMMCDFGTGNNNKLNFMIYDKQEMIDIIETVYRGARKGKGLVMSPKDYSRSAKDI

SEQ ID NO: 15934 - protein, 338 aa, Candida albicans
LLNIFTTMATLKKKDKKASACFTSSTTTPLNYSNPVRLAFLGGPKSGKTSTISKLTAGNFRDTYYPTHQIHPILFNYKPSNEASKVLTEFVKGNEDTILSPMLNSNELVPTNEYYKVGNNDVGPILVELIDTPSFNPQQVVPFLEASLYTNLDKEILGNLANEPRKPVSTNPLLVASGASELNGNINGYFFVYSAVPGSSPPGYDEDLSNFTGDNTFSLLPVIKGALEDAWQEYNEYIRKKNAEKEQDLFSFKVALRNLLKEPSSNNSDKKGVETKDYSPPIWILCTHKDSNLASPKLIEQGKQLAREWNCGFLAMDNLEDNIDILLTLMIRDIIERK

SEQ ID NO: 15935 - protein, 540 aa, Candida albicans
  UNSURE (1): Identity of amino acid sequences at the above locations are unknown.
XITVFGPSALKVESTELTDFLFDCFTARLRTITNTKSGAFNMAIQDDGKPANAMGAGDIVLLSYWLSSLQFLHFYFGKNNIYLKFPRFLQELINLVQSLTATLSFSINSRLNLLVDDCIINFTNLVDVSNVLYAKDWNLFKKNKSHPNTYDDIMNTLYPPTQMELMKPSPIRYLQVLGALDYVLRIHKVDNLLRLEAFSQVFYYINCTIFNRLISQSKYCSRAKAIQIRLNVSAIEDWLRSHNVKVYKPDTIGGLNKLLGNEDVKLHNLLNEDPSLKHRKNPHYLQFYYNSLYHIGKNQLQPTIELLQWLQCMTSLSDEESLINTINQFDCLNYYQLFKVANKLYKYEVNEVKLPKKLIQVIKSLMTEQGPNQIQRMFLHYMTQTTFLSKEEYIYLNPNYIFEVALPNLTELINSYGAGLGGVRILRNKKYQPSLPISIMDDIDEKLTENRSWQNETYDYDNEKDGEDDEEEEHNEGANANGDSGSVHPGTFEKKPTHTKEIEDFKGDELFKQVQMPNSLLHKNWGDTSTGVEDFESNPW

SEQ ID NO: 15936 - protein, 441 aa, Candida albicans
  UNSURE (322),(418): Identity of amino acid sequences at the above locations are unknown.
LPPEYVAVPGASWREPIGNFKIEPLLSSRTLNFNFITNSIEKKFKEAIKESLVYPFWDDIVFYDSSDQLYRAGIWKEPKIDKDETTALEKENTENNQTDNESAGVDEDNSTNKFDDIDAKSELSTSSRSLRNGKFSNTLTDLTKRMKKKSSPSLSNTENSLSVNTNNTASLSASNTTLNKTPSKLDLTASQSPNTNSTLVSSTFKKIGKWYFKDDGSSKKQHDEKLGYTPPEMISSRRAPRKSSSSMTLGSDSTRYTLATEENKDLPDIESANTTSASVSNTATTAPSLELSNKGTTTTAPVNVISLSNNFTVPSVAVGADXTTTAPAPVANSKLTSTPLDNQTPSYNFSRLDNNNEDLSIFSVAYQNAAQIIPSLTPPPLPPRDISDNLSIRSGSLVGEPTISLSQPNSPIRTKTLXRKPPPPKSPLLHAHSPNQDIKDL

SEQ ID NO: 15937 - protein, 534 aa, Candida albicans
LFLPQAIIILTRSKFTHTLFFPFLSSISFNSSTINQLVDEQIMGLVYFLFVYVLGGLTFLPGLVALYFYLAPKSTLSDDNELDEEKPSGELEEKHQSGLEAYKSGWIFVTRDYIESPDEINSNTQLITESNDNKSAYSALYKLVKDLATKKFKDNSQLKKLQPEEKKFLDHDDNDLDELNKDTFALPKDTNSPNPKSYSHHQRHDPQPQHNHQSQNQPQQQIRSSQKKHRYFAVLKHGNLFLYKDQTLKDVKHVIVLAHHFVSIWPRDLTDAQLFTKYSALALINPSKLTDTPFSTNDTFNSTVNTSNGTEISSSTRSSLSSRTTDQQQNLQQQTNNNAPPGTFFIYCENNCDKEDWYFALIRAMKLEKSELPDILNPEKYAETSHFQTKEMINLIQTLYSSEGQLQTKWLNAIIGRWFLAMKNTKHFEDYVYKKLSKKLNKIKKPGFFNQFEITDIQPGKLAPFFTYPKLKEINPDGTVVASCYVTYNGGLSVTIETKVDLTFGTKFTNREVDLVLKITLSIFPTGLENQRST

SEQ ID NO: 15938 - protein, 121 aa, Candida albicans
SIMSRHQYDLIQCMKQPGKSIGLLCSNCDGKCPICDSFVKPTEQVRICQDCSQGHLSNKCILCANNLGENNENGVLAYYCLECVRLEKHREGCPRIINVGGTKTDMIYMKKKDNKSSLQGF

SEQ ID NO: 15939 - protein, 259 aa, Candida albicans
DSDLPAAWSKISKLYLNLKQYWQIQIRKRDKDLFKQLWQEPELSELIKKFLIIFYQPLMTIFTKSDVHLAFRGLQKFIDDLIETVTKINNEEIYYLNSFEIFNKLKNLLDRHENVIWEFIHKIYIKDDQHLFLNLIKWIEKYLTMMRIKFINPEIVKINIHTPNSGGGGGGDGDNNLDKQLFMNQLNSRVQKIVTKRKLFKEYLEAKANLQLQDPNNNDIDGNWEDINNKIFGNTTSDEFGVKTDDLEEFNYLNAENDL

SEQ ID NO: 15940 - protein, 293 aa, Candida albicans
YLHLTMYRIVKNATETFKKVLELTPNTGSKIDHLLTLTRIDFFFNDLPLVQKHLEQIGQLSEKGGDWERRNRFKAYNGIYMLATRNFAEAAKLLIDSLATFTSTELCSYEAIAHCAIVAGVLSLERVDLKNKIIDSPEILSIASTTPNLEPLLNLTNSLYTCEYNCFFQYLLESYEKLLLPNKYLYKHANFFLREMRCKAYNQLLESYKSLSLKSMATNFNISEEFLDQDLCKFIPNKKLNCTIDKVNGIIETNRPDNKNNQYHALIKQGDNLLTKLQKYGAAVKLSGAERVA

SEQ ID NO: 15941 - protein, 622 aa, Candida albicans
MMKSSIYPKLKRILWRFWKPSHQVKSWANDTIADGSGGPSVQDLENALNGNNESPVDKSNIEVVNTVEDASDDEYNDFKELSNKHGENEDEEEEEEMMSLGDLPTNEENKDKNESGENLAANENISDLEWLKSRSTRIKENGEVPEIVPEVKEVNEVTEATQQSDNEPEMTPEEQIAHKIEETGRLFIRNISYEASEEDFRSLFSQYGALEEVHIAIDTRTGKSKGFLYVQFLKKEDATRAYRSLDKQIFQGRLLHILPADKKKDHRLDEFDLKNLPLKKQRELKKKAQAAKTQFSWNSLYMNSDAVLESVASKLGVTKSQLIDPENSSSAVKQALAEAHVIGDVRKYFEDRGVDLTSFDKKERDDKIILVKNFPFGTTIDEIGELFSAYGQLKRMLMPPAGTIAIIEFRDAPSARAAFSKLAYKRFKSSILYLEKGPKDLFTREPTTNEVATIPEQQQNEHAVEAKISANEILGESKEDDEIELVQGPTVAVFVKNLNFATTVQALSDLFKPLPGFVVATVKTKPDPKNSGKTLSMGFGFVEFRTKEQANVAISTLDGHVLDGHKLQLKLSHKQGTGTSASSIKKSGKSSKIIIKNLPFEATRKVFWTYCLHHGLPDPNYE

SEQ ID NO: 15942 - protein, 106 aa, Candida albicans
  UNSURE (100): Identity of amino acid sequences at the above locations are unknown.
FYYLKSIITTMSRLIVKGLPKYYTEEKLIEFFSKQGDVTDVKLMKKRNGESRKFAFIGYKSADAAERAVKYFNKSFIDTARIEVEFAKTFSDPTVPLSFXEKRIRE

SEQ ID NO: 15943 - protein, 291 aa, Candida albicans
MSLSPIEKAASGALASAIANTLVYPLDLSKVLIQTQVKKNKPKSGSNGIPTPPSESDLEDSVYKQKVDEDNGLKYKNTIDVLTQIYKKKGILGWYHGLFSTVVGTAAQNFSYFYWYTIVKRVYANLYKHIPNHKPGTFTELFLGALAAAISQCFTMPIGVITTQQQTDKSHKNLFQLIQDILDQDGISGLWRGLRVSMVLCINPSITYGSYERLKQVLYGDKQFLKPLESFSLGVLAKSLATIATQPLIVSKAMIQKKSSPKKNNKATDKNTDLDYEEQIHLSLIVPSNTI

SEQ ID NO: 15944 - protein, 82 aa, Candida albicans
KNALTETNTEEYMKRYIKFDHFTDGLPYLWRTEKFRGLYKGIAPQLLKGVFVQGLLFTFKDQLNILFLFLLSLIKNRSVLKK

SEQ ID NO: 15945 - protein, 421 aa, Candida albicans
  UNSURE (53),(58): Identity of amino acid sequences at the above locations are unknown.
TITTPLAIPKLRNLITQTRFIIMAGDPFLSDPSKKRKRLNKLTSKTKRSKSSXPTPTXTPTPNTNHQDDDISSGSDSENGHANGTNENDHGDNESELSSDEEFADETVNDKRRRLAKQYLENLKQNEHELYDEFDAKDLDDDILARRLQKDIAETKGYVYKFVGDKIKDQLDEAYPLELITTRIGCKNLTSMTINYPFLYTVSKDMEIIKWDINETHKKPKRIKHTKGGNKYFEINTINPQLNHHWQQINCIAASPDGKYIVTGGSDSRLIIWSSENLTCLKVLPTRSSVNSIVFRRNSDQLFAACADLRIRTYSINQFTQLEILYGHQDNISDISALAKETCVSVGSRDKTAMFWKIAEESRLTFRGGDSLEKTNKKKKRHYHQEEEEAETENDESTFYNEGSIDVVRKIDESHFVRASG

SEQ ID NO: 15946 - protein, 344 aa, Candida albicans
VGLGWLVGKKKTLEKKKDNHLLASTNLITNLVYNNHNNIMEKFSSWRDKGTGISPFMPQKLPTFQKNNSLLSVASKSPIFLIKLPFFIITYLIYTITGFAFILKFILTILFGFNRIDFGVDGIKKSQIDKLTSYKPKKGDLIVTNYITPLDGYFLFLLSGTFSSSSSSSSSSQIVILIPNESGDLYQYSPLGLFNHSFTYSNSNSNFSSSGKLVEDVSKLQNKIVFLFLEGTLSNNKSILPFIKLNSKYSFDDFNIKSLVVKLIPNYFTLPIPHVSKLQYFFELLTNLSQKLVRYKMYKFDEFDIAKIRNSFELNSLTSMSQDLNIDSKNKFIDYYFDHSIKKN

SEQ ID NO: 15947 - protein, 446 aa, Candida albicans
EMSNHKKKIYGIEKKNIIKIPFQDKHSKKRPSFYFAMSFQDVLKRGDEFLNDYPRTNPFWNLASHATCLFMITGSKIILNTFYKPVLHNIEKLDNALQRARDENRGLLTVMNHMSVVDDPAFYASLPWRYHLDIDTIRWGFGAHNICFSNVFQSWFFNLGKILGTKRFGEGPFQGSLDAAIRILSPDDTLDLEFTPGIKDEQKAVVLQTVNNITDCRNKELVKFIKPAPESTNVLMSKNPFIRTKTSWFHVFPEGFVLQLQEPHNNSMRYFKWGVSRLILESTRTPIVVPLFSFGFEKVAPEDSAEEGLKRWLPANFGAEIHVCIGDPIKDDVLESYREQWRSLVSKYVDKSNPTDLSDELKTGSKAQSLRSDLAGYLREKVLEIRNEIGLFNPEDKRFKDPKFWKLFTNTEGLSDPSVKFVGKNWAIKRLQSHLPEYDPSEDTKN

SEQ ID NO: 15948 - protein, 67 aa, Candida albicans
RGSSTRGQDEKIAQRGVVRLFNAVLSTQIKTNQEVNKEKLGQTKKEEIMNEVSKNKFLDLIAAAGNE

SEQ ID NO: 15949 - protein, 234 aa, Candida albicans
  UNSURE (96): Identity of amino acid sequences at the above locations are unknown.
KKEDCQSVIEEEERAQSNSSVQEVEIEDGSDSELEVADNDDLDQEIGSDDEVNMADASSSEGSDASEDENENEEEDFPKLKKRKTKSTEDGSESFXDALNSIVNSKLKAYDRKDPILARNKVTLKKLELDKLEMKAKRALLQEKKVLHDNARVKNLLPTSNEPEKVRQVIEKEKALKKVAQRGVVRLFNAVLSTQIKTNQEVNKEKLGQTKKEEIMNEVSKNKFLDLIAAAGNE

SEQ ID NO: 15950 - protein, 324 aa, Candida albicans
DLLGPLWTFFNCFTKGFVIQRKELEEEPLWIAPNKEGKLPSSLYKHTLFKSQFQKSVIAMLSYPLLQEQYKSVLTILHKRIIPYMSQPQSLMDFLTDCYDLTDDLIVPILALNSLYELMKNYNLEYPDFYSKLYSLLTPELLYTKYRSRFFRLCDLFLSSTHLSANLVASFIKKLARISLAASASGVVIIIPFIYNLLKRHPTCMIMLHKEDTESGYQDPFNSEEKNPLHTEAIKSSLWELDTLMTHYHPNVATLAKIFGEPFRKPSYNMEDFLDWSYNSLLQSEYDRKFKDKNSALEFEEFDKVLDTSNSDSKSLLLEGWTLV

SEQ ID NO: 15951 - protein, 74 aa, Candida albicans
GIKNWLFFARNDHWVANEIREYLIDKYGNSDNTLCEVCDDETNPISHSFCVAQSDQFAKITVARIKEICNIDLD

SEQ ID NO: 15952 - protein, 254 aa, Candida albicans
YLQPQMTVTYLNTTPKTPVYHKPPLEKSTATNIFVLIPGNPGLVDFYISYLDSIRKHFPQFETLCIGHVGFLDSTKRKIYDVPSQIEHKYDVLKQLILTKNESNIIPNLYFLHHSMGSFVYQRTIRKLYHDENLNGKFNIKFSGFVTPTIHNISASSSGRVLSGLMQRNVPIVSIVLVFRFFVSLIPALILRKLLHYHLLGNKTGDGFENSVEGAYKIVKSGTVVNQALEMAKEDMLIIDTQDDINDWYFNHSN

SEQ ID NO: 15953 - protein, 331 aa, Candida albicans
TRNKLKFKVESAHDDSINHILGMPAVSAYHYLTLGSTTLAHIDIRKGIITQSDDQEDELLAMCFPSDEVSQSNDTVLVSHGEGLITIWKNSKNKLMDQLSRVKVNKSASIDTIISTMNADNEDMANSVWCGDSEGLLHRINYKRGRVVETRLHSVAKGKHGAVDEVGILDIDFDYRLVSAGMDTLKIWSNTQDEEQNDEDDDDDNDDSDGDDSESVSGEDSWSDISSSDEELDTNPDDDSDKDDVDVEDDLQLRKKRDDISQLISKPKRKTIDINKLTKATKDTQPEDDEEDQEVPEPSQKKQKVKEKKLTTKQLRNMQKHEHGIRKFEGL

SEQ ID NO: 15954 - protein, 211 aa, Candida albicans
  UNSURE (209): Identity of amino acid sequences at the above locations are unknown.
LYYTAMGKKKSNSSNAAQILESSVSPILEINYNDPLFTAASHPTKPILLSGLATGHVYCNSYDAEKLEELTQSKREEYATLEKQAYTQGKIPHINKSVSQLKKKWWTIVQDNTEIPNDGDLIKTNWKTKRHKGSCRHAIFEPLENSVGDFIYTCGTDNIIKKASTETGKVVGKVDVLSDYSNKKDYLTKLCHSVTHPFYLSRDRGWTCXSL

SEQ ID NO: 15955 - protein, 439 aa, Candida albicans
  UNSURE (8),(39): Identity of amino acid sequences at the above locations are unknown.
IDHYMPKXLTFKQLPEKLAETSGKSNVFKDLINVLIDDXNNYLINVGVVINNKRNLFDLIDALLLGCSRSNNNVTVIRYSGNNVLRESKKKAQNKTTTSNSSTTTSTTTATTAIATTTTTTATKKHKKKHATKEKGYGKHKIQNHSVTIHLIPHDGQISKGKPDLKEVKFDLLIVFDGSVDTESDFFKLLRIQNRNVNINNNVNDNVNDNFMTLNIKLDRGRLLTRGRHLTRGRPSTKENLLVDKNSSEESIINLPPCAIIRLIPTRTVEHAKLYYKPDEDKPDYLTKVISSIVCLRDSIGQLPPDIYPIYHQKLTYFSHTFFDKLFQSTTMAQTKINGKNKYNDHYNDEHEHEHDHIHDHDHDHEYPGWPLPDLPKIIKFSPYDVERSLLTETRFHYTPYDFNPNHLNNENSSKDYKNQLKSTYYELSSTTGLCRIRP

SEQ ID NO: 15956 - protein, 88 aa, Candida albicans
MVPPPKPCITLAPINMGIFFAKAATNDPISNIKIPTKRQFFLPNATAILLFNNDKQAIGKRYPEVNQPILSNALKLFPTSLIIVVTIV

SEQ ID NO: 15957 - protein, 531 aa, Candida albicans
TALLHSQVWFIQRHILMYDHLPRILKWSICLAIVFWYINQNSILFVLSIISGIILLCLVMVYYTTKVQISRSPPIQRRHRRFNFTLSKHWKQEITQLQNEQIEVKRPIFLESFLISESLQRFIDLIIQEFISPWYTQITQSAQVQTDISLEFKEVIRNLQNRAKSIDFAQLLVSNILPLLQEHFEDYLRAEDIIKSQGKFSKFDSNEYHIAVASQFRRGKLHPAVTTSLIVNEETNFKEKQYLRKKMKNVLELALSENEKFNDVGISLVTEILACTVLCNVINLLTESDFYNLIIVKLIGDNLRRRDQVKQLRAALEEHTQKCSKEIDDNKVQVPDMASALLTPDSNLQNQLKLKISERKQQREKQKSLNLKDILTDKNNFQVFKEFMESEGRSKLVEFWKAVEMIKAPLEGEENDDETDPLALSLEFGNNDDVYNIYTKFIKTNEIPQPDTHIVEVLSNSGNSANVRTYQEARTYLFKMQRDCFDQMQSHDLPVFVNSDMYLRLVSPKESAGSKSRRHKCRGKCFYIDYE

SEQ ID NO: 15958 - protein, 152 aa, Candida albicans
ELKEVAKVNQFVLIPTDEHIEMKKQAEATIQDKLEGTDWKLIKNDEYDELLVKAHQPTIDDIARNATAIGFGVMSVEAINKMKEQANESIYERGSREGMVVMSKEQHDEVREKIQTPLAERAKSEGYALIKPDELQKLRVAESRTARGQSFS

SEQ ID NO: 15959 - protein, 251 aa, Candida albicans
TQLRSFQPVVKTINILIELKNLFRNLKWFAELNHKGFIKILKKLDKKLTSILSQHSGVSVGGVSNHNQEAYMGSRINALPFANGTEASNCLDSIHHILSRIETRNDVVQETIPVENNETSISALIKNDDFEGLKKHITIKSSQKFLISTLNKAALANSTKCIDVIWNQLDMLYDDSDFNGRNFFHQHIISLGKAQFIREEQIVPGEVTNRLIGGDNGPDNSNKNDNPIGLFYILNKLKHKRLILAQIITTS

SEQ ID NO: 15960 - protein, 88 aa, Candida albicans
FKRLFSFQFPMKFGKTYVTHQIPEWSIYDMNYKQLKKIIKSIDSAANTNVDESKYPEVISDTLGSFFYDLDRDIEKGLHHGLEGPRSR

SEQ ID NO: 15961 - protein, 806 aa, Candida albicans
KRWVEVTRYLVEFGVKWGLINTSISIDDVSIWGDQEGLTPLHLSIIGKHPKTTETLLGFNKAQTLTCPNLLLLAVRLNSPQILNSLIVEGNIDVNYTDIDHRNETALYIASKLNHPDLVEFLLESNANTEIGENVFGWTPIFIAASEGFMTIVKLLKEYGASYDIVDDSGWLPMEHACLRGHLDVTDLLLPKNEKLLLYDMYHPENNLPRIPSLAASPVLTGSDDGTVSTSSIDKLPEPQKNTVNQFYKQLKNNSSNNVSRSTSPKRNKRYKPVKSFGHRYLNEDESLILLTLGTTDLRDTNVPVELNKVSLAKSFATELDTALSLSITCRHKLTNNPVEPPVVVDLPLEDFHGSATDPISFKLSNDLTVNDVIITFDIIPTYQVNKKVIGRAIALLKDAYTKVGPNLRSLNNSIDIPIIESTNLDILGTIRFEYLQVLPFKHKAMSIARSDTYWKQLVSTRVIGHRGLGKNLSGQKSLQLGENTVESFIAAASLGASYVEFDVQLTKDHVPVVYHDFTVAESGVDIPMHLLTLEQFMGFNTPTEKPTHTVDDEVLTRGKQRAQSSYQLSNNHNDDIEKEFANQRDERMKFTKTWKNQGYKGNLRGSSVASNFVTLRELFRKLPNNVGFNIEVKYPMLDEAQLEDMGEIGVDLNFFVDTILKVIYDENTTGRDIVFSSFHPDICLLLSLKQPTMPVLFLTEAGTAPMYDIRASSLQNAVRFSKKWNLLGIVSNALALIKTPRLAQVVKSMGLVCVTYGTENNEPELAKIQMRAGVDAVIVDSVLAVREGLREHNETMNEFEDSPTE

SEQ ID NO: 15962 - protein, 139 aa, Candida albicans
LQFVHVPYHLDHGPCPSLSDIMIKLSESNRNQRIELTIDGITQPDLHPGDEVHITSEVAITSSGASSAGSSTHSGSSSTSTGTSSSSSSGSGSNNSGSYGDKNGIWCVATNQNQWSKDLNSLLGFNSSFRDQKGKKLHL

SEQ ID NO: 15963 - protein, 209 aa, Candida albicans
  UNSURE (5): Identity of amino acid sequences at the above locations are unknown.
LMNRXLECLKTYNLDVKNKSIFGDLFNNTVTTLIDCSDGVARCGNCHWEVHGSICSHCGTRFRRSTRNINGESEEDEDEEDDDEDDEDEDAFEDVVAGFRQSVEINEYDSDDSFIDSRTANEIPVGTDSDSEISIHINTNNNNNNNGNVYDNESNENNNTDDDDEEEEEEYGDNHLGHTESFGNNSAIHDDWHGFEIVLQHRAGKSTLR

SEQ ID NO: 15964 - protein, 188 aa, Candida albicans
  UNSURE (138),(139),(140),(142),(184): Identity of amino acid sequences at the above locations are unknown.
YKLTYIYILNMTSNNTDKTPLLSSEIPENPIVLPSSTQQLSSSQLLAKPSSSSSTTASTSSITPTPSLVSLKQPTLSPSSNTAKTNSKLVKSNKIGLQRTSRTSQKLKLVPEDPDLDIMNTLSGKDGDYDDEEEDDDXXXPXRIYAQVKKITDTSARKEAETWNKRLREFIPNIPAYWYWWIPXNESI

SEQ ID NO: 15965 - protein, 198 aa, Candida albicans
VDLKSEKLSEEDIQIEEFNYYITKSYQPRIYNDFITLRDDDNYMLKLSISHGLAQSVKISLFEELVDNTIEDTQEIPQQIAHTGKVEMTRDEIMKSIGELFILRININLHGSVLDSPELMWAEPHLEPIYQAMRGYLEINQRVELLNQRLEVISDLLLMLKEQLGHSHEENLEFIVVVLVGVEVLVSVINIIIDIMAF

SEQ ID NO: 15966 - protein, 80 aa, Candida albicans
THGGGGGHGHYQQQQGYNAYGPPPPQGGYYQQQPGGGGGYYQQQQQPMYVQQQPRSGGNDSCLMGCLAALCVCCTLDMLF

SEQ ID NO: 15967 - protein, 298 aa, Candida albicans
RGRPSRGERQRNLCAWILCIVAICKKKKPKKKKTSYSIYFHPIYQKDSMTDIEVKSRSRSIKSFSSNELTPDSSVQELINELSSDNHMSEHRLRLTKLENGKQVALIPHKTFAENGIPKTASKIELFVKDLGPQISWRTVFLVEYFGPFIFHPLFYYVQSLYGSGSFEHTQTQKFAFAIVLLHFLKRELETIFVHKFSNATMPAFNIFKNSGHYWILSGFNLAYFIYGPSDKLGVLKYFFHVNELPSSVVYGLFGLWVFAELSNLTTHLILSNLRKGDSKVYVIPFGYGFNWVSCPNY

SEQ ID NO: 15968 - protein, 439 aa, Candida albicans
  UNSURE (12): Identity of amino acid sequences at the above locations are unknown.
MAVQGTFISPSXSNPTFFSSLKYFFVSMKDQWFPNMSDDTIAPITLRHSHSHNASGTIASPHRNVIGEIDNDDGDDDSEELAEALEDESVDYQDIELNKQSSRNLYRHHNSDIQQANLENFRRRQRIIQKQMKSIFIYPFAYCLVWLFPFILQATQFNYEEDHHAVYWLNVLGALSQPLNGFVDTLVFFYRERPWRNTAMKNFEKENRQRVDNIIVNNLEQRKYSEGAESAQTVATASKRIAKNSLSASSGLVNINAYKPWRQFMNKYRFPFYQLPTDKNIAKFQDRYIKRKLRDSRKLDKLVQEVTRDRQDLTFPTNIAEKYGDGSGNGSGSGSGGHHGGSTISNTNDSSPMSMGAGINWTEPTNAHDFSNILNTGGNSNVSSWGTKDVPGFKPNFGKFTFGNRSSNLLSRKSSTVIGLHGTGRNVRQPSNDSFNDAR

SEQ ID NO: 15969 - protein, 439 aa, Candida albicans
HTIMHKHLHHVSHTIKSYLSTLIALENLKVVAFLISLLSCLVAGSILLFTLYTSSFHEVLGLSYLQINMISSLSALGMYFCLPVLGYLADSYGPALLSLFLIWFFCPSYFVNSYLVSTQSGSVIGFCVCFCFIGLATSSLYFSSLITCARICPDHKGLAISLPITCYGLSALLGAQILKLPYFHRHDVLDLEVVFLFFAWLYLVVGIASFVSSSIVIVELELLFGVTPDEETALLELTPTRSLEPPNHRQRFVLFVKDPSAWILLVSLILNIGPMESYQNNLSSILKHTNGADLPNQVSIMAASSTGARLLLGVLSDYLSKYVCRVWLLVVVIVVGVAGQMSETSAILNGVSYGGMFTIYPTIVASIWGIDIMGSTWGSFMVAPALGSVIFSMFYGRNADSCSDCLLHYFYTTAGAMIVSCIFVLLAWKIWYARGFTRF

SEQ ID NO: 15970 - protein, 434 aa, Candida albicans
LNPVIPPSILLHTQMGKHRRNKKTQKSRHDPLSNPNLTTSAAINAVRGSGKQSKIGPLIDKLKSLVLNDKSMAIGVINVLAEDEQMRQELINNDIVLVLMQYCLNDANASEDILIESFGLLRNLIIEEGYDIIQFIWDNDIWTIVENNLNKINISFNYLMNHNNNDDGTSDGKPKKNLSKAKIQSLYEFSENLFTLIIMLITSDERIFDFVFNINSNGENNTGGNKIDPIVQFVLSLIDSHINNKLRLSKKLFNTLLELLFQLSTESISFVQKLSTSFDWDKLGQFLQSDANYDSTSKIYYNGIFFSLVEIVLQPSPQEKKEELMRQVLSDIIKAITVKEGSESKPKEGEEQETQDLAAFEAGCDIIATICEYLATDETNPETPARLSPETLQLLEMVGNQLVGKIEAMGVSESESSSAEAAINNLQLVISFNQ

SEQ ID NO: 15971 - protein, 697 aa, Candida albicans
LFISIYTLVVSKLISVMAVDNEKKRSTPDSLNSPHAKKLKPMQELSESGPLTQADVVYFQKEAIWRQMIQYKQQMMSMRLELIRLQRESDALKHIVTVLTAWYEQILALFDELNSEETSDLLLAITKNDDEQLDLIRKKLSNLISSKVTFDSAKYEKVSGELALLSRQNEQMTEEKRSLGERIDELESKITELAKEHERAQSKTLKRLDSQRHIKTEEDEQSTTKEENPQPNGHHKENDKTAVVDSEELDNLKCELDKLKTANQLLVQQVEQLTKENQSLIQKSLNLENKLHNLEESDLEDNTYYKKIVKNNQSLQEQIGKLTKLNSSNVSRLNELERQQNDLKSVIEGEIIEENEKLKQQLQESENNLVRIRTTRDELLSKNNILTSQLQDQKTNESLVELNNVLSKRVELLTEERLEAIVGTPGTGKLEDLSQQELIHKISQLNNEIKEVELAFKQTREITLKKLTSSIDQENLTKKLTIEKNKADQKYFSAMRVKDSLTNENKLLKAQIAKSQDLIKNLNDLEKKYLNKIDLLSNQLVDFRIIKENSLAENSKLHDELKTLNIAQDALHQEVERVNAKLESTLKEHTDLQESNKKRELELAKLQKQLQSTENILQKYKTNNTNSLLQEDEQQLEALRSIAKCSVCSKNWKDTAITVCGHVFCSKCTQERLAARLRMCPSCNRGVSANDLLSIHL

SEQ ID NO: 15972 - protein, 285 aa, Candida albicans
  UNSURE (17),(51): Identity of amino acid sequences at the above locations are unknown.
TGSKSPPHPPSSRISPXVNSQTIKSTFRNYSSWLNYLLIQPLIIIILVIFXILSTIINVIYIQNQSPSIVNGSGGGGGSGSGIDGSTNNNSRCEFVDPVAKASKFIRDLEDNLQPPLILQGNDINSGGGGSNDTHSPITLATRPVSGTTVTTTTTTTSTTISNSERLPPFFQGSYTQALYMATKRGKFLFVYLTNPHNENANGIFNNIITNEIFLKIFRTNENIIIWGGDLTNPEAYQLANSLAATKFPFLGLLCLTKSLKMTPEGPRKTVSKLLVHHGAGKSRA

SEQ ID NO: 15973 - protein, 233 aa, Candida albicans
  UNSURE (224): Identity of amino acid sequences at the above locations are unknown.
GSTILEFHESHAYILWLRYLNTGLIANDTFQTIIQKSDYWKSLQQGLISDSHEYRKFSLSILQVSLTSINTDLNNDYIVWEITDKQKYLNEWSRYMTLYEIIAIDTSLNQAEAGQNDITGLISPTSLIPYSWGWCLLSTGLQATLESVRKFTLRLLLSIPSENLYLIKHGLPILEKAFLPNLMNASNLNVKITSNDKLDCEYAYQLKNYICNMVKNLSPDQVFXQPGGRRYRR

SEQ ID NO: 15974 - protein, 494 aa, Candida albicans
CGSFQPRGEESVYDYIIDNQQYFHLFKPLKNTDALEEWTRMQLYSIILSLSDNLTNIDLDIFLARLATEPSPMVRSYIEWIIALKLSDNGNYVDKLLNELFQKINILKPSVVTSYLKILFLFIQQQSTTKECQLLTKLLYTVIPGCTVSRKMIRHFSLSLIISIHDEIKRKNLPLDPRVLDIVNNMYLNAIESETFAQYRNGDELLWDIVKDLTLVNISGGVMLRLSDRTDLDFIKKENFDKYLSQDQINLLKYDIGQDPQLWMINEEKEEEEEEDYDKKRKLNLKKPIVTPIKPVDSNEVSSSSFLQTKSGAWNTIMDADAVVDDVNNTNNSVRGSEIPRSELIVVSSLVDKPPNLGGICRLCDVLGAGLLTLHDIEVKNHINFKTVAVTADQWMPMIEVKMENIKQYLLDKKREGYTLIGLEQTDKSIELNNDLKFPKKSLILIGKEREGIPGDLLAELDFCVEIKQVGIVRSMNIQTATAIIVHAYSSQHC

SEQ ID NO: 15975 - protein, 253 aa, Candida albicans
LKNEFVNNINNGGSITDSEKRGVFGFFGKEKGENDTRMRSTAGYWMGENRSQLKPTLKKIFLFNPLVPLFLRVLIIVFCAIALALAGSIFIFSKRDYEGHKVEQQPSTIMALVVQSCALVYVIYIAYDEYTGKPLGLREPMSKMRLILLDLLFIIFSSANLSLAFNTMNDDEWVCKANKTPGLADIGVAFPTIGSICRRQRALSSFLFMVLVLWVITFTVSLLRVIDRVNTPGPRNVYRALIVFYIVIMVRLL

SEQ ID NO: 15976 - protein, 358 aa, Candida albicans
LNMSKKPKVLVIGSGGVGAISALSLTTNNKSEVTLVVRSDFELISNNGYSIDSCTYGKLTNWKPHNLAKSVDHATTDFGPFDYILVTTKNVPDGPITCEEIIKPAIKTGNEVIILLQNGLGIENPMFEAFPNHLILSGVSLIGSTYYHGHVKNLGKDFVYLGDFKSKQKRSDLSFEKIQKFIEIYQNDDPLKNTILLDEDVQKRRWEKLIYNSVFNTISALVQLDNTRIQMTIGNEELILPAMLEVIAIAKSVGVECDPTLIDKYLHIGDGFFYSPSMCVDVRKGQLMELEIILGNPMRIAKENNVPTPILSTIYPLLKLVQFRLKEEKKMFEIDKNDFQGNSDDYQKIFSEKYTTKH

SEQ ID NO: 15977 - protein, 203 aa, Candida albicans
TFNSSLSINNIITMAGSQLKQLKAALKDKGLIGQTNVSQKKLKKKNSQSSTTNNTKNINRDEKLQQLKEIRDQFNKFDQKINRSKHDISIIHQGKFVKVGSKQHNSLAIKNGNMQRQMKMQYDLEKFQHGKTGGILDKRFGENDSHLSKEEKMLARFTKERQSGSSKKRSVFSLASDDEQEPDESDGEDNGGLHHGTADPNIL

SEQ ID NO: 15978 - protein, 181 aa, Candida albicans
FIQEMSNVDPNKQPEYVKKICETYKPNLAEGNKEKMSNFVGILFEYILHIANQYQDFEPFVKILIKLAESSTSSRATTITTTTTTTTTTKAYNESLVERVREHIKHIQSRIDKQLTPVELVFFTLIAYLFSSSDHYHIVITPSLILIYQILSNIMYHPKTVTDIAPGVYLIDVLLMFSRFA

SEQ ID NO: 15979 - protein, 535 aa, Candida albicans
ANTAPSRAVVKILDLSVLFMNEKSLLTKTLEWNLKLCIDNFIYNQQGQINGKILKEYNRNQLARELTSRFKLAAIINLILSPFIVIYFVLLYFFRYFNEYKSNPASILGLRQYTPYAEWKLREYNELSHLFNKRLIMSMGPANTYIDQFPKGFLVVNLMRLINFISGSILAVLVIMGILLEDENHSFWSFEITDGRSALFYILIFGTIWAITASSATGTSHELTISTTSQSSNSNSNSNAASTFVYDPEASLRYVAQFTHYLPSSWNKKLHTIQVKNEFCQLYCLKIIIIINEILSLVLTPFILWFKISHNSGNIIDFYREYSIHVDGLGYVCYFAMFNFEEKDKNMMSDLNKSKKRRKRMKNKMNKYGKTKMVNPILGKTVNSEIEMTKISKSELERSSDDESGNEQDYDNDEELDYLSYKKDDKMIKSYMYFLESYGGSKQPQPQPPQQQQHPQNQNQTVGGLRNRNPIQSIDPAIMTGNYYDQQSLNSSIYNINYKYDDSGLLQDETMNSSSRKKGGVLRILNQFYKQDINT

SEQ ID NO: 15980 - protein, 245 aa, Candida albicans
  UNSURE (233),(240): Identity of amino acid sequences at the above locations are unknown.
TDSTSLSDSARISKTTVPQQQRALATVNTNYQRTRNNNRRFIIPPKERALYLWANITNMDEFLSDVYYYYRGRGLLNIVLSRGFDLIILIFILIFTVFLKWGIDYSIFFDNLHQEESKHITLNDMIIPNYFATIPLSIKFILFGFSVYILLRLVQLYLDYNYKLKELKNFYHYLLDVTDDELMTISWKTIVEKLMLLKDYNSLTSTTKSNNFLENHYVNDLSSKVRLNAPDIXNKVDHGXGRSRA

SEQ ID NO: 15981 - protein, 60 aa, Candida albicans
WDQNPILLISFAPSLNLEDYPPWHIRLSEIYWEPDNKDVNYAVFLRGLQQFSNCKINIGK

SEQ ID NO: 15982 - protein, 317 aa, Candida albicans
TFSSTVIIKFIRILSTAANMNVTSPKISENVRLRNNGNTQLKNITCDMNNNDNESNEDSETKAPPNSYRIYNIFSIILALFRSLIKTTSKTTNSVFQMSMFYINHFILLSLFFMIAIYKNFQYLYRRVYLKYLAVTYYPSKSPQVIREDINKLEKIPKIVSCILDLQDDEDENGGKDGLINSISELTAWSMSAGLTKLIIYEFTGALIENSGCIVDLRKYITKTLVLYFGTEAIPTFSIRIPHKNLIIYSDNHIDGNAVDLEIDLISRIDGKPTLVELTKTMSELAVNRELLIRDITIDLIDEELHELVGPEPDPID

SEQ ID NO: 15983 - protein, 401 aa, Candida albicans
YYLANTVITQISTLFHHSVILFNIMINVFKPIVQRDLVPTAYYNNEILQYNGVSPKDTPILPFNQTIEDLNRDIYAKPLHSHNDYWREYPLFSALSAGAISVESDIWYFPQSYKLTRTVTPSTSKYNNNNKQGNSSVNETLIFKNDEIYVGHSQEFLKPINTLFNLYLNPLSQFLQFVNPTYEIIDGDSNSENSRLEQDFFAQSQLERNSVFYNNPGQPLYLWFDFKTEANSTYDALKPLLKPFIDNGYLAYYNTTDDKYYSGPLILTITGNLPVEKVTNETIRYLFLDGPLDKFTIDNNNTNKDELKKWSKLSRVASGSLETILGSESYATSTKNDFNEEQKSQLKQVLDLAHEYGLKTRIWGDITWPWNVLDLHLKILFELGSDLLNVDDLERALQLFS

SEQ ID NO: 15984 - protein, 214 aa, Candida albicans
TRYFQSRGARRTLKRECAKGYIDGFVELLVEDLRLHFNNVPVKDTLNRIYVNKDKTKKYNSNPINTTYLNFDETTKATLREFVSNLAKAGSLSQAYSNYQSKFITEIKDIIKQNLPLQKLTDMSNTSSRASPISNAEPVPPKQSNALSSNIKTLTPKEFENMLSKTYAQLSECLRRLTVHQKLLLDIALTSIPPTSDIDIMSLDITNAIHKAIE

SEQ ID NO: 15985 - protein, 488 aa, Candida albicans
VNSENQKQKKNYLTKNRLVIYIHTIYTLNMTDDSLNLPSRVSMDDNSINLNDDLVVPSENSSNSVLSSTSNVNTRTPTTIITNNNNNNHIHRGHRRTGSAISTNYRTSIDNESYILSGTFFNFANLEDQKDDIYSPLGPNSIYALTIGSDIARAKRHRAPKTNVTLNGGATTIYHVNTPTTKDIPQIQLVKLKNKVSSKELDEKYVKNIASEYKKFESSYNPLTEDILLKLAQNERKSSITSSTSSLPSPSPSSPTTIDNLKGLSTQLDAIPQVFQELDFRLDDPRVFKQVLKGTTLMFDENDPNLSITNNTELQEKLSDYLDIVEMNLVDEIAKSSDSFFSTFGDIENIQKKSTECVTNYHTLMNKIDQLEKNQSRKGLDILHKMIERKNVETLEQSLLQIQYITSLFQLANKSFTHGDYSKGLNQISAVENLLKGVDHEDITDEETQKIYPKLNLIDLSYLPAFIHLQNDLATLKRLHHAAGRTNI

SEQ ID NO: 15986 - protein, 299 aa, Candida albicans
ANCAGSSIRRYYEQALIQEVRELLHDWKNQLAECTAIYIRANGASNRKVLVGEVSPIQANDPRLRGFPFTTRRATTSELKRAWVELTHLHVVDMPKVEKKKETPKKIEKTTVSPPPPPTNTLSTDLITLLKKQKAPKLINFVKQNSIDVNEFRLDYTHTPTLLHYAAANGLGHMVQVLLVNLKANPIVYNAAGRTPAEVADTSARKVFQIVRHKLGEEYCDWNAAKVAPPKSKEEIEQEERTLHEQLELEKKQLIQQELTKPEPKKVTPSFDLTGLSDQQKMRVLREQRARAAEARMKR

SEQ ID NO: 15987 - protein, 216 aa, Candida albicans
LDPRLANSSKQGIYLNLLFKSLKNDIANIPRVLAFVKRMLQICSHWLNVGAVAGMLYLMMELSKTIPEISDLLVEFASRPDDTEESSEKDTEEVDKTKDENKDIEYDPRKRNPKFANANRSSLWEIHQFLNHYHPTIAIYASSFLDGTEQVKPDLGLYTLSHFLDRFVYKNAKQKPQTKGSSIMQPLGGAHTGSLLVRSTNLVDTTVPVNTENWLW

SEQ ID NO: 15988 - protein, 179 aa, Candida albicans
RILFNNHYSVFTVSVMSSGLNLSSLKDKIFSKLNLQKDNQTKSQQKSKKASSNDKEIQKDKKKPATPAKANAKKTKGVDEILRREALALGATDEDLKLVEGIESDDDKSEQEFDDDSKLDKNFSADLSKFMKGIGLGEEEAMVVSEEEEEEAMVVSEEEEEEVPELVEGEEAEEEKVSE

SEQ ID NO: 15989 - protein, 205 aa, Candida albicans
TSQKKFFSQILSDGTLNDKMSALTLLIQEAPLHNLKALDTLLAYCDKKSRTAALQSIVALKDLFVNSLLPDRKLFAFDKQPLRKDDSDIQLAIYYFEDHLKKVYFKLIQILEKLSHDPIVHVRMTVVNHIFDLLGAKPEQEVNLLKLGVNKLGDIDNKVSAKASYLILQLEQAHPAMKQIITDAVIDVIFQSNNDDQSSPRPEIR

SEQ ID NO: 15990 - protein, 256 aa, Candida albicans
NNYQELQTKKMANAVAENVLGTIGTVLWCIQLIPQVIRNYRAKNCEGLPPLMMFLWAASGVPFSIYFIATDGSIPLRIQPQLFTFFCTLSWIQTLYYPPKKVSRTRLVTFVGAFIAISIGLEVGFILWLRPLYRRGIEWPMLIIGIVACILLAIGLIPPYFELAKRQGRVIGINFVFLTLDSLGALFSLLSIVVGTMDIMSIVLYAIVLALEVGIFASHFIWWLRIGRNSDNESVDVQRHHETHSNDEEKSEVVVV

SEQ ID NO: 15991 - protein, 162 aa, Candida albicans
LVRDFHVTSKTKTKKLFPKRKVNTVHIPSTMNDDLTGVFKVTNLVVAGLCVVGGLSQLFYSFHAFVCGLYIIVFGGVIGALEFTVPAEAYAYASFLFSFIGRGIFYTFLGVSLSGGSFFRVFAGLVVFGIGLAYVVLETVPSISPPDNMNPDGAVVGLDDEV

SEQ ID NO: 15992 - protein, 272 aa, Candida albicans
CQGEVYPNDNRMTGYSEFKEMGIVTTEEIDHFTGKNNKQDFNAKSSIFIRDFAVTHQLKLKTSKKLLGEIDRQFSVYPFKLDYASKNFPINTESSEDEIKQQIAAIGQDMKSNRLGAAELSNRHLIQPKPIQTTKFIPLKEILLSANPTGKHGIDATKPVLPGMEIPLPNLGVSSLKLKSLLKTGRSINNVRESTTVAINENNQELIRLTGGEATAKSNWVHSQYKLPASLNETIGQLVQISKDKRFGIKIKEVVPYKVQQSNMSVESMQID

SEQ ID NO: 15993 - protein, 280 aa, Candida albicans
LKTMQLAVRQEDADILLKQKNVLDELVVEKYRVAGQITQTALAYITSLINNSYHLQTSPKLTIQQLCLLTDSFLLKLLSRQYVNKVNEKGIAHPTTINVNQLLNGFSPEIDDEREFFLNQGDVVTISLGVHIDGYTSQVSHTLVIYPPSADAKPEGPLLGSNADALCACHLATESVVVLLGCSLSPEKLPANLKNVSNTVTGSQIRELVDAIADSFNCVVVPGSKIRRVRRFLAGQAEGIVAERDFKGVVWDESHQEARLLTQSNNTSTDLILLDSNRLH

SEQ ID NO: 15994 - protein, 669 aa, Candida albicans
RQKSTGGAIRASRSKIKASIFKSYEAGEIIRIDKVLVLVMKPPGSGRVSERWREYIAVLRKTDLVAEPLMLQFYDIDKSPEESHPRVGFRLNTQVKADFYSYLDKTISLTVLEKVQYILRLNNQTNSFRWLYFIKETLGVETEINLFNIYVPRLGYFIEVEVPESVFANHFRSNQNIVVTKHEAGYEIECDGISQYLKQFLPKGLSRGWFCFRKYDRLEWAGSTGEQLFIQNMLFLQNHQLEYREYEASDVPPRPIEGFLGRLTNVSGKEKSVLRDFHKILYFYTNRNLLFFTKYYRAVPPPQGGDSLVNEVDLFGDGHMEWLESDFDGHNKAIVEEIGRRTDMIVKAEGVIDMADICEVNISHSTQTQNLVHCALWYSKPELASEKEIVDSCFEIQLKWGALIKLQAQNQAARDIWITSLNDMCRYWKRRQTETLANHIQISANNIERLLATQYADSNASDEINFLESQHAIACGASIPHLLPNMLVIKSGYLYEKNKKHASFNHFYVVLCPGYLIIYHTFRRSRGTGTPKLTAFYEHYITIPLSQCYVYTGKLTELDLLNCETRTTQVDTHSVPRVYPDGWKSMEEDCELCFTLWFGKKRNISHYEKQLPKLLEVGVQNEKNPGMVTMIRKLGITGKSIMFTANSRQERDRWTMCILSEMDRLTGQM

SEQ ID NO: 15995 - protein, 396 aa, Candida albicans
PSVGPSSPVVRISWIALSPFIINKIEKATFGFINISCGPDGSQCISFTSVHRINFALGILHLILASLLVNVKSTANPRAIIQNGCWKLKIFAWITFIFINFVIIPDSFFIFYGNHIAIIFSTIFLGIGLILLVDFAHAWAEKCLEKIEMEELTGEGDASFWKKLLIGGTLAMYIGSIILTILMYWFFTGSGCSMNKTAISLNLVFSIIISAMSIHNTVQEYNPNAGLAQSSMVVFYCTYLVMSAVASEPDDKFCNPLIRSRGTRTASVILGAFFTFIAVAYTTTRAAANSAFSSESSPNFVTTGITTTSQQPSARNEMRYQAIKQAVDEGLLPESALNQLDLYEDEDVNDEEIQSVQYNYSLFHIIFFLATQYVATLLTINVKQDDYGDFVPVGRT

SEQ ID NO: 15996 - protein, 276 aa, Candida albicans
FGACEFIAQQTRQIIEEMEKSGHKISCIFMSGGQSRNGLLMRLLADCTGLPVIIPRYIDAAVVFGASLLGAVAAEEAVAEHCRDKAKSRRSSLFGKGSHTNLKDRGSTSPYTAPSATSTTNLSMLAYAESHQGQAQLTPMNEETDYFNQAAQQKGGAGEHHNNAIKSDDESDDDATLSFGSKQQTQKGLSQKLASLNLKPLTSSSKSNAPGAALWKVMKKMTGPGKVINPHPDDNPERRLLNVKYKVFLEQCYSQRKFRDMVDKIELENAELAKKH

SEQ ID NO: 15997 - protein, 120 aa, Candida albicans
  UNSURE (7): Identity of amino acid sequences at the above locations are unknown.
RSNVCPXRLCENDESEDDATLSFGSKQQTQKGLSQKLASLNLKPLTSSTKSNAPGAALWKVMKKMTGPGKVINPHPDDNPERRLLNVKYKVFLEQCYSQRKFRDMVDKIELENAELAKKH

SEQ ID NO: 15998 - protein, 320 aa, Candida albicans
  UNSURE (276): Identity of amino acid sequences at the above locations are unknown.
STVCYVIEFVHCQQETTMVQNKSNVSLANRRQSSFFRQLPPAEPDVYYIGVDVGTGSARACLIDTNGIILGLAERPIKRQELEANYITQNSTEIWEAICYCVRSCLRDSGVQPEDVFGIGFDATCSLVAISELTDQPVSVGPNFKNDKDNIILWMDHRAVDETNAINATNDKCLKYVGGQMSIEMELPKMKWLKHHKPGGIKDCKFYDLPDYLVHKATGTETRSYCSVVCKQGFVPIGVENSETGWSEEFLLSIDMPELVEDHFRRLRGIPAKNGXYLTAGDPVGNLTPEAADKLGLTTKCVVRSPVIDAYAGWVGTVAR

SEQ ID NO: 15999 - protein, 239 aa, Candida albicans
THTLRMLSSPGLFRLFTIYFSMVLIYASTILAAFSDPGRITTINLKLYPYTPNQLIFFDGKTCSTCHIAKPARSKHCSVCNQCFLLYDHHCVWINNCVGYYNYKWFMLFLISNINMLGYGGWLCYWALTPVSWRKITSTNNANKVTGIFLILCSIFIVITTLFTFLHLRYIYLGVTTNELDKWSEIDHLVGLGVLYQIEPSIANENYVERAILDGNAVYISLKDERILIYNSNVKNLNF

SEQ ID NO: 16000 - protein, 687 aa, Candida albicans
LIRKIDHLLDHCFTWQHFKDPQDFESSVDIFFSGLEDLWTISHSYLMTSNITQQAENQKNSNTDNGVLDSVILGVFQIESPAIRSSEQNKLYSILLAFHDAVRVSFKIWNWSDSKTTTPSTVNYYSDRSLTYISHKLKFRARKLLESLLDMERQEVVESILILNGSVNAKLKLMDILDGGRPQMTLPSILKSILLRSNLPVFSELSRVAVDLDFDLNMKELSRFLVDFLNFIDNDSVADIWNHIMVFFKDVLTHVGAFDEILLDCLLICSGLSKKLTSIKNRDHKYQKELGDIFVRLFNQVLNLKQFLVSDMSKNNTKTTRKGDLVSSKPDLENNFSTLCQIIPVFEDILPDSDKVSLLANLTVTNFIIARTKLKTVSEIPEDVVVIINILGESNSCRSWKTLVSDLFMDKSFFNNTLSMSSVWRSVINSWMVHDKERFGEIISRITVTSGASPSNLFVWNEMSEIENKANLLKRLVYLILVLPKDYFLNYLEPLFDKVNVLLNGNCPDIIRIQIMILFRAVCLKFNELHLLLKWTLITHELLSTFKNLLAKSAKELSTLSQDSLQLIFFGCKLLDQLLILSYDEFNLKECLFVSTSPDLDDGESISIISKISKKYDLTYLKDEPFNVDQALRLLRPLLDGKRKIELLTQLTLFFDSLGLINYERTYSLYPIDYDSCTTDALSDLVN

SEQ ID NO: 16001 - protein, 704 aa, Candida albicans
KLHDKDDLSEKMSSLLSKTKLSPKDKKYSQLVEKTLATFDSLEEWADYIAFLSRLQKSLQLNIDTAKESYYVPYSSQVSNRLALCLSSDLPNGVHQKALSVYEYIFDRLPESTLNKDINIWLPGLLPLFSYSSILVKPLQIKMFRHLILSQLSATTLCGISKPFILCLLAGLDDENSEVFGDVIELLDAYKLKLNNDSHFWQSMFVCIIRNPERRLGALHWCVKRLPLFISFKDQNGKTVLSEEAQLCLKPEPGLLIRAMAISIDNPESFDVVVVRGFFDLMLSHIPLDSDVITNRITPTDREVLIMACSKITLRKDMSLNRRLWTYFLGPETEHESLKALTRTEYFKQYVEETLINGLLAMAHSDKIELKCDAFKILLPLIMDKWEIGNVLTPKLFSSFLKIAYNNRDHQDLMISASTLFDGVESIYIWSDIIGVILSDESDEEEHEFDVVHFVLKDFNVNEEEMATLHVPFAILCLLAKSTVTPKRLDTLELLINLVSARSLDTLDEGVTCCESEIINKIETWYSSSLKGESPDTPFSQGQVSFLIVNLLQKVYVDNMEDTRFCIKVAELLNHVRNFAMIKSSHGIQDSKLVEKILNISVPDFSCELNNQDGLLVAFGISKLVGIFSKLLNHETNEKVLKVLLSNLWSAVVSSDPANYQVEAVRAIFELETCYSLKKLEAGLVELFLALPENRRLHHGWKTA

SEQ ID NO: 16002 - protein, 350 aa, Candida albicans
ENYELEKAYQILTRGCELDPNANEGFEKFLYLGQIIGGQDGINYINIAINKLQSLLLEEEEEEKNDSTKKSFFINKLNLAIFAEIEIWMTDLCMEPEAESKCNELIDYSLQLDDNNNPESYSLLSSIRISQQRTQEAIEALLKSWELFKLKKSKLEEMANNAKTDQQQEAEEEEEEEDVGGNSGDSFEIGMEYVDLIQPLITLSRYAIELEQYDIAIQISNNVQDINENILDSYYIESLANILKLKKILYPNDQNYKDIELSEILNQVNGDNDEINSILQDVKLSLTMAYKIINSDIGEEFDHGLIEQINQLLQEFGGHIMSELMPQRRRGNDDDDDDEIEGWEDEIVSD

SEQ ID NO: 16003 - protein, 376 aa, Candida albicans
  UNSURE (79): Identity of amino acid sequences at the above locations are unknown.
MPRYPRIQIIQKFKIETRNGRTISTQQIHNHLRYLILTPVEQHIIASTDSDKSILIFKIDFNNSINCLKLIKRQPFPNXPSSITIDSQGQRAIVADKFGDVYTVSINDDYSMSEIEIEIEKDIQPILGHVSMLTDITMATTHHNNNNKQFIITADRDEHIRISNYPKSYVIKNFLFGHDEFVSQLYIPVQYDPSILISGGGDDFINIWKWYEGELIETIQLRQYIESYLSDDHLPPTRFRTETSPKEISIAKIATLRTNDDEEEEDHLLIVLVENTPVLLVFNLDDSYKAKYLQAIIVNDSIIDFAIAADNKTIITSLESEQHSIKYFTLQEENDGKKFSEIQGPNIEQFIPIEVEQKLDFQQLYTIFQLRKRSDS

SEQ ID NO: 16004 - protein, 446 aa, Candida albicans
NFFFRHHRFLHYQMIDNFDLKLETLLHWVKNTDDEKKISNHTYISPKIDVKDVRSSGRGIYAVEPLKKGELILNIPHSFLLNFTTVMAHIVKYNGMAIDLHIHVPFDKSEDEYTEIYRTLTKEEILELSSFQLLSLYLTFERKRSHKSFWKPFLDMLPSMDDFELMPIDWPQEVCTLLPSSTEVRNKKVRSRFDNDYQVICELIKTKIDKDGDVTTLLPRQEVLLSWLCINSRCLYMDLPTSKNSADNFTMAPYVDFMNHSCDDHCTLKIDGKGFQVRTTSQYNTGDQVYLSYGPHSNDFLLCEYGFVIPDNKWNDLDISQYIIPLLKPPHVEFLKSFDYYDNYTMTKEGISFRTEVALATLQESDPQNSRKLLALINGYTDGDVFKEHSNALLLVILNKIIHEAEKHQHLQYDDDKRKKAIGTLYHDMKSIASNVLTYIQDETSL

SEQ ID NO: 16005 - protein, 249 aa, Candida albicans
HKTNQMTDIPIALDNSQLLNNNNNLNSSNHHNHNHNHNHHHHHLLKQNSLQTTVPKSSTSFSEQQHQQPFPNLETKKSGLIYIKNSQSLKNGTKISNKVPRSNSSSSGNGGLSSNTSSVDAKSSTAALGRKRSNSQSQVVSIPTKPKYTTASTSRDPSKGGGSLLLSLTSRISSNPSSNNGSLSNHNPQKRNQIQYYVTLLPLNDTFIKKHLPVATYPETTKLGRPTGTKFKPDVTNGYFDSRVLSRNH

SEQ ID NO: 16006 - protein, 112 aa, Candida albicans
EHKITNNSAPILKELMGHSDTRAIFNFLLLNATFMFVQFLYSFSSKSLGLLSDSLHMALDCMSLVLGLIAGVISQHEIDSNGKYPFGLKNFENFGRIYQWDIASRYKWIYFI

SEQ ID NO: 16007 - protein, 205 aa, Candida albicans
QFFSCLVFIITTGLSIRLYIYIHTYLFNYRDFTEMGWFGGGSGSSSTPPSKVSIVTEYKPEEKTQQYLEDLPPKFEDSEPIPERQATLMDAAQRIKLSDFTVDRFISMPCFREAMITGFQAMGVLGVVTFLIHKNVQKTMNWSVGGFFLGNIIGWEQCRSLRRKSFQMIEKAQQERDEKNKKKWAEMQQSDDEDLKKFQEFNSRK

SEQ ID NO: 16008 - protein, 374 aa, Candida albicans
IQHLNISIMSTSIPTESPLTTNNTTTTTAADISTTSGTTATPAQASVPTSTSSIADTHHSSCSTTDFLTWKNPIKTGKVFGSLVFGLIVLKTVNLFNIFFHLAYIGLLISAAAEYSGKLITGKGFLANFKPTGKLYAKRFNDEVLPELANFNVHLEESFNKIVYSHDIETTLKAAGISYILYKLTSWFSLYTLIFIFVVLIFTVPVIYKTYKKEIDAAVADITKTIKTKSAEFTEKAHKAAGPHIDTLIKKTGPIGSFIQSKLPVRTAGSTVGDSKATSYGTDADKSIAGTTSATGTSSATANSTTVPVSVPAATSATSAEPISTGHSTGASQFPSAPTSGLHPSTVEDVIKQASEEADEFADTTQESFKPTLH

SEQ ID NO: 16009 - protein, 126 aa, Candida albicans
YYGWCKLIPLTAQCDEIKKRVDGKDVLFNHGNELTNEERDIFPMVMSIGWNPYYHNKDKTAEVHIIHKFQKNLYGSKIEYVVLGYIRPELNFDSIDELIDTINSDIEFVKLKLKSDEESGKEYFTK

SEQ ID NO: 16010 - protein, 187 aa, Candida albicans
MKRDQKILKQEKSLFVLNSVDCFNNLLQSILPQLSSISIFSSYIRQFASIDARTANPQKVMLIVAPDNDSLETKLSDLKPWEFPEQITPEQSEQEQDKTLKNNLLHFLNGHLINNFEENLVIDKSSTDAVTIISKLNNGKFLKIKQDQLSQKFSIRLLDSENWIDVETIKQVENGFVLIINDSLVKP

SEQ ID NO: 16011 - protein, 470 aa, Candida albicans
RSFFFFHSFIHPSTYRLSLKVIKQLTMLGQRMILRNTYRLTVPKLVILPICRTNYSTSSSSNNPFPLNDKERKQAKKQSQLPWYKRWTNYSNSEQFQNKTMPKVYICAFVVSLVPMYFYMRDRYHEDKQLKHINAKYAQDPSSLSEYEYLVLKSMNHLEKLRPLELKKYKIYQLMRKEFRRKNLFNQEMFNPTPQELNDWYQNQVKYELASKVVPILVDKIDSKDKINANPAIQNAEDTTAFYDSKAKEYDDAVKWEERGIFMGSKRKWLMSQAKGDVLEVSCGTGRNIPYLYLQQIKSLTFIDSARNMVEVTKEKFKKAFPEFKKVAFAVGKAEDLSNIAQDVKYDTIVEAFGLCCHEDPVKALQNMAKLLKPGGRIVLLEHGRSNWGFINNHLDFRSEKRMETWKCRWNLDIGELIDEAGLDITKEKRAHFSTTWMVVVKKPEDPINPDEKPFLDKLFGRESRKVQKS

SEQ ID NO: 16012 - protein, 423 aa, Candida albicans
SQLCAPARGEDICSWVTSLGLYSLIDSKIARIATTTLLLAMRSNGEEVKEIGMKAIVDILAIYGMSILDKSSKYKYSRMFFKVLNSFDAPKLQCIVAEGLCKLFLADILYKTDKRSLFGNAIQGGGGGGGGGNDDPTTTNDDETEEETDREHEKHLFEAIVLIYFNPNTKSNQELQQILSFCIPVYAFSHINHQINLAAVSGDVIYRLFTETETELSPSVIIPQLISWCDPRNLVKLSNEEINQATSHLWQCVYLLQVVEQVDARNVKRCIINNLNKFHITEELESNQLQALIKALDATVELFTNNEDNPNFILDKPTKKNFDTFIESIKNKLEIAQKREENELIKSGTNSILHELDDLDIGTGESSQISIKSETKRRDLDRSLQVSKTTSPETSENEDEEDDNEEEEHEKKTNFTDGKINLN

SEQ ID NO: 16013 - protein, 862 aa, Candida albicans
IFKRCPPSACEDDEEDQEGEGDQETPISEFISYLIKYLLSGIEAKDKLVRYRVVQTLAYLVEFLTEIHENNTLEALYTLLSNRLQDKELSIRIQAVVALSHFQLFEFSIEGDTGEFEDELISSNQIQNKLINSIQNDDSPEVRRAALMNLVKTQDTIPILLERARDSNSINRRLVYSKIARELITDLDDLEFEDREFLLKWGLNDRDETVKAAATKMLTIYWYQSVNEDLLELIDQLNVKSAIAEQAILAFFKNKPEVLETIKIDESYWKNLTTEKAFLMRTFYQYCNENQLHALMDANFPELLDLSITLEKYLSVRLKTINENENLVKTWETYNAKIDELDNQIFSLENQISRINTDADNFRKSLSNIEEDIIEINIAKDLFKKRIKQLKNNSGNLEDLITEENQEIADQIKDFLMEDLQQQLEDINKNLDEIEHQPEDITAKLEELQTKYDSCIRALETTSELKIQTVQIFEQAHENDCIPFVDALKELEFIINQLLLIVKDFDYGDEMARRKLLHIIRMTLTEDKLPDALISVALRVLRALSINEKDFVSMAVEIITDIRDSRDDEEFHSAAATFDDDDDDILGNGDDESQQSSSLSAVTKKRRIEPDMPPDDIVLRCLTMTQYVLEVITHSLDDHLSLSSIYSGIVNYAIQNESKKKLYLAGLTCLGLYSLIDSKIARIATTTLLLAMRSNGEEVKEIGMKAIVDILAIYGMSILDKSSKYKYSRMFFKVLNSFDAPKLQCIVAEGLCKLFLADILYKTDKRSLFGNAIQGGGGGDDPTTTNDDETEEETDREHEKHLFEAIVLIYFNPNTKSNQELQQILSFCIPVYAFSHINHQINLAAVSGDVIYRLFTETETEL

SEQ ID NO: 16014 - protein, 778 aa, Candida albicans
VRKTQTQILIHTETNCRRRRAAQKKKRNSALKNTGDGKMALKLLGKKSSKVKEEEGDNSIDTTESTQSKSPSKHHRRSFNIFQYQNHRNSQGSSDNSFEFRGMVNALNRSHSTSKKTRPLSPSPQKSNSLIVSSSNSSKVKKPKLSTADTSYEDRRYNLPENQETQTNIDQLSHDKMNSMEDRIALRQDQNDPAISFDVKLTSAQGSELLLNPPTKDTTDRSSTTSSSKQPFPHSPSKSQLSNQETGTSPQPQPPKSESNGFLSSLLNAAANKMISSTPPSPPPEDKKKDHSFSSKLDTLLRGVKHEGSKSSLVDGAATASADVDSLENKQITNSTELKSIHSLTHDVQFEPVRESPLNTLGNGDLSLADFDNKFAREELGMGSRRPSFRSADSITKRATTPELMPNSGSLNGGDTRRLLSRSLNRSNSSLISIPQRPSSLGKSPVADSRMAKSSDDPNRNSTITENGRVDDNDSGVLPGNFDTENIEDIVDYTKKIKHALKKRNKEFHQNFKKLPTKEKLIDDFSCAVSKDILVQGKMYLSDHYVCFNSNILGWVTNLVIPLQEVIQIEKKSTAVLFPNGIVIRTLHQKYVFATFLSRDSTFDLITNVWHRVLLENSDIDPKKLQAQINKGKRRARAGSRVSNFSSTSRDDDTNSLDISDSDGLGGSDEDNDNSLFDEDEDANDSGHDASLESDDFESDGKPSDASESKDGDVAATSGSGNTFKGLPIVGPLTHAPTETGYSKESSETFISVDTIKAPPGAVYLIIFHPRGLERSAH

SEQ ID NO: 16015 - protein, 247 aa, Candida albicans
VMPCSISFISTTFSTTSCISWIFAQLPQILENYRNKSAEGISPSFLILWFMGDFLSFTSCLVNIDIVLDFQLYLSVFFLCNDVTLCFQYYYYNSVYPRLQQQQQQQQRQQLYVPLSTDTSDSSRLTMTNNEDRDISIYQAQDIQQIKHANSNQSTSEDFVNSTPSSYDSINDNDNGSIIKKSIVGAILNTGHAVALPISTETFCKRDTEDKSTSSVGLYLAWGCTLVYCLSRCPRLYQNYKRKSVDG

SEQ ID NO: 16016 - protein, 527 aa, Candida albicans
SLHICFPLQSTSKNMSLNPALKFRDFIQVLKNEGDLVEIDTEVDPNLEVGAITRKAYENKLAAPLFNNLKQDPGNVDPKNLFRILGCPGGLRGFGNDHARIALHLGLDSQTPMKEIVDFLVANRNPKKFIPPVLVPNEKSPHKKHHLTHEQIDLTKLPVPLLHHGDGGKFIQTYGMWVLQTPDKSWTNWSIARGMVHDSKSITGLVINPQHVKQVSDAWVAAGKGDKIPFALCFGVPPAAILVSSMPIPDGATEAEYIGGLCNQAVPVVKCETNDLEVPADCEMVFEGYLDRDTLVNEGPFGEMHGYCFPQDHHTQPLYRVNHISYRDEAIMPISNPGLCTDETHTLIGGLVSAETKYLISQHPVLSKIVEDVFTPYEAQALWLAVKINIQELIKLQTNAKELLNLVGDFLFKSKECYKVCLILHEVILVGDDIDIFDFKQLIWAYTTRHTPVQDQVYFDDVKPFPLAPFISQGPLIKTRQGGKCVTSCIFPKQFTDPDFKFVTCNFNGYSEEVKNKVSQNWEKYYK

SEQ ID NO: 16017 - protein, 677 aa, Candida albicans
VILLFFLFIGTLNMVILIPINYTGSSTGYTAFGLDKLSLSNIATTNVSRLNAHFLMGLITIGFFHWLIVYEFQSYVIIRQSYLLSQPHKDSVMAKTLLISNVPPYLQNHEVLKTIFQVVPGGIKDIWDINEFEIIDHQVEIAQDALHYLEKSQVLGLKKYYHKKAQWCGSSVGDSVEEIKEFIETHEIYFYPPLYLGPIRIPQIERTIRITLPGWLRIFCFQKPIPMYEWSLQTLSECNQKIDEEKLKLAEGQLAKHSKIFIEFTSQEGSYIAHQCLLSQSQGFLDKTTIEINPNDIIWRNVCRNDGIACKFEKYLVTIAFISIIILYVIPVSLIGLVSQIPLLTQLLPFLEWIYQFPEEARETIAGFLPSILLGVLTEIVMIIFRFLTYFKGRTTGCEVEIDLQKWYFAFLFVQQFLVVTILSSVTVILKQIIDQPTSIPVLLATNLPKSATFFFQYISLRAFAFCGNNFLRISPLIQSLIVCKFIDITPRQKFNRITNLPKIKWGTTFAVYSIYACIGISYSIISPLISIFIIFFLNLSILYYKYALKYVYSHINESETTGRLYPTALLHLYTGVYCLECCLIGVFFLLKNDKGGYPMRVQGWIMTGILILTIFANTIIYNRYIPHFSNLPILSDKTFKDGAKPISESSNTNTDDTCQLNHKLLYLHPAFKYDSS

SEQ ID NO: 16018 - protein, 405 aa, Candida albicans
RHMTFVLPAACVKTTAFEMSIKSHQTMLNNLFIFLETSLNEYGTPATTEEYVKAGFTDNPRQFVVENFSILLAMNLKVFLKDPNFTFKKRFHEELMMSDHARTFPLYQFIFKCTDLWTDIFEKKNDFPKINSAILSWDLMIYYTMNHGLVLWQETRAQLDNKVDIAKIFQLLYSNIEEIEKSGQSIDEALASEGGAIGDVRHFQINKIEQSLKEKWAGKLFEFYKELDREVHEFVREQRILKLMEGNMITLNSNTGSNQILLRLTPNRQYLESEDNSIKVPVVEIVDIKIVNVGGATGVDKKSLVSIKTNLYRITLVGKENKHLLSFFSDSQSAFDGLTMMLGKGSVSEETTKQIDTLIEIRSKTQLLDLNEIDDSDDEEDEADEDADEVLEDLLEVINEDFYYK

SEQ ID NO: 16019 - protein, 116 aa, Candida albicans
LILQKVQNMTVATQKFYYQPSIEANKQKLQHVHDVASLALGVGSGILTLESMNGFIFYLIGITVTNLLFYIICGEGRPSKYFKNPLQEVFISGVFSNIPGFIMMWCLVYALVKSSS

SEQ ID NO: 16020 - protein, 374 aa, Candida albicans
YLHLIHMLFGKIKWFCIFMITFGACCVYAFFINNKLPERAKILAILHAITFTICTRIVSMVNLCREEQRPYCEPNFTNSWWSVLLLHFAAYLLPACIKSFYMLSDSYHSAAPLWIGTGLKFLLFMNAVYWTFEYVSNSEYFNKLNLIIGLSLIKSLKLAIARLVLFISLILANFSWSRGPLCVKLELSEASNTIDIEESDDMSPGINNNNNNNSNNKTATILGYGNVYGSSYFLLVLNFTVAIMLTTKPLGSLSISLLIVQILSLLEILDVLSIRRNLITPIIFGLLGYQHFFSTGHQATIPSIQWELGFMTTETIVFPFTHLNIFLNTFGPFFIPALAIPLITIWKIVPSSKPITLLSQIITNITTLITYHFV

SEQ ID NO: 16021 - protein, 125 aa, Candida albicans
QCHLNLLDQCVAMTIMGLVLSFSIYIVLKPGDFTLKICLAIGAALGMVIGFWAPIMDRFSVGFIWHQTVDFFLYNFNSWSLMGILFVSFHCLIFASNSYVVWEDKMVLYFYDNFWCLLCLCIFYK

SEQ ID NO: 16022 - protein, 306 aa, Candida albicans
ENCTKWDLLVGHFLRVDHVGHRFGPQHYSMKDKLNQMNQVISKVIENIDDKTVLIVMGDHGMDSTGNHGGDAPDELESTLFMYAKNKKFLKKDQSFYNVSGLGENYRSVNQIDLVPTISLLLGLPIPYNNLGFPIDEAFGNVDELSVASQKTINQIKAFRDDTPNLSGSLIEQYQSYATNYSIFGGKSKKHYWQLIEQAKQYQSLSLEQCKTLWARFDLRFIGIGIGILFLALTFMITYARSIPAVRVLTMSFEFIGSVCGDDNNGIGFKFFNLYCIKTRRFHLENLFGYWGRLGYGDWILGSYNG

SEQ ID NO: 16023 - protein, 89 aa, Candida albicans
  UNSURE (6): Identity of amino acid sequences at the above locations are unknown.
HLRHSXPAVVELVMILGSVFNEYIHPDFNFPYDSLNVWDLDTVDNGVIEHLFPLISIRKLYKMGFVSRAFFKSGSCWTSIWSPTLFYER

SEQ ID NO: 16024 - protein, 163 aa, Candida albicans
TMQQDDDSLTNRSSPPMASKDSRLQPPTRTRIRQQKLKYTFIGYIIVLIFLAITQFIGVGFFKEGFLLSRTVLPNISNCSQQIDCMTPRFEKAILLVIDALRFDFVIPIPGSNEYYHNNFPILYDLASSSQNNAILLKFIADPPTTTLQRLSSHTGLEGLMSH

SEQ ID NO: 16025 - protein, 264 aa, Candida albicans
LNGYTIDCIDMELSMIPILGGIDLFNFHQIVKHTKANIYVPDLLPNLFNSQIITDNKDLKIWITAKYMTELLLAKFILNKLIQNNNNNNNNNQQQQQQHLIMEKITMNKNKLDLMILNNQKNLLNIMFKYGVFIQLPNLGELKNSTILVQGCIKESVDDCVSDINGIATDYYTVDVVSPSIVNNDKMGLIQLMQQKKTCNVVMNEHGLQFNGRSDEIKLILKNLATNGNDVGNGNTCLAIKLRLELGNDQRDFISGKKNGKLIK

SEQ ID NO: 16026 - protein, 335 aa, Candida albicans
TRTCSSRQGVIHVTNKVFFHDDFEVPIEELIKTTYDSNFPSFFMWDILKMYPNINKVITGKQPYSLLIPTAESLKDFNITTSMKDLLRFIDFHLIPNSEVTKILDCISGEGYNNSVIKTNLSEGGLTCKHKPQTNKVMLQLHKLNTISTVSYNKDQEVRLLSHGCTKKYQSGTDQLSCVFLIQKPLNFEWFENPKNGDNFLHVHLGLVSVGVGVILGLIIFGGVMVGLMFCIGKREKNNNKDDFEFPRPDSGFMSVLTDDDEYVPYDRGYETDVDVLRTETDALLPSHMKRKKRVKKPDYGSTKQGSNGVTLPRDIGDIRSTLNRERNLPGYSQY

SEQ ID NO: 16027 - protein, 226 aa, Candida albicans
  UNSURE (193),(195): Identity of amino acid sequences at the above locations are unknown.
RQDTMHSLLDTKLCSKKKIGGCFKLKFSISNGKNNITVNDEVHIQAYTPIANESVVFVANGEITPPVNLKHSLGDLISSGAVHRHLENIEIDQGSCLKTLEYINRFGLSSLRDNDEGYSIFLPCGTTDTKGTWKDLGLILTYLERNPHMLEMVVKSMFMEGVVYSDFTSHKTLKDLNGNQVKFKSRNITNDAXEXTWNNTQLSFPLNSDLLFPTRCDPCDKQSFFP

SEQ ID NO: 16028 - protein, 395 aa, Candida albicans
TAKKNNNNINHQLSSNREHSCTIMKPFWIYIFLFILSSVGANESTTSTSSSVEPAPTPSTLVDILSERPQFSYFLRLLQRQGMIPTLNQMENVTLLAPINLAFVGKKSIDWDNNSLNRYIVNQKLRVGLLGKSESVYQTLYRVGNTNYLIAVSPDFESLEYVIDEVSYIVEEDIYAKHQHSYIQGIDQLLPEKPTICDVLMNNTNPEISLFSKIFQLLFIDTDEQQVQSKKKKKKKKHKKPKKTKLPPLPNSCKEFLNGTGTILVPSNKVLKNSLTDIQLQYYLANSDFARYATTTDAVFEIKHDVMSLLQSLMFPALIVGSNNTNSKIKSNLGSSHKFKLKDGHVEVDKVAVTESHVSADGVIHIFKETDLLFEQLNIATAYSARARRTAYRVA

SEQ ID NO: 16029 - protein, 245 aa, Candida albicans
LLVQSFSVAFVSLYNIPNLLMGYVGFSTLCGLAGFVFNWSSYFDKPECRSIRIGFFLGLSFSGATAMICKSYYEGIMATLSFSAPLVYKSFIWYLIGVGFYGGLIPERWRYDVIIEENHLNNRHTYKPTDVILEKMGHDGEDEMEEIEEEFEEIVDQHISECNDTTTSNTPNHDIFDHDQKFAELIAKHFKQNPIKTPYSNNFLSLWWVDYFLASHNIWHICVVLGILGHYVCLLDMFRGLEKLV

SEQ ID NO: 16030 - protein, 250 aa, Candida albicans
HYVHLLLYNYCVRITFLTSLSLVDIYNGDLIFLAKRLGRIPANCLPTILFLTLRPSPLPHTLYLTLIPIHKWLSRLIIIQSVIHTVLYLGYFQKTNTTQKTFKPENNYGWVALLGFVIIMITSLSSMRKRWYKVFYCMHYLWTWTIVVCLQFHIRPSPFTFYTLANVSILVGQIAYRVCLTRVSNKGEVKVCDVSPNIAMIEFPNLLIAKTATAPGAHIRLTNYSSSFIVRAFKQLIPNYLPYPLIVLSH

SEQ ID NO: 16031 - protein, 76 aa, Candida albicans
NNWCINEGFTQCSGPTEDENHNLICCRDLPRNKVVQEDLNAEKIWVISAGPKPLVENVKLWATEYGLKFHEEAFYS

SEQ ID NO: 16032 - protein, 179 aa, Candida albicans
PSTQSLYTPAMKLIDKVYLWYFIIHIPITILIDSSIVIPKHYQLSITKSILEFHISTNNDILLAYPQTWFKIFGFIELIFQLPLFFYFIYKLLSSNRRVLDVNYYLWSIIYGFNAGFTTFVCLIWLIIEYKNFQLLDLQLINLLAIYIPYLLLPLILLIHSFKQIQQYNNNNHNKLKQQ

SEQ ID NO: 16033 - protein, 279 aa, Candida albicans
LQLFEFNFHIMAEEKKAGGGDSAAAAPAITFDQDKLLKTVQTLQFGWFVGNVLTLLGFFLFTLSYFGILPDVGFVWYLISLLGALISFGILLVQFIQKNGFKVPLLIKDDNFHYFLLAFFLIAMRAYVWITLVPFVIFSSFHVLNYVNTHLLPIVGLDGNNPISKHITAFVNKNNLASIQIASGIELLTVVWLFLRMITFRKRSLTPFLVFLVFLKKRHEVSPFTRKYFDFFAAQGDSIVSTINNPVINDVWGHVKTAFRTIDLFKLVHDRTKDEDKAK

SEQ ID NO: 16034 - protein, 175 aa, Candida albicans
IIVFNARQFTMAIFISRKSNGKAKKKEYNLLSIKSNQILFAFRQCHLFHHPCFPYYSLYTSMPPTQPTPTNSANLRYRTPLQQLVTLAKTQQFYWFLGHVFAVLFFILSTLTGFWNRHSSLKYYRFSLLSIILTYLIVIRQIHFKSTFKLSSINYLNVCGDEKCYHILLVGRWLF

SEQ ID NO: 16035 - protein, 199 aa, Candida albicans
QRLPKLPSYYLPNLTILTMASASAKKLAVANTNILNQLLIISASINIIVFLIISIFHRPSSYKPWIIFSIPSIFLQYSLEKFGRPKYTNGNSLVSSGEDIRLLGSLYEYYFDVIYLTWGFDILMIIFGSNKVWYGYLIIPGFAIYKLSNFILPFIKKNKSNGSTPEEQQAETKQTNSATSKRQQKLQARREKGPAVKYR

SEQ ID NO: 16036 - protein, 278 aa, Candida albicans
DKIPVNQPIDLTLLNNRIIQTEQGKAIVPRVFNYISSGKYFNIVSDDNGNIWTWGDNSCGQCGDINTTDLKPVPKIVFTKSDIKRVLRNTIPRAREEFIRIKKLCTGDDSSYALINYLDKDVLISFGNGINGQLGGGRYMQVCCWPEIVKSLIGLNEFDESSNSVKPITIKDISVGNKHLFITLNNVGHHKDVYALGENESGQQGNGKRNKSCKPMKIPKLIEPEDGKDKLQLVKNLHDVNTKRLLLLNEWEISKNTVDQVIMAGDDASIIYYKKTQK

SEQ ID NO: 16037 - protein, 119 aa, Candida albicans
REQKLTGSGSGSGSGSRSSALQIGQIQSILIDDSYRFQSSDDLKKTNKNLSRGKVVGISLTCALGSTTLLGLLYIIPYFALFKNRKDGYFQPERIHEDEMMDAVNPEDLLHEIDLQREK

SEQ ID NO: 16038 - protein, 417 aa, Candida albicans
SSIKDLSNNNQSVSSANNFALYSDDQWYSFGNDYTSNDFNQFTNLTLDLAEYYVFSGNGQFRTWDNDNFKWVTDPTKQLNLTQAAQINDHQQILGGTGFSTMQFQSVDQAYIADGNFSKFGIDVIANKSFMISNSYYVNSSLSVIGGKFETKDVKNVGLISNSDPNNTISALQGSIVWGDNTLIQSLYVDSSDEYLFMGVNGSVQINEQTNVTGIVIYDLVNNTFTSFQPAELSHSNGDPISVNSMVLFDKGNKLLVGGDFDLAGSLSCPSLCVYDITNTRWINPQNDATTTQSIGGVVTDMKFFQSNQVLITGNGLQLNGNSGIKFLIYNFNSNSFSVKDSLNKIDQTVEKFILNDENNKNLDGRMIAFGEKSISGFDGSNWQRIDSDIIYENFTKFNDMKLLTLDKPSDYNQTYF

SEQ ID NO: 16039 - protein, 476 aa, Candida albicans
EVISNSTILIVRQFIISLPKKSTQHLSQGFGPNSSINSIAKVLNGDKEKEDNEEELGSILFGGQFDTLGLSDLLVHNITSNNTKKHNTSNTSIISAEQLISLRHGTFTSVNGESSEEDAAAIVCPSDNKEWAAQKNSGAEWKVELPDEMKGIHPTKARIYIPEGPNGIKLFRIYSYPNNGIMNLTYIDPATNELAYCDAWCPLLNYDDLNDHVDNNILNATELNENNSVFVDEQDGSYFQYYDPSTKTKNLGYASNFQEFAFVDNVGVDTVGVTIIDWYGDQGILAGFELYQNAITVYGNDSLNDPNCQSDASDDTNNNAVINSGSFKSVQSINPAITNTDYLVTSDTNAKITLYPNISYLGNYSIIMMTPGCAYDGSCARRAIVNVTVVGDDNDVLSTKTIYQNNENNKFDYLFYGHLNGSKTSTSSNRIEISYMGTVTEGVQDPYMVVDKVIANIVSLDNYYDKISTPPGRSTI

SEQ ID NO: 16040 - protein, 101 aa, Candida albicans
MVFLLCSIINQLLVPLFLLFPPREVTKIFNDDINGSVKTIFLDNDLIYLGGNFKFNNTYSAAVYNITAKKVHSTPFPRVWTKLFNQLDCQSLKWRQRKRRQ

SEQ ID NO: 16041 - protein, 385 aa, Candida albicans
VEIRCMGDEVSLKFYGFVIRYLFAVRENYFGDNIHFKTFEEYTSQEETQENESIDGTSSQEPNYWKLIKTENDMDVFFTFQVRSGLVMLPYHTYSCQSHIGLNFDMLDIDIRFCNYYMDMQVDFSPISAVFVEDYYSVHDPLLSVNEYVERYFNRKADMHVDGFSVHTHRMFGVPPEELTFYCKWDFCAGDWLVDSSPMFMRGVAGGISNFGVGFLDLENALDVAFPPAFDAANFTFKCPNFTFRLRPDSSSCLEIQLVDFLLSYNDMSNNRYSSKLVVSIPKISLKVLENDMIAAFLNTSLIFTNICQKKDMLGHRDTQQLHVRNSDAPFHRSPFILLEEYRDDFYETSKGCLFTPLSLPNASIPLTEMTFNTSEDLHHECQCR

SEQ ID NO: 16042 - protein, 391 aa, Candida albicans
YKVLGQEKPQNTRYEPNFNWRGLKRYIGDNQDDSEVFAFLNSDVQYAKYSLILDSVATRLIYFYDNPGIQPLQTNLRTQMPPESGIEVEISNGTIHYGPWTDRERVPIQNMLFPPVARDSSPTRGFLKPGSQREYGGFKVTVIVKDEVIIRIPTREPSKDKELIKQNAANNGPTKNSRPFGWLEIKLSEGSNVSTFTSYVAKEDGWPNIMKVNFNLPEIRSSVNHDVLFIADSHEIDAKIGFPLQWNGKCTWEFDQVSLNPKIFFLREHTMLFSDLFTDFGLGDPQPYEYFRLFVYNIKWKLLNYKFYLNVIDLNIVNNPLDFERNKYLSLQGEELDCDINLPLNGLLTKSTTVLFNITTPHFDLVLDTPPWHTVNAFWKESSPRGGRTAL

SEQ ID NO: 16043 - protein, 1171 aa, Candida albicans
RHMFLLVKSIEIIISTLQAMEDYSLDTIMDQLNVSTIKFLGSLIHSTETVKNCRIVNHDISIKLGEFLLVDPKELTQQAKKHSTINLQISDLSLALSEKASKTVDEGNITSNEELSLALHIKDILISVAQPVVFNAAVIFTIQEIEYWMELTQDDFTASGNVEAIGFNIDDTQTTWLADGITHIIENIEELKATFEKHSHEINANACLVHALTLASIEYYIDYESDVLTKPAYILRAKKEHIRFFDSWKVIARLRHILQSLPADWHHEVNNILRDKNYILPENSLEEVTEIFSKWRAWEANQEERRKLLNRIFSGDTANMDKRQMHLQFIFGNISLKLVSSTQTDYIVLQQLSTTVDLNTENERKPVDVVVGLDAYQSNITVLTFDKLKLLQLIKENEKSNIVVEEGESKNFWQHIDLSISIYIEAFSQRVLLSTLVLELQGNNLASIATIKEEMKHISNSFTLKNAVCNLWGSSNPVYSQAMENISWVIARTNTLGKELYKVDFELDKVDIHMANKNDKILTILQSILASDIPYVKELLSESESKSSSSLNIVELLGCISLKLNIQEFNWRIEILSPLVLEGNPIGCTIGASTIGDDFVFDADFLKGKFSINIDEQNIIEIESSKFVNVIEIGIWENLMLFSVQSSMGYVKLLSPNLISTIVLLDTNLPKLEKKIDSFRDLLVSRELTKHSETTVQEKEFAFKVQFSNDYMGVSTFVNKTKLLFEVESFTLGAYNVDQVENENSPHLQQLVPIYGVISVLAIRISILERSIPIGLSNLFDVNFGIRLLGVDSAGDLQTLQFESQYCRICLSEPIIFKLIKISDEILKVLPKQKAEKVQEEPKDPITEIGSSDLEKLIFSRISTVQFLSYNFCVGWLFNDSSKDYPRIIMGAERFFAATEFKLGKFTLMEAYFSVANGNRSSNFYSTLSQKSNLNRAFLPNLQLSYFIDNNRQGKNLSLSMHGDELDVKFLSTSVAIIEKAVNLASNVQSYLDKRLKPFYQDIEKDVATPHKESLFANTFDSIEFITTFAGSNVLIHRLDNDDSESPASLYLHAPAIKTAIKYLNKKNQGKSKLMGEILTTSSDNTLYSKCMPVVMDIINGTKGLLGKSKKVNSNDLLVEEQPQSSDFIRTILDETDIHFGVSIENQSLSLSCEPTAKVAAIVGLERILCN

SEQ ID NO: 16044 - protein, 584 aa, Candida albicans
DSRDISASAGIKNILLTNTFEFSEVTRLFSSGSISDADAYINVKQYQDVELFKDIWFPKEYFENYYTHPYPEEEQEESPVDDTFEGLALAQNRNLSSRFKEVSTTYAFPWIVAFVISNVNARVDFGQSLGNFNLHIENFWAVSKKSVDWSQDLKTGVNEVSLTSVGRLGGSLFIRNINLHTGISWKLDLGITLDVPLILVSGGVEELHLKMSFDHHVIAIANFEQFSMDIYNKKSEISIAKDHLFMTTTFKTAEIYVTSLTASNFMDIQNTISRMVQENQRSYKETLRDSSKGKSLEEKKRRRYSENAILETVKKLETRIHVSAGKVLIHIYPSSMDNSKVLVIKLDESRAKFQQNEYSSGISNELDLKFNDLKVSLSSVSPVLEEFVNEASVSELTQNAHKASGGTIFVFPSFRISMRTFQKYNSNLIEYMFQSTFNGTVDIRWNLGSINFIREMYSIHSKSLESRMEYRRKMQPFDEGAGAISKAILEHQVKEEDTTQKIDDAIKETIEKVERSSRFKYSALAPPIIEEPRLKELGNATPPLEWFGLHREKLPHVTHQLAIVSLQKLIHEIELEYSKMLGKA

SEQ ID NO: 16045 - protein, 258 aa, Candida albicans
SNFVMAFESLHISVTSEPTIKLSFWIYWADWILALILSLGFVFYFHRLLGFIVSFVFKIFLWRHYKISVNIQSFKVSPLGGRLFMKNLTILTSDMTISIVNLTFTWRYWIFRLNRLSNFYFEIDNEAPEISQKRNDKLPSRFLLVIDGLEVFIYNRTVAYDNIMDILEKNNDVSSSEEKTDQESSLYSDDIKNGNLRFRNRIRASNPSSTSDEDLNSEQTSKGYLSLFFLLQVLPIAVKIKRRAIVIGNVSTPSIPMG

SEQ ID NO: 16046 - protein, 374 aa, Candida albicans
TYKNVNLSENNNSIHFSFGTPSLATHLAMSLLKDSTVAVITGTSSNLGFNIAVRLLEGLPDNKEITLVVTSRTLPKVKEVISDIKKYIVAKIPTKVNKVEFDYLLVDFTDMVSILSAYYELNKRYKHIDYLFINAAQGVYGGIDWTGAVLEVLQSPIEAVTNPTYKLQKVGVESGDKLGLVFQANVFGPYYFIHRIKHLLENGGKIVWVSSLMSSPKYLSFNDLQLLRSPASYEGSKRLVDLMHFGTYNKLEREHGIKQYLVHPGIFTSFSFFQYLNVFTYYGMLFLFYLARFLGSPYHNISGYIAANAPVAAALGQTKQNCKTASACTRSGKEYLLEEEIDSTGLDDVVLYLDTLTKEWDEKLKDQIVNTRQP

SEQ ID NO: 16047 - protein, 144 aa, Candida albicans
PYRKFGSFQRRGEKLIVISSAIALTSANIFDLVNNFNTGGRQQQNQGVRTPQEYESVVLNSQCDKYLCPDTGLCVEAPKYCPCPYPSSQIRCFLPDGRFVCISKPAGEGISEKYNDPKTNWKIDAKDDNIRDCGWVNRAWRGLV

SEQ ID NO: 16048 - protein, 185 aa, Candida albicans
IITLLIMNNHITISFNQGEELYSTYKSFYTLKKLPNQLFKFNKSLSIDEILNQLSLLALDHTLPTYYCYKPIFLELVARWVNNTIELESQYNKSKSETRRISGSVILFALSRLLHISTEYLNLFELFLSHNAFWDNIGIEVFELESILLAFYRLLKFDTNRFKSFIKPKALYQITNNLHNGWKSR

SEQ ID NO: 16049 - protein, 449 aa, Candida albicans
  UNSURE (433),(444): Identity of amino acid sequences at the above locations are unknown.
IKEYVLYKVFEDRKVFGENLISSWESARRVFSGDKEMYLESTLKHLIDLEAPNNPKVYRDSKSIDGLFDEWNSIMESTIDMGPVESLLKSVFTSSEQGVNMMEMFQNNTSQFIMRLKKNYLLYYDLNDILCGYIYGMKLGFEMITIDKNQGKYLYPQTWSIDVCDFTSLKSVERVFPSVQDFAKTVSIDSLAAEFFMAYFIKLGFAHRCSENEQQQKQQQTQSILIQSLQTLYYRWSLRRIKEVKESLQQGSLYKYNDPDEDIEGDFKKLFPDYEDVLDIDGTTNANTLKKNNASFESIYESIASDYIKEYLLQEKDSVIDIVHQGSELITHLNQYENNLYKISNNASMMTSLVNELANTHTKFNQAVSDFNFYQDLNPTEVKRAVTIMTTVYNLSKKLLDQWPEHATLKNIVFATNEFLSYPIGLPLGRYLXKLEQIYTFIAXCLRHG

SEQ ID NO: 16050 - protein, 700 aa, Candida albicans
QEKGNDDAFVMCFEYLEFLATVFPGGVYVKKEFSPVLRISLTEFGFHFWEVFNDVFQIVESRFKYKQLTTAFVKFSEWFAKQFGGGHTNNGVISLRDILAWTEFINSCPDNLNPMAALYHGASMVFIDALGTNNTAYLAENESRLHIIKQECVTKLSLFADYDLTEFLNNQFQVSIGLHDLTAGLFSIPILEGSEHNKSFNLEAPTTAANAMRVIRAMQVKKPILLEGSPGVGKTSLITALASATGNPLVRINLSEQTDLVDLFGSDAPAEGGKAGEFVWRDAPFLRAMQRGEWVLLDEMNLASQSVLEGLNACLDHRGEAYIPELDKSFKRHPKFTVFAAQNPQYQGGGRKGLPKSFVNRFTVVYVDTLNAEDLNMISRHLFPSVNENDCSKLIEFMSQLEEQVVIKKSWGAQGGPWEFNLRDSLRWLSLYTSGNISQDIQLSDFIDMIICQRFRNGDDRRHAQKLFLSIFGEIIERDNYYNCSESFIQAGGALIARNDLIQYVNGGKLLPLQCNFTFMETAFRCISNNIPLILTGPTNSGKTDLVRYLANSVGAKLDEFSMNSDVDSMDILGGYEQVDLSRETNALFEKTHILINELIVTNLRYQGSNAEILAKALKLLEFIENHNSVDNDSSFFGHFCTILSDFSNYHSIPEIKDLVNAAEILFQKLNETASVKFEWFDGLLVQAVEKVFTGGRGST

SEQ ID NO: 16051 - protein, 1338 aa, Candida albicans
  UNSURE (1335): Identity of amino acid sequences at the above locations are unknown.
GGGADLPGLGPRSIQILSLYLQASEISKNKMIDTHLPRNKNLESNYEGETVNYYFIALLEAKRISNFLSLPKVEYNSNPEKTKSIQIPPESLSSTVTSVCGVLVPHLNISKSESAPLQQEETKFVPTNSAVEVLRKLASSVQFNKPVMLYGKAGSGKTFLINQLANYMSYSDSIVKIHLGEQTDAKLLLGTYASGEKPGTFEWRTGVLTSAVQEGKWVLIEDIDKAPTEVLSVLLTLLEKRELSIPSRGEVIKAKNGFQLFSTIRTSNDSKKDSIPDLIGIRLWELIKVEVPNEIDLKNILVTKFPLLINLIGSFIKCYNEIIRIYSLSSFVTLNKGSHPRVISFRDLMKFCSRCNNMLMVEGIIKPDQLLESSIFDNIFAEAVDCFGSAITEPQALTPLINVIGETLEIPTSRINLFLSKHVPIFINDDEKLKIGRAVLKKTAQDKALYNKRLSNNNNTSFARTNHSLRLMEQIAVAIEMVEPVLLVGETGTGKTTVVQQVAKLMNKKLTVINVSQQTETGDLLGGYKPVNTKTVAVPIQEMFENLFIGTFSEKKNAKFSKILSKCFNKSQWKNVIKLWREALKMAKDILSEPESEHEEEEGGPRKKRKLKSFEKSVLLEKWIDFENKIKEFELQSSTLDNSFVFNFVEGSLVKAVRNGEWLLLDELNLATSDTLESIADLLADTINQRSILLSERGDVESIKAHPEFRIFGCMNPSTDVGKKDLPLSIRSRFTEIYVHSPDRDIQDLLAIIDKYIGRFAVGDEWVGNDIAELYLKAKQLSETNKIVDGANQRPHFSIRTLTRTLIYVCDIVSIYGLRRALYEGFSMSFLTLLDRKSEDILKPEILKYTVDRLKNSKSVMSQIPPVPSSNPDEYVQFKHYWMKHGPQEIVPQPHYIITPFVEKNMLNLVRATAGRRFPVLIQGPTSAGKTSMINYLANITGHKFVRINNHEHTDLQEYLGTYISDSTGKLVFKEGVLVEALRKGHWIVLDELNLAPTDVLEALNRLLDDNRELFIPETQEVIHPHPDFMLFATQNPPGLYGGRKVLSRAFRNRFLELHFDDIPQDELEIILRERCQIAPSYGKKIVEVYRQLSVQRQSTRLFEQKNSFATLRDLFRWAMRDAVGYEELAANGYMLLAERVRKEDEKEVVKKTIEKVMKVKLDMDEYYKSLEVEAIFKSDSSIVWTKAMRRLAVLVSASIKYKEPLLLVGETGCGKTTVCQVVAKFLGKKLVTVNAHQNTETGDLLGAQRPVRNKYETQSSLFNHLLELFAKLGIETATATTASLTLDNLLTQYNKITVPEEYKELVEQIEIEKKNLSLLFEWSAGPLWFSPRGXDQC

SEQ ID NO: 16052 - protein, 207 aa, Candida albicans
KGIRTLSSSILVAVQKIMEIQEKNQEINRDDDDWLILSQHKLINYMKNLHLLTISNKLKKCMEIISLVEHNQQSSKLISALTSFTLPIVNHYYQLCLKIFDKVRLNYYDLSKATFILSSSLYTLATKGFCTPEAPNEQKDDNTNLHDGTGLGDGEGAQNNSNDVEDDEDLSEQAQQPNEENKEKDDGDEEEENDDSSPDGWKDTTVR

SEQ ID NO: 16053 - protein, 176 aa, Candida albicans
  UNSURE (175): Identity of amino acid sequences at the above locations are unknown.
LKPHANFRLFLTMDPKYGELSRAMRNRGIELFMDSLEQRATEFDRQILGFSPCTTDESLQIKIEELDISDKRVVPTSSFNLDKESAIKSFSLIDDAFSLGNISASALWSFVQLKNFPLLKDWASVVFSSSEFAQTSKSYTEKLCDTLKYIEQTSLVDISLSLYFPFSTAVAAHLXP

SEQ ID NO: 16054 - protein, 257 aa, Candida albicans
AVIYIHIMALGTSTNKKTTSWGRVIIIILAAVFLIVGIVFQQLSFNTSSSASSSIQGKNKGTTNNPFTTGLTETTESMSVSAIRIPANGSLAKAAVIFLHGLGDSGDGWSWLPQLVSQSKLINDPINYVFPNAPKIPVTINNGFAMPAWFDIYELGNPHAKQDVTGFFKSCEVLKEFILEQHNKFNIPLEKIIIGGFSQGAAISLATLALLDTKIGGCVALSGFCPVRNEITESFTLKNPGSAIWNTPIVPKGHGYG

SEQ ID NO: 16055 - protein, 84 aa, Candida albicans
  UNSURE (12): Identity of amino acid sequences at the above locations are unknown.
SINRIGPSVREXKNARVNFDTPIFQGHGTVDPVINYDYGKQTSELYKQLGFKNLKFNTYEGVAHSASEEELADVIKFIKNIVEK

SEQ ID NO: 16056 - protein, 218 aa, Candida albicans
GGGIVFLRLLSNTTGFICGQSSIFFIDWLISPECPFQLSKTFTILELGSGSAGICASVLLSKVQHFIATDQKHVLKLLRQNIENNVSNFTSQSSFKTSGGNPHKLIDVVEFDWENIEMGKFNIQSLNMQKEHPDIIIACDTIYNEYLIPHFVQSLNALMAGNQQTVALVAIQLRDLITFEVFVTEVVQSGELSLYNVPDHLLSDDLKNGYVVYCILKN

SEQ ID NO: 16057 - protein, 146 aa, Candida albicans
  UNSURE (8),(15),(21): Identity of amino acid sequences at the above locations are unknown.
TGKQRGKXRKKEEVXDKQTDXYHHSFHHIHHHHHIPIMDKSTFKQLTNEYDILYLIYHRSKNQHRQQIWFKYLNMMIRNLRKILKLQIDINRIRTTTTTTTTKDKIDYKTNQIIQYSNKILKLMKSSYWNYNSILVLGQYINLGLG

SEQ ID NO: 16058 - protein, 207 aa, Candida albicans
  UNSURE (204): Identity of amino acid sequences at the above locations are unknown.
SSSGLSDVFKQLTNEYDILYLIYHRSKNQHRQQIWFKYLNMMIRNLRKILKLQIDINRIRTTTTTTTTTTTTTTTTTTTKDKIDYKTNQIIQYSNKILKLMKSSYWNYNSILVLGQYITLGLGLIGSLSKITHLIINGINGVQKRGINRDSFINKMNNDRQRVDGVDVVGSKDLKSNNEDEIDFGEVIPYEEEVENVSINDDVXNNC

SEQ ID NO: 16059 - protein, 527 aa, Candida albicans
PQSPQLGAQSSNFFNNRKDLSSIAMFNNYANNHYQHNGDGNFDINDSFSNLNLNAKFNDFQSRRPSQLVDFSFSPFGDTRQQQQQQQQQQQSQSQSQSHVPNQNLQQLQPHLTNAGNSAPFIAYQNKQSMNSAQNQSMGQGNPIKLENGLMLRDQYIVASPELKSLYMKTIKYFQDQSITADILSKLNNLLTNPVIIKLITFIKNLNNLTFNHKILCLVINKNGKFDLLSYPHNSNIFLQKNDLVIVDGDRGKDLVMIVEPLVNLNFAILFNFLKKLEHLKSLTIIEGHETKTNGGTHPTTMDASTIINSHLNEDNEFIITLPTKQVLRFATPKEVHKISGKFLEEKKAFITCYNKIKELNLDSDLSLINVEYQCDFKKLIFYYFAGFKRIDFRGLIKELFKIYKTRIWLCAVLPYNKPELYITMDKEDSEPKVVQVNNNLVPREYELTNDQILNFSINEFDNLATPSYFHLKNVQNLIKHMTNEIKGHFYGFNTGKIEGNYQPVKTVDLSDRSRILPNFNPFGDFQ

SEQ ID NO: 16060 - protein, 304 aa, Candida albicans
SFTNPIIYHYTYNMQYKLSGATSKLSQVEIIPAKTDVGALANRINLETRSLHDRADKTVTLKFALALRNYKVYRQGLQAFYHVFASIEKALYRQLEKKDEWSEMLEQVWKPEIARAGKAEQDLLFFYDDNKEKFIKPIMPAQIEFCKHILEVTEEKPYLLFAYLHVMYLALFAGGRIMRSSVLKATGMYPQRDGLSHDDVVRMGTNFFTFDVPDEDLLRLTYKRDYELVTRNGLTEEQKLEIIEESKYIFEHDVKCVAELEKHNMDKLSGTWTYFLVTRGYYAALVLFSLLALIYLRRVVNKLT

SEQ ID NO: 16061 - protein, 80 aa, Candida albicans
GRGSSTRGEDNFKFFEISQKLLNVVLNNFAVDKLTEVPGLMKIMESIIPYNERHYNRIEEMVEQTYVLDYTVEQMNKLIA

SEQ ID NO: 16062 - protein, 231 aa, Candida albicans
YHTMDVLKTTYAHTDIEPIYVGGTSASISTSNGELLLATPLNEDVIITNLDTNEIIYKIPGDGEVITNLTITPDGSYLAMISQSQLLRIFDLNKGSVIKNFKLPSPVYISSVDSTSSLFAFGGSDGVITVWDIENGYVTHSLKGHGTTICSLTFHGELNSQDWRLASGDTMGTVKIWDLVKRRCIHTLKDHNTAVRGVGFDQDGDLFISGGRDNVVIIYNTKNFKTINTFP

SEQ ID NO: 16063 - protein, 248 aa, Candida albicans
SRIFQPAWVKTNCRKSGIIADIKYVGPEFNLLAMATNSPALRIVDIEKPLELRVYEGHTDILNAVDVSTDGKWIATASKDNEARLWRWNGELQDFEPFARFQGHAGAITAISLSKSQNEPKFLITGSTDLTIKKWNIPNTPNSIVKTSEYTRRAHDKDINSIDVSPNDEYFATASYDKLGKVWQTDSGETIGVLKGHKRGLWDINFYKFDKLIVTGSGDKTIKVWSLLDFSCQVYINLPTRPGKSGCS

SEQ ID NO: 16064 - protein, 738 aa, Candida albicans
FSILRFKYPNIYVANFNHLNFSLHSTSRRNLPELPSNSLFGWIPTVYKITEQEILEHAGLDAVVFLEFFKMCIRIISICLVFAIIIISPIRYKFTGRVDEDYPDDDSDNDDDDGSNNNGTTIIKHIVSAGILVASKNNDGEQYQQFLWLYTIFTYVFTFVTVYFLFKQTNRIISMRQKYLGSQNSVTDRTVKISGIPGSLRDEVALARHIDRLNIGEVDSVLIVKEWQNLNKLFKRRRRIVRKLEESWVEYFEKNGITNKSDLISLHPQVGELYRFSNRYTDDAEESPDWGSQNSNSAQASIIDQDSESVEGDSSDTLNRLLNDELRTRPSLRKGWFGLFGPKVDSINYYTDKLEVIDKEITRARTREYPATSTAFLTMKTVAEAQMLAQAVLDPKVNHLITNLAPAPHDIRWDNLSLTRQDRNTKILAVTIFIGIMSLLLVYPVRFMASFLNTKSISKIWPSLGKAIESHKWAETLITGLLPTYLFTILNIVIPFFYVWISEKQGYLSHSDEELSSVSKNFFYIFVNLFLVFTTFGTASFVDTTKIAFDLARSLRDLSMFYVDLIILQGLGIFPFKLLLVGNLLRFLVNSLFRCKTPRDYLNLYKPPVFNFGLQLPQPILIFIITLVYSVMSSKILTAGLLYFIIGYFVSKYQLLYACVHPPHSTGKVWPIIFRRIILGLFLFQITMVGTLALQDAITCATFLAPLPFLTLYFWWSFHKQYIPLSTFIALRAIERKS

SEQ ID NO: 16065 - protein, 662 aa, Candida albicans
  UNSURE (19): Identity of amino acid sequences at the above locations are unknown.
LTLIAGMFSFLLFCMLRFXWPHIYAVRTLRQPRNNLHILRPLPNNLFGWIKVVYKITDEEIIACSGLDTFVYLRFFKMGIKIFLILSILAIFVLSPIRYYFTGNYDKENIMTKPNQPPDINYDFPSFYWVYPIFTYVFSIVVFYYLFEFTTTILRTRQKYLASQSSITDRTIKLDGIPKRLLQREKLKKFIEDLGIGKVLDVKLIYNWTPLEDLLHKRQELMNNLECIYTSMYKMDIDIYNQHEVPAVNPIWSEPLDKPQLNELANKYTQELIELDGEIKHMQGKFDSDLSTIDVKENREFKQVPSAFITMDSVASAQMAAQTILDPRVYKLIASLAPAPKDIIWENLKLTYFERKIKSYFITLVIVLSYGFIIFLVIPLTSLLDLKTISKFWPALGEFIGQSKWLTTFVTGILPPLLFTLLNFLFPYFYQYLSQLQGYTSNSDVELSTLLKNFFFIFFNLFLIYVAAGTFWDYMSYISDTTKIAVQLATSLRRMALFYVDLILLQGLTMFPVKLLQVSDFFLLNVLGKLFYFKRLILKTPRDYRSYYFTPQIFDFGINLPQHILIFMIILIYSVVSTKIVTCGLIYFILGLFVYKYQLVYNFVHPPHSTGKVWPMIFRRVISGLIIFQLFMCGTLALENALLVVDFMYPLDIYNNDYSMEF

SEQ ID NO: 16066 - protein, 312 aa, Candida albicans
RAYTITTYHHHHHPFSMICIECGYSNIDCLYSKYKSDYIKLSVCPECNKIADKYIEYDSVILFLDILLLKRQAYKHLAYNLTEMEMEIGSSTNFHINDNTNFKFFHTYRKLMKLIFMILSFEVYLTWANEEKLLIHSQLINLIFNQSVVYQYLFFIIKSSLENLILNLSLQLILRLGYKWGQGPQKINGNIRDKELFGYKTSVLLVTTMVSGSIRLFHILMFIWPYDNIYITKPLINMIAFINIVEALRVVTSLGYVELILSLAFSIVIRNIVSKLLLVLIVRLFLDFNFTEVYYNEMYQLYSQIQTYIRWI

SEQ ID NO: 16067 - protein, 336 aa, Candida albicans
QPLVSMFIDFTVVVLLTKLISSHIISLHQRYNTQKKNKEKKNVYNKLFHLLFAHQTPTKFNKDMSRTGVLVLGPAGVGKSTFCNSMIAYMQSIGRRAHIVNLDPAANPTEYEFTIDVKDLISLQDVMEEMELGPNGGLVYCFEFLLNNLDWLDEEIGDYNDEYLIFDCPGQIELYTHIPVLPTIVRHLQTSLNFNLCATYLLEAPFIIDNSKFFSGALSAMSAMILLELPHINILSKIDLVKDEYSKKQLKKFLNPDPLLLAKQEDYINPKFAKLTQSIANLVDDFGMVQFLPLDCSKDSRSVETILSYIDDVTQWSEAQEPKEPHDEVELPDEVF

SEQ ID NO: 16068 - protein, 408 aa, Candida albicans
NKLTNWMLLNNKKISFIHRFITNWLIMDPNLISHYNNTNTRRFKNYQIENQGQLNFIYFLGGRLHTIKTKYPINLITLSLIIIPGILYIIFELSWQWRNFSPIIVIIFLYIWIISIFHFFKLSTGDAGKLPKNIHLPKKLITITTTTTTTNDNEIDHRNNYKVRGSPPDEYFNTVTLPYWKTNNDNNDNTKISKLANAYHSHGVQVKYCGTCHIWRPSRTSHCNTCQQCILNHDHHCIFLNNCIGQRNYKFFLWFLLYIVIACLYLLIISILQLCHYKFASHKELEIITTFNQSIKTHPISLLLLIYSCLAICYPGLLLAFHIFLTSQNITTREYLNFVYKKPSKSTDGGDGTRGFVNVYNTHSIWENLYINWLGKSNGVSLTFPRDYYHQGDIRFANIEPLGTFTNK

SEQ ID NO: 16069 - protein, 268 aa, Candida albicans
PWARVSGERLDNLKYMEQNNIDPSEVSSCLSHIFNNMIFTPGVALHCDPHGGDLTIRNVPPSKHNKSGHYFEIILYDHGLYRTIPLQMKRDYSHFWLAVLDNDVPNMKKYAMKIANIGDDDQKFRIFMSAITGRAPEEALNYDISSRRSNEEIQKIQGQINNDNRVLEDLMDILSNMPRMVLLILKTNDLTRNLDENLESSLGPERTFLIMANYCAKCVYDELKEEINHKYRGWSWLTHSISNWWYYQKRLSTLYLYDFVLMIRRLTF

SEQ ID NO: 16070 - protein, 219 aa, Candida albicans
KSSSSSSSRYGKFFKFGLAIGLGTTILYYTNDSFKHIVLTIDRVNTVTVAMIRCFALYKETLGETYDSDIDRHKALSKTHKKAAEITLKALEKNGGIYIKLGQHITALTYLLPPEWTNTMLPLQDKCPQSSLEEIEKLFENDLGKKMSDLFIEFDPNPVGVASLAQVHIATLKNGEKVAVKIQHPSLQEFVPLDVALTKMVYDLMYKVFPEYPLTWLGD

SEQ ID NO: 16071 - protein, 318 aa, Candida albicans
TPQKNFNITSPQNMKKKIYINSMSYLYFSLSNSPKVSKLLYTMSDEEADVLYEVRDRTAIITFNIPSKLNALNGEQYLKLGKFMERANEEEGTVMTLIQSTGRFFSAGANFADNGLMDVDPQLLFTHEYWLGKFVARNVWLTNLFNDHKKILVAAVNGPSIGLSTGLLMLVDLVYVHDLSKFYLLAPFANLGLVAEGAASATLFARLGWSKASEALLLAKPISGADCYNVGLINKHYDGKFKSTEEFNQQVYKEVTDAFENLHEDSILQNKQLLKLNRDQYINHANSQEVMRGLGKWLEGVPQTRFVQLANKDVKHKI

SEQ ID NO: 16072 - protein, 228 aa, Candida albicans
KDQTTKRAISSFGFNQPAGFSLQVPMLIWLPSQDTGLNICLNLSVAKQTFLVQTFLAHKKILAVALNGPAIGLSASFVALCDLVYVNDLSKTFFLTPFANIGILAEGGTSATLPIRLGWSKAAEALLLSKRISGQDLQNAGLVNKHYGGKFKTAEEFNSTVLGELLDATENLHVDSILQNKELLKQIYKPAISMVNSQEVSRGVYKWTSGIPKDRFKKLASGELKHKL

SEQ ID NO: 16073 - protein, 186 aa, Candida albicans
PRVRKILELGDASALPSLVCSLNHAKEVIVTDYPDPDLLSHMEYSFNDLKEKTKYELSPWKVKGYIWGHDLGELLFDEPGRKLAEEEKFDLIILSDLVFNHSEHHKLLDTCRQSLKRNGGKCLVVFSPHRPYLLQDDLSFFETAKQYQFKTEKIEMVTWKPMFEEDEETADIRARVYAFFLIPEWE

SEQ ID NO: 16074 - protein, 281 aa, Candida albicans
PKPLFFSILCFTHIYIRLVMSEDEISIEGDLFEEPEGFLPERPSSHFSTYKRKIPNAEPQEITMKLVGHNPLYGHLLWNAGIYTADYLDKHSDTLVQGKKILELGAASALPSLVCSLNHAKEVIVTDYPDPDLLSHMEYSFNDLKEKTKYELSPWKVKGYIWGHDLGELLFDEPGRKLAEEEKFDLIILSDLVFNHSEHHKLLDTCRQSLKRNGGKCLVVFSPHRPYLLQDDLSFFETAKQYQFKTEKIEMVTWKPMFEEDEETADIRARVYAFFLIPEWE

SEQ ID NO: 16075 - protein, 143 aa, Candida albicans
SIVMSKVEASLGTNKNPVSTATSTVGESATATTETSTELRANFAEVTDPKLNAKPQSSPLLSSTPPLVSKALVNSYPYLIIINKLLSITTWTNDDYWVNVVIISLYALVVLYFENLVIWLGHLILVAILISYTLLNTKIIRQS

SEQ ID NO: 16076 - protein, 187 aa, Candida albicans
LSDVRCDYVPIKHVPIQRKHFYKMVNGSIFLTSPQFGVLKTLIPPQKYILFLGLFLFTFHSPYSFAIRRLLWRSLYVRIAILYITGLDIKIRKDYDPNDYQTVSRVASASNSDAEGLGGIPVLSDFKIIKKRVFSPTQLKQTVFFEILENERRWLGVGWSSLLYPSERPNFCYEGSYNLAPNITVHK

SEQ ID NO: 16077 - protein, 163 aa, Candida albicans
AQLKFEPRRYFSVASSFFYHFSFASKLIDMSQIQDQLENIPGYDVVMDYFNEYGEEHWNAKVNPFEDENGNKRRLPKDLATKHDQQVWKQIQSQAWTDDKCFLGSCAVGLDCGLGLAPLVVLIFPVLGPLIMYGVHTRVINIAQKNYNLPNTLIAQLPNDYYD

SEQ ID NO: 16078 - protein, 209 aa, Candida albicans
TNLDHLITFGDANHDPYFEEIPENELHFYQRKGARRRRKLPEFIPKHDLKILNSVKNRAYHLDLLLNLCGLRIGWAGVIGLIPWIGDIIAFYFALQLVRKARTIDGGLPKGLEAEMMANVMFDFGIGLIPIVGDFINVLYKCNSRNFILLEKYLVKKYNTVANPLPPSNPVVTETPINNSLNPPSNPSGRKTPTANISNRPPNPPPRDL

SEQ ID NO: 16079 - protein, 383 aa, Candida albicans
TEGFHPTKFPSIRPIQPFVLEELGEGVDGPVPHPASFWRPTPTTARSYDASHASDTESKYHSKIPRKHTELISSSSSDEENEPLSPKPEIIPPKKEILPPSIKVRSSQIADLEEVPHGIQRQALKLEDYHFPTHRLATTLTDDSKHPLVIVACGSFSPITYLHLRMFEMALDAITEQTRFEVIGGYYSPVSSNYKKQGLAPAHHRVRMCELACERTSSWLMVDAWESLQPKYTRTALVLDHFNEEINIKQGGIMTRLGEKRGVKIMLLAGGDLIESMGEPDVWADQDLHHILGKYGCLIVERTGSDVRSFLLSHDILYEHRKNILVIKQLIYNDISSTKIRLFIRRGMSVQYLLPNSVIRYIQQHNLYGDSEPVKQVMSDRAD

SEQ ID NO: 16080 - protein, 209 aa, Candida albicans
FIVLLWNLLGTLIMGFWVTNYVIHIHSEKTFQFMLWDLIKELDGGSADDEEEEDNFIGFDTFDEENKMKRILNLGRFYGFLLAEGSIPLHNLRTVNFLTASSDTVLFLEVLLVSFFDQVGKKSRKNSVGGGLQNKAKGMYEQKYDDRLLVERVLKAKDQTTMLRGLQYFVQEKVKTSEVVSGKKQSKRVAWGVDALFDIIDEFLKDSED

SEQ ID NO: 16081 - protein, 526 aa, Candida albicans
TQIRAELESEGNKDVATAEENRKEEESKKEQDDERKDAAQEDAKEKGKEAEKLKQSSEQNDNDQPKDFEEEIKPESPKDEKKDKREIVTNRNDLNRVLYVPKMEAVLKSGWRYKSNGIWLKYGPHSSKNAVSAIDLLFGYETVDPRPNWNLIKTPIIGVSNPSNLPAYITFRRGPKIDYKKEIGTTLTMNSEDKFKILQIADLHFSTGYGKCLDPQPPSSAKGCKADSRTLEFINKVLDLEKPDMVVLTGDQIFGDASPDLESSAFKALNPFVERKIPFAITVGNHDDEGSLKREEIMGLYADMPYSVAAMGPASIDGFGNYVVTVQGKSSKATALSLYFVDSHAYSKTPKVTPGYDWIKENQLIYLKQEAESIQNSVEKYRKSNKIPLAMAFFHIPLPEFRNLNQPFIGENREGVTAPRYNSGARQVLSEIGVSVASVGHDHCNDYCLQDTQQSLSPGDNKMWLCFGGGAGLGGYGGYNGYIRRMRVYELDTSKGEIKTWKRTEDNPGNIIDEQVLVSNGDVVNW

SEQ ID NO: 16082 - protein, 939 aa, Candida albicans
TKVVSELFCRKQRQKKNNKSKYHHTLVRIYSNLSRISVRRFPLLYESIDMTTGKVLEPSLVKDLSNHIYEKRKATAFQIESLTKNALGHNDSQTIYKIINELTELTSTGTNLAKMGAITALGSVSVALGSFAIAYFLEDIVKPIFSTFKDTDARVRYYACESLYNVAKIARGEILIYFNDIFDILCILVSDSESSVKNAADILDRLVKDIVSAKATNYVSILQQQQESQIRSNLVDAQGNAIQVNEPQDPSKAFSLPKFVPTLLERMYTTDPFTKKFLLSWLELFDDIPSLELVRFLPEFLKPLIQFLFNNSPTDIRSETENLLNVFLEEIKYITKIKIDARKKELANKKTKQAELDANVKKDKQEHGSPNLKLHDTESAIDEDSGADDEASIKSDDTTIVRRPLASGLTTKPTEGHNKIEVSGSDAKEEHEENEEVTLGQDIFIDYEKIILILLSFLKSPESESSFKDLGSEPHEIYCQVQFIAIKWLRDILEMAPSSILKQFPECVGVTLKNISKTDKAQDFELRDSFLDFNMAMQLFLYKFNDASLDEFNETLGLDKETNTEFNEVKLPLTLSAIVKEYLDSVSELARTTSLDWMIFIYERNPTEFMSLFQAEANNFELTDLLKYDTSNEVILKVLTLMAKISEANQQFFKNFIVKLVKIFELDGTEKTFKVEFIIRKLCVSLNSELIFTALSEVLITLSDLDFLNTMIVTLNNILLTSQELLPFRKKLKGLDSNKVEDWQLFSSLFQSWCHNAPSAISLCLLTSNYELSYLIIKNLSELEVTSQLLIQLDVLVQLLELPIFMKLRLNLLEPEKHPYLFKTLYGLLMILPQSNTFMSLRNRLTTVSNYNSNSGPQFHLSTPLTTPTPAPGTTTAPIPSGSSTTSQSIRRKRIYEMLDKFIKIQDSHEKYNNSNKRMNNPVGYNLESASVFPVNLLK

SEQ ID NO: 16083 - protein, 330 aa, Candida albicans
  UNSURE (316): Identity of amino acid sequences at the above locations are unknown.
VRLYQIVMSWLRYLGLTVPLAALRSYLYMATTATTSLFVLLPIAMITYDQYYKTLIPNESSPIIPLNFTTTTITYKNLKLSSNNNNNNNNNNNNHISNTKNILISNAINPIFQNYQYDDQLIYIFNINIQAICLPHNNLQHEITKINYELISSTTTETTNDKNDNDNDNDNDNNNKSFKQGSIILNCDPYVIYSQNNQFIPFNFRFWLSPYLIEHSQINNINLLPLEIPGDQLKNWNNFKIILNNNNDNDNINNQVSTPTAAQNQEIRYLIDDNFSWIQFDVKWTGFRYYMVKYYYSCYLIGTIIFFMVSAGVGFXTNYTILLLNNINKL

SEQ ID NO: 16084 - protein, 473 aa, Candida albicans
  UNSURE (50),(429),(449): Identity of amino acid sequences at the above locations are unknown.
MPPVITKQPKASKFFSPFRVLGNVTDSTPFAMGTLGSTFYAVTSVGRSFXIYDLATLHLLFVSQTQTPSRITSLAAHHHYVYASYGDRIGIFRRGRLEHELVCEGNSTVNQLLVFGEYLIATTLEGDIFVFRKTEGKKFPTELYTTIRIINSLVEGEIVGLIHPPTYLNKVIVATTQSVFVINVRTGKLLYKSRELQFEGEKISSIEAAPVLDVIAVGTSNGNVFLFNIKKGKVLGQKIITSGTESSSKVASISFRTDGAPHLVAGLNNGDLYFYDLDKKSRVHVLRNAHKETHGGVANAKFLNGQPIVLSNGGDNHLKEFVFDPNLTTSNSSIVPPPRHLRSRGGHSAPPVAIEFPQEDKTHFLLSASRDKTFWTFSLRKDAQAQEMSQRLQKSKDGKRQAGQVVSMREKFPEIISISSSYARESDWXNIITAHKDETFARTWDSRNXRVRRLWLNTIDGGIVKSVCVSQCG

SEQ ID NO: 16085 - protein, 306 aa, Candida albicans
  UNSURE (46): Identity of amino acid sequences at the above locations are unknown.
QLEAPITSMIYHKLSDLVACALDDLSIVVIDVTTQKVIRILYGHTXRISGMDFSPDGRWIVSVALDSTLRTWDLPTGGCIDGVILPIVATAVKFSPIGDILATTHVSGNGVSLWTNRAQFKPVSTRHVEEDEFSTILLPNASGDGGSTMLDGFLDEDSNEDGTIDEQYTSAAQIDASLITLSSEPRSKFNTLLHLDTIKQQSKPKEAPKKPENAPFFLQLTGQAVGDRASVAEGKTSEQTNNTVEETNSKLRKLDTNGNHAFESEFTKLLREAGESGQFERFLTYLLNLSPAVLDLEIKSLNSFVP

SEQ ID NO: 16086 - protein, 317 aa, Candida albicans
  UNSURE (3): Identity of amino acid sequences at the above locations are unknown.
PIXLSLLRRYPVESGSATSSGSGSGSTSSGSSGSDSSNSGSTSGGYYTTVSQAVHSLSSNVNPQVLGMAQVYSVGFWGYCRGYVIQDDSKKTKKFDNSNVNYTWCSEPKVSFFFNPVEIFKKEMNNTLYGIQVYSQAAGIGQLSYTQKSELKVLIDHLDIDELNLPGNINGKLQQLHNLTNASFGLLMAVAVLSFVSVLIQMLAFCFSPEKCCLSFLNFLFECIIGLIAFVGAVVVTATYSYVKAQVNGNLDTFGVKSFLSINFYAFVWSAVIVCILVVFFNLLGHCCGLFGTRRHYRTVRNPQPDAEQHKEETESD

SEQ ID NO: 16087 - protein, 309 aa, Candida albicans
  UNSURE (273): Identity of amino acid sequences at the above locations are unknown.
PNLHPYISLLYPFINPIMTWIRTDFLIKGKIIKPFLPNDKHPNLKNKNFKNLYPGDQVFIFEVKDTKWARVHAVTKPLPTDYIACTAFLHDLLVDKSNVVVVPLSYIKILKEMPSEDIRISKKFNNIHENSEIPTIRDTELARQEAVDGTILNEFIKKSVPPRPTKRDHSRDTLLDEIKYSLELLNAHIFAVYSKSEFRLFEKLTSIYYSLYEIRTKLNHHLLTSEEAQVARETATFLLNRIPKILASRSSRLGKDVLELDNPTLKFPVIIYXIKRCKTGEVLSLKTALPTKINNAIMNWVLWVLIYPN

SEQ ID NO: 16088 - protein, 363 aa, Candida albicans
IARIDKEIAVDNDDRTLHLADLYSRDDMYTVIIAVNEICKYEYFPSHNWLSLQAIIAESSLCVLELLSPVIFHKYIMGISLDINLCGEFLSTLLKLAILDTVALEGLPVLARAASTSITCSIGARVELLIDKVWGRLGDYVNKHKLESSLATLVLDYDLIHNVVLYTLKCTQTRKTGSKLLISIMKNYNQTEVERQCIISLFDIYCNGLYEPCESDELGFINNLNEFSTTNESETDQISMLFDFVAYLSRFIRVLNRLIRVPDTVEFNDDKVVYKIQALLYLVNVGEPEPLREFVGDLYKETIAQKDHIQAGLYLELLASTFPWSHGEYVTASLIPELPIQTNFERREALLELSAEHYISGHN

SEQ ID NO: 16089 - protein, 856 aa, Candida albicans
YDYYLRYIHNLFNEIETIETITKLLNEVTKILARVPYKPSLSSSSMIWLEVASKYCYMLARDKSNGEILNLGNSIPPTIAKAQEELILTNNNSVNIPTQSQLTLAPHNFKEYKNSHLLVNITDVQGDSSTQSTGLHNLFLHVYLRNETKRLTEPFVFKTKSIDDLQKVETISSILFRNLPEDQFDQNVFMVFVLTEEISLMRRKTFGNLKYIKKGVAAGVINIYKVFTQNQPNFHFDIKLFGAPLGGGGKKSSKSTFSWGVLVDKLIRGNIEGLVASSPIVQQVSASVKLIKHSPFGLSTKTKFSKHHSNLPITMIKPMFFDPFTETTERLYILLGQLALKKKKNSTDLYSVEISAPNNETIKFSQATNQREKKIWQLVGVTSSECFGEFIKIDNISLKNKNKKLPIDDYLQLTVYINGVLSGQGHLHYKSGNKLVEYRSKPHAVEIFSTSKGNQIASIEVSSTYVGKLFNSEVTIDNILEYESLYHSGTPGIDGLSSSLELFQKVKKKHLIRRFPELLTSLFGIIIISGADTDSTNLQNLQENTFKAIVFLLNSVLFKPQQHGHFLQCFEDIFINQPRIAVFLWTKLREVYYRGETIWDSYSKSVAKVQEILIRFATKSIQGSWEFEEYNETVVQSYRAMAHFLSMKSSLLIEDQINLLGIVDLMLTNTMYFDKRVVLNWYETFIDAIRLRSFGGHEKLMEDQEHKIQISKLLLILRVLGTELNRDKDTRSTVLLKSIEWAVEGFPDVTDIESVRLACSILNKCCTVIYELLVEGETDIIEVCHFLFKLLPALSRTFLKYSHIGNLAQQKSFGTQLFPQVYPFETVAIDQSFTDVGFCEVLVALAVFTTSSQIRT

SEQ ID NO: 16090 - protein, 985 aa, Candida albicans
  UNSURE (186): Identity of amino acid sequences at the above locations are unknown.
FLLTKVEQIFNRAGSSWNSVSRSVCRVLSIILRISILSMNAPNEQDLYLQTLNNLFKSIAYLLTLDSTNMIDDQVLVMDIIDYIFAFDVNFKGSELVQIMINCIDSIGLKGVGVDELSMESTPAGSRSIKDHKIIIGKLLLILRLLNSDLVKEESSRCILIPKAITWAVDVFLAPTDIEATRLACXVLNAACTALWNDGVIGKYQGDMEICYSLAKFLPAISRTFIKYNKFTRGNGSFKKKRVFTQLFPSTYPFIEFSIDPVVNDESMVEVLVELAITFSFVARVGKEAAGNEGYITILDSRIENDFFIPEKYLASDFHGEDILTLLSGIRYMRLGKYFPETKWYSTYSVIIEGCLCAIELVRPLVIINQLPALDDSESFDRTLWGNYLRSLYKLTVLPPVAVEHLSDVPKSACAKITNDVRKRAAFLINEAWDSLAWDATDEDMLRFNLKKFGGYQVEFINDEFGILPDLMLLGLQRDSECQSVAIKILWSIMISEYILSDTLQDVERQCLLGLHEIYHNNSYKPTSLDQENFIERMKMTVRLDREDEAFDIIYNFIQNLSSFFGTLNYYISVPFGPEYEEDRIFHEIKLKAQIKNAGKPELFNSYIHQMYEKYLSQNDYVQAALSLELLASTYSWDHHIIVPASFRPKFPEQSSFERKEILLKMIANNFVKGNSLEKAADTYNELLDSYNEHTYDLKSFAYVHNKLAQLYLDMESSDKLTPTYFKVEAIGGGFPTYLTQISQIFQGLPFEHITSIHERFLKVFPGAKIISDDAEAIRLKEKATNGRYLYIKTVEPVYEFSDKLINTSLGVRQYARNKDLRFFTSLKKFPGATSVFDLWTEETTYETWLSFPTLMNRSFIKDSKTVKLSPLDNAVRTIAAKNDDLIQLEAFINAALKEKTDYSHYFNDLSRQLAGTVDSPVNGGVGQYRAFFSDSKYQINEGSIAKTELLRNAFNDLAIILYRCLNLHGSLIGLVFTTGRNPRQ

SEQ ID NO: 16091 - protein, 315 aa, Candida albicans
KKVVAAGVADITRIFLRAEGSLQSGEAHNFSIKLFGSYLSKKGHKNMVEDLRGHSHNGWGELVDRIIAGSSQGVAVNPRAEKLVITVKEFKHQFQGNVANQLSSSAPISRIKPIFFDPLAENYERIYLKMGKVTLLGSNAREDLLTFEVSTPNNELITFAKASNQQEKRYWQFISVFPGESIGEIVKVNGVALKNSSKKLPKDDYILLSLYVNGVLAGERRLLYKSGNRLVEFNKKKNHTIEIISATHNVPMAHIELSTEYVGKVYNSDVSIDNIFQYDRFFQKGKKRIDELSNSLVAFTKIRILPQLLNISQNY

SEQ ID NO: 16092 - protein, 326 aa, Candida albicans
CTFILKLDISVCDNIALLTRISSIFTRKYSSVPYYMFLTSLVFAFVYKFSVYYNLPKSWKKISSSDIALVTGGSNGLGLGLVKELLRRGASVYIFDVSKPKFQHDNLVYVYCDLDDEQSVNTELEKLIDELNSKNTWINILINNAGIRDNKPLIKLSGDRVKTMFNINTMLPIWILQKVISNHIDKVLSVQPDGQLFVVTVSSILGTLAPKNLSVYSATKAATILIHEALHQELKEYLNNIRLLLVTTGQMSTAMFKDVEPSKLFFAPIVNHIELAKLVVDKINVGYVGCISKPFYANFLPGVRTVPQCIQDFCRYISEMDNKIKE

SEQ ID NO: 16093 - protein, 460 aa, Candida albicans
MANSTSNPAIIMAKDDNSVSGQHKQSLQNHRSKQTNKNQKRQNRQSRYDHSNDHELNIIESQLKNGKKVKGSKNQISINHLLEFQSYRDLEEYRSNQQRNRRRRSSSHKRPYSHNKIQLTGMRFINVNFKFVVDGRKDYRVQELDPNVPVDTDDIIRIIAPRGNSCPICLTDDFVAPRMITSCGHIICLKCVLSLLGNEVPQAKKRESAAIVEKYRECPLCFSIIRKHELKPVLMNNVDERFEVPKVGDEVVMTLMARPMDQILALPKLLAFDSHIRGFPDTKQFELLPYLRIFRGDSQYILEMYEEEKRDIMAAYEEEKLVYGDDSSLVAESIAYIDKEVEQWNNKLLQNVVKEPNPSHTTDNSHSIYYFYETGFNAGCTYVLSPLDMKVLKTTYNDYATLPSSLVAQIENIIYEELTAETSMNRYKYLSHLPLGSEIRFLECDWSNIEIPSTETWGDF

SEQ ID NO: 16094 - protein, 679 aa, Candida albicans
DFSAAADNDDDDDDELFLSCICAKSFYLSQFYQDINDILPLFENVSFPKFNTWFKGIILPYKYYYSHFGLAYSTNTLNSYLSPESSYSLRLHLLLGPLKTEKILNNEGWFKNVIFPIVDYYGKDLHPLNEWLFDNENGYCSKPVESVVRKYQFWHVCLKCIHHHYDLKDYQIILNSFLSACYFYGFKEDTDSVSTIELVEIYDLIIDTITLFDIHTEELRLPDIDYKDIPFDCHNLKEFQSATNPISPLFQIGAIAYLRQVIETCQKLLPINRLTIKKYFQLKYQNKEMDTKREILKITNNINASNWKQLLNSIAFFQKNFIFNERISAIVIERLLLANLFDVVDEVYFEKKLGDITVNELYDVVLDKFWDCMNHANSLNDKSGLLHNAELCLKLFDKLVLEKDLAEDNHRDIVKFKHLFKAINALKRFKLLNRNQPYTPQQLIINFANGNILKLINIVLEQNPKSYLAFDKLYRILNDMILFYNDDNHKDGKQHADNYYFNKLKTACIESALIDNNFNYAYKQSLELFDYLDGKEDSSQIDDLWLTFYQVGKYVSPLWFENSGEQVDLGILTKQREILSLTILNLQLKENSKVVLAQWMSLNDKIQRHSLENNIEAVKERFDNENSQFKHSKKHLENIGNLATEIISDASKTTNNASEKLSNLFVSGLGWAIGANQQL

SEQ ID NO: 16095 - protein, 465 aa, Candida albicans
RFCVEDDPFETELGMIYQLGKVEQRKRLELYNLFETKASTSHIDTEEYFDNLSRLNRTISQSWIRKVNVYKSKLRSEIIANKDYLLGNEVKLDESLNDDVVTYAYALPLFSVYMDKFQIDISKPKFNIDEVANFIYDFGQGVPKTTEYTLLIPMYMALQLGELRMHLRDYPLPLLHSPRNKDMDETSFKLNGHLVISEAFAKVIEHMRQIDVPIVPVHKHKHKQLNKFEFLVMEETLASVKLYTDLECVFNSNYPTRIVWGASYNFGIQQMMANFDRFSKPPVDPSTKLGFWDKLKYILHGKCQIRTRKSLEVAFKGSRDPYDLFTTAGGFVLSFRKNVVWDINKDDNSKNYFDITADKVSWYIPNYLAGPLLAWTRSSKNSIYLPNSPNVVNSCFAYYLQDFTGQADFDHAARVFERNVVNLSGGIHFQVGFLLERKDTNGKRTDEFKPHYDLLQGVDVPNKNP

SEQ ID NO: 16096 - protein, 382 aa, Candida albicans
  UNSURE (381): Identity of amino acid sequences at the above locations are unknown.
VCYGGSVDVDIDPDRIESIGLRAKVDDFMVDLHQRKEPATLYHEELSKNEKVMKMNFDLGEVVLSGIDLRVMHVSFLQNLYTQSHSNSGDAKSTYNIYDNDHRWFDIMDFQEAFLTSIKDCVRTVDIYPLMYLQRFFYERDTHGGKSEDETAFGKEVIHKCNLGAMNPLETRLNVLVQRLNALQEQVKKLSKTSAPEPVADLKKRILFLQKEISTTKASVKSKMRRTSTINGMNNSENYHNKFTFYNMLLKWNFNCRNLTLKYIHFVKLKSQLRNYLSHKSIETLEKMMDSVNAYNDEDDLSSTSEIIRRFTLERVKSQTSTSKDITSQQKLDNFNTILRENRPDDEVVEDYLIDVIAPPIQLQSEDNPDSVVLISTPSIXS

SEQ ID NO: 16097 - protein, 267 aa, Candida albicans
GMVQGFNLQEGAKYPQLLGPDINEEKKKLDSCHNEKPIISMSWTVLNAVGGIPIIKNAKLETQRLQLELEYATAKKLESYLFPKEANTEDTDEQDGDEFDDIYVNNQQNSMSDSTSDIELSSNDSVLSSKNPLKRLMSKRSNRLPKSSSDSATSSPQQSLSLNSGVRSSNSSALSSDEISFGSGIKLNRPQLHLPLQKKREQQHEENDDEMEVIIARSLKFTSLIDIEIANFQMIISFSAPSTLHLLDVHRLVINIPTLRYVNKIWS

SEQ ID NO: 16098 - protein, 352 aa, Candida albicans
IFLFVYIFHCSILQISYLISFHLLIIIIMQDSYTLLRQRPKLDNSQTSTELESTPLLKRLHYYHELDEWQQDNHFIKSGYVKQTNSYKECFKSLTYLHNESVNIYSHLLPLSISFWVILYYINYILPKYDNYLGVWEKLNFLQFGLACTFCMFMSSTFHCIKAHSHPVSKFGNQLDYFGIVILITCSLISIILFAYYDYPWYRNIFVGLSLFFGTVCTVLTLDRKFSTNEYRPFRSFMFILFGLSGALPIVNSMYMFGFEITRQKAGVEWLILEGVFYIGGAVLYAARVPERFTHVEDDEHTLLNNPLSGTFDIFGHSHQIFHVMVVIAAFCHWKGLVQSYHYLHLQTLPNL

SEQ ID NO: 16099 - protein, 448 aa, Candida albicans
IIMAVQLKWPILGVIIPCIIIFSLSYGSHYFILRHHLTMKQQLIYEFYVTMIWISYLLAIYTNPGRVPKNYKPSLASSTRIEQTEDDSDGLGLESREDETLIREEPISGDRCEWIRYCKKCNNYKPPRSHHCKICQQCVLQMDHHCPWTLNCVGNNNLPHFMRFLGWIIWGTGYLMIQLIKLIINYYENLNMPHYLFNKTELVAIIAITPLNFFVFASILVLFIRCLINICKGMTQIEIWEWERLELQWSSKRLWRLIRFNYGRLHKGKPFPELNTWTNTTNNVNYNDNDDDGDEDVELINLATNNNEDSTIVPQNFTIDDLIFPYNLGIWKNLVNALGYPYMWLIPFGKPKSNGYQPQISQDYKQDDQLNLPWPPDGIRQKEIEINVLQQQGYQRDREEEDEEELRSIRNYQELRRRLDPRLNVQRSDFINDMGEGLTDFGVDEDSD

SEQ ID NO: 16100 - protein, 339 aa, Candida albicans
TWIFHGWLISANLEETERTTNNNDNESGQVEVEVEANIDEDVDVDADADADVDVEEEIVNDEDDDIELIWDNKPYYTKGIDIASAVLTSISYLSFVYLLTIHSGLSLPLSMLQGTYSSMRRAWVETNQLLAFIESSKRLDTQLANASAEDLSQSDSLCIICREDMHSVEDYQRIFKKPQSPRRSPKKLKCGHILHLGCLKEWLERSDSCPLCRRKVFSNDGATNATNNNNNNNGENNQNNGNVPPPQPGDVPVPPPAPTATATATAAAVNAELQREVREINDLLQNAENTIAPQEQPINTAAEPIEGPSRTIPLPSSSSTLPIPQSNDLSQSITLPKNA

SEQ ID NO: 16101 - protein, 202 aa, Candida albicans
TNHQSLLINPIYTFYFQIMLINKTQQYIIGYSSISIALLSWSIYDSLRKSFNFVMFLVEFTDGIKLGIIVNFIIFLFLIIDKLLQILLFGSLRMIEVEHLFEKLPIFVINLLLNLATGDNNIIMNVFLMGLSMSFKVFHVIMFDRLDYVNLIIVNKINDEDIYLNQVIYHFGTSINFWLNIFFIFADFSLAKFLVYDVFPRY

SEQ ID NO: 16102 - protein, 134 aa, Candida albicans
LHTPLMSQEYINPSTLNSSNSLLIDELTESNDLVVLEEQLSPDEVILNADIINTERLIEESRSLEEQPSYVIDIFGILKKAAINLVLPFINGMMLGFGEILAHEIGFRYNWIGARVEPPRRMVQKKNESASKYL

SEQ ID NO: 16103 - protein, 386 aa, Candida albicans
QQPIIMNFLIRNTIIGQTCNSKQIFYKHARTLAIKSSLTSSIRYPLQPSLHNNLNANTINFPLVKSFIRHNSSKPQKSLLLPEQIKEKALETLEKSPATELVHKTAEEPKKSIWEKVKHEAKHYWDGTKLLGYEVKVSTKLLLKLMAGYELSRRESNQLQRTIVDVVRLVPFAMFVIIPFAELLLPIALKIFPNLLPSTYESTVDRQKKLAKLKKTRKAASEFIKNTMAESGGLKLLKKITDQERENFVQFFHCISMGKNPDRQQLIQVARLFKNDQVLDNLSRPQLVAMCNYMNLRPFGTDSILRYQIRHRLLNIIKDDKVIDYEGVDSLSILELQLACLQRGIKTSDKSPARLRDDLETWLDLRLRQKISSTLLILSSAYTYGE

SEQ ID NO: 16104 - protein, 182 aa, Candida albicans
  UNSURE (174): Identity of amino acid sequences at the above locations are unknown.
LGSFEARGEDYLRNNPEAISNILTNFDKSYVDNLFEQLANENDVLQKRILGIIQALVQNSHFVRQYFSFDHSSGLNDLIAIFPKLGPNSKSRASNILEDLQLFPVTNDRRSLEDQDPESQVSKFIQNSFVGNKLDEKNFKSYFDQLVNLHQLNKSLRPSGDFLNWLAEEVESRXENNKRDDY

SEQ ID NO: 16105 - protein, 283 aa, Candida albicans
HDRKGLYYFVTHPTVWPFYITILIPQLVLTLVIYLIMFSLFFPPQAIVYTLLMGPLGVIGAWYSLILQASTLSIFVVTISLMPHIQRVAYDAILSRECANDVVLMGKLRRYRKLPIRVRAREYLKAIPDFSIFPFSLLKLLVFFGIYFIPFVGPIIVLFFQSSKRGLKAHARYFKLKGFLRSDIRTIHKLNRPAYMGYGVVALWLELFPFINMFFMFTNTLGAALWAVDIEQQEKAVTENVAAATTTATDTNSVNQQGLVIPVHNEPATNIPEATPKTATNTI

SEQ ID NO: 16106 - protein, 642 aa, Candida albicans
KIDFKFPFSFMSKNKLSSLGNHGTTTTSSLSSSSSISNNTSIARIIFVFSNILKLVQSIPIGHITHGNVGGDYSTETKRPVLTPEEFYMNLFTSIFLVLAGGVFAGLTLGLMGQDEVYLKVIAHSGDSTERKHAKKVLQLIGRGKHWVLVTLLLSNVITNETLPIVLDRCLGGGWPAVVTSTVSIVIFGEIIPQSICVRYGLQVGSLFAPFVLVLMYIMYPVAYPCAMLLDHILGEDHGTVYKKSGLKTLVTLHKTMGVERLNQDEVTIISAVLDLKEKPVSSIMTPMDRVYTMSADALLDEKTVEEIFNAGFSRIPIHLPNEPTNFIGMLLVRVLISYDPEDALPVASFPLATLPETGLDTSCLNILNYFQEGKSHMIVVSENPGEPTGAVGVLTLEDVIEELIGEEIVDESDVYIDINKNIKRKHPGPLAKRNLTSYLHTLYQRNSSSNPNSKRNSIDSSVYRNANANANGNGGRVSPPLDISERLRQGSESSQISYTTNNNNTKNRKQQDQNEVAGAAAATATAATNWKPKNPASNPLETKKKFVTIKRPDQDKIESMKKITSPKLVPTQVGTIYSTEKGALEEAHRRSLDEREHGPKFLLPMEREGDVSEINQQNYHGENGSHHHIDITHEWQWQWPW

SEQ ID NO: 16107 - protein, 758 aa, Candida albicans
FQYIFITLFTLSNRIVSFSTDIPWEAFQQFLQSRGIQRIRKQHRRLTDTIRSRATSDGNVRISTIMSNIRNENEVHFSDSDDEVIIEDEPLGIIQINNEIDDDFDSFYNTRSESFGGGRNHNFIISDRCNNEIDKSYEYVAAQSTTTLIESVIPDELYKDRFEFKIPSQDFKHVNYTAMDTSDYSKILHKSPSDKFVNFLKLKHFGIKKLFAEDFRKFKNNLSTIISDGMVEYLVLGLNSELIVFGFDGLTNLPSKQLLRIDTRPMYTSSTDRLISTWPYFPHTINYLKTGNFNNKQVLGVCSDDGTLFIWYTETIINLVKKFGNSKKPQSNDNDQETENPVATVTLSSTASSSVATPTIVKPDFRIKTEASLWGLDFKTYNGHNILVASDNSQSVVLLYYHPVDERFYNIKSHQILHNIPDISIVSYTQKGERHTVQVSCVSISGEIIVFEFNFAIALGPLNKEEFEYFRKEPYYYVDATMEQLENRNGIDSHELAQLKLKKFRRVKFAEPLCISRVVLSEDCWTVKPMSSKWFLPVGSLKDVFGDDSIDESRELNRIRYETRLLNALSGKFQFFPSKTVNFESRLEDNCHNNTSTTTNCKPTTVDDEYRRIHKELVNGSSDEFLLVSTAKKLSMFRFPSLFCNCSTLKIFDLAIPFNEESKFTNRISISMVVPELLCFIAATQQGLITIMRLCSYQGVYGMRQEHIFPNALSLSLGYHGYRTIIGLSVRKRTLEKPIYNLYVTYNDGLIIGYQISI

SEQ ID NO: 16108 - protein, 112 aa, Candida albicans
RSMAQLTPIRGFTNTPVTRSICMISTVVPIMLSVLAIKYVVKFAIDPYIIQYNQFWRVVTYQLSVVNESDYLITVLLWFQFKVLERFYGSRKYLIIITLSTVYKCGCIANLS

SEQ ID NO: 16109 - protein, 204 aa, Candida albicans
ADPSSPVGEDVTFLNEIIPGPLGILSSLYVCYGANIPVSYYFKILLKDPRNADQPETSSPSKELNLTNLFPIHILYTILILNNGLRSIIPCLVGLLIGKLYVYELLPGGSSWLLSNTVFRLFINPVKRAGVWLEAVRRRLSIRYERLSSGDSQEALEEEELNENNDEPDDNDEILDETRQQENQIRAETPVRPLGSQFLDTFRT

SEQ ID NO: 16110 - protein, 315 aa, Candida albicans
NYNYLSSTSSIHPTYTYHSTFSIMSAIYKALQSKSSKETSEKTKHINRQRLLVISSRGITYRHRHLIQDLLALLPHARKEPKFDSKKNLHQLNEVAELYNCNNIFFFECRKHQDLYLWISKPPNGPTLKFHIQNLHTLDELNFTGNCLKGSRPILSFDKSFLENDHYKLLKEMFLQTFGVPPNARKSKPFIDHVMTFSIVDGKIWIRNYQINETLDVKENDKIEDDEDYDVDQLNLVEIGPRLVLTLITVLEGSFSGPKIYENKQYVSPNFVRAQLKQQAADQAKSRSQAALERKIKKRNQVLKADPLSNDALFK

SEQ ID NO: 16111 - protein, 132 aa, Candida albicans
  UNSURE (106): Identity of amino acid sequences at the above locations are unknown.
EQTMAGSSIPQSSNSSVSQFLSTLIPTLVISVVFLLAFIVIHSKQRRVYEPRAVVESLPDDLRTETAPKGPFSWLTYLLAKPRTFYIQYAGTDGYFFLRFLFEFFXCMCLRSSYNLAILFFCPADWKIMRPA

SEQ ID NO: 16112 - protein, 327 aa, Candida albicans
EYSIGSEILQKQKLTYINTYQLDMTHSLRLFDNFLSNISKTSSIISLTIWLFTHIPQIILNHKRRDVSLSISFVGLTFLADIINLTYQILIKDSPYSILLVYMIILDLIIISQYFYYSRYFKKPVSPPPPPQQQQQQPTLVDRILGAAFVTDLVLAMNIKAQQPEYHHQKQTSPVHFDWVQILPIVCCFLYIILRIPQIRRNYIRKSTTGLSLYMVLFTVLGTIFNLLSIVTDTNLYNVLSIKIFLIGSLVIVLMDGALLYQFWLYRKHISAHENDTVDIDEQPQWYVKNQPLVFYQSCETTQTQTARTSIFSIGYLQSLLASIFPT

SEQ ID NO: 16113 - protein, 81 aa, Candida albicans
SIFAEISIISFIFSFVVLYIGNKFAERFWGNYLEVIKFVIIVGSITNLFTVIIAIISNIIIQDGKNMDQPLRGGISYYFGI

SEQ ID NO: 16114 - protein, 441 aa, Candida albicans
  UNSURE (433): Identity of amino acid sequences at the above locations are unknown.
IRKVNVDKTTNIMLVVFGTFISTKAQQQDQQQQQQQGQQQGEHHHIPELAQETGEIPHPHELFVPLLTFIPTKSPVLTRPWVLLTSGFIEENFIELFISFILIFYLGKYLETIWGSKEFSKFIIINVLISNLIIYIYYNLKSFIVELTDENLPPVILSSMSINIGLIIAMKQRIPKHYLIFFKGNLRFKVTYLPFLTILLTWILSLLSEEFYILFVMSIVGFIVSWAYLRFFKTGANERQLYILPFALTHKRKNRFNTTTTTTTVNNSNTSHISGSNSTSNNNSNHTNTGFSLDNDSLKGDRSEQFALYTFFPYPLSIPIKFIANFIFEILVDHKLLNKRDFKNYDDEEDNNNNNNNNNNNNVSHVRGISNRYEDVDKLKNNLFGLSALNGAQLVSTISMASSMKKFWDWLIPTTNSKSHETSNIKINMDRRXKLALKEIE

SEQ ID NO: 16115 - protein, 181 aa, Candida albicans
KHVPFALMIFSSLWSIIISRSLYPAIPSIGSFFVSYFYLRFFQSLNTERTLPIATTTTSTTTTNSGNNGSSIDMQNSSIMIGDASDTFQLIDFFPQVTRPILTPIFQHGYDISVFLGIITPFNDEIVEQSNLRAQKRQEQTNQTQKNVAKSVAERRRQVALQVIEDRINKETAANGAVTNQ

SEQ ID NO: 16116 - protein, 187 aa, Candida albicans
KVFSPNMDHNHSSNLFRLPSIQLPKSAKLRSFGIYLSGALSAIGFWSLVDASIYLKTINASDVHVHFIDWIPFLASSMGMLIVNSIEKSNLMINPNNQLDFTGSGGNGGGHAWAARIILFMGFSLLAGGLAGSFMVFILKYLMNHYTFPTLGMGVANIVCNGCVMLSCIFLWLSQNIEDEYSYSLAL

SEQ ID NO: 16117 - protein, 414 aa, Candida albicans
  UNSURE (157): Identity of amino acid sequences at the above locations are unknown.
KTIMLQDNDNQDLESITIKPPTSQETTTSSSSGSTVVVPPLQTPQFQNVKHEIEYEGEILTIDSTNWRNSRLLKLQILVSFAVFILFGLAEQTVGTIIPKLQHDYAINDIQISFIFFCSVSGYLLTAMINSITHEYLGIRGVTVLGSTSMALSYWIXSHKPPFVIFLMCYFMSGVGFVTLDASINTWMGKPCDSNQLLGIVHGCYGIGSLISPSLISYLLSKSNHLWKWQNYYVILSVVAGFCLVSLILTFKYETPKKYKYISELRHQQQKEQGQTHKDGSIELEHFTGIHGSTTKDSFDLEATVEDNQEDGEEEEDDDDHHSTSVRKTLSSTLVWSFALILFIYVGGEAVFAAWLVTFLLRIKNLDYKTASYMATTFWSGVTIGRIGLGFVTAHFFSSEFWFSTRRSGNNVGK

SEQ ID NO: 16118 - protein, 505 aa, Candida albicans
FYSKMRRFSTTANESHHSDRQFQQSDETQLNNPIFIGDNGIALETISSNTSDDSSRSGYSTQELSHLMTSTNPPKNRWRIASTILFNFTSGFSDAAPGALLPHIESYYNINYAITSCIWVSNAVGFILIAAFSHKIQPWFGKRNSLPIGNALSCVMYAIVASGTKFPVVVLGFFFGGCGLAMVAAQCNIFLSRLDKQSKYLAYYHGSYGIGPTISPLIATSIVNSGVSWNLFNLILLGLMVITAINLYFSFQNADEDLKPWDHVEAVHSSSTSVELENLDSRITNTTNHANSTTQTSEMVLALQSHVTWLIAFFCLCYQGAEVSLAGWIVTFLLDYRHSDANSTGYIASGLWGGLTLGRLLLTRPIHKYIGLRRGVFIVSLVSIILVLLTWVVPVIVVEAVLVSLAGIFIGPNYPLLITYAALPGLIPRKIQVVSITIMTAFGSTGGALFPFIVGVLLQKVGTFVVLPVFIVLYAFMVFLWMLLPNTERQNKQNQTQLNFWERIW

SEQ ID NO: 16119 - protein, 1068 aa, Candida albicans
  UNSURE (5),(6),(51): Identity of amino acid sequences at the above locations are unknown.
GILSXXSTILHFHEISPSSSLSSSRSKKQTSQYNTQDTNNNRLSYYCDKEXISCSQLNCSLLIGGYSGDLQHHVVIGGKNILRLLCVSESQQRIISGINLLESKSIYNSRAPNKLINVNTIKTFADTIATGLSNGVVSIYKISPNGQSKVTGKYSDHNRTINSLDFIESENQLLSGSQDGTIKLWDLRSSSTKPVMTVQANLHSDPIRACQYSPHSAVRNKICVLSVHDSGALCKFDLRTKSGGKVYSPEKKWNLHTGPALSLHIHPEKELVVTGGRDKRISIFNYGERQSRNTPQNLINTYGPVVKVRWSTYTNTEETAEEFEENKQAKPNTLYNYDIACLYLNDDPTITIYNLGRKFIPKQIIHSKKPIQNFIWARNETRSRKIWTISKSSTFSSYNLDRLEDSDVSRPIEDLNNIAMTWDNNNDFCAVSQARYDYDLETYENGINETTEENFDAERNYSLGNEELIHSQANSLTASPVDKPQLTRSLTFNPALLFSTFSPVLVARAATGFLQNDLATSSSSIPNMQVSSSRPKLTRNTSQTTQDSSSSQFASVLPPPSASQTYSSPQYKKNNPPRFMNNPAYVIPVSIPIPANDEYVFRKLSSESLVSTPDGFTLVDVCLLNASVAASVGNNRTSQIWRLLAVSIQEEFESGIEPRRIYAFQPEAINKLPQDVQETSTNANDTLHAETTNSNFVESFKSTSTLGSQFGKQSDKDERKLQSKNSSGNLMDMINKANRTNSFSATSFKFKEQERKEDESQKAQSIKDENERASIHSKSAPILISSHPEDLDDENMGSNNSAALKFSPPSVGVSIPSTRIISSSLASSPKSVRGPSGVKLHISRSRPSPPVQTWLKQKNLEVSNGLAMASTSGLSLTLKRNKTNEEGDQLTKAWKFKSLLRKSLDYATLQGDIIFCSTAALLFYDIVPEIISQFECLEWLGIYIEVLQRKRLFVNAINVIKCATADIQEKLQKLYCQDLSLRFYCSNCQALLVNEKSKFSGKGEFGYWYCDECSKLQLQCVYCNEPCKGLAVTVGLKCGHHGHFGCLQEWFIEYQNTECPGGCGYQII

SEQ ID NO: 16120 - protein, 215 aa, Candida albicans
CVKFRTRSKEKGQKKDSKKKTKTRSKYIIAKLQPQKHTMTTDYYDLDDILADSEKLTCKFNITVPGLGYLEGNPGKPIHEDTKLELPHWLSGILATVAIDEDSNINFLDLADPDIIKEKVINAIKTDPLAVDLHKLTPYYYSLILKWGNLYTDKTLIANVMNCLKARSLEIYNFSNNANKTLNNEFLYTLDEFERALFKLTSDSNKSMRKWLKTK

SEQ ID NO: 16121 - protein, 169 aa, Candida albicans
  UNSURE (6),(14),(15): Identity of amino acid sequences at the above locations are unknown.
GLDTDXLGVVDTHXXLFIDDQLKNKLIDAEKLSQVLYDSRQVAKRRFEYTKYTPMANTFSNKVTCPVMAFNPKEPWGSIVSQYNVPHFKRPVVEVLYKWRDLMAKKQDESVRYIMPNPLLVSLTNLESPVDLNKVLNVSYRISDAVRINAKEVADLIEKTLKETEANDW

SEQ ID NO: 16122 - protein, 104 aa, Candida albicans
YLDNGKTSTTTTISNEKASKIEKPQLKFKVPIDNSESGPFKPKLSSKPHALVPFNDSLINPQPVYEDSIEIIDPPFYAQPYEYEIDNQPYPDAILAKSDAIPPK

SEQ ID NO: 16123 - protein, 324 aa, Candida albicans
IILNQLIFTTFCTPHVGVLYPQSHNFSARLNNRIAPFFLADTGSQFIFEDKVGEFGKPLLVWMADRRYKFYKALATFKYKSLYANVVNDKRCSWYTASISPDDKVNSLYNKRPENINCKYIKGYQPNVIDVTKPFYYEKVDNLRESSNHRFKWFWKTLNWIKLIGTITVYSPIFIITSIVQRIYNRKRVSEFFQNESNDLLHMYEHEHEVGGEEEQQQQQQYHSSVFADISNKVDDEQETLVEDIYDAMNWKVSHSSTFPPIRLDHNQSYIVEKLNTIGWKKYPIIIRHTKGTHGAAIIKHYDPNFDEGEVIVRHFVKEVFKLD

SEQ ID NO: 16124 - protein, 222 aa, Candida albicans
KKFVYGNAPIDPDDAKVGNVQRLKRRTLDRHESFKGDTSYLTEDTMDRVLYAEERYLNKSRKAGSIKNEDDEDALVAENTDYNTDSDGVDESSEADTLKSNFKSIEMDIEQNDKVISESIETLKSYESFPLFQDHKYKLPLNEDKLFIVKNLNTLDWIKIPVFLDVWNAHDGIVSRRGAKTNPKGASTIGLWVSILRNHLQENGRADASVNGNQESTIAHTS

SEQ ID NO: 16125 - protein, 361 aa, Candida albicans
  UNSURE (77): Identity of amino acid sequences at the above locations are unknown.
FHIILVDKIIYTKSTMSDINKSLSSNSKSKSTHLFVLIHGLWGTWSHMATIEKFIKENLPSSTDDKIATIKRAFFRXWKTYDGLELNAKKIIADIFYEIESLKQNNDLEVTKISIIGYSLGGLISRYVIGLLNELDFFEKIEPIFFSTFATPHVGIQFFNDNIFDAVANRLGPYLFGKSGGQLFIADHDKILVKMADPQEKYMRGLKKFQKHILLANIKNDRTVAFFTSFITDVSPFEELDNIKIVYLDNLPQAKIANKLVRPKFVDLTKSHRLSLKDKKIFLGNQQEETPFIRKNRWAKILVIALLACLVVPFWVPFVLISSTTVSIYSFIKIKFVKGPLSPQHWLRVKKVCLRQRTYRS

SEQ ID NO: 16126 - protein, 222 aa, Candida albicans
NSLLMSFSVEKKTTLAHPFRAPGSTLISSDQSNLKIVYNKYKTRSPLPNSTNQLRYNFIFCHGTGFNKSIWKYHISKLYQLSQSLQVPWFLDSVIAIDMVGHGDSSLENQGKLGTIFRWDDGAKDVIAIIKHEIATTGDFQNNLESRNLIIGHSMGGFNSLYATFLEPSLFDAVIPIEAVIYGAPGGLEKFSKKFSKISKLLIDTFDSKDDINFFFKEFSFF

SEQ ID NO: 16127 - protein, 306 aa, Candida albicans
YSQICNIDTVIAADHVNMGDSANVNRGKLGHVSDWNDFAKDYIMITKIHERDAFLHPNAFNVVVAHSMGGFIAMQMTAIEPNLFQSSILINPVCVTFPELRHHNLKVYQDWYHRDFVKFYFDNIPEGENWYHKIYEHYTNRSFYRKFHPVVLRNMLEDEIPEMYDRSKYYRTVELKHDGLEDYINYYNSEESITATKSSYEQIRVPTKILCGENDALATFIDSQKDQELSFAEIQVLEGKYHNMHAESPDLIMSLVNDFVVTCYKEHPKITDFEYYKKYGSDYKLILRKKKLHDLLGDNTNIPSKL

SEQ ID NO: 16128 - protein, 1026 aa, Candida albicans
QSNDSIGVVEVTVKRCRKLKTGNPTKPKSLNPYVQIKVTNNGKIDERTKTKKLVNDPVFMETKTILVNLLEGNFLNFNVYNLIEDKMDDQLIGNCEFGLGELLQEETIQGITKNIMEGGKVVGKIELDIKYFPTIQPTILEDGSKEVITDNEVGIMKLTLHEARDLDISKSVIGLLNPYAEIYVNNEKAKTCRRLRQTNEPGWNESFESLIKQQSETSIQVLVRDSVNSDIVANLEVNLQDVIFESQRGQHWFTCPPISKNGPAPKIRLTTSWKPLAIDEATSEKVVRNAPIGGMRLHLRGAKGLKNLESVGYVDPYVRVMLNGKLRAKTVTFAETVNPQWNSVYFLPVANEHQHYLLQIMDAEPEGKDRSLGTAAINVADILRKNEEGYYLGYDGSDEIIEQPVLFNTKEAGSIFYSVSFFPAIPTYSLSQLHNFETYQKELKEQEEREKERYARDEKMFKENPDEFEWIEIENEQMKVPPKVELKLQDAIKYRAGNMIVHLKGGQFEKPDVYVHTLFDEHAYPSGISPISEGKKLTTASVGETFIRDLPNSNLIFRVAKVAEVTKSSEVIVEKMYNTLDIYEKSFEKPIKLNLGNRNTIEVQLEFIPSTVKLAPLDTILDVGKIKLEIIGGENLRSVDSNGKSDPLCTVNLDGVEIYKTDKKRKTLDPIWNESVEFPMISRSRQVLLVEVYDWDYTHDDELLGVANIDLSNIPALTTTPFSVDLDTQGKVNLRATFFPEYIRPPLDAKSAIPIDLGAVSDVGMKAVGGAASLATGAVGGGIGAASDQLNKGAGFLKSFKSKRGRNSKDKNNNDDSSSLAPSAISQSKSSVSDDGGHNLKPDIPEEEKELREEQGEEIESIQAAPNIREQDLPKPQQPFVPHGNVRGHQRNVSNATDVSSFAASIHGADALPGRLTIVEARNFKAGDNLEVKASLKTSTKDKLLFKTRGTKFDNVSDSYKWGESVPFKSSPSGNIILQLREHHTFGKSVVLGEATLNLENYVNVSENITLPVGSGELIVNVKYFT

SEQ ID NO: 16129 - protein, 640 aa, Candida albicans
PNSRQVFRICSNLKLLIDKIIPICFKEDEITSSNSAILSDPVIDLVYQAAGGKGDGKEGTSSYKYRGSLVFCLLKVCDWYWQQAEFELSDNELYSLRALTAQTIAAIIIEREKRDKYLFLNMLCHRYTICVNGVDATPVSALEMAVDMHSTIVIGSSGYQRCIKWLWRGWIIQSSTDPHSYVLYKGAASQSFRTHFDPARIKTPLYQNILEIFLSIIYLIIFTIVVNTHSTLTGDIDFFETVLYLFTVGYILDELIKFYHVGWNYLGFWNAFNDTMYCILTVAMCFRIASVNSHGVTRIKYDEISFRVLACASPLMWSRLLLFLDAYKFVGAMIVVLKTMMKESILFFFLLFVVIVGFLQGFIGLDSSDGKNEATQRILISLVKAVIGGSSFEDMGNLVPPYASVLYYFYQFMLTVILMNILIALYSTAYAAIVENATDEYFALVAHKTLRYIRAPDQNLYVPPFNLIELLITPIGWFVSTSTWKNINYYVMLVIYSPLLAYITSDELSNARRIQYNRFKGVPDDANEIDTEWDLTDGYDEDSPGDGDDCWDRIRERNLEITEELRIQREGERQDPEFMINTHQFSEKIDKIVKPVGQASKVGVNWQIYEVIEKIDKLTNLLEVVVAENKELKKRLENKA

SEQ ID NO: 16130 - protein, 611 aa, Candida albicans
YIIVNHFIPFPIFIFIFIPVYLKGKKWKEIDKISFNKVYPFFFFLTTSILHLYTNTYLPTLFTMSSIKQSRPRSLSNVLMMFNKQYKKLMISLVGFITLTFVIHIFNSSSPTKSPDLSLFQAQQLQTPGFLPTNKKAVQIISDFTVLKCNIYSKCNVPKGYIQLFPSLNYYHNSKIKTDYYLIIKLLSIDQTTKIITDVTTTNKNDNDNSDSSSSSSYEEIIIEPGKLSLYKKTQMVNVDQPIDDKLPILRSIDVLFGNNDLIDSRPHHKSLHLSNSESMHTILSLNMMTLTDQNDLQEIHQQTINLRNSQLIETMNNKYKIMQLSDLHFGQDLGRCDDSNTSSGGGGDGDRDGDGDEHVDEFKCSSDLKTLKFIEKSIQEENPDLIVITGDLIDIHRSIDYKSILLKSLQPILAHKIKFIYTFGDEIKDQLTKISIIQFLSTLPNCLNTVPQEVIEDNNNNNNNKMHGITNYNFQIKQKSSTPSSSSSISVTVLDSEDHLIDDSQMTYLYRINNELLNDYKLLFFHYPLPQFRPKGKFKIVGSYNEKHELDRKTKLKFHDDIISCGYNVISVGHEHENDACLLSSSSSSSNSDKSMCLWSSPRTCRSNLI

SEQ ID NO: 16131 - protein, 627 aa, Candida albicans
QPHSTYHPKSVMSDEKIKQLQEMGFSQEQAANALKVSNNVLEVAIAHLFGEPVEQPQENKENTQLVPYNENDTVQISNPLDIPKFPSYRETPTSSNGGWSEIQDEELIENYEDEDDNDNDDDLVDQWTNNSKQASSETIFDYPQAFTRLTEMPPCVLPKVTGTLQSCLISLIVTLSQIGELRNVFFSKDFDYGFDENWYTPTTELTVETPEKFKDNSFYSFVVEIQRIFGFLSPKVSNRSFISGKNLFKSLPEDFAIDDDDWEDVIKKVHRYIALGSESILDKDLTLVFLSQVESNGEETTDLSILQIEYEARNLNLQASLNSLIWNSELNPVFTKLGLLLTIQMFGGDEDDDDDGRCQARSFEIPEYFYPGIFTSTYQEIIAKMNQKKLNATKERSSTTTKLLGFSSFEGKKIKKILQNSIDYLATTDSKEAHDDLKRLSEKVQNESLALNDRLKFVNQEYLKMDVKNPDNILEIIEKEGLPPPEKYYLTSVIISDSEYIYKAKHLTTTDFENEDWLYIVIDLDHNNKVLEYRTETMSFEALQLFILEETKLNRRQLILHYVAESSLQDLAKVPEKLVEFFDKDNQLLAEEVHEFNKNNKENDAEVSNDSSVDESFLVSHSETQSL

SEQ ID NO: 16132 - protein, 542 aa, Candida albicans
KFSRKENSLDTLTSLVNKSDLYTPRSNRTLDYSPLIQYIPVFFQKNYSSIDTPHNNDFLALQSPATTQTDSNKNLQKNDSVLDECHFMSFEEWKKQKIESNTTTSNNYSMNGSSELKSITPSNHSSVISTNVTLMEADGKVYKDKFNFASVDCAATIMKTNAQAKGASAILKENKDSYLLNECSVKHKYVIIELCQDILVDLVVIGNFEFFSSIFKDIRISVSDRFPSQNWKELGQFTASNIRDVQTFKIENPLIWARYLKLEILSHYGNEFYCPISIVRVHGKTMMDEFKEDEEGNQHMGAIKEEEPPTPQTIEEDVLLINQTTLNECRVRLPHLQLNEFLKSFNSSNQEFCVPSDAEPQVTTAKTTTAITTQESIYKNIMKRLSLLESNATLSLLYIEEQLKLLSTAFSNLEKRQTTNFNTLISSVNSTLMNQLMVFKESYYELYEQYGNLFKMQENSHRQLLAETNKKVGLLSSELTFQKRVSIFNSIIIICLLVYVILTRDVAIEYPEDELNEKSPLPQSKKLSSPFIPIRYKKSKKR

SEQ ID NO: 16133 - protein, 125 aa, Candida albicans
CGSFQPRGEDKGMDALINDMFINTALNLYSLFVAYLVALLAYLYLKFTKPEYNSGGAFYAPVIAFAFLIAGQINRISLTVIESGTATFFVALAKDPEIFQMTNRNRFDDIFRNYPQVLEKITSDH

SEQ ID NO: 16134 - protein, 764 aa, Candida albicans
  UNSURE (562),(580),(755): Identity of amino acid sequences at the above locations are unknown.
VVPVDQRRLRDAIQIIDENKHFNTGILDYINKTSPADVGNNYHIISVFGSQSTGKSTLLNRLFNTNFDVMDELNRQQTTKGIWLAYSPVVSTTLGHTTSKSNILVMDVEGTDGRERREDQDFERKAALFALSTSEVLIINIWETQVGLYQGANMGLLKTVFEVNLSLFGKSKLETHNDHKVLLLIVIRDHVGVTPVESLAKTFTLDLQNMWSSLAKPAELEHLQFADFFDVTFHALNHKVLQPKEFGEGINRLDDRLVVSNELFKPEYHHDVPIDGWTMYAERCWEQIETNKDLDLPTQQILVAQFKCDEIVESVFQEFLAKYQHHFKEVDAAPDFEELGALFADLRQDAFEDYDASASRYNKAVYEQKKKKLRWLINDKLKEVFDVHAKNLCNTLLEKFEKDLVALKGKDFAVNVKTLSTKLVEDVNFQVSLMSLQGDLSLDEIILALTKDIDAIVAKQQVIELNSIVNKSVKKLSASLSKSIQFELGDPNEETWDNVLQQFKGVYEKFGGDFGLGTSSTQNQQAIEKFKFKSWCQFYDVTHKLISREKLLALLQDRFDDXFRYDENGLPKLYLNEQDXEKTFAVGKQHALQVLPILTFAKLADGSEIVPDYDIFDSKLREQFLGGYDDSDDEEDHCFAEIITEQEKLEVLAKFKKEVDAKYIETKRSIVQHITQIPYYIYLIILVLGWNEFMAIIRNPLFFSLSIVLGATVYVLYYLGLLRPALVVAQRTMDEVIVMAKTKLREVLIDDHVFXPLQWTDQRF

SEQ ID NO: 16135 - protein, 150 aa, Candida albicans
IQQSDELTTFEQVSEKVYNEIQMILLAALDHCMVAEYGDDLDLIRGYDKNSVTTIEDCAELIIRFWMTVFLQYFDATPGNFVPFRETGKGRNSRKTPIHIYQPEDSNELRKFVTFWTTVLTVIYDAVMDSTQQAALKWLIARWNKMADTV

SEQ ID NO: 16136 - protein, 294 aa, Candida albicans
IPAMSLPSRYAPEGLSEEDQLKVITLGEIKPRKPIDYKLRTIDDRVQLALHTHPNTSEDIEMIPIEDGKEVDVISEYIEYLRGNSVYEDKNEMVIEESPEFEIVGGNISFLVLDTNFLISHLNIVDTLKNIASEYGLKLIIPVYVVQELDGLKNSNRLHNNSNGKFTGETVSQLAIWANRWIYQALADSLAVVKGQKLSQRISKDLVKDDAIFDCCLYFKKTYPQSLVILLSNDKNLCAKALSNDVLTVSFRENMSGRLIANTIYEENVERFGKLQTKVEPVAPKIQNHFLPRW

SEQ ID NO: 16137 - protein, 599 aa, Candida albicans
IIQNGISQLLSVSGLDEANLKILICTLLSFPFGIIFKRLPDHDYTLKNIYNVAVSCFYVFGICDLRFGISTLLISATGSYFITRYVRTKSMPWINFLFLMIHMAYSHFHLQFFKEYDPKLIDITGAQMILVMKLSAFGWNIHDGKQPRLTLNDFNKARAITKHPNVLPYIGYVFFYASLLTGPAFDYADYDKFIHGTLFDDVPQDKRPGKNKRRIPRSGVQAFKKFLLGFFWAFLLLQSDKFVTMEYMFSPEFVQYHGLFYRIIYMWILGFTFRLKYYTIWTIAEGACILCGIGYNGVDPETGEFKWNRVQNIYPWSFETGQNVHACLEAWNQNTNIWLKNYVYLRVAKPGKKPGFKSTIFTFTTSAFWHGTMPGYYLTFVVGALMQTVGKFYRRNFRPIFLEADGKTPKPAKIVYDFVCWVNTQLAFGFFVQPFVILGFTKSLECWATVYYWLLWVIAISFFAFSGPFAKSVSKFFKSLQPSYKEQQRKSREDKYKLNNEEASIVEQAVGAKLGQDYDIPALGLPPFDVFTDFDQTEVDHDIQHLRKAWTSFRGRRGSITENDFDGLKDAYNNFTNEINDIFNTKKEEFKKEKLNKQN

SEQ ID NO: 16138 - protein, 63 aa, Candida albicans
  UNSURE (53): Identity of amino acid sequences at the above locations are unknown.
QRNEIPKSMSSHFIVNRQQQQQQRNELRGYYKRYMIPPFYGTIDLVIKEIGYXNIKPTGEENG

SEQ ID NO: 16139 - protein, 460 aa, Candida albicans
NSNTMFSRLILLRSVRKSLGRYYSSQAHPQTYIYNLLSDTKCRSCGIQLQDKFPDKPGYYRLPGQNDSNTDKKAKTSELNKKYEKILQNLDISDRNLLINNFSAPKQDDEKVASVPSLQQITPVEADTRDTTKDQQTHLGHSLSCKRCNDVIYNSKTRSIYDPNRDNLNKSEFPIPKLQQVLSTIPVDAPLVYVFSANDFPMGINKDIFQYRPPQQIYFVMTKSDILIPKTNVAFYNNFKKFLQNYMFKKFNVPRENVFIASGKDRWKMTDLYHFIPNYSYIIGDTNCGKSTLVKSLLINHHVKHWKYEALQQRPDEKQSSSASLKNKDFKKLDRLIDSFSSKNGPGTSHIPGFTRDVVPVDIDGIKELFDVPGFTTNENLQDIFDKLNHKQIARITKGANTSKYGSLKSKFDTVKNGQVLSLNGVGYLQFPGQDSMYQIRNVTKFALHKFKNLEKVDSI

SEQ ID NO: 16140 - protein, 340 aa, Candida albicans
RGLRPVVSNPALVSQLSNNSNSLNSSSPNVSRSNSKKGGLFSSLSSKFRSSSASSKQPQLHSSSTPSTTTTNGGGNSSAAPKSSHHSPKFNPSLVGPVSKHNREAEDLVSLTNTLPAGSGIPIKRKPSIPGNSIFKDSFLDDASSSPSSSLNSDGGLKFFRRRSSVASTPSTHASTPRVILNKNPNRRKVPIEEISEVRLRRVTFSVDKLEHDPQQQIPSRRPKRGNVLIPQDINAPPPRLCLGISVNEPNNKDDGKSHNHSKYSDHEIALAEDAQRRAIIEAEKHAQEAHRQAKKIAQEVSGYRSHRFISIKEGGSVGNSNTNGNDNDFHHGMSHPLAN

SEQ ID NO: 16141 - protein, 205 aa, Candida albicans
TNMYYRISCSSCHGWYQYKNYKKCFQKKPLHHINNGRHSPITNKLEDHDDEIGFGGISNLFGLGYRKSFTVQFGLTPLQFSGYVLIPFFIYHMYKFRYIPWINDGDSSLINLEYISYVLNLKHPMWNVFALGTLIYSMSYHGTNGLMKLKGKYSKTWKKIGLAVVNGVSLLGWISVYLFKCNVEVIDVNGFLGKSFTKYLRSFWL

SEQ ID NO: 16142 - protein, 354 aa, Candida albicans
ILFCSKKKPAQTISHRHTKKKKISKKYSLIVNNITYQKVQPTMSKETKPPLDSRIGKDSPFTFGQRYLESEEDVFNHNAWDHVEWGEEQIKQAQELISKQYDHPVKEFDKNLYNSNPAKYWDLFYKHNRENFFKDRKWLQIEFPSLYKVTSKNYQQPTTILEIGCGAGNTFFPILNQNENENLKIFGCDYSKVAVDLVKSNESFISNHEKGVAYSSVWDLANPEGNIPEDLPPNSVDIVIMVFVFLALHPDQWKQAVDNLSKVLKPGGEILFRDYGRYDLAQVRFKKGRLLDDNFYIRGDGTRVYFFTEEELEEIFCEKGPFKKEKIATDRRLLVNRKKQLKMYRNWLQAVFRG

SEQ ID NO: 16143 - protein, 376 aa, Candida albicans
HSLGKSETYKTVSTGPRYIFGYHPHGVISMGGVGLFATNSLRNEPYTPFLKFLKPFFHDSSKGERLFPGLGNIFLLTITTQFAIPFYRDYLMGLGVTTASAKNIRSLISNGDNSVCIVVGGAEQSLLNNMVAKHARVGYGYKENQDINGSDAEDDQPEEEEQQQQQQPNGSVEVDKKTTKEVGEKTSSQPSKREVKLILNKRKGFVKLAIELGNVALVPTFAFGEADVYRLVQPSPTSMMYKFQKWMKGIFLFTIPLFSARGVFIYDYGLLPFRNPINICVGKPIYIPAGALQEYKQQHPEEFTEEETKPPMKKSGSFTDIFKMNGETPKVSTIKTKIPPALLDKYHKLYVDELRNVYEENKHKFGYGDVEFSIVE

SEQ ID NO: 16144 - protein, 200 aa, Candida albicans
RLFMTFNIKLIFVAHYLLTLKSLPFSQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 16145 - protein, 401 aa, Candida albicans
LCVYVICLYQTIQKHTHIITQIPISLGSLVNSLIFHLFAFSFSFSFSFSFSFSLSLFFFFCCFIFMPSFELDSLPYLNPNVDRRIAFITGGSSGLGFYSVLQLYLHGYTVYIAGRSKSRCLKSIKELKNKAIDIRLEYTSSQLNERFLGDLRFLEVDLSNLNLVISAVENFKKLEDHLHILINNAGAMALPYTLTIDKFEIQLQTNFVSPLVLTTKLLPILQKTADKFPKLPTPRIIYLGSFGHQFALPYFNLSNNLNHYPNFIFTWIRYGMAKVAGIHFMKMLTLRNPKVLFLTVHPGLVMNTNLFSYWTRLPIVGIIFWFAFYLFGYFFGVTSKEGADVVIKCALDENLTVENDNGKYFGPDGKESQPSSIATNMDYAARTWIWTIKELSQRGIDIPNP

SEQ ID NO: 16146 - protein, 67 aa, Candida albicans
NLFFLSSSIFPINTNRIMPFVNKSGFFDPSTAPYYDPKETRKVVFITGGNSGIGWYTVLQLYGPGYI

SEQ ID NO: 16147 - protein, 182 aa, Candida albicans
ERLIFQPRRCKNECLQISNYNEAFASLHQYFDYMVSNNSKYFYHFALISRASLHQYFGEDNKAMDAIEEAISVARENKDNSTLTYILSWLFNFMKNKPELWKNRQIFYNNNNNNNNNNESQLLDFLIKKSKQISLLLYSMSYNFKTLYFLNNGDYQSCINSLIKSIFIAINDDVKSTFIKSA

SEQ ID NO: 16148 - protein, 370 aa, Candida albicans
DLHRRLRICTSLSSLKFDESFLLFQAFQQFTEPTRQRYVELGGDIINENNNLGDDPDRDLFTRLNNNLIELGINNSISLSSLSSPTLTSTPTSTKIISVPKYDFQQLLDRQISLLETYGTPTPQYLKDIMMMMISPNSNVGRIQNIQFNNLPSYYYLRYLECLQISNYNEAFASLHQYFDYMVSNNSKYFYHFALISRASLHQYFGEDNKAMDAIEEAISVARENKDNSTLTYILSWLFNFMKNKPELWKNRQIFYNNNNNNNNNNNNNNNNNESQLLDFLIKKSKQISLLLYSMSYNFKTLYLLNNGDYQSCINSLIKSIFIAINDDVKSTFIKSAELAAIVWSKLGEPILSEVYNVFTSESQTAYISP

SEQ ID NO: 16149 - protein, 232 aa, Candida albicans
QIFKKLTQLKRLRLCVVSLIDCIYLTSPSQYISILLLSLRTMLQLDLPHVNVISKIDMLKNYGELPFRLDYYTEAQDLQYLTPYLEKESNSVLGQNYVRLTELIGELVEDFHLVSFEVLSVENKKSMISLMSVIDKANGYSFGSEIGGDTVWSEATRQNGSGNGGYQDVDIHERWIDHKEEYDAEERKQEQAFAEGLPQEEVDNKPLTEDEEWEAALKDWEEKHGGEGAMLR

SEQ ID NO: 16150 - protein, 74 aa, Candida albicans
CVYFLMYGQIVIGPPGSGKSTYCHGMYQFMSAIGRKLCIINLDPANDRLPLPCESDIRDYISLEEIMEESDLGS

SEQ ID NO: 16151 - protein, 120 aa, Candida albicans
FIMGFFQCLWYKFLQIYSIPQDPKFIEVLRKVMTDQFLFSPISLFCFFTFGTIILEDKTWNDTVNKLKRIYLKTLIINYTVWFPIQFFNFLIIPRDYQVPFSSSISVLWNCYLSMRNSTS

SEQ ID NO: 16152 - protein, 553 aa, Candida albicans
TVTMYNEKYALDFPNSHYLSNLNNLNGTNQSIHLNRLPTLGEILANKSKSPVDLFTFYQFMKDVEGKIDYLDFWFDLINHLNLCKHYVKGLRDSIIRQSSTFHQQQQQLQQQQQQQGHRIISSLQPQPQLQDLSYESPATATGFRNSMAVSEKSNRKSLSSSILLDLIINDNILEENDSHRLSAFLRGDINLDNLDPKLKDLIEQYNAEIEPNSKHSSRVDSVARSSPSYVSNPIMGSAPIANPQQPYLHQDRKTSSHSLLLHDDDENNHSYYENQLDIGRADKAVSASKYISLQSENKDVFGKEQENERFQHPTNPFADTSAINNQKKRASTINPSLLEKLIKDSPASNGTHSFITRENLRESSHQLLLKYFVEDSEKNLNLPSNLNSQIIKAIEVDGRDDPDVFNYVKNFVFNKLENEHLPKFLDFMATRNINHSNFWRIILGFFFLFIGFWVSFIMVFLNYRKGLRPVIIIPYFLAFYFLISSIYLIDPVMAWMGISETFSKSNGRLLMKIREKFIYRFIVKRSLWVLFLVLIFTAIFTVLFSLVPGHRL

SEQ ID NO: 16153 - protein, 164 aa, Candida albicans
KNCSVMSFVIRDNEYNSYNGTLFYLVGVLIVLYAYPKDISVLSILLLSWADTAASTFGRAFGKYTPQIASGKSLAGCLASCVTGVLTAYLWYGYFIPQYNYWNQPGEIYWNASSNKLSLPIYSLLIGVITSISEVIDLAGIDDNFTIPVLSGTCIYWLVRLTQQ

SEQ ID NO: 16154 - protein, 236 aa, Candida albicans
FFVFNFLDKLFSLLLSTDYKVYTYFSFFLSSIFFYNRENENEITKYPMSSVPSSPIRNDSSFMVAEGQEARLRKEIKKTILDFDSNQSYIEEEDRTYIYNNSSILDDDDELEDAEAEDDEDSYELDDTEIEIEEDDSSIVLEKVANSTTDFSKDSNSSATEKPSLTFYQFFKKHEIPRKLFHSSIGVLTLWLYTIGVTVPQLFIPLGSVFTVLLVNDLVRLNNPVLNEKIVASCHL

SEQ ID NO: 16155 - protein, 455 aa, Candida albicans
TSIRSGKKEFKVAAFIGIYFLISHVVLETTDVVNEKGLKSHLKVLPEEVIDYYGKQPFSNVDKYAYMQYATNYDYLNLAIINFIHLRKANTKIPNLVIIYDEVLHYYASDKWSELYQVANQYKITLKAAPLIKASYQDDSNWAASFTKFHIFNQVEYDRIVFFDSDSMLVDIPNEIDFDNMESRFNHIDELFKIPQELSFALPQAYWLNNVVEGKSPRPRKNVEIPNKKRYSLRMKKLVNDLSIYQDFNLLPLLIYENHYFDNANHFFANHIMVITPSKNTFQELMRYIHNPWWWSITNRGSLRKPNDYDMEILNKYLNNELQRKRINVGILPHRVYGVLTGEFGEEWHERFVVKPQYLPFINKKSNKGWLPLEFFKKIKVVHFSDSPIPKPWEEENNEEHYNIKKIYCDKGDMEKFHKDYPVYKPRLTDDCDSVLIWNWFREQFYKERLGYWFA

SEQ ID NO: 16156 - protein, 123 aa, Candida albicans
PRLINIPALGSNGHVRIGVPTGAARILRMQFKLPVTERSGLGIAWDDEVPPTYEDVSTLSPPTYNDHTSSSFTITPVMSDSERPTPNVLYGRGETPVIGNFGLDLSHVNSIDAMVDNIQEFSL

SEQ ID NO: 16157 - protein, 503 aa, Candida albicans
  UNSURE (18): Identity of amino acid sequences at the above locations are unknown.
ATSFPPGEHAYPFSHLLXGSLPPTSKLGSLHSQSFIKYELVAVVTDTDGKVKKLVIPVNIARLIIRGPDRNSVRIFPPTEVTTNAVLPNVIYPKATFPIELKIDNIVSSSQQRRWRMRKLSWRIEENTKVRAYTCEKHIPKLQMVEKAYSKSSKANLPHTTGTKTSSMHHSTVLTNISLMTSPSNLESQPQNLDDGIPDSEPLNDAEHDIEETIRSGPSHAHENFIEDFVNPNQRNSTTHELDLSVQPSIQTPQPRDTDKHLYLEETRTVSYGDIKSGWKSDFSGRGKIELVANINTTNCSTGMINHINMLSSEDAPIVLDTKKGANFSCDIDDPTLGVFVSHTMIVEVVIAEELVHNLERKRAGSGTSKDLAPVQSRSSVVSNDGGKSSSNGPVQMGVPTGAARVLRMQFKLPVTERSGLGIAWDDEVPPTYEDVSTLSPPTYNDHTSSSSTITPVMSNSERPTPNVLYGRGETPVIGNFGLDLSHVNSIDAMVDNIQEFSL

SEQ ID NO: 16158 - protein, 345 aa, Candida albicans
VQKHQESFIADIKVLLLSITIKYYAMNIDNTNDISSPPTPIHPAPNEELTNGVPTNTLLADSNIDLNPDLYEEEEMDIEEAKSNIVDEIPPENLTSNDPALQPQTGNAFNDNINDATTNADSDLEDVEINQLHQITLPFNESYQLLKQEFQNTLTNLGQSQITSAQQSKLINYIDETLLQIQRKFIKQQTELEINYSLIQLLQELSTVISVIWVSIQQKLVLYGQIEYYIKILGDLEDYVNNYKTLFNETWSKNNNLHINMQNLVIFFKFWQKIDLQLSFLIDGYNIVLNNGNQQTKLIKMNVTELTRLLPIVTRLRIAIISKIDGLRMRLMFTMGWTIPPYIAD

SEQ ID NO: 16159 - protein, 284 aa, Candida albicans
FGPNFATCVVMGLAIDGEVFWIRLLEEKDYPNKGAIPVYTGLTTGFGGTVSSFSSVILEAFNKAADTDIGVRHHYPNGAYGIMQFLAVILAQFGLSIMGFHMGKQFLAVVDNYLPLVTKRIYKVLELTSMILGVVLVVITCILIGVKKQGSWRSWTFSMLFAPFGALLRYYLSKFLNNKVSNFPLGTFTANFLGTLLLAVFTLLARGKLPGGKGHIVTNTIALHVLEGLDDGFCGGLTTVSTFVVELFGLKTLFSYRYGTISILVCFAGVVLILGSYNWSVGLD

SEQ ID NO: 16160 - protein, 531 aa, Candida albicans
SIFKYRHKNYCHIVFGYVYICFFSPWWQTTKRQLVLIGENKIYIRVFEYNYNSIICNGVSGIFSIIGLRSTLIIAEVIPFLVLAIGIDNIFLIVHELHVISEGNPNLALEVRISQALKHIGPSCFISAVLQVCMFLLATSVGMPAVKNFAYYGAGAVLINFSLQMTCFIGLLALDQRRLEDNRVDYVPWVTISPIQLQDNDEIDEPVHLEYNFSRWIGDHYAPFLLKKTTKPKVITLFVLWVGISLSLFPKIQLGLDQRIAIPSKSYLVNYFNSVYDYLNVGPPVFFVVKDLDYSERLNQQKICGGFSACDEFSLANILEQEFKRSDISMLSEPASNWLDDFFSWLNPDLDQCCRFKKSTVFEKTPEFCSPNAPQRQCQSCYLNHNPPYDSSMKAFPERDFMFYFNDWIQEPSDPCPLGGKAAHGQAISRTTEKIDSSYFRTSFAPLRGQDEFIYAYKSGNNIVKEITKLIPSMDVFAYSPFFIFFTQYQNIVLLTVALLTVAMLIIYVISTFFLSSFRSSPRRWKVRTCG

SEQ ID NO: 16161 - protein, 642 aa, Candida albicans
EFFSSSLILQAMRAICLLLLTINLAIASVSLSHKPGYCNTYGNCGKKSVFGKPLPCAEFVPAVKASQESREKLKSICGKDFDYICCSPEQIDILELNLKRVDPLISSCPACRKNFYDFFCQFSCSPNESQFVEIIKTETARDTGKEIVTEINQYVEPGMANQFFDSCKNVKFLATNGYAMDLIGGGAKNYLQFLKFLGDEKPLLGGSPYQINFVYKLPETDSGLVLRNEPLRDCNDKEYKCACTDCEESCPKLPHAKDLTKKCTVGVLPCFSFSIIIIWSCMIVLLGGYHVYLAKLKKERRRSIAEDSEDDESTMINPLFYAGLGKKRAKQFLSEIGLKIQDWFANIGYFCSKFPGISIGTSLAVVVLLSLGLFKLQLETDPVKLWVSPNDPAYKNQQYFESNFGEWFRIEQVIVSSKDDGPVLNWDIVKWWFDKESQLETLNENVRLSDICFKPLDETCALQSFTQYFQGDISGLTETNWKSKLQSCVDSPVNCLPTFQQPLKPNILFDSNDISQAKAFTVTVLVNSDTQNENYTSNTISYEHLFQKWAADLQTEYPNLNIAYSTEISLKEELNQSSNTDIKTIAISYLVMFIYASLALGGKLPSANLYSLVKTRFTLGFSSIIIILLSVTASAGSFLLLD

SEQ ID NO: 16162 - protein, 574 aa, Candida albicans
VDDAITYISKMIEDILFSIKYQNATKDILEFTTATILKLRSRANPDFLDVLKNVGDWRTNETDNFPYNKEAEDVIAASISSMGPEVVLSVLPLNLTGENGGPGRAWLLPLLRDNVRFAELDFYKNSILPNIEFFDTKIEQSNNKESINSKIFQTIVDQIWSLLPHFCDLPKDLTSAFDETFATKLSDLMFAKVELRVPICHAWRLLVESNVAYRDGALDEDLLMQQEFPKEEARKNVGYLSTIAGNILTVLFNVFTYTVADSRGFVLETIETYLNIIPKDELATTFDKVCGMLKQAMDEEAGQTSQQQQQQSKTDIPSTSITMMDLIVAMAKYVPESSHNALFSIFVATVSLVKNPLMQKRAYRIISRLAETETGKQSILKFIGEIERVLIETIEQTHNSARSSRLNAILLVLELLPSTDLYFIPAILQEIIMATKDVNERSRGLSYQILIKMGQKMNEGGVIENSRVPGFDSDAPNSSASLTEFFTMVSAGLAAQNPHMISATITAISCLIFEFKDVLPTDVLLEIASTVELFLTHNSREIAKSAIGFVKVEVLSLPEEMVKSSTTALEDQAL

SEQ ID NO: 16163 - protein, 322 aa, Candida albicans
KTDRLFLQLTTKLVMNDNNPDGGLSIDSFELEDKLSKIRSQTNSKLDNQKHLAIILSAVEENIEEQKNDKTPVAYFVSFLSLLDQCISNDQILDSNLAATTAYFLDLVFPFTPKPLLKSKFNQILAKLAQPLTLENAEAALVRSTIGALESLLLAQDGSSWNSKGQVSPKRAFLALLETSFDPRPKVRKRAQEAVSKILSNPPASPSPTHVAAPLAADAALTQLSTLLNTYKTQKKNKEVNSQIIHVLQLIKMITSTNSWPVNKIEELCDILLEISKTSDQFLVSSAFGAFEGLFQSMTDVIDVEKFTRFFTYGTGRCRATC

SEQ ID NO: 16164 - protein, 261 aa, Candida albicans
EQDLSDLLSKLMRWSHEHKGHFKSKVKHILERLIRKFGVEEVERCIPEEDKKLVANIKKSRNRAKRKQEAETEAEGETGSKTAGSSHNSEKKFVSAYEEALYDSDISEDEVDIYDEDANRHRKAGKSNQFILETGDEPLNLLDRQALAHISSSKPKKFTKQDLQNRKEEFKTKNGKLVFKEDNEEDPLANKGSGIDAYLDAVKQAPIRGQKNKLKFKRSRNEEDNWSDDDADSTPVLKKGKTLGKSKISKPKQKFKAKKKL

SEQ ID NO: 16165 - protein, 909 aa, Candida albicans
DNLTRYIIIMPTSCLLVGSNPNVAFYAWRFYQSNSVAVSIVNSSIDSKSPITWKSSQLGTSQYRPDNSYSSFKQIPTTEKFDIIILSCSSLQDFQSICQGLTHLLNQDSIILVELTGYIKLEPYVSTNFPNNPSLAVGSIMNESDVRMVSRNEYYHQIRNKDSRIYLGCTSSDSASSNIANNKGFQKVYKLLQTVQEESHGSITLLKSVNPTEFTTYQWKLALPRVIFSPIMTLFELTFPEALEKHILSKPLITGLINELFKLIKKMGCKLVKGFENEKNLLNYWESVFPQTKQNENYINSPNFFYNFHKQYDLELDLLLLQPILLSDDSGVRTPYLENIYSTMSQFQKMNSPTGSLFFERKSGSKNTSASNGASSKQLDDDIQRKVQQQKKLDLAIKDLDIAKISLDNDMIKQEMNLKSIQQKIVDAESKLSNLQYDQDRKTKSIQYENDEKIKQLIDDHERKYKSLDEQHQQKIKSLEQEHMSLEAKYKQKIKELEERYNRKNQSIPVNNTSPVSIPAQQPTPVQDNIVSSTKNVNRDSVMTLDGFQDYKHLVECEGAIGPNTPVIQQKPQNSPVTHVQRNGSDNFVDANNGEAQSYRPSQGDRESQAQSQPQQRHQPQQYHSYNNGSQSNGYASSEQQYYDQNQNQQHQHQHQPPTPPQQQYRNVPPPMPHYYYNNNNNNNNGTIPPPQQQYYQNNNQPNSRLLYNQGNGNMYVNDQAPLHELPNGGMAQGNFPSNLRSNGSMPGPNKYQQYPSMHSNPPHQNMQQKRLDSLTGSISSYYDYQQQQQQQSQAPPPQPHQHHSFNNAAPIDPFLEQRFKTNPKKSNRRSQMPLAGNIDGLDMGGRGGMPLPGTNRKSMNVINNYGNGNGIAPASRRASSGGPFMLNGNGSQQAPQQQQQQHLGPQYS

SEQ ID NO: 16166 - protein, 164 aa, Candida albicans
NIKRVPKFLRSYAKQFINAPFSHLISFLILHEITAIIPLFSLWYFFHNNPSFIPMEIPSWAIDQGAKIIDYALSKITNWEINSKDKMLIIIEGAYAFSIVKFLLPLRIIVSLSLMPWFARWFIVPILNIFPNFTKLLNYKKIKQKQDKTRFDNAKIKHVEKPRL

SEQ ID NO: 16167 - protein, 490 aa, Candida albicans
PGGEDPMTTTTNLETLLEQNESEQIEGYQCIKCRVSKIAMNEEHLKRQIPLEDVDYINKIIDLNNNPNLCINEDLPEDLENFIKNYNVEGIDASRITSTVQKKSQILKPPKIFGLHLSRSSFDGQVVTRNSCRVKFSDKMTLSIGKEYHDKLKQFQTMVQKEDEKLREKYTSNVLTTDENDMEDEDVQREDIDEKGEEDDDEDDEDVTTDDGTATENGTDDLDDETDEEEDDEDDISSVMSRETETQSVTTSSTIRPNSGPTGLSQEYSINLAPISHKQTDNLKELFKRFKFNDNDLYKYRLRAVIKHMGSHTQGHYECYKHKPLYVKDKNGNIFKLSPEIKDELTGEIHCEATPVELNPAQSNANNGSATMRSSSSGSSENDEGFRHKFSTMMGRRPSVFQANPTGVEEILLSGLQTPAEILVDDPNQNNFENAFATHNFRDAFNGNKDTATNKKQEEEKKVKMKKIPSIISKPYWRISDATVTEVSKA

SEQ ID NO: 16168 - protein, 92 aa, Candida albicans
  UNSURE (34): Identity of amino acid sequences at the above locations are unknown.
LGINLKWVLSWASMLGVRGGGFIWWVVLFYKNGXGPNGVMGTLGQYIMGSVGTFGLFMSMGSVIRSESGFQNYEKSMVAMQRAKLRAIYRDE

SEQ ID NO: 16169 - protein, 231 aa, Candida albicans
PPARIPSFSRRVRLFMNIRIIGFDLTQKLVPGPNPQDISFLPLNAEFNNMVNQISSIIKNQLRSNPTKVIRLIIPSILNPSLYHPSCSSSTFIVPFIHSLRSLVRRFSNNLVLVCSISLDLYPKDSSLLLCIQSLFDAIIHLQPFNQEMTQLLEKAYKNEPTKIQQGLVNIIKIPILSEKGLMMVHDGEYAFKNGRKKFEIEEWSIPVEDDSKDDTHQTQEGGTTTKNIDF

SEQ ID NO: 16170 - protein, 120 aa, Candida albicans
RAPPLGRTPPAVTGKGITTTTTSSFQLKSKPKSIEKDNATQIMQNPGVRPSLVTSQPTTSTGSSDLDKILLHQRLPLGNSLLIEESCTTDFSSVLLRAFASHGILHNIISNDINAHVIVL

SEQ ID NO: 16171 - protein, 452 aa, Candida albicans
IPNLRNTYQKPMLQPLSIKSKLGLGLLLSYTSYEVYMQVRTQYIIKARKEEYKNLENGTDIDISKFRSTSVGGMFVNPFEEYRPQTAFEFILVRIMQLFESVYGNTIELHKKLPQPHDGAVEVEDILKVFKPDLERFRKNSEVLKKCIESNNFLQLKVKPSWFNSIPLHQQLLFTWLGQSCTLFQILGVNFLTDPIISEHLITPSIGPKRLTRSPMDLDQIKFATNDSLNFVLVSHDHPDHLELDLAGKIKNTTTWIVPLGLKSKLARKGIYKVIEMDWWDTIDITNYISDNLSDKYEIECVPSMHWSGRYVIDSNQSLWCSYVIKRNGESLVYHAGDTGYLKELFDVIGKRCGPIKLALLPIGQYCPSWHQKPRHISPEEALRICSQVQASFMKGVHWGTFKLSGEPILEPKNLLTELAQKIGKAETYRVPEFGLTYLFDLQNNTETEIHV

SEQ ID NO: 16172 - protein, 416 aa, Candida albicans
  UNSURE (5): Identity of amino acid sequences at the above locations are unknown.
RKSIXVGVIAQVYLGKLSPKVLERAKKDEDKLVKQLKLQAEDKQEQFFENIVVTEHLDSNEFVAIKVLHPNVELKINRDLKIMKFFANVINIIPTMEWLSLPDEVEQFSILMRLQLDLRIEALNLAKFRENFKSRLDIHFPKPYLNFTTRDVLVEEYIHAIPLSKLLSLSENYGKNLSKEVSDKGLDAFLKMLILDNFVHADLHPGNMMVRFYKNELYRHKKEYKIVKTSNETETNKITNELLKLGDNTNAWCEKLSELYEQGYHAEICFLDVGLVTELNKEDRINFIDLFRALSEFDGYRAGELMAERSRTPETVLNKEIFALKVEKLVDRMKQRTFTLGNISIGDLLDQVLGMVRNHHVRMEGDFVTVVVAILLLEGIGRQLDPNLDLFARFVYALLFGFPTEEMELFSLFLVQ

SEQ ID NO: 16173 - protein, 303 aa, Candida albicans
RPSKLYSQPQQSFNSEWVEDQSYNNSPSKLSTLLELELERERSNNINNMSGTVRSIDPSKFETPSKASSNNNHNNNALNFNYINTPVSNHKLDINNTSTNKDNYHYNDNNDEYIEKASTTSSSTTITTRLPKVSNWDIFWSMLNDLVGKDKMAKVGQYTLRLLVYHAGKSQTYLSDNNINIKIINERYNDTTKKLNLLKNFFNHPADFIKIIVILILSIFKQKAAGMINGLSMYRQFLRFGKTPFRIRDLIVKFHHNVFNNSSDNQVQINKSKIFDRKTLGQFLSLYYGINDGSILLYNAHQP

SEQ ID NO: 16174 - protein, 498 aa, Candida albicans
LMLVSRLSVNTVRPKFAHNIATTLSKTKKKFIKSSSDFDKFKIRYDYTSQFEIHPKTKSMYFPNGALIQSFDLFKNEQNFIQHGAPVLGVGKVRSETKLLDPLVTLLKFTHDGEWMCTFDEFTNTEVDSLLLKNEKQYALKFWKYVGHKENATSGINNNNKTGHWELTTKIIDPHGMNPILAMIPAPTSYFNGLAFLTADDKGGLRIWRPSVPKEQYKTTSARSQQTAWTLRKSRAPSALSSDAVALSWSDDNSLIFLAHECSILTIDSKSFEEIPDFKIPSLSGSRVRSLNMVNNNLIVLSKTRISSFDLITGELTSLVAKVNTTIGAKNLIAIDPIKRLICLALNYYSEENNTLSIKSKILIFKPNQLKPICVQLHEQGVSSIRYFNSSFVFVDLDCRVGTIYSNEEITETIELGLTQEINNMLIAAQATADVINDRNVKTTVGHQNGNKEGEMDIDNSMAYAAKVVDLHTFQPIFQNIEGVQVESLFERIVNVLK

SEQ ID NO: 16175 - protein, 345 aa, Candida albicans
TISSSKQKNFIETFPKKEKGALTSFCTSGEAILFTLIMPSAISEWSLSMATGGKPLYLPCSQTTASVYSQDGRYVIIALTHQLRVYFISTRQCIKTIDLDLHDLADLKIDVTNGNQVLLFKTSGEILTVNWKDKVSQPIISTIDINKTQSGTSLPLLSVISVKHLFFIIVTGRKEKKKGTPHTRYINYFDRNLESLVPIIEVANSINFATSLDNTKIAFITSGNEIDLFDLSGIFNVDSIENLSDNDIVKETIPFVYRSPVTSIAVSNDSMIAIGTSAGPIQIVYGGLTTPKPQRVLKWHLDQVKGLMFTADNNYLLSGGMEKVLVFWQLDTEKKSSPGEGGSAS

SEQ ID NO: 16176 - protein, 351 aa, Candida albicans
SQKLLFKTIKIMGCGELLSVPLVFLSLFSHENVPVLNTGTTDDDGKCELIGTFSLMTQAILGMLCLSSLLIKRFYEYPIRRTWPVWIFDVSKQLIGALGVHIFNVILSMVKTAPEIWLTQNNNNSSDPDDDNTKDPCDWYFLNIVLDCTIGVYILYHVFKTMNKICRDYWHITQIESGEYGPNPNKPSTKAFLKQLIVYFTSLMITKIILYGLVECFETQLLWFTSHVLLIWLNEYPDEFEIFIVMFIVPIIMNCLQLILIDNFIRNQMWININKRMRIEFPNFSDETESVQQQDIIQAQREEEEEEEQRKYLLMNDSTEGGNNNHSSSSSNDTLLGESHNKNNYGSYNDV

SEQ ID NO: 16177 - protein, 333 aa, Candida albicans
GLFSGRTISIPKLFLEGKAKDQGNRNLFYGYFKRNSSRKSTTFRYEIFDNDLVDSTKDKSILVFDIVNNFELKRTLRLINDKINESLLVESFIKYRNLIIVWSNDKSLRAFHYQNGKEVGVAWGHLESVLELYLFNDHEIISIGNDACLFYWEVIENLKSSSSSSSSSSSSGSSAGSVISQDNNGKEIPEKQISAPLYTKVTRKILPTAPIKPIEKEGQITPTKINPTTTTTNSPIPKLTAATLKRLEAKQNGAGHTISPSRSISPIRSNSFPNSNSNSNSNSYSASTYSAPVKLSVRTLNFSKLQSPSKTPVINTTFPKRLISPTRTDNIKT

SEQ ID NO: 16178 - protein, 311 aa, Candida albicans
VLGGGLYHGNGEYWLGMNLFQQIELWENFHRGKHIWSGDVDNVELNIAVTGGADGKVRVHDLTQQDRQKFSLAEISSNISLNKSDFIRDYFELPEFLVLLMSNGYLLIRKDNTFTSLGYFEEFDGFGIVSGFADLGVVLVCARDGRILSIDGSATPTWITNPCNNKIVNMLLDTNCGRHFVLLESPNPNVPFTLHELTYTTSLQISKTWDIPKPELRFSVTAMTIDTVHQKLILASKKVTIGVFDLETLAATVFRKVSPGDSVSSLSIINTTPKSLQVLVVARDGFYTIADISGTSASNILQQIFTTGRDP

SEQ ID NO: 16179 - protein, 276 aa, Candida albicans
  UNSURE (12): Identity of amino acid sequences at the above locations are unknown.
YPLPTNSGTSAXDLFTNRTKSTRGVIEGGFMNNNDLILYGFKSSYFLVWIETKQMEIMNEQCGGSGHRHYKFYHDAAEYFKFIYTLKNELCIRTHHVRFSNTFGLIQNGTHGREIRDVAISSDHKLVATSSEDSSICLSKLSDDGKLVNVWNMTNHVSGMQKIKFLSKDFIASSAANEEFIVWKLSWSQDLPMLMEYNRLNPTKEIPDLRVMDFSSIKSDTGFTIATVYSDSNIKIWQFDLDSGLHLLKSWFYSTCCILNCQFLNNHYLLISILHR

SEQ ID NO: 16180 - protein, 484 aa, Candida albicans
RQQQHQQQQGLPGMVGAPGQEAGNSRTVYLGNLPNDLEPHELLDYVRSGIIENVRIIPGKNCCFISFLDTNAALLMHSEFILKKINIKGYNIRVGWGKNTTIQPGVLQAVTNDGATRNVYLGNLSPLDISEEEIINDLSIYGPIECIKTIPEKGIAFVHFLSIASAIRCVNNLQSEKYPKVYYGKDRCAFITKTQQHNAAQYLGLAPGMEHIVTAADREFISLALVQQSAAAAQIATQAGGANNLGNRTVYLGNLHQDSSIEEICNVVRGGLLQSVRFLKERHVCFITFIDPIAAAQFFAMCQLHGLTIHNRRIKVGWGKHSGPLSNALSLAVSNGASRNIYIGNIVDFEYFNPAKLREDFTKFGDIEQINYLEEKNCAFINFINIANAIKAIDGIKSFEDYKNLKINFGKDRCGNLPRQFQNQLPLSTSLSSSSPSPTKNQSSAGVTPAFANDHDDDHNNPSLLTPQTEISLGFTFINDRFLI

SEQ ID NO: 16181 - protein, 207 aa, Candida albicans
  UNSURE (12): Identity of amino acid sequences at the above locations are unknown.
SPEIMRIGPSLXKDTVRELLQWFKKYIDTTQSNDHKLQLDIKRFNPTKITKFIVQDLLTVHDDISWWYHRIQFGIWDLNFLKYLNQSDYFQDKFGKVNKFGYDQFDIFNISVNWRDSIHYINYNFYLDESSPVDRVKIKLTGVSLIYISTWSVGFLTKFVPLLRIQNLKLYSWTVNNKLQYSYLNKVGKLANLVEYGVISDYPDVMA

SEQ ID NO: 16182 - protein, 226 aa, Candida albicans
  UNSURE (217): Identity of amino acid sequences at the above locations are unknown.
TCLDRLVKTIRNRSYDELDIELKFKALNILIDLVISSPLVRNHIDSCLENLTLLRRNRLDNLKEYKIVLELAQKAHQYITTKLATTKNVSQLDQSSPEQQQQSQQQQPQQTEQISEIKKGLDLNKLELSESERLLAEQDNEFKEQCNIRKDAIIKLNQLKEAKREIEQKLTELDCQRMKLLGKDRLYNRYWWFENNGLPNLHSGGNNNDEDDDDDEXHDHHQKDES

SEQ ID NO: 16183 - protein, 1186 aa, Candida albicans
  UNSURE (1165): Identity of amino acid sequences at the above locations are unknown.
DVKHKTIFFFIFINKLPLYPPICHTIMEQQQQSNKAHRGGTKKPGAKKKLHQDGQNKKAFAVSAPRKLERMARRSHDVNEKKLHVPMVDRTPDDDPPPVIIAVVGPPGTGKSTLIKSLIRRLTKTTLTEINGPITVVSGKRRRLTFIEVNNDLNSMIDIAKVADLVLLLIDGNYGLEMETMEFLNIAQHHGMPRVLGVDTHLDLFKSQLTLRTSKKRLKHRFWTEVYQGAKLFYLSGVINGRYPDREILNLSRFISVMKFRPLKWRNEHPYLLADRITDLTHPQKIAENSKCDRKVAIYGYLHGTPLPVENAHIHIAGVGDHYVHSVEKLPDPCPTPYYEQKLEELERERVKNAAASGEPLAKTTRRRKRLEDKQKIIYAPMSDVGGVLVDKDAVYIDVGGKEIYKTGTGTSELKGEGEKLVNDLQEISQTMTERLEDGPGLQLFSSSKALNQVDEDDNNEEEDDDDDEEGLLSDEETIVDTGRSSLRKARVYGKSVSEDDEFDELESDEEQDGDQFSDDEDDAENNLKSRGMVEVNFGSNNKYKENDLEYVEDSSLSSDEDYYKKSAAKLTGSVRRKWDIIKLIYFKDIDVKEVIKKWRNNDVQDDDDDDDVEEEEDIVQDNQDFFVKKKVQDDKEDLDTSLPRFPTLEVLKAKFNPNTIDENNSDDEYENGYNILKSRLLVAPKVTDETEEGKEIKENDDDDELYGDFEDLEATENQDQEEEQNKSTKTAEDEDDFADFDAEEEKEEEEDDDNVDEESMTTEEKRQLNAAKKAKLKMQFEEEEDREFGASDPEDESETWYEYQKNKMAKQLEINKVQYEEMTPEMRIKIEGPRAGSYVKIVFDNIPCEFIDNFDPAYPLVLGGLLTTESRFGIMNARIRRHRWHKKILKSQDPLILSLGWRRFQTLPIYTTSDSRTRNRMLKYTPEHAYCFASFYGPLVAPNTTFVGFNIVDSKSTTGAFRVAASGIIEDINSSVEIVKKLKLVGYPYKIFRNTAFIKDMFSNSLEVAKFEGAQIRTVSGIRGEIKRALSKPDGYFRATFEDKILMSDTIFLKTWYPVKVKKFYNPVTSLLLGQHSEWKGMRLTGQVRADENIATPLNVDSQYKKVERVERRFNPLKVPKSIQAELPFKSQIHTMKPQKKKTYMSKRAVVLGGKEQKARDLMXKINSIIHDKEPRDKPRKMRNL

SEQ ID NO: 16184 - protein, 488 aa, Candida albicans
  UNSURE (18): Identity of amino acid sequences at the above locations are unknown.
RIVATGYTWFVLIGYLLXVLLVLVKSVIILLTRAKKINPRTFNSFRGSFPNLIKGSLLRYIAIGSTQLIIFSLWEFTQNDSPAMVVLAVLFVLLLLGVLGWSYFNVMKIGRQSIRTYNNPAALLYGDNKVLQKWGFCYTMFHANKYWFGVVLMGYNVFKALFIAFCQNAGKVSVLPIFVADLAYTIYLIWTGPYLNKPTNVINYMMSIVTTINSFLFLFFSDLFGQPAPVASIMGWVFFILNAAFSLILLILVIVFVLLSVMSKNPDARFAPAKDDRFSFQRKSSIKHKSLTEKTGFSNTNGGHGGVGGGDEELTALGVAAQDHSADWESQMYKLNDLSLDEEDDSRTNQDFVRPDKTRELTSDYDDDTSFTNEDNTRVVNNEEDKNKKLAEKWKSKISRKLSKKKSLKDKNNNTTTTTNNNITTVRRLSDTLLNDERDSNEKREENDELSPITHPYNQSTSFNNHKREHSTTSTISNNNPTHTKGFI

SEQ ID NO: 16185 - protein, 213 aa, Candida albicans
HLDTRKIYFPSTSLFYIMHYHFSSVTSTSLNRYLFYRSFTNTVLYWSSSQFHIRLKFTTRSNCTTTITTTTTTTALLSRHFYSTFSIFQRPMSTSNNKLSKEISPPPPPPGQDSHSHVHSHSHDSEHSHSHSHSGASMLHHHKHSMHEPNELLAGGASAIKTNPAVRITWIGLLVNVTLAISKGIGGVYFHSQALVADAIHYSRQPRAGKDPR

SEQ ID NO: 16186 - protein, 186 aa, Candida albicans
IGTFYAVVRTTKTKRNDGNTLLGLTYLIGSMILDGLTNSTQDQLFKLPLENKLTSGKLMSLLNLFIFIWTSLYTIIFHKYEIDYTINFINNYPELLIDIIGFAICGAIGQVFIFIILEKFDSIILITATVTRKMLSMILSVILFGHHLSWEQWVGVGLVFGGIGLEAFIKFKQQSQQKMKIKSKVA

SEQ ID NO: 16187 - protein, 209 aa, Candida albicans
  UNSURE (8): Identity of amino acid sequences at the above locations are unknown.
YFNICYPXLPLFETRNVIIHTGVTLNLLTVIAALQYCIVGLIFYPNTGVIGLSGIAFLLMSYMAYHESKFRPIMHTFHLSNSLEIKLYTLYVPFVVAIVFMILFPSSSLPGHLFGITTGYLLSYGYIDKLYPPSKVITTIENKLSSLINFLELIVTFYKEEESLVTRGSVGYKPLFNQDIEHGAANAASHGSSAFVGETRVLGTRESTV

SEQ ID NO: 16188 - protein, 187 aa, Candida albicans
SIYHTTFFYLLSNMTYSGLVTPHSRPTTPSFGLNSNAATSATSTGPSNSSSGSTPKVIVPSYEKPIHESLSQIYKTLLELKNNRSKYINSKQIYKIYHEFLDILNELKVTRKDEELKGITLNLPNTNDLITDDIFQLLSLCFVTCGLTKFAPATYSSLSTVMKLLNHLKECKVYTVVLHRRTGRIRA

SEQ ID NO: 16189 - protein, 234 aa, Candida albicans
KQYAQTDLYSYQKQLKTFDEQRLNLVKQTNKDDTKAFKKSQLLILFLLRRCYGLVYKLLESSEPVSESITPIHNQLQTVKRCLLELKRVDGLNNLKELYPFQFKLASLDNLRQDGKFIVDGSIPEGQGTLNALLAECLDIVQELKIELEEIEIENGDEGEDDLTGGSFTNSKTIGNGDYELTDDDVEIKRNRFHDFNEADYDLDSESDYDDDDDDDDDNDYSISESEYEGNDYY

SEQ ID NO: 16190 - protein, 415 aa, Candida albicans
SNNNSQNQLDEFKTDSVDSFTIEELDWVNTYVYHPELSPLQKIKYFSMSFYSKYIKPNIGLSLLLLSQFLNSIMVTTCKLLVTDKNFNTPIHPAQILFVRMFITYICCLLYMAITRSVPDAPFGPKPIRKLLLLRGLVGFFGVFGMYFSLQYLSLSDAVALTFLVPMVTAFLAFVLLHEKYSILEAICSVFSLAGVVLIAKPTFIFGNESNKETGNDETIESSSSEKRILATIVGLIGVCGASSVYIVLRKIGMNAHPLLSVSYFALTCCIVTFLAILVIPSLTFVLPTNAYQWTLFFIIGFSGFFMQFSLTAGVQRVKAARASLMAYSGMIFAVVWDLTIWHHFPGILSFLGITLIIGNAIIILKFKPQQEEITDKQGDDIERNGKYNRVDDSITMQDFIITDDEEDENVRGRT

SEQ ID NO: 16191 - protein, 970 aa, Candida albicans
SPINKRGSVQSVSEDSTALTTGMHISNILDDRLPQPLSPAPPSHQQQSGTSTSRKYSIKPHASPQCANMVHQNTLPSQTQSNVRMSTNGILQNQKLLQNLSNSIPAVPTQQSSPGYQTTIQANNFVHIQNELNNFNNLNNLNNLNTLYKSYGTTIPQNDILSWLFNDSPQGNSLVQSSPETQQSMPRRSSQPLPSLQEQEVQSQVPLTSQFHPIPSPYGGSQFSPMADQIQSGLSVPVSSALPTGIPNYPFDMSAFSNGYGADANIFLTDDNPLDNILYKNYHTLQNSNQLVDTSKDDSLRSIGVSISSASPTNTVESSNDNTTENAQEEEHVFFNHREKNIPTNRHCFIEPSILNLMLQSIGVSRQDLPFDSNYPLEHRFSFYLYLYWKHFHSQFTILHKPSFDTKSAEPLLLIAMVSLGACYSFPENALLLAKESKKSAEFKFALQLAKPLRFSIFEHEDFKSPVKLWILQSLNMLEWVEKNFLTRRMHERAHLHHGTTAQLLRRSPLLGGNPTHRKKSHANSTSSSAGEESELEDKNNTSDTTDHDLFEKWVESEGMKRITFMTFYLDIIDFIKFRHNPQILFYQLQLLNLPCDDEHLWELTEVNGSFKKVVRRQRKLQDSNITTSLTTSNKKKKAKSDNFLAALKKILKSDKLIELKNKSIFCQKILLAGLISLMHQMQQSELQNSSSLLTIHNSNSNSKIWKEMLIRSFDNWNFEVMQTFKRSNNMGISMYSVPNSNVAFPIFYLTQIIGLPEINHYDIAIFAGSPANQSVDATLKDHFMVQQKLNNIWSKNNKNIENIRGIFYCYFFLWTLMIDENGNKLDWNPNCDYYDTVNAVSTATLVLWSYCFTVGGLESNKYTDGNSAMDPTICAEDGYDYLSRIMSTLLASQQSDKVNFGLVAKYCEVLQLIPNKQNISGLCFLMARKLMTSQWEVLREHAKLIFNCGYRSIGKRSVLCPDLFDNEFQ

SEQ ID NO: 16192 - protein, 100 aa, Candida albicans
KMPPLDSPSSNTESTPTSNDDQVISKKRSQSISSGGRKKKRSLGVFPCTHCDKVFTRSDHLARHNLNHETKEVYVCDFVMDYHGSKSKCGKTFVTKDLKG

SEQ ID NO: 16193 - protein, 156 aa, Candida albicans
STKNFGVLDQFEQRSGLPRSYAVLGAGGLYFFLILLNFGGIGQLLSNIAGFVIPGYYSLVALKTTTKDDDTKLLTYWVVFAFINVIEFWSNTILYYVPFYYLIKTGFLIYLSSFGGSTLVYNSVIKPLSDKYVKVENPIASKIQETAEGVSTGVHY

SEQ ID NO: 16194 - protein, 578 aa, Candida albicans
RRDLQGVWKTEEIDPKHIDLKVINQLGIPQNSIVAVAYDPVQSLLAVSTTSNDVRVYGQLNVEVVFEFNIKHPITFLRFVKGVYLVCASPGAGLNILSLHSKKVLGTTLFPGTVTAMESDPSLDWLIMGLSNGSLMFYDVDRVNLTPFRIDNLQKKIMPKEKMSPVLSIEWHPRDIGTLLIAYQQSAIVYSLVSGEVKSVLVYQLSKDHRGFQLASHIANGGKKKIFGGSKEVIPKLKEAHFHPNGLHAVTVHEDNSIVFWDIASGTILEARNVFDVHIHQPGTPLEIPEVFQPIETVQWVCGEDPENTKLIVSGGDSNSKNAIHVLDFGYTLKYSITSYEKQAEFYAQPQSGQRIIPVTFYLNNTEVEEVIKTILPITENGSPYFHGGHDPSFLLLVSNLGRIYFVSFAEHAGGQGSSDLGTVILPTSISFIHPPLCAFDVEQVRRIDWYSIMSSRASTGATSKTKEMFFGGASVGLNNVLKPIGYDDSFRNILITGHESGLVRFLDVTKGEQHELEGIVQIGLRETLFDYGNPKSLRVIFVSCAFENRELLVALATGEVVVCKFGKNNRNAGLSAN

SEQ ID NO: 16195 - protein, 271 aa, Candida albicans
ILLSMSEISYLSINNAHNGIIIKIPKPVRFHTLSEFKKYIQQSYLIDSVDNLFLLTTFGIKLNYNLINEIGEVFVYDKRLFTNIVDQSLIDQYTQSTFRVSEPTHSPLLKSNVGFLKQNLSSNLKINQGWARIITQDGELMDQYCRELIQQINVIFKCLNTIFQFATNFTNEIEKNFSNFFNYVKLINYKTLHKSWITNYKNLKTFPTFKIDNENIKLSDFLEVDRLQSSADYIEKFLPLIVNKLNELKQVIETVNEEKLTLHHGAGRTRA

SEQ ID NO: 16196 - protein, 115 aa, Candida albicans
LQEDSINDTRFFLNAISKRFRDVEGFAKRQAKDNKLKEQEHRKLVHRLNSKISVNGFQEKDLVVFLPTRIDRPNVENIHSNDKIEPWAAFNIGAPQFFLKIEFSPRDGRSAIKLH

SEQ ID NO: 16197 - protein, 121 aa, Candida albicans
VTVITFCLINTNQKFICSYKHVPAKPRKDSTGVIAQSLPMAAMFMRNKVLSWSALFLTVQSYLNEPINKPDADDGSQPPFVKIVFALVSVLTCYMDVFFPNTNPALRMAAKVATETPAAPK

SEQ ID NO: 16198 - protein, 724 aa, Candida albicans
AQSPLRLISGKYASVVIPSTELPELPTVAIANWIDKLTQVFKEKFTEAAKAKNVEQLTKFFQLFPLINQEEIGLNCYSKFICEIINETSKSLTAGLENAHDLKPAIFSNVVMQLFENISMMLSQHGPLIKKYYSATYPLALSYVISKIQREIDLQVGIIADTFYDLRRLDKHFQDIKLYSFPVLTRRLAELKDHPNQDQESRRTSFDTSDDLLPIRLIGDLIQELSSIFENWTLYCRFITVKYLQEPKHRQNGKEVVTGKSPTEDKDALLLPDLIRKSTFTRKINEKLLPSFETLYKFYFRRSIEKSITIEELPSLDAYLVLSNEPGVHPEQVPISSVVEDLTLVLNNTLRNIIQSGLPTAVKSFINESFGIVQQDLLNGFFIKNLNDNQPRYNQTLSLIDPASTINRTNSPISISATPDVHGGSGGLSTGAGFLKGASSALGSVVSGSGAIVGSLQTTPNNTKLLSFIIYLNTVAMAQEYFTKVFQNINKDSYLQSYYPFGKDKSKISNILQQDFLDPFTSVSNKIISESLINLYNQLIKNKLLLLVNEFFTDIPTANNENNYVIYSSNNINDPTILIKFTSNWQSLMKPYLQTLHKTLWSKLLRLVVVNLTNLLEKKLFMILNKLKINELGAIKLEKDVSYLINEICRDNYYLREKFVRLTQIVLLVGMDDEEYEESNQPVTKARETEEDGGEGRDDFDDEIGGINWVLTPQERIQIRKYRI

SEQ ID NO: 16199 - protein, 442 aa, Candida albicans
  UNSURE (428): Identity of amino acid sequences at the above locations are unknown.
DAVAVLPRRGEYCEMDQVGKPKIKFGTHMFTMKYQLIFNPVTISHLYRHSTSDVPKKNSTVAFTGLRGRFDVCEIDLHQRREYVTHENKKLNRKTKIRHLKMNQAEVNIENADARVIYALFNDTSVTGKLMTYLNADSLDSSTDGSQSLDYRGSSYLRWLENVEISDGDFSWYDPKDFIELEVREPLSPYPKTKILPFFATPKFSYYREFTLQKDGPFPFGSEKIHDCIMNLDKPAIVQSRILLDRLQNLEDELAHNEEMLRRFKIQNGPEFQHDIRMTEQEISTLKEKVEVVRAAYNGFSDDEFGGLPLSSANNVADDDDGSSSLLRSSTGLSAYSSHVTQDQMLQAAAFVSIAEFHNRFILHNLTLKWDDNISKYFISYMKRIAERKSHIYYMTKYAVDLVEKVMQENAKEGNPPCSQEKRCFKSXLNKPTISWIVLKMI

SEQ ID NO: 16200 - protein, 234 aa, Candida albicans
YLPKMDTCPDKYNWPPWFECEVCYDGSWAHEYLVSEKNTIAIIQKSPNQLFISSEKLEQGNELVVYLSKYVINATSAQYSSIYYVITGLLLSNDDKESNYNARLQRLMDLADASDYEGLDVRVHNLQQGIRDYRELLFSFDQKGADLNEEQKKYLHVLELEMERLKLELILIMNALQTRIKATSQLTSKCLQILADQVIWHMLDDDREPFIDFALASTRFIKHESSPRAWKDQQ

SEQ ID NO: 16201 - protein, 230 aa, Candida albicans
RGSSTPWRGYYKLPPRTVYRVQLLSIFVSSFIQLGILNFQINGIKDYCKPGNTQKFTCPGGRTFFSASVLWGVIGPKKVFNGLYPVLAWCFLIGFLLAFPCIAIKKYAPRKYVKYFEPSIVIGGFLKYAPYNLSYYIPGVYVSYAFMSYIKRKYEAWWQKYTYVLSTGLNAGIAFSSIIIFFAVMYHEKDINWWGNTVMYSGVDYAMTGWLDATVDAPDGYFGPRRGNFP

SEQ ID NO: 16202 - protein, 346 aa, Candida albicans
LRFFSSPAVEEISKCWEALQSLYKGIRNFKRSTYEGFDDPHSVMMRAYPEVPEWAYLIILVISLVLAILCVKLYPAETPVWGIFFALAINFVFLIPLTTVQSRTMFGFGLNVLVELIVGYAIPGNGLALAFIKALGYNIDGQAQNFINDLKQGHYAKLPPRAMYRCQLLSVFITSFIQLGILNYQITGIKDYCVPGNKQKFTCPGTTTFYNASVLWGVIGPKKVFNGLYPILAWCFLIGFLLAFPCIAFKKWAPRKYSKYFEPSIIIGGFLGYAPYNLSYNTGGLYVGYAFMHYVKRKYEAWWQKYDYLLATGIDAGIAFSSIIIFFAVMYHEKHISWWGNNVPFE

SEQ ID NO: 16203 - protein, 171 aa, Candida albicans
SSRTFYSASVLWGVIGPKRVFNGLYPILRWCFLIGFLIAFPCIAIKKWGPRKYVKYFEPSIVIGGFLNYAPYNLSYYIPGLYVSFTFMSYIKRKYEAWWQKYNYILSTGLNAGIAFSSIIIFFAVMYHEKDINWWGNTVMYSGVDYAMTGWLNATVDAPDGYFGPRVGHFP

SEQ ID NO: 16204 - protein, 508 aa, Candida albicans
  UNSURE (487),(503),(504),(506): Identity of amino acid sequences at the above locations are unknown.
TGEVASTLTESQKWFVLKRLHFDALVSLEELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPVETFRVYLIGIIWTAIGAVINQFFTERQPAITLAMAVVQVFLYPSGLLCEWFLPKWKFKIWKYTIDLNPGPYTYKEQMLATIFCGVTGGSTSYVSSNILMQKSEIFYDNKWVDFGYQVLLILSTNFLGVGFAGIMRKFAVYPTKAVWPSILPGLALNKTLLTPAKKEVINGWKISGYNFFFITFVASFLYFWIPDYLFQALSTFNWMTWIKPDNQNLAVITGSVGGLGLNPITTFDWNYFSSMLQPLQVPFFYPLNNIIGMFFAFFCIIGVWYSNYKWTGYLPINDNGLFTNTGERYSVALVVNKDSLFDNAKYQEIGPPFYSAANLVVYGAFFXIYPIHFVYEIGMHYDXXWXIV

SEQ ID NO: 16205 - protein, 696 aa, Candida albicans
GSQPVVKNLQVRLESVLVAYWSPYPEVRAVTFPYDDPTIPAETFRVYLIGIIWTAIGAVINQFFTERMPSITLAMSVVQVFLYPSGLLCEWILPKWKFKIWKLSIDLNPGPYTYKEQMLATIFCGVTGGGTSYVAWNILMQKSPVFYDNKWVDFGYQVLLILSTNFLGVGLAGIMRKFAVYPTKAVWPSILPGLALNKTLMTLARKEIINGWKISSYNFFFIAFIGSFLYFWVPDYLFQALSTFNWMTWIKPDNQNLAVVTGSVGGLGLNPITTFDWNYFSFMLQPLQVPFFNPVNNIIGMSIAFFCILGVWYSNYTWTGYLPINDNGLYSNTGEPYSVRLVVDANSLFDQAKYNEMGPPFYTAANLVVYGAFFAIYPFHFVYEIGMNYDQMWDACKSFWRVIKDFKKSTYDGFDDPHSTMMRAYPEVPEWAYLIIVVISLVLAILCVKVYPAETPVWGIFFALGINFVFLIPLTTIYARTGFAFGLNVLVELIVGYAIPGNGLALAFIKALGYNIDGQAQNFVNDLKQGHYAKLPPRAVYRVQLLSIFIASFIQLGILNFQVNGGIKDYCDPKNTQRFTCPNGRTFYSASVLWGVIGPKKVFNGLYPILRWCFLIGFLIAFPCIAIKKWGPRKYVKYFEPSIVIGGFLNYAPYNLSYYIPGLYVSFTFMSYIKRKYEAWWQILHHGPLPGPRKGR

SEQ ID NO: 16206 - protein, 341 aa, Candida albicans
VANNMSTEKPIPALPVTSITSHVDVAAHEVNLQAITSNPLSIGEVGTTLTNGQKDFILKRLHYDSLVSFDKLPPQATFIFEKIEHISIEEALAILEKAVVEHENDVNILDNDEELWTKLINYKQGKIPSDTDFSEKAHPSNFTAKDKLSAFIHEKRVSEETSSLDNSASENLNEPYYKIVDWELQVKLEAVLIAYWSPYPQVRGVTDPYDDPTIPVETVRVYIVAIIWTAIGAVINQFFSERQPSIGLGMSVVQVFLYPTGLICEWILPKWKFKVWKYTIDLNPGPYTFKEQMLATIFCGVSSGTSYVSSNILMQKSELFYDNNRVDFVFQPSRQAAPSGV

SEQ ID NO: 16207 - protein, 469 aa, Candida albicans
ICLMCNQLEVLYQFQIMRLIYNKLLIIHFLLGEVATTLTESQKWFVLKRLHFDALVSLDELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPAETFRVYLIAIIWTAIGAVINQFFVERQPAITLAMSVVQVFLYPSGLLCEWILPKWKFKIWKLSIDLNPGPYTYKEQMLATIFCGVTGGGTSYVSSNILMQKSEIFYDNKWVDFGYQVLLILSTNFLGIGLAGIMRKFAVYPTKAVWPSILPGLALNKTLLTPAKKEVINGWKISGYNFFFIAFVASFLYFWVPDYLFQALSTFNWMTWIKPDNQNLAVVTGSVGGLGLNPITTFDWNYFSSMLQPLQVPFFYPVNNIIGMAIAFFCIIGVWYSNYKWTGHLPINDN

SEQ ID NO: 16208 - protein, 341 aa, Candida albicans
FAAPSSPVVKTHCKMMAHYPDVPDWWFITILVVSTLFAITAIWFYPVETPIWGIFFTIAINFIFLIPLTSIASVTGFSFGLNVLVELIVGYAIPNSGIALITLKAYGYNIDSQASNYITDQKLAHYAKIPPRAIFKGQLLSTLLNIIISLSVANWQLNNVENICDPHQKDNFKCPGANTYFYSSIQYGEIGPAKVFGGLYPILKWCFLLGVLLVFPCVWLKRNGPTKIFQRYFQPTIIIGGMLDFAPYNLLYFTGGLYISYIFMFYIKKNYLLWWEKYNYMLTSALSTGVAFSALIIFFTVQYHPHPLHWWGNSIGQQSIERGEISPIWKNIDTAPDGYIG

SEQ ID NO: 16209 - protein, 204 aa, Candida albicans
IFIKKKNAFSGYTVTQVVVPGERNFSSLIWVAIGLGILFTSIDFFAVRGLTVCFLIPINKYPFMPEQDLPLLVKWIIGYIIRENGLALAFIKALGYNIDAQAQNFLNDLEQGHYAKLPPRVVYRVQILSVFVALFIQLGILKFQINGIKDYYKPGDTQKFTCPGGRTFYSASVLWGVICLKRVFNGLYPVLAWYFMIEFLIAFP

SEQ ID NO: 16210 - protein, 323 aa, Candida albicans
LYKIVPYNFFKFILYIAFFYYNWDSLIHSLRYHFIFINYIHSLIPTMIPDSIISKQGPLGHVWLAANYDKKLTKQQLMNTSIVKSTEYIANHPVITNVSVSQELPSDLDSTNTITLRLSGQLLLGIVRIYSRKTKYLLDDVNDILYKLKASFKLSSGVNLGSDNISNQVNLPPEQTILQNLNSIILKDQVTSANLLQQDDLDLSDIHGTLTGSGLDGMLNHNASQSSSEYSEYDNSIEFPRYEEEAAAPGHTEDFELDFDLNLDDDNSIEYGRDASVSINDREISIISDVHKERTTGDIFDLNFGQPLDDLNDDEAENEEDRQ

SEQ ID NO: 16211 - protein, 194 aa, Candida albicans
QIKNRNYGTGMQELPYRCAELVIPRAASSTKHKEEDNQQTNFHLDQSFDNDSMDCDYSLPDLDDQHSDNIRDAGILDDEVDEEDDTNYTHTARVTEQIGQELIELFRSSNTVEFEKLIETDSEIHHRNPDKLPLGVVSKNKDRINSRKEATKCFFELLVLATNNCISLGQIPQETTIAGDISITSRDRLFSQFV

SEQ ID NO: 16212 - protein, 474 aa, Candida albicans
KNNSDYDVVPILHIRLENHPPTGRDPIYLGHLLRVFGEKIEEFNKLLIKEDPDCKLRTPFGDIEPLGFERFKICELIAELLHCSNMALLNENRGFDIVKERDELRIKMKEFDPISFKYNETIVLPDDDNNNDNSNNNNNNNTASNANDTIDDFNADDSIDEEEPHANANLTEEQLRSSPVVGDFLKIALFDTQIISNILSMFFRFPWNNFLHNVVFDIVQQVLNGSMEIGFNKFLAIDLFALGDITNKIIEGQKLCADYESSHNGLRLGFMGHLTLIAEEVVKFVQLYPSNTLSDLIDIKVESDVWEEYVNNVLYDTREKYNAILGGGDEDDEDDEEDDENTTFEEGLGEIIEEVKTGLVFEEPQKKKDFLDGDESGSDDDDHFSNYMSQQLTNPSTTPNHEHEDELETSSEDDEDEEEYIDPNDDGRSYKKSNSLYDSKGSLKKPENEDAISDDSECSEEEEFLDPLLPESTS

SEQ ID NO: 16213 - protein, 242 aa, Candida albicans
KSYNSFLIVELFKEDQCNLTDIVVSSYKEDTNPRPGYMGHLILISEEIVKFTSLYKPDLISPVIVSAVQSEKWTWFINDVLLKTREIYNVVLGAEDSDGNNDYGFDTSSVGYLDMDQPKKIILGDASNHDEFINDNLGNQNNGGVSELEQEQTLNDLNDLGDDYDMNQFFVPDINVLKMSPSGDLTKHNIEDDCDDDLDEHHDDSSDKYLENLSDSSSEDEDEDEDIGETNKLKRVPTHNDD

SEQ ID NO: 16214 - protein, 464 aa, Candida albicans
KLWYSKSMKLNELCNRVDEFYNGELCRKVWHCWRSQQNVYNLKMEVADKRLLNQYYIKWRKKEKDMKANLTIAVEFDHFHLLDKSFKILKGYFNLAKNSDVLAMSLFKSFEENRDSRIKLKYFQYWNLKISDRVHGLTMKLEKFHQVKDKFVLGNYFETWYYKHNLVEKSNNFVSAKDLQLLAKTFTNTWLKKFLLYKKAFKIEEELGADLKRKTFDRWKEAVQLEVKAKEFHERHLLETAFHEWKLKLILISNRASFDHILVQRCFQTWSVEIKFRELQQKQDTRLVVNIFQKWRTRQLELAKLDEKSQAFYESNMKHLVVQKWNVENSNIGLLEKRADRFFIRRFFIQKWQSKMTKYEDITVYHLEDEIATKLAYKVWRQRYFENYEEKLDNLLETMDTSAADTVRCSRYFGLWRAKLQTVKQIEERVSTSVAPSVAIHFKNWHVKSQQKQELFDLHHGAGR

SEQ ID NO: 16215 - protein, 292 aa, Candida albicans
NNIPLLLQLSNTHIASTFDTITTIVMRFSTLHFAFLATLSSIFTVVAASDTTTCSSSKHCPEDKPCCSQFGICGTGAYCLGGCDIRYSYNLTACMPMPRMSTFQESFDSKDKVKEIELQSDYLGNSTEADWVYTGWVDYYDNSLLIQMPNHTTGTVVSSTKYLWYGKVGATLKTSHDGGVVTAFILFSDVQDEIDYEFVGYNLTNPQSNYYSQGILNYNNSRNSSVNNTFEYYHNYEMDWTEHKIEWYIDGEKVRTLNKNDTWNETSNRYDYPQTPSRIQFSLWPRGDSSNA

SEQ ID NO: 16216 - protein, 444 aa, Candida albicans
  UNSURE (407): Identity of amino acid sequences at the above locations are unknown.
FNRELNSTEMLTQEEIYKTTRRNEITVQEWQGFFDFSGRLLITVDEVKSRIFHGGLNQDVRKEAWLFLLGVFPWDSSEDEREALRKSYETRYEELKLKWVNDDVKRNTEFWKDQKFRIEKDINRTDRNLDLFKNPKKRKENTDGSTTETTAATNTTDNVTNSDTTQTRESTPETPDEEDIDDEFDVSNIRNPHLYTMREILLTFNEYNENLGYVQGMTDLLSPLYVIIQDEVLVFWAFANFMERMERNFVRDQTGMKKQMNTLNKLLQFMLPKLYKHLEMCQSNDLFFFFRMLLVWFKRELHWDQVLTLWEILWTDYYSSQFHLFFALSILSDNERIIIQNLKQFDEVLKYMNDLSMKLHLNPLLIRSELLFLKFKRMLDIIDRDTSLNALRHDDPYRNGNATGTGXSENSNNGEIIGDELRELLRKDLVIQKEVERPEGVGGG

SEQ ID NO: 16217 - protein, 232 aa, Candida albicans
LPVVHSESPLAGSMLLAGVILKLAVYAIIRLIIPTLSDATVLYTPVVYVICAITIIYTSIITLRQTDLKVIVAYSSISHMAVCILGILSNSLAGINGSLILSLAHGFVSPALFIIVGGILYDRYHHRLIYYYQGLLTYMPILAIYLLILSFSNIGTPLTVNFIGELLSLTGAIGRSTILGCISAFSVLLSAAYMLKVTNRLTGGIRTPYTALTSDCTYRESLLMIALIIPTL

SEQ ID NO: 16218 - protein, 152 aa, Candida albicans
SITIKMKFSTILAIPFAIAFANAAAAPAVTAAPAPAADNPYTIYPPVPKTASINGFADRIYDQIPKCAQECVKQSTSSTPCPYWDTGCLCVIPNFTGAVGNCVASKCRGADVTNFRKLAVGACAAAGVWDPYWIIPASVSSALDAAATATGN

SEQ ID NO: 16219 - protein, 452 aa, Candida albicans
SLGTCVCSVAGVNAPYWMLPASVKSSLSVGVTAVPTSDSASETVSQEPSETSCEQPSETVSQQPAETSSEESSTITSAPSIREDNPYTIYPSVAKTASINGFADRIYDQLPECAKPCMFQNTGVTPCPYWDTGCLCIMPTFAGAIGSCIAEKCKGQDVVSATSLGTSICSVAGVWDPYWMVPANVQSSLSAAATAVPSSSEQSVETSSESAESSQSVESSQPAETSSEQPSETSSETSSQQLSSITSAPDSSATSSSSTTSTFIRTASINGFADKLYDQLPECAKPCMFQNTGITPCPYWDAGCLCVMPQFAGAIGSCVADSCKGQDIVSVTSLGTSVCSVAGVNAPYWMLPASVKSSLSVAATAVPTSDSASETASQEPSETSSEQPSETASQQPAETSSEESSTITSAPSTPEDNPYTIYPSVAKTASINGFADRIYDQLPECAKPCMFQ

SEQ ID NO: 16220 - protein, 478 aa, Candida albicans
NQAMENSKLMIAIDLLVVVYIYLLVSVSFFRVYSIYVKIMWGGIRGENCLCPETTKTIFAFCKHSPPPFIPPTFFFFYSTKSLMMQYTPEDRQKAIDEYISNSGLLYRQLSEKYHVPVTTIRDGVHGAKQPAICHENQQCLTNDQEEILADWIIELIEQDEPPTHQLILETAKDLARCTERDPPTNVEWVRRFLKRTKLDCFENVQLRVFAKRRAIEEEVICDWFDLFKKICEKRGIKRENIYSFDEISIQIGRNTNEYVNFANDKKRNSVTENCNKEMATVIEAVSANGVSIRPVVIFKSEYRMTNKVLSNQRPKWFYTNSNSGWTSNYIALAWLKEVFIPQTQPDNPDEIRLLICDGNSSHADDLFMKTCIENKIDALYLPTYSPYLTKLMGLICFDKLKKTYKKLVSDQQQKNGIYEITKDEFLKIYEMARNYEMSKQNIESAWEVAGLFPFCPNKVLRSSSSSLRRCQIANNFH

SEQ ID NO: 16221 - protein, 185 aa, Candida albicans
SPVAILFPHNQESLSRQALDITELLTRYTNAAVSAHSAAFQLSKKYYDAKHLDVEYEIGSEVFVDNRFLNSHPDGHDSVLVPKLRTKFSGPFSILAKSGLVNYTLEIPPSYKGDPTFHISQLRLKKTVPSNYLVTPSEPAAWKRYKDGSILVDTVAIAEHRKIGRRFRLAACHAPNINSSRRRNC

SEQ ID NO: 16222 - protein, 363 aa, Candida albicans
KSFRLSSYSSFFFFRQVFIMLKEIAYTLYSYTVAHPVQTQVIVLVALLVYYLVVYPVTSPLWKVPGPYIHRISYIPCYNAQRNGTWIARVHELHKKYGSVVLLSPNEVSVNGDPKFINDIYVKNFPKSKFYENFRNHGFKDNIFASLENDRHRKYKKLINNLYNKTAIFSKENHTRSVLLETADKLVETVGKESPSIEVFTLFGALAMDVVSRFELGRTNGTNLLDGFADRRIIVSHREVSSMGFWTTLMPNFLWDYAATKTIMQAADDICNFQLNLYKFAEKNLTSNGKNLTTLETLKKNGLEGEYAYSFLTDNLFAGHETTAVQLTYLCYELSRPANYKMQQKLREELNKAFPDGDIDLKT

SEQ ID NO: 16223 - protein, 249 aa, Candida albicans
TTSRPVENSLLGNLRAKIKKCKQSFDHTLLLFLFNVPPYMPKTKEVKQEVDETAIQNAIQDFKSGKFKTIAETARFHGLVPNTLRFRYNGGLPRKLAHTKEQLLSPEQEDEIVNWIVDSDADADGHGRSRSDIIAFAELMLGTSESSPKIHESWYDRFKSRHDEIHTVEGRSISSLRAKAVTYEEILKYYRDYDLIVRQHKIPHENIFNYDESGFIMGKGKSSRVAVPSYKNRTYVQSTEGRDSCTVSS

SEQ ID NO: 16224 - protein, 347 aa, Candida albicans
GRTLEGMFKFSRRLEIQCTVIEVANFSWVPLILPPLFVFKGRISGKKILSDDLPNWYYSSTPNGRMDDRLVSSWLCDIFFPFLNENNISHAILLLRNNNDYIHEVPFTSKCKEKGVIPLFLPRNCTTLLPPFHLGELGPVLPLYQTKLKGLKTFLRSPTPLKQKLFLSRYDQVRKLEMTREKLVQAWKDCGLIDFDVDKMLKLSPLMIDEIDTIPEIYNDKKWYVVATSSLQNYVQTDLESSESEIGWEDDLEENYRTGPVFKTLDQLREEWKAEKEQANPKKEEENLNQKPVAKQKQKPNSTKKQKQTQKQKQTKKITKPKTSKRMLEGISTSNIINKPRRTRSKK

SEQ ID NO: 16225 - protein, 547 aa, Candida albicans
LLLICLLLSTFISGCLFYFFGFALYIKIMWGRIGGGGKNCLYPETTKTIFAFCKHSPPVIPPSVFFFYSTKSLMMQYTPEDRQKAIDEYISNSGLLYRQLSEKYHVPVTTIRDGVHGAKQPAICHENQQCLTNDQEEILADWIIELIEQDEPPTHQLILETAKDLARCTERDPPTNVEWVRRFLKRTKLDCFENVQLRVFAKRRAIEEEVICDWFDLFKKICEKRGIKRENIYSFDEISIQIGRNTNEYVNFANDKKRNSVTENCNKEMATVIEAVSANGVSIRPVVIFKSEYRMTNRVLSNQRPKWFYTNSNSGWTSNYIALAWLKEVFIPQTQPDNPDEIRLLICDGNSSHADDLFMKTCIENKINALYLPTYSSYLTKLMGLICFDKLKKTYKKLVSDQQQKNGIYEITKDEFLKIYEMARNYEMSKQNIESAWEVAGLFPFCPNKVLKSSSTIDKENSEENAIEEKSRVSTDANVSPRSKFMRQFNLSPSKYQSPRYKNKKMIGYNDAYKVIKGLVTQLETKNKKIKQLRLELHHGVDIDIDN

SEQ ID NO: 16226 - protein, 60 aa, Candida albicans
  UNSURE (39): Identity of amino acid sequences at the above locations are unknown.
KSKLQRNNIMEFYEKIVKLIQFPLIKEKMEFHEVRMVSXTKPMFCVSFELPEEVAFKQSK

SEQ ID NO: 16227 - protein, 76 aa, Candida albicans
IMLGLGGYFYGGKQWENKEETPMPKDVPDVDEVGATSAPLLSASYYIGDKCKPFNEDFLLCKEEHNGGTPRMYERR

SEQ ID NO: 16228 - protein, 176 aa, Candida albicans
EGFDIRSNYIFNSTIDGIEDADQILLVGTNPRFEAAVLNTRIRKVWLRSNLEISSVGQDFNSTFDVTNLGEDAKALESALQGSVGEKLGQAKKPLIIVGSGVAESKDSEAIYKLVGEFASKHENFNSGEWNGVNLLHREASRVAALDLGFNTLVEDSTKAKFIYLLGADEITNKDI

SEQ ID NO: 16229 - protein, 206 aa, Candida albicans
QKAREGFTEMLLENHPLDCPVCDQGGECDLQEQSQRYGSDRGRFHEVVGKRAVENKAIGPLVKTSMNRCIHCTRCVRFMNDVAGAPEFGTAGRGNDMQIGTYIERNINSEMSGNIIDLCPVGALTSKPYAFRARPWELKRTETIDVLDAVGSNIRVDTRGIEVMRVLPRLNDDVNEEWISDKTRFACDGLQTVFYHRDWPDPHLMC

SEQ ID NO: 16230 - protein, 268 aa, Candida albicans
DDLHIYKNQMSMHKELKKKTGVYIIINKITRAYYIGSAITNKLYVRYSDHLLYFRGSKPLKESVLEYGLKSFIFGILEYNNNIITKKNRKVLWEIENKYLSLYQPIYNKYPQADSPKGYKHSEESIAKMKLNFTSERKEKYSKMLKVKNIILTSEVKLKLRNLALSRSKDYISEEGKLRQSLSKQVDVNLYLDDTLLCTIKGINKAAHLLCCSYSTIHRSIEKGYIYIPDSFIRYLTNDYINNNNDIISKINKDNKVSKVKYKSGNKD

SEQ ID NO: 16231 - protein, 492 aa, Candida albicans
TETKSNQIKSHFPISTPTPTPNTMASLKSFIKSVRKAKTIADERSVVQKESAAIRTSFRDPGLDQTTRRINISKLLYLYIMGEKTHLGQVECLKLLASPRFADKRLGYLACMLILDENQEVLTLLTNSLDNDMQHPNSFIVGLALCCLGNIASPELARDLYTNVETIIDSKNVYLKKKACIVAAKLIEKEPELAEFFITKINSLINEKQPSLLLGTIRLIQALYFASEESRSTLIKTIPKLVADLKRTTTSGYQPDYDVTGTTDPFLQVLLLETLRILGRDEQCPPQYLEQINDILTQVASNLDSGKNAAHAILYECVKTIFAIQSDQSLKILGVNILGKFLSTKDNNTRYVALDTLLTVVTIEPMAVQRHRSTIVNCLSDGDISIRRRALELSFGILNEQNIRILAREILTFLEKCHDQELKSYVTSQLTIAANKYAPNDKWHFDTLIRMLKVGGNALTPDIISNILALILQCNDLELKKHVASKLVASCI

SEQ ID NO: 16232 - protein, 424 aa, Candida albicans
ILSSWCLPPIKLGHFRNQLNSLTASNIALCMGLNELPKNCFEIHLDEESELRNNLRALLSVYCSCGSLELSVRRFKVVTWTQSHQIAMNRLLETSSNQLPTLEDRYICYFAELVFTGHEILDFVDQINLAVNRSRISLLNIKRALRKYEQRLSQILDQSGFTSTKQALALQIQYFHLLVVIYDNLVSGVFNQSDEITPNYADEIPSSNERQFCLKMIIKLITLCESLVDQFVRLNNNIINIPSVLYYRPMHALILLVRLRLILKFQNFKDLEIDVESYFTKVSRVINDNLMKNSLVCSKMKVVLNKIEKWLILSQKYIKSDSVENNGPMNFDVVKIIFQNKDKEIENLDVPKSHNESPIKTNTTIESQDPSPVNSVDNPFTANNEFNGIISLEQIFQGIDSDILHYLNPLESNFDLSTDFNRFS

SEQ ID NO: 16233 - protein, 290 aa, Candida albicans
VKFIVSSTMVNTQGLAVGLAVGIPSFIILVVVGIFWYRNQQKQKHEDMNDNEIDIGLRDDHSFNQFQEELHKQYEKNNDDDETHIREEKLTHDSSENSNDGQQHSTSTASRQTPTPHSQHYNSNHGDQRPQTSYDFYETFIPILPSNQQRSPSVQGSTADIADTHPNDTDTDLETTTNNNNGTGNNLATDSSSSLINSHLRTSSNDLNTLAKQLNNPVFFEKLPSRATKYQVKSVNNNYGNTNAVGKNNNSSSDLINNYLIGETHAINDHFTYEAPKVEVTNLSRPEEKN

SEQ ID NO: 16234 - protein, 278 aa, Candida albicans
TYTNMASRQSRLEAEKLAIIQQSMTRGRSTSPRGGSHSRSSSLNREDFNKELKWSIVNHDPLERIIKSDKQQTDNDFWENEVSEEEHISDDDTNEKFQYDDTGNILPNYACQDEKINEISQILENSNLNDRATIKRLEELTASERAFAAARKAGSKIDQEILNKLASDKQKLTGTNLNLDESDQDALARRQKLENYQAYRKKIIDQENGLRNGSVSPTRPEEGEGSSEDFMAPYTSAVEDKLDSEFASQLNETIKEGPVDSNKSHSRSSPPVENSVRT

SEQ ID NO: 16235 - protein, 187 aa, Candida albicans
ASRNQCYEFHNMDTCSGVYHIYHRLCNHRDTYHHHPYTCHHIFCLCICHGIYCHPCNDHVFACHHIFCHCIYHGTYRHPCICHGTYYPIYHRISYLCSDRLCVCHHTCPCICHPIYRDTSYLCIYRPICHLSIYCRHHQQKHWYNVYIWSKDRFHHIHDIIDHLHLHKLNPNQCLYRTSRLCDISIL

SEQ ID NO: 16236 - protein, 93 aa, Candida albicans
NITCCHVKTRHLSLFQHSILKNKKVIFVVPFVLLVNFIINYIPAIQRTMGTSQVPVEYYFIAVGFGLVVFTYDELRKLIARKYPNSFTARIAW

SEQ ID NO: 16237 - protein, 367 aa, Candida albicans
IVLLFSSLFIMEKLLLDRLLGRITPSRFSNIITENFYSEIYQLGKHDVFPSNCHDYAAVNSLSLETTDYQYLLSGSNDSSIKLWDLKQQETIREENEIDANLHLHPSTFDNFDYDNPVSTFVNLATILKRHHHKFGISCIQWWPYDTGMFASSSFDHTVKIWDTNELTPVHTFDLLNKVYDIDISAENALIATANDQPFIRLLDLNSTSSAHTLLGHKGKTLVVKWHPINLNILASGGYDGEVKIWDIRRSQSCLTQLDMLRTNDSSYTTKLSKAHLGPVNGLVWDPLGSLLYTVGNDDKIRVWDMVNVSTPPPINKLINFGPLIRNKHPHTILLLLNPQGETETQFLLFPSESGDVFIFRTIDGKL

SEQ ID NO: 16238 - protein, 158 aa, Candida albicans
YYWAILIVAIIIRILEQVKSYDIDASHHGILSILVVGIVLLLCLQTPEDTLIVMRGIGIQLQSKKMWRFQSSDSFIPINNMIDLVIHEGFHDYGQVIFYLCVLTKANNDKNPITIVFPEFLPRKDIFLTVWRLSRELLFGSTKRYWRRVPGQGLKQVI

SEQ ID NO: 16239 - protein, 312 aa, Candida albicans
TIARILVGSVSEDNEDDENNEIVNPDLLHQDLDQKLYQSIQEFQKLSVQEKENLKELKKLEQTKTELETQLSNYEQELNNLRENGLNSISKLKNKLQLELNEKNKKLEQSKAAYDVQLDHIDKLRNLNIYTRIFHISCDSQDKFATINGFRLGHKIIWPEINAALGQIVLLLVFLIKRLKLDLKNYKLVPMGSQSQIIKFSAKDAVDGTTQSKTILNLYSSDEFSLGKLFNFNKLDVAMIALLDIVSLIEAKVLSIDQEIELPYKIKNDTIGGKSIRVTSNSEWTSSCKFLLTNLNWILTFVSAHTNSEETL

SEQ ID NO: 16240 - protein, 198 aa, Candida albicans
YTFTNTKLVHYYSSLKMFNFSGSTKKRVVNLGNKKLGYNNKINFLEQSRLQRQEREYQKNKEKSAIIIQNHIRKYLDLKKNCFAIINDWLNFPINNEQDFNSWINQFINLSKWYLLKQDDDLIYQVIKSLVEQLLDSMFEIYNTDGVILALNKLLSGLKDINILDLIVQALHIVISENDKFRGRTWNDQQFGQSFQQI

SEQ ID NO: 16241 - protein, 246 aa, Candida albicans
KVIRSMGTAWELTQALKDQIFKYASFNQTPVSLRQMVQFGPVPSPGSIFLSSRFIVEELPIRLAKKVKDLENAPLGLNEMPSTIQVKNWYAQSFQELTELHKPKISDELAKLLSKGASKHSLPEDSINEKPHTKQEIHRIPDLLEDNPAINNIFSDDGIVVRHHHHHHSISRARPRLNDNTQTRVESPTYGMSYFNPCPGNIVWPKEVYDYNKLVRETLEIIKKRHDATVATMAQGVQEWKNKNQT

SEQ ID NO: 16242 - protein, 346 aa, Candida albicans
NLSADCHSRGEDDELKVYCANHERGCDWVGTRWELEHHVKDICQYTGVRCNGLRSDGSICQLIIERRFEDKEPSQCVHLKFECEFCKTKITKITETKHLEQECLFNYKTCELCDNDMIPEKNMARHQENCRKIGRFICPAHEIGCKWIGTNETSLELHIENNCQLYHFLPTFTTMKDKMDSLVLENETLQKQINKMLDSIIQGKITNLGYSESIEEINKFESIEDQDKLVYLNFEIDRLKYEINERIIPFMNKSIVNERENMMNNLINDNFMIREDMNVQRMMINSLRKQLQFLLFSKNRNTTLSGGVGGTNNMFPSMFPTEELGLGNIYETVSRSNSEERLNLKL

SEQ ID NO: 16243 - protein, 1191 aa, Candida albicans
YQMLQQFTLLFLYLSIASAKTITGVFDSFNSLTWSNAANYAFKGPGYPTWNAVLGWSLDGTSANPGDTFTLNMPCVFRYTTSQTSVDLTADGVKYATCQFYSGEEFTTFSTLTCTVNDALKSSIKAFGTVTLPIAFNVGGTGSSTDVEDSKCFTAGTNTVTFNDGDKDISIDVEFEKSTVDPSGYLYASRVMPSLNKVTTLFVAPQCENGYTSGTMGFSSSNGDVAIDCSNIHIGITKGLNDWNYPVSSESFSYTKTCTSNGIQIKYQNVPAGYRPFIDAYISATDVNQYTLAYTNDYTCAGSRLQSKPFTLRWTGYKNSDAGSNGIVIVATTRTVTDSTTAVTTLPFNPSVDKTKTIEILQPIPTTTITTSYVGVTTSYLTKTAPIGETATVIVDVPYHTTTTVTSEWTGTITTTTTRTNPTDYIDTVVVQVPLPNPTVTTTEYWSQSYATTTTVTAPPGGTDSVIIREPPNPTVTTTEYWSQSYATSSTVTAPPGGTDTVIIREPPNPTVTTTEYWSQSYATTTTVTAPPGGTDSVIIREPPNPTVTTTEYWSQSFATTTTITAPPGETDTVLIREPPNHTVTTTEYWSQSYVTTSTITAPPGGTDTVIIREPPNYTVTTTEYWSQSYATTTTVTAPPGGTDTVIIREPPNPTVTTTEYWSQSYATTTTVTGPPGGTDTVIIREPPNQTVTTTEYWSQSYATTTTVTAPPGGTDTVIIREPPNPTVTTTEYWSQSYATTTTVTGPPGGTDTVIIREPPNPTVTTTEYWSQSYATTTTVTAPPGGTATVIIREPPNPTVTTTEYWSQSYATTTTVTGPPGGTDTVIIREPPNPTVTTTEYWSQSYATTTTVTAPPGGTATVIIREPPNYTVTTTEYWSQSYATTTTVTGPPGGTDTVIIREPPSPTVTTTEYWSQSYATTTTVTAPPGGTATVIIWEPPNPTVTTTEYWSQSYATTTTVTGPPGGTDTVIIREPPSPTVTTTEYWSQSYATTTTVTAPPGGTATVIIREPPNYTVTTTEYWSQSYATTTTVTGPPGGTDTVIIREPPNPTVTTTEYWSQSYATTLTITAPPGGTNSVIIRVHSSTNDESSESTFSTLSVPSFSGSISVVSTISRPHYVNSTVTHLPSSLSKPVDIPSSDAVTSTNDNSLTSLTGSENGKTSVAISTTFCDDENGCQIFTRRLEGTRTCVH

SEQ ID NO: 16244 - protein, 812 aa, Candida albicans
QSTIFNSLIPMKKLYLLYLLALFTTVISKEVTGVFNQFNSLIWSYTYRARYEEISTLTAKAQLEWALDGTIASPGDTFTLVMPCVYKFMTYETSVQLTANSIAYATCDFDAGEDTKSFSSLKCTVTDELTEDTSVFGSVILPIAFNVGGSGSKSTITDSKCFSSGYNTVTFFDGNNQLSTTANFLPRRELAFGLVVSQRLSMSLDTMTNFVMSTPCFMGYQLGKLGFTSNDDDFEIDCSSIHVGITNEINDWSMPVSSVPFDHTIRCTSRALYIEFKTIPAGYRPFVDAIVQIPTTEPFFVKYTNEFACVNGIYTSIPFTSFFSQPILYDEALAIGADLVRTTSTVIGSITRTTTLPFISRLQKTKTILVLEPIPTTTVTTSHHGFDTWYYTKKATIGDTATVFIDVPQHTATTLTTYWQESSTATTTYFDDIDLVDTVIVKIPYPNPTIITTQFWSGKYLTTETHKEPPLGTDSVIIKEPHNPTVTTTEFWSESFATTETITNNPEGTDSVIIKEPHNPTVTTTKFWSESFATTETITNNPEGMDSVIIKEPHNPIVTTTEFWSESFATTETITNGPEGTDSVIIKEPHNRTVTTTKFWSESFATTETVTNGPEGTDSVIVREPHNPTVTTTEFWSESFATTETITNGPEGTDSVIIKEPHNPTVTTTKFWSESFATTETVTNGPEGTDSVIIKEPHNPTVTTTKFWSESFATTETVTNGPEGTDSVIIKEPHNPTVTTTEFWSESFATTETITNNPEGTDSVIIKEPHNPTVTTTKFWSESFATTETITNNPEGTDSVIISLHRGARISI

SEQ ID NO: 16245 - protein, 300 aa, Candida albicans
  UNSURE (289): Identity of amino acid sequences at the above locations are unknown.
RQDLFQVLTKLQSLMWQPQCANGYTSGAMGFIVLTGDTTIDCSNVHVGITKGLNDWNFPVSSDSLSYNKTCSSTGISITYEMFPAGYRPFFDVYTLVSDQNRQLKYTNDYACVGSSLQSKPFNLRLRGYNNSEANSNGFVIVATTRTVTDSTTAVTTLPFNPSIDKTKTIEILQPIPTTTITTSYVGVSTSYLTKTAPIGETATVIVDVPYHTTTTVTSEWTGTITTTTTRTNPTDSIDTVVVQVPLPNPTVSTTEYWSQSYATTTTITAHPGGTDTVIIREPPNHTVXISSGPRVDNPR

SEQ ID NO: 16246 - protein, 287 aa, Candida albicans
TKMSYDNPNNSDSHLRLHAYYNSRRDDSDGDELSIEFLNQRSNTPLTQGTYNYHNTSTNSLNFQQPEPIYRNQTRTSLSDSYYDHPIFDTSQTQIQPPHDNPFTESYEMTDTSYQGNDHHYRTGQPNHLMNPTYNQAFIPHVYDEEDNDEQEYDQRIQYNQFQGDHFDLAAISYADDESQSQLDYVPTERVIPEGEEEEEEGETSFEKEPGSETISGPFGEERSFEEPPPQQEVRSKKLTRATGLNGHLVLDCPVADELLSKFPDYNPAEKSGGLSSVHHGAGRFRA

SEQ ID NO: 16247 - protein, 302 aa, Candida albicans
FDVSTRIYTQEGIDNNNDTKFLTKAPYPHPVFPQDECENVTVTHRETKTLGDKISFRSIQFMRQCFDLVTGYAVPKTNNPEEFKGTRWEMTEGKWLTRCIFLESVAGVPGSVAGFLRHLHSLRMLRRDKAWIETLLDEAYNERMHLLTFIKIGKPSWFTRSIIYVGQGVFTNVFFLLYLLNPRYCHRFVGYLEEEAVRTYSHLLDELAVPGKLPAFETMKIPEVAVQYWPELTPKSSFKDLILRIRADEAKHREVNHTFANLEQKTDRNPFALKIEGLNKPQPNHGINVMRPTGWEKQDLQL

SEQ ID NO: 16248 - protein, 321 aa, Candida albicans
LVMIGLSTYRNLPTLLTTTTVISTALRSKQLLRFTTTTSTKSRSSTSTAATTVGNSNPKSPIDEDNLEKPGTIPTKHKPFNIQTEVYNKAGIEANDDDKFLTKPTYRHEDFTEAGVYRVHVTHRPPRTIGDKISCYGTLFFRKCFDLVTGYAVPDPDKPDQYKGTRWEMTEGKWMTRCIFLESIAGVPGSVAGFVRHLHSLRMLTRDKAWIETLHDEAYNERMHLLTFIKIGKPSWFTRSIIYIGQGVFTNIFFLVYLMNPRYCHRFVGYLEEEAVRTYTHLIDELDDPNKLPDFQKLPIPNIAVQYWPELTPESSFKDLI

SEQ ID NO: 16249 - protein, 224 aa, Candida albicans
FKQVMIGNIRQLSSRITGQQFTIFTRSIYLHKGPRVEGLKRDPEAAFINPKGIKYGLNETNISHIKSFLGDKYNIPDEIALQVITHKSFGNGIKPYNEKLAAMGSKLLSLYFAKYVTNQPCKHDNGVEGKNLDVLGSPMSRELPSLKTAAIFAKSNNINEIMFWHTRNSTLGFESSGELKVSGELLFSLVGAVNFYHGKNKAEQFITEKLVDQFEKISAQNVRN

SEQ ID NO: 16250 - protein, 144 aa, Candida albicans
  UNSURE (35): Identity of amino acid sequences at the above locations are unknown.
YPPFILRCSQEKGQEISLGTMCEHQDTATNNNTSXSPSATAAPMPAHISQEQPSSQPAATTPAPVSTSTPPASVTATAAAATAAVSAPQANGTPPSDEQLSCLWQGCSEKCPSAEALYVSLCHFSILFFASLHRLHHGAGRIRA

SEQ ID NO: 16251 - protein, 200 aa, Candida albicans
PSAMSTFFDEMSKSFADVKVSDGKIDTADFLQASESLVKLFDLLGSSAFTVVKSDMTGNITKIRNKLLEDPANSATLQDLVLTEAKTKTKTATQGLLWLSRGLQFTAQAMRETVDAPGKELTVTFTDAYTKTLSKFHGMLVKPVFKLAMKACPYRKDFFEKLGADQTKVAEQLQKWLEALEGIVKIIMDFFASGNYGKGL

SEQ ID NO: 16252 - protein, 134 aa, Candida albicans
ITLTHSILSSRIMTTSVDKLNKLIEEVNNQDELQLIEEINLYIKTLYELRQVKIDQLSNIIHQLNQQIITSNKEINQLNKINDYNYELINVNNFNFVSQQLFQFTNFDRSSSSSSESTNNIFPMINIFNRRWQD

SEQ ID NO: 16253 - protein, 71 aa, Candida albicans
LLVVAAMPLIDEVSKVDQMTLVKEETDELYFVNELYFVNELYSVNELYSVNETSSVNETSSVNEISSVDEL

SEQ ID NO: 16254 - protein, 93 aa, Candida albicans
VKTEIIAPQLESEFNQVLVRHNLQDTIYTGQVSHVGGHAYAGNVLYYPKDCQTSKDFIWYGRVFPKDVQGIVELTIINKEIIKDLFRGDIEAY

SEQ ID NO: 16255 - protein, 113 aa, Candida albicans
  UNSURE (33),(89),(96): Identity of amino acid sequences at the above locations are unknown.
ISTLPFIKDVCLIFNTKTRFKKSVNEIVVMAAXRIPITKSIKGGLSRLYPEDIIYQVVKGTVSDSQVDLNLIDDVLVGTVLQTLGGQKXSALPIKXIGFPIKTTVGYGQSSMC

SEQ ID NO: 16256 - protein, 156 aa, Candida albicans
ARRIPLSGGGHMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGA

SEQ ID NO: 16257 - protein, 99 aa, Candida albicans
TVSTMSGLATKLVGNLISGKYLTFSCSVLIISVNFLPSISSSKTHILTSLWKIFGFSAQFSATNFATAVPQLPEPTIQTLNGVSIGYGEVVIMKLFFIC

SEQ ID NO: 16258 - protein, 117 aa, Candida albicans
FIKILPTGVDPVNDTFLIKGCSVKYLPRPEASADGNTLITPGGNPASSAKNAKAVADNGVSEAGLITAVQPVAIAAPNLRVIIANGKFQGVKIPQTPIGCLKVKILLVPLAEGIISP

SEQ ID NO: 16259 - protein, 123 aa, Candida albicans
MVLSKSASLKTMFGDLPPNSKVTFFKFDSAANFMIILPVAVEPVKATFSIFGCLAMAAPAVAPKPETMLITPFGIPASTNNWERYKADNGVDSAVFKTVVEPVARTGPNFQEAINNGKFQGII

SEQ ID NO: 16260 - protein, 587 aa, Candida albicans
RIGGSGSSVVKTSNMSSNEEIINLLGRLNQNKNKNKTDDDSADNETTLNQLANLTKNGISEPLIMIILDKIFNDTLKITDKNKLLDECLIPNHDLSIDVFFKIISIIGVSRVYFKGNRKFKSKQLSISLQLKLLQWMIDNFQFLENTFCKSGSIVLTLLVKSLDYEFSRGPISQLIILVLNSLVLKSNQIITFYNQEIYHTINILKSNHIQTVVNLYNKFPLDIYLEELLAYFRVINPDLDYMIYSPENFPLLNKLNCNLNQVYRWKDSDELTATTITTTTTTTKSNKRQKTTITSKPDTITHNIEVLDQINKINPYKLVRNAFDNDKEAQLLTILFQTGNNRFINKVDKYIGAILTTFTNLEKELQSFLQQVSHLYKISDGTIILPLIENFILDNNNNNSLLVGKFCQQFDYRSKLIKYLHNVDPMRLVTMIHHNASILKQIYYDTNNGSYETNSNFNYESCHDYVKNILYLLNLWIFENQDDIIISRINLLLPELYEFIKYCKHIQEQLTNQVVEFFINLPSSLFNQLELKTIIIPRSLTYSCLLSCDPLVVSNITQHISNCKSHDYTNSTHYRDLQNSYIMDTI

SEQ ID NO: 16261 - protein, 184 aa, Candida albicans
LIDWLVGSINIFITLMASSVKLATALKQRAILTKELSELDDKIQSSLILQVGMKKINDPDKLYLDYVAKSQELAKLVSSINYTNNITPIEVDLTMGKYDNTIKTINDALICRDRIFKKLQFVKKISTAGKEQPLDSKDEIKFVSFIDVDKYDTLAQELNTQFENLNLKLQEINWQVDLVEIYKG

SEQ ID NO: 16262 - protein, 158 aa, Candida albicans
  UNSURE (155): Identity of amino acid sequences at the above locations are unknown.
FHLLFYIFQYCPAIMIAPNTNAPVVAEMSDETITENTIAVNSQHKNMRLFFVLNTLVQHLHDFAREVRLTTEEWEEGIKFLTECGHITTDIRKEFVLLSDVLGFSVLVDSISHPKPDNATLGTLLGPFHTHDAEVKEKGETIVSEGKGEPLLIEXKLN

SEQ ID NO: 16263 - protein, 329 aa, Candida albicans
EFRLPTQYCISVFHFSLSTHKQIKFIMSQAFTESVKTSLGPNATPRAKKLIASLVQHVHDFARENHLTTEDWLWGVDFINRIGQMSDSRRNEGILVCDIIGLETLVDALTNESEQSNHTSSAILGPFYLPDSPVYPNGGSIVQKAIPTDVKCFVRGKVTDTEGKPLGGAQLEVWQCNSAGFYSQQADHDGPEFNLRGTFITDDEGNYSFECLRPTLYPIPYDGPAGDLLKIMDRHPNRPSHIHWRVSHPGYHTLITQIYDAECPYTNNDSVYAVKDDIIVHFEKVDNKDKDLVGKVEYKLDYDISLATESSIQEARAAAKARQDAEIKL

SEQ ID NO: 16264 - protein, 82 aa, Candida albicans
TDGLMSHQALQNFQRYTGIQHVHRIGMAERMWCDRNRERHTVSSSGGNRLPNPGPDRSVRHFPDPRFLCPSCATVTPLHELI

SEQ ID NO: 16265 - protein, 130 aa, Candida albicans
AKLTKELYSSLLTNFKPLTFSLSCKYSSDGDSNEFFKFAKSLLGITSCSCVADFSLINSRLGFSNCFLEITIESYNCAFSDKNSDDGLFTVASNSSNLVLGIVTKPSLVALESISPLVGSLINVCMYVKF

SEQ ID NO: 16266 - protein, 228 aa, Candida albicans
QHIILIMLVRFVNSIIFKDIIQKLILKSPFILRAYVNFSNQHDSLEFLNFLKEKPFENEFDSIIPVIEKALFHKMVDTSANTSQKTLKESKKNLKRDDLVNNEIYKKFLMFINNEIDQFDLIKINKSTKKKESSKAVSSTSKSSKERKKLKAKKSSKEKATTVSREKSKEKDKCKEKTKDKGKEKPEKLKNGEDVSKDKLVNKDTKGQEDVKLSKKLNGSKRTHVHHG

SEQ ID NO: 16267 - protein, 187 aa, Candida albicans
AQELKSSNEAYDKMVKKYEEKLKTSKLNLHENLNSFTKENEKKIQDLLTTILKYENLLEEKNSKILQLSSSKPISIPIGTPRPSTSSNKLSRHDSYDPIFSSSAYSPSQLLQQQQQQQPSPHHHHSGNDITAIQHSTPMGQLSSSYFPPQPIRNNSAPITSTPAASQQAIPIIRGRGGYQKRSKKLM

SEQ ID NO: 16268 - protein, 203 aa, Candida albicans
QMYSSNPFPSDLFSLWNHKTRDSKMSNKGEQEHIKNLYAPPLSAYSSDFPGASLYQLEYTINTTTNSSPLFTNTPLTQLKRAQLAKIRNTGYTTIRPIGIVQTMEEIELEKVYYSLDEQTMDPAAAAIENSSDAIVGANASTVSIQQQIQQPEIDLDAQVFNADEIYAGTDDERDSLDELDVQRMRRQAGVTMDDEGFYGSRS

SEQ ID NO: 16269 - protein, 922 aa, Candida albicans
IISSNLLFLLYIGTTENPSYLDIQSKFESVICYALEILMGLANIKDHGLDTKMLWRFIISLLIVTDDNHEQLCFISSSILIKLLKLVPLLLGSTCRVTNDSLETLLTALLNRLSKKCDTIINTHITVLFPSSSDQILHQMAFEDSCLPNIDLNKSILEKTVDSQLLLEFITCTAQILSFMKSNDYDILTAFQSNYVKSPNEDKASKKKRKTSFSNKTREFAFNVVASPTPVIVLSVNVYLALLLLVKYDNWALNLASLNLIAFYLKNLKPSQDGDKALIFRSYKKLFPRIISMLELKNDYTGCMNKKTKNPTSSASGLNSMASFANKIKSLNQTEFRLHDYQIPMFLLSPTRILSDLCLQYPRLNDDIHDTNIDYKLVEKLQICYQSSKLLKILKSLKSSSNHGKMLVDFTTMLTIDKDETEVSDLLLLLSVYTANREEYRTRVVNVPQEYNINVAEIIFEIVDDYYFLLNQLHLAYRLLNPKKRRNLNGTTRTTKEVPDSDLPWFGRNLGIISTLHDASIFTNCFYFIRSVSRSVATLRTFFVECNSFKSFSTTDDATDNEQQPSGQASLRSGNVGENLANNADSLTIRTTASAPRVTSGANTNSNSNAAVTSSSAGSTSVTNGPPGGFIFDILQIIHKYEILMQIFEFFYGVNNTSDNYDHTEMDIAKCKKIVMTNKSICIGSLANFILDFSSFRYKIIGHESFLSSLLTIYQNSSTDNEIEESIPITSSKGQSTLEEIYQNNDIQLKILQVIKNFMYNEATENKKEVLDCFSLNFILQKASYGLGDNNESISHHKSRLVDNTHITQIKLQQKITAFEILRNFISGSPHFNALLIDAYENDFVQFEYANGNTGIPNTWFQFLIQNVSNVNIFLPDLNYKHNASGRIRNPEAQLKLFYENDEVLSKLIQDEKYVRLIRAIN

SEQ ID NO: 16270 - protein, 279 aa, Candida albicans
  UNSURE (8),(256): Identity of amino acid sequences at the above locations are unknown.
RRRRGVDXYINFFVMRTSVEKIDNSFFLSTMDHNYKLALKQFINKNFEASFKLTSELFHICFNEYANHTISQTLVTKIINLYLVEVGVCLKDGLLNQVQTNAAINSITSNEVLNQIRSVFGNDIPCEILYNYHLAHITNPKVLIGDGYFDQLHKDYLGANNDKYKPKFMQLVVFEILPTFGKYQEAERLITDPKDLEKLRKIQHLHEEQKAHQRLAKQNQEKERAAALEQAKQQTLKYKSIKEIQNSYEEEHHEVXISQLSYIYNLVKTYLRENYLAVL

SEQ ID NO: 16271 - protein, 123 aa, Candida albicans
LWLLVVEIWVELVLLSTEKNTKEVSIWSTSKMLWKTLSLPDCLTFLLLVLKPVNHGSHYQRVKVSNCLFLKKETEEELNKVCKFYSHYKKKNSFSENRKTNVNKCTLIAYSFNNVVNSCCGFV

SEQ ID NO: 16272 - protein, 637 aa, Candida albicans
FHNISFLNLKVQFRVISMVIVSFNIDTDLFINLAKLPAEVIALIFSFVPKCMLPELLYCSPIKKVAASAILSYVDVYDAIERHKWSYELGVGYPNCSCRQFRITQENLKQGIRQWKIFPKSIALNKVDQLAIALNDSREFFVDAQLINASFSEIGYHDYEGVFRDFLKSRFKFSCLTLSNHRNPLTLPPIAINVKLSKIKLNSYVIPGVKKLELNVPENQEERLTFSAELEDLIINSDRSIQVTLPPNLQKLEVYAFLNSVHFISEEMVNLEYLTIQLPNIRTFNETGIIAPNLKELNVRCDQLSNLEELRQFQHLKELEFEFCNYPFGLFNEGSFPELEKFRCRECSCLASEDFDNSLLTFPPNLKKFEIEIFRFQNVNFGSLVLPSTLTRLKLKNFPFDYDYLVDSLQYIDVHTVKLTLKSDFRIPHMAKEFILAAEYFSIDSIDFMYHLPSNLIHLSLHAIELGQMKSLAQMVKWPPMLRKFTLINFNIDHFKLKQLNLKESRLTKIHIYQGNVKTLDAGLFPVSVKDLSLTEMGIQQLPDSFENLENLQKLYLWQNQLRDVTSVKLPMATLETLDLSICNLRFISPFLVSMFEEKNKNAKLRVIAKENANVSVIDIRRALKAIKRTFIRSRTI

SEQ ID NO: 16273 - protein, 243 aa, Candida albicans
IPIMSNNPHPQDDGSQLYDNFEISPPSIVIRKADTDQSLNKIMLNQESQDINNYYTENVKNDNNPNNSYQDYTFSGNSSNQQHQQQQQQHLYEDLPTQFHYSNNSFFEPPPAPTVELTDDPLPNFNYPPSNIYINDNASDISLNTKDLPQFTTNEFLSPTSQLSTPFSPGHYSQLLQDFLQVNHTNGSGNNNNNNNNNNLLNPRSPSQYSSHSLYSDNSSQPASPFLDAASHVSNNSFLPPVS

SEQ ID NO: 16274 - protein, 243 aa, Candida albicans
KKKKVHSSTSKSLLIKPASIMSNYSTEVAKLISEGSRAYSSKDFDLASEKYGEACEEYSKSHQGNEDADLLFLYGKAVFQSGVSKSEVFGGKPAEPEVETENSESKQEESKPETDKTDDTFQFYADGDGEEEDGEENEEPNEDENNDEDANKSDFEVAWELLDLARALFEEKLESLDKGDLKPPYLTQDTDESSNDYIVVLKKLSETYDILGEVSLEAENFNQAADDLRKCLDLVSRAWKIRS

SEQ ID NO: 16275 - protein, 213 aa, Candida albicans
PNPILIHTEYTLLPFVMAVELINWQFCQISNHAESPLIPNQWYDTKNFTSHQIHTDLLEANIIPDPFIDDNEIHVQWISELNWQYRCIFDAPGNSNSNASLILEGIDTFANIKLNNKTILTTDNYFHKHVIPIIMNDNNELVITFNSSLRIGQELEQEHGKLPVWNGDSSRLYVRKPQFQYGWDWGPNLNTCGFESIKLITDEDYVKDFLIGI

SEQ ID NO: 16276 - protein, 135 aa, Candida albicans
KINRSQFVDITTVSSVIKAMTENTTPYYKKQASYQDKRYTINKSNLIEPIIRHRIQDSLFYKQHLYLSNEATILPIIIEHVHYIGGTDSSNRPSTFISCLFRLLELEPSKEIIKTYLTQLDFNTSPRGWKVPRLA

SEQ ID NO: 16277 - protein, 202 aa, Candida albicans
KMSKTTEIFCRLPKSVELIQDFKDITPSPKANAECRAALYSKNGDFFAYTQPQEVVILDTTGEAKVYHRIEIPEVFDIYFSPEGTYLCLWCKPIQLNKENGTWNNNLKIFNIKTKTIIAEWSAKHQNAWKPQFTSEENLFARSINQKEIHFFELDPTSDSTVNINQPSFKYKVNDPKATLQAFQISPGRNPSVAFFIPGKIR

SEQ ID NO: 16278 - protein, 200 aa, Candida albicans
THQFYLIMDAWNSATTFGADGLLGFSSQLPDILNLSDPLLAKIITSKKALQLLESNIVSGVSEDGEESNTNNENKAIIELLMSACDGDVVTLESITRSNPQIVNQLFPSDENGATALVYAVCFNNPDIVESLLENHKADPDIPDSIVNYTPIMWAVHLNYLNIVQLLLDHQADLFLSPKDDGTNASTLVFTTSLPGSALT

SEQ ID NO: 16279 - protein, 193 aa, Candida albicans
LADGCMSGTDSNVVGIAPSVVETTALDSGIVIAPLEPAGAVSAPGAIGEVSLAKTEDFGEEEAPGPAGADSVPGATGEGSVAGADDFGAAGLVSVPAGVISGAGADSVAETSDFGTAGEVSPAGIDGCEPAGVISGTGADSVAGTSDFGTAGEVSPAGMDGSEPAGIVSIGGMEASGVESVPGVFSVNGQNVV

SEQ ID NO: 16280 - protein, 103 aa, Candida albicans
SYNHTHIGIAFFLCRRRTKRNMETIYDEIEIEDFTFDPVQQIFQYPCPCGDRFAISLYDMQEGEDIAVCPSCSLMVKVIFEPEDLEDYLSSTRGLDPDPTVRS

SEQ ID NO: 16281 - protein, 163 aa, Candida albicans
VRRLSCDYVIMKPMVTTLYNGKLPLALADPNGIFTWCPHLNLIFIAMNKMSIWCYRMNGERIYSINNKSIVKHIAFYREYFCLSGTDNLIKIYDSNNGQLVKVLPHEFDGVEFVGWNGTEYRVLVSMPMVYDLVSELEYLVVTERKKNGNTFNHSFDRGTGDC

SEQ ID NO: 16282 - protein, 81 aa, Candida albicans
KPSISPTNALKSALFNFQSLLQVILLLICTCTYVHSTAPAILDNRKSGILSVFWKFARIGERLSPYVALGCFIMAFNTLSS

SEQ ID NO: 16283 - protein, 294 aa, Candida albicans
GRGSPGRGEELILKADYLIFESPNFMYSLPKNLLRLHLIADKQGKMSSFIQTIKWPLIVSDFAIKGFNIDYKTLKLLNLKESRLREINVYQGNVKVLDTDLFPISVEYFTLLHMGIHKLPVSLEELKNLQKLSLSGNQFRKINSVKLPISPLIDIDLSQCNLGLVSPFLVSMFEEKNRNPKLRVNATGNLNINISDIKRALKIIKGLSLELNKFNEALTEISKHSSRLHCISQLVDPYFEESTTEKIVGSDYDPEDLYNGSDFNLDEEEIDYVIAPVTEDESEEESEEDIEEDN

SEQ ID NO: 16284 - protein, 211 aa, Candida albicans
GISAHVRHNKDDVMPIDSLIFQKIVQRFAPYTIANLYYGHTHNDQKIVAYSDAKSPKPNQPITSAWVIQSLTPFGNHNPAFRYYEVEDESFNIMNSFNYYTKLNETYVNGGEEPVWEYEYSARAAYDPNNEWPVSAPLNATFWDKFAISKMKDPTNIKFNQMYTDYQYRFSPYTPNCTHPSGKNITTSCYVNNYCNAANLDIVSVEECMKK

SEQ ID NO: 16285 - protein, 445 aa, Candida albicans
TVMDKTNLKEPSLSEECMICLESISPFDKVGKVPCCPTKIYHDQCILQWSQKSNGCPTCRNRFHKIEISIHNKIINTVAIKDRLLPNPAINDIPSQYIINDRILSAITTNRTIGSASIEEEAEEIIEGVCYICSIDSRNGIICQNCGCNFHLNCLGVIEVEDLFTWCCPICDCNQETWLPRRRSRRITSRLQLDHQESRGPRRRGRITTNGLVIHNDNDELDVDFLYSNDGDDYEYNNTGGSDRVSLENTLQGQYHVHLHYNPVINGGVISRREQLTTEEVQSWEIFDEARKNSETAPLLGISQDTTPNGSTSNNTVISGNLNGRTATQQRRKRKKVTPIESSTSTSNGMGTISSNGNSRISQLIDQVKTSNGKLLTIYNQQQVQLQLQLQLQPRGVLVTPLASTTSYPQSSSDSPMSISPAANSPMELVSYSSDDNDYTRTQQH

SEQ ID NO: 16286 - protein, 393 aa, Candida albicans
KYFFLTNCGYPFGLFKEDNFPMLERFEYDGNGFIDLENFETPLLTFPPNLNELSIRCRDFINIDLSTLMLPPTLIRLELLDLSFNDGYFHLGENLQYVHIETSTLTFDSSFRIPHLAGELILEADYLTFESPEFMYHLPNSLTRLQLIANKQGKMGPFIRKIKWPLVLGDFAFKNFSIDYHTLELLNLKESRLEVIYIRGGNIKKLNVDLFPVSVKNLTLMEMGIHELPASFKRLNNLRQLSLMGNQLRNVNSVKLPVLSLEVLNVRQCNLRLISPFLVSMLEEKNQNANLRVEATGNLNVNIIDVRKVLKAIKGLSLELNRLNDSLLKISNHSYRLEAVYRDFDPYFEKSKSSENEEVVSDYDSDDLYNGSVFYLDEEYSDDEDDNNKRKKN

SEQ ID NO: 16287 - protein, 201 aa, Candida albicans
  UNSURE (13),(36): Identity of amino acid sequences at the above locations are unknown.
DGVDQLKLEMKGXPQVFFNGNKGPQPNFKSKNTRFXGETDIIRWEFSEIRVRKELNLPGDKQLLSQQKGQLPNTKQALIPAIPQQPAQRTIQDRLLDILIGSDNSESVENRYALICFHCFAHNGLAPPHTEDPADVKFQCWKCGAMNGKGMLFEQPDMKFDSSKNSSSELINLEVKEKESGNLDHPGTENEEKEESTKKLQ

SEQ ID NO: 16288 - protein, 121 aa, Candida albicans
LLRSKTIYNPKMDQLNVKEQQEFQQIVEQKQMKDFMNLYSNLVSRCFDDCVNDFTSNSLTSKETSCIAKCSEKFLKHSERVGQRFQEQKYVDLLRVTNGNMPLMIIIIYHQIILTNKLILL

SEQ ID NO: 16289 - protein, 501 aa, Candida albicans
IMPPPFTPNPRTSNVLPTNQEQSEDIPSLSSSPNFSRYEEANTLDSMQRFRNASNTTNNSSLFSRLNSINLVSDYMYRNLHAEYNDHAINEPDAHFRSRILRHISDMHRLQNHFNELINTREQRNTLDHELAINTIPVQLRNLSRELTRNDNREAYYIETTDEDDQSFQEDDDPNVIYYSDNHDESDVIEVDDDESALSDDASAALRQDVRNNERLIVTSARNNSALYPYRSSLLGTTSALPLRRQNAIRIRQPPNKQGEEHAKSTNKDGNLITEVLNEEANALRTDISKFYQALQALGCFQGESPLFEKNYHDHGANFRKLYLTGPNGGSAMITEYRLLNLDQRMDAYLQSRRNRLLWQKTTLPIPPPPTLDKKRSRGIAKRTSKKQKLIHNTDDEVAKYVDDAPSNFPKTRCTYSKTEKEAIMNGLPSSLLESGSSYSVGISAEPLYRCDVNFTDVNKIIHGVFSFTPEEKFPFIVSAIKSYTILPNFSVGFNEYAPKF

SEQ ID NO: 16290 - protein, 221 aa, Candida albicans
  UNSURE (14): Identity of amino acid sequences at the above locations are unknown.
HVTHFSNIINSTNXNPNPALVIFGIFLIISATLLQGIQFVVEEHILAKNPIIPLQLIYIEGFYGLSLMIIISILLNFIIGSIESPENFQSSPFNLSLAIYQVFHNKRILISSLLILLSIAIFNYCGLSITHRISATARSTVDTCRTLIVWIVAMSMKWESFQSLQFCGFVVLVFGTLCFNGVLNPENWGFIPSWLKNDANDSSHERLIDVVDEIDEPIERM

SEQ ID NO: 16291 - protein, 164 aa, Candida albicans
VPVSEDVYKNEDTGKWIISVRHKNPITGANEWYQEEFDAIVIANGHYTIPSIPAFPGLAEFNANYPDVLIHAKSVRELDEFKDKDVLFVGGSISTANIIQYIIPVAKSVTISKRSKNLVFDYINRALVTPEIDQRGEIVKFDPKTGKVHFVANDYGNGGEPKKF

SEQ ID NO: 16292 - protein, 704 aa, Candida albicans
  UNSURE (434): Identity of amino acid sequences at the above locations are unknown.
DPLVDDILIWPLYLQFADTIGGITAVKIYLKYKQFLPLSILQGKENVNKQRNYGMNLHEIIDKLRKFGDVENVMKFYYEIITNPNDYAKLPQPIVYYLFQYIDLLIRIKKSFDDDYFETLLTKSLYQYPDHLGKLYIKATKYFKSRGNIEKTRYYYNQGIKKCCTIKDFTMIYDSYLQFEENQVTEITEKVDPESDLGSLYLDDFEKLIDDRKILLNDMKLRQNINDLDTWFERFEIIETQTPDDLNLLIQTLTQALKSINPLKVVTTNNSKLSGIWLKYVDIYSSRGDFQTADLIFSKSVLSQYIDPDELAELYINWSEMILGSDKFPETKAIEILDDILYREYSDINYTDNSKPVQQRIIKSIKLWNFYIDLLESFIESDNQLKEIEKVTNAYQHLIKLKIATPRIMINFAQFLESWNQYEQCFNVLHQALXIFQNDNQIKFDIWNVYLIKAIKHIPLTERIRDLFEQSINEIAAYLVKPILLLYYQYELDQGYTYNAIKILIKSLTEKFTPAQKDHKLSTTNPQQRKEINLLKFEIYKLIMIELGEIQDIEQFNKIGTMAMNDEYLSNYQLFDLGSRFIKFEISTVTATAAATTNGNITTTSDSQWGRIRELFKFLCQSTLLDESWKMWESFEMEYGDELSFKDMLRFKRIVLNSIANDKAIRESANPMGFLKSMSITTTPNTKTESDEKIANPDIIDIDM

SEQ ID NO: 16293 - protein, 247 aa, Candida albicans
THLSIKHASFLIINLNAFFLPPKLTHLELWNVKFSKGYLYLSKNLEFIRICAPVIRFLGNFKIPPQAKHVQMKAKFLSIRKPDFMYHLPDGLKNLQLISNGSEKVLPLGKKIHWPKSLIVFCVHNLGLNFPSLELWNFNNSNLEEIDVIGGFLEKLHADGLPTSLKMLTMKNLRIEKLGGSFENLKSLERLSLHFNDIKYITDMEFPSLKFLDSGDRKVDLVPPVSISLVDAKKKLLNLEHNGNDHQ

SEQ ID NO: 16294 - protein, 522 aa, Candida albicans
CYGSTSDSSTSGRTRTQSQVDAPIIMNPDPNWPAPLTKFYIDSMARIGNLKKAKQLTGKQQWPNIIDMAVRRNVVDSNDWANQRVPICSGGGKLELEIFRIKKKPKKSNSTEDDTNKKSKEKPLNTNNNSFYIDVNGDAPYDPTKKPTTSKILNNSSSSSNNNNNNKKTKGDNKKFKETGNNFQKNENKKRQLQEEYDSEARKRARSERFAQISEFKPISTYYEDQRRKDSGAVVGTSEQLEKSYFRLTSAPNPAQVRSLKVLHDSLKYVVRKYEESHNYSYIIDQLKSIRQDLTVQHIKDEFTVHVYEKNARISIENNDLGEFNQCQAQLKSLYHRLRINKEKYKHRFILYEVEMMTYSFIYMIVTKNQSEINKFRLQYLKYKHFKKHEFEKPYFKLMSALFKSYLCTLQGDFEVFFKELEQFAHIKETKISFKFINDHLLGKVRLESLYQIAYSYRRFLVVTASEKLRFPDPQSCLIYLGELGLEKCLMKGNHEFDIPKTQVALKELIAKNHRVDIKGQI

SEQ ID NO: 16295 - protein, 312 aa, Candida albicans
VKIHEFGVNSNRDASALIKAEDDARNARKGIWNDYDPARVEKELAESTAKLESVNLAASKPKFFDIEVVDVEPTTGVLSFHLLDSTTTQNFAQFKQAFQQFHSQMPSASQSSSNDLPFNLVKPPKKNDLVSAKFSENGKFYRAKVINFDKSTGKYEVKHLDFGNIDKVPLSSLRSLPEKFGFSQYPVFAHTTTLQNLRLPPSKPTDYLTDSIYALEDLVYDKKLVISALPGESEAEYEGVLYDAEQSLKDSSYTINKQLVQDGWAIVDNKVVKPAVKEYVAELIAIQREAKSNHLGCWEFGDVSFDEDSLLA

SEQ ID NO: 16296 - protein, 220 aa, Candida albicans
YRQLFEFLKSARNGIVYGGKLRFLHALVINLLYRSGPIVLRLKSVLEATKDHAQVLAAFAIIYKACVMILKQDAFLGDKNLGLIKFIAGSFGSWIVYSQHFNFFHGGITHQITLYCFSRVVLALSKILLDKYLNCFQPGFRNYQGELIHYKDLNNQQQKKLKNIVYNKLWKYFAVLTWGLVMLIYDYQPQYLQSSLRHSMAYIYDVEMDTWSNWREFLGV

SEQ ID NO: 16297 - protein, 518 aa, Candida albicans
NNKSTIIGIQYWWDIMPTVFAYCAHWMLLNFILYWGHQKILELYFLTMKELYIRIEELKDTKIIDISLSYLEIYNETIRDLLNPMTQCKNLVIREDANNKISVSNLSRHRPNSVEEVMQLILEGNKNRTCSPTEANATFSRSHAVLQINVIQKDRTGDITEEHTFATLSIIDLAGSERAAATKNRGARLNEGANINKSLLALGNCINALCDPRRRNHVPYRDSKLTRLLKFSLGGNCKTVMIVCVSPSSQHYDETLNTLKYADRAKEIKTKLIRNQHNLDRHVGSYLKMITEQKQEIEELRARESKMVESTINKRKDLESKVFKILFESLESTRKAIAKQNQEKWKKYFILAKRKLLLSQKIETELVLEQRDDIDINSLLIASGNESESVFKIYDLCEQLILKIEYQLPQLESQYSQPTDLDYILEDSAMQTLKRLQDEEGWTEHHSAIYRQSIQSMKREVHTDLLLYSSILYDNLIHDLSIFFYIPREIGNFINNISNPTSLNEASSPTGMGGSKLN

SEQ ID NO: 16298 - protein, 277 aa, Candida albicans
IGSDALTQKVQASARFNIVLKDQLKLIEKIKLERGQIELGVNVEDLSEEDYLRIIEQDYEIQKPWWFTNEFLDVIRAGETDKLEEHNKDDDLDKQLEALPFDLKQYQLANSRYKQFINSLTSARASNEIEDEDEVDGLIPRSDDNNSVINVVRKQLQHEKPNKKFPRVMSNPVLERLSNDTKKLAHDYIRHENDQNDDDIDKILDLETLKTLHDKLANQLNTAYKINKVLANQLTSNIKMKRKLWVYTQLLMDANIQVGLPPEATSAPQRVMHIDGR

SEQ ID NO: 16299 - protein, 280 aa, Candida albicans
LTMGSPIIMLIKLLLDPDVSKKVILQMAWSQVKAIGIGKVIAALLSALTVGVSSFIRVPQIRKLLINSEHDRIAVANGLSLTSLSLDTLNSLIHVTFNSQNRIPFIQYGESLLLGIQNAIIILLVKFYRGQETAGVGKWQGLNCDDKFAAIRGAVTKPLVIMIASAIFFNKLAPSSLISALEILNIPISIVAKFPQIKTNYELKTAKHLSDTVLRANVVGSLIRVYTSFTDYSTKKQRNKNTVDETILLAGYSTSLILNSILLGQSIVYDKLGDKKVEDE

SEQ ID NO: 16300 - protein, 162 aa, Candida albicans
  UNSURE (151): Identity of amino acid sequences at the above locations are unknown.
GRWGLHAWQAAGQVSRSAGEPGRGAGPRGGLGAPRVQARGRGPGAMLDMGGSFLSETEGRESVAAPGRAARPRFGYRRDERGNWRTPIQVKAGGMGHGPPGDPLDVARPPQIGRPPAASRNPGRPPAAQLAPILVRFHAGCGDGLRSQPGXFSTRHRPVISG

SEQ ID NO: 16301 - protein, 323 aa, Candida albicans
VGQTTRAMLLLNLFDVQQTILLLIPATNFDVSTSFPEPVLSTTDTYRPVVIWHGLGDNYNTSGIHKVHEILDSMYPGIFVYAIRLDDNPSSDEQKSFFGDANKQIDEVCQQLRNITELLHGFDSIGFSQGGVFMRGLIERCPLEVNNLITFGSPHLGVLELPLCKDRFDWLCKRRNALLKKQVWHDSVQKRVIPAQYFRDPANIDQYLEHSNYLADINNERDEKNATYKENFSKLNKLVLVSFTEDTTLVPKESSQFHDFDPEHKRSIPFLYTELYKNDYIGLKTLYEKNSVDFLSIEAEHMHIDEDFIKNIAQEYLGGKLCT

SEQ ID NO: 16302 - protein, 75 aa, Candida albicans
PKMIEIQANDRLGKKIKLKCLETDTIGDVKKILGLQIGTPLEKIILKKGYQVYKDHITLDDYEIHDGFNFELYYG

SEQ ID NO: 16303 - protein, 295 aa, Candida albicans
  UNSURE (244): Identity of amino acid sequences at the above locations are unknown.
VRFHLLTPVKSLQKHVSSIQEKQNTDKLCLKLEELSKRIEEQESGYNDVVLRMLETNVYMMLATIQTTDYNLFNQLTIYFKKLITYTLQEDCLYTVNQVGEIFGCHLHGFTKYPLLVAFQLPYINRLIANIIRICKKYPIILQIWILPDGDSKLATLFQSLPNNTRLPMYQIIKNFLVVDSPLDQTENVVELISLTKVSNCLDNWFLQNKDLVNLLSNKCSNSIFQMENLDSRFHNVTEFAKYXKMFVLIVENCTPQFAQTYYNFLKTQLLIFFYIMRYVININLLFRSYKLLLR

SEQ ID NO: 16304 - protein, 338 aa, Candida albicans
DFSLMSLLQRPIDRITKYRLFVETICKNCIKLGHSTANIQNSFEKICNQLNQINRNTEDRNIHKELFELIDFSTIRYHEMQIDFQFFGIPYLVGTCWAVYVENKVPRGHNLPILLFKSHLILIEYCHYSKRKKFELKFVVPVIKCHLDLESTTSSYGLHTTYPHCIKVLFEIGLCHYELLLCWLTKTDYDIWCEELTVIVCFVNGNDVLQKQPTTEATQYLYKLPTNLSPYDINTTSESFTMRQGNCYFKQCLLIKIVIDKVLMKLLHTESSNSIHTSVNNNHEDKGYKIVFENKQLSTNERFFRASISKGLHIYLIQESEAKFIDFFLSWQIKNQLK

SEQ ID NO: 16305 - protein, 297 aa, Candida albicans
LSLARDLFISFFVFPFFNFPLSFIITYYIIAIMLLNQYTFSAERCTTPTSISHPPLACPTSPPPTNSLNRYQHKPVTLAPTVDHGCEINGTTIDCIPKDSKFYQLIMDLKQLLAGKGLSNEDIDVEKVKQLMADYDSNEIDWQHLALHDPSRNYSRNGIINLNGNANLLILVWSPGKSSAIHDHADAHCCVKMLAGELIEHLYDFPDHEGEELQCRQETSMKRNDVGYINDSIGLHKMSNPLQNRVSVSLHLYTPPYASMYGCSMYEASSGRKHHVDMSKYYSWQGQLVNEKESLTC

SEQ ID NO: 16306 - protein, 181 aa, Candida albicans
SLFLFNTLQHFPMIRLIRQLSIQKFVRPQPQSQLLLRFNSQKINFHKPDKAYSNERSDAADAAATILSELHDEKVHPNKATWLDALKQREKFQAEGKTLDSYSYIDPITTAVGEKTRSDSFSYLILPFKDDKWLCDAYINAFGRLRVGQLFQDLDALAGRIAYRHCSPAEPVDATGLNARD

SEQ ID NO: 16307 - protein, 323 aa, Candida albicans
PNISFLNAQKLLAPNLQRLTLSSCEKLFNFDGLRKFQHLKELKIENSNYPMDLFNEGYFPELEKLLYCHCKFPELEDPNNSLLTFSPNLKELEISNYRFQKDMLGSLVFPPTLTVLRLDSLIFNYDYLGANLEYIHVRTSKITCKSDFRIPHMAQYFILDANYLILESLDFMYHLPTSLAYLHLIAQELGKMNPATQLIAWPLKLRDFALENLKIDHYTLESLNLKHSRLEVIKIDKGNVKTLETDLFPVTVKDLTLKEMGIEKLPDSFENLENLCVLSFEGNQLREVDPVQLPMATLELLNVSNSNLRFISPLIVTTAWNSA

SEQ ID NO: 16308 - protein, 259 aa, Candida albicans
SNNNENALKDWVLKIWKHGFCLIDNVPVTPEDTEKLCEKLNYIRPTHYGGFWDFTSDLAKADTAYTNFDISSHTDGTYWSDTPGLQLFHLLYHDGTGGTTSLVDAFKCAEILKQKYPESYEIFCRIPVPAHSAGEEKVCIQPDEYNPIFKLDDQGQLLQVRWNQSDRSTMDNWENPETDIPRFYQAIRNRVEIITSPENEMWYQMKPGQCLIFDNWRVFHLRSEFTGKRRLCGAYFERDDFVSRLKLLVLGRQAVLDAI

SEQ ID NO: 16309 - protein, 814 aa, Candida albicans
QLIYNGKFKVRNTMFNIYWILTISITIYLIVLFLINLIPNVSIKYVGFFSLRGITINTRKSTIYISKISLRFNLFESNKDSGFKLVNIEIVDVQVTIKETAGPGSSALKLKIKNAIENISLSEKLHFKVPNSLYEYLLKTRVANRINIHVFRCAITHQKILQDHSIFLDYTRFNVNVDKDNSTRVTVILFNGLIQDKIDRLNKINLFRNIEFYVNCQTVTSCGTTRSNAVSIYLSDFKTSLSIGRLNVPLDLFVKSQSKKDAGNVEDDLTNTKVIDVAKYKNFIKEFMSVYSTTEIRLEDLTLSHKSMRTNLSNFVLTLEKLEKDNGVTNLKFMWYLTSFKFYHIDTKCLELPSATFFYELCPIQFLTVAQSLLRHEKNPSETINFDFNLTMSNPVFDIYYDQQDIVWDIIRDKMMKRRMNTMRKATGVQKKEEFFTKMSIASKMLKAVFSKLVVVDTKLNLHLPEFGKTEVGKFNRLSKSNSIITVALLELILKVFTRNINKGSNKFTLNTLFKMKNVKCEGQGNKFHFTKVNLLATYNMLQQNVSIKLSSKSLELLSANDLIFHIVRLFKNRQRIYFNKKFEEWKKMDVNNVCPWSEQMDNKSGAPVADTPANPEFIKLFEVLPSFISSVKIDISSIVMDMVCKEGLPSHKLYDEKLGKEIDLKDFIRGISFKVFDFSVTYKLARKHFETSVALLKAFTLSEYASEYIEDFDKVTEVQVSESEISDLSSINSAESIPLNDASPSELDESNTKKIKTVLTVRDILVSNAGKLDEKDPDRLTLSIPEVDGRVDMFLVWCCFYAKTMLERFKPTV

SEQ ID NO: 16310 - protein, 329 aa, Candida albicans
TQIRLMKVINVRLEQTGDLPIPFYFRLYSITSAYLQECEMINPAFAFNGAGNVLSEWFNNHVNYFVHRVHVNSVKSMINECMKENWKVTDKSDLFAPAQTIINEFIGYGEYITLNGSSGFSGDTWLKDFDFYESDDQEKDTTEDKNGGEALSLSGSGSGSGSVSTKKLTIGEQEFLVPSLVLKALPHIKDYLVISKAFPNYTSTIENNLLTYFKDMNSKASQAVLGAGATKTAGLKHITVTNICVCYLFLEVVMKIMDILTVSEVDFDDVMGSYKEHQNQLVLKIGMIVRDRGASETVGKILHRVLGDERAERIMSELGIGTPQPVSQE

SEQ ID NO: 16311 - protein, 100 aa, Candida albicans
RILRLENLNKKLQADLNSSKDVILSEHGKLQNEIMKLKELCSDYERKQKDSQRTIDSLQIQLRKDEDYKSRYESKIEEAREKVTLLKGKVEKKSQEIDQY

SEQ ID NO: 16312 - protein, 431 aa, Candida albicans
TTIMENSTTTVTQPDESYQRTKWIETKKNIKQLLQQLTPSNIKQTVLQLFQINLLRYQGLFIREIMKQQIRITTNAELYGSLISIINSKIPEIGELLINRLVLQFKKNYLQNNKNLINSSIIFICQLVNQQVLNEILILQILQMLLEFNVPNNNNNNNNNNNIELAIMVLKQTGLYLFKHSNTALIMILNRLKDILQDGANANANGGNGGVGLSSWNRKSIEYILKLARNDFKNIPIIKNGLDLVETEDKETHVITLEDKLYSRDHLNVFSVDEEYLDHENEYIELKKEILGETDHENEIQVIETTKNYEQKITDMSQSELLQYQKTVYLTIMSSMSSDEAVHKLLKLNFKSKIKNKTKTKTNSNDNEILADMVIKCCSQEKTYLKYYGIIGEKLISRNDHWHNLFIKLFKYYYDIIENFSSHTAVRRSHA

SEQ ID NO: 16313 - protein, 228 aa, Candida albicans
FSLPNHQPVSNMSATIIDNGQPKAKTPLKKEELEQIARQLKKKLSKASITAKQSLSPTNIKTSTTIALPKSSPLKSYIMKNNSNDHSPTNNISNLSSSPINLYSPNGKSPTHIRTPAAAFLSCSPLKNVSHADTSADDMLDSPTKRRKTSPRKMVLQEITPEKVKKESTLKPSLELTSTPTKKKPESPSKDKTTTPTMAKRELSSQSSTSSSAQNALLKIFTRRGKQV

SEQ ID NO: 16314 - protein, 469 aa, Candida albicans
DADLLARGEDSTLATSYYGYSVPDLKFNRSRLTVENTKEQTKHNEKVYEEEDEEEAPKLPQRPINHETATKNPPPLPKRKYKEEIEEKPPALPARKPELEKINLLKPVARKSSFPMPLKPTQLNLNVNLNASNESSGKHRSFKDIEELIKSGNTVKKTAPRPPEKLTTDKPTVTSPKTPVKPTKADWLTSLSTAKTTTSTPQAVSPDSKRPVPPIISHKNWIDSAVSKTDTKPPVEKPSKPSFLKKTTKPEIPKKPNLPKENLFETEEEAEFKLKFKELKSASASVSPEKVEKKITGVPQNKVIVEFEAKLAQLRSQSPTRKPIERTKDEQEYLSKFEKVKAGPIPPLRPKSMTFNNPPPEFQKRFEKIVTKAPPKPIKPSKVSLSTYQEKDTKELMSQLKRLGSPKKEDQEKPKVEHKKEEDTKDIVTSNGGNEQSKRRTRGPKRRLPKLKEIGDLKPTRVISGELFI

SEQ ID NO: 16315 - protein, 71 aa, Candida albicans
TEPSPNKQANQKKAEENELRISVGKTKRNKASSSVILIFFCRKKNLLGIVISLRLIVEIMMYVYSVIALIN

SEQ ID NO: 16316 - protein, 164 aa, Candida albicans
DDDLLTAGWITKSDSQHSHHKKRENVSPRKTKHNHDSTPRVRRDSPTHEDDEDNERGPMTPAAKAFAARFDKPTDKTAGNKHDHNRSTDGNSLAERLDKLSVSKQKKPNHIPHNTGSVKLETPRQDKSVVASEEDKQKEEKEKEELLKMLEELESQHLDWASME

SEQ ID NO: 16317 - protein, 116 aa, Candida albicans
  UNSURE (108): Identity of amino acid sequences at the above locations are unknown.
ICGQVILLRSPEISSVFGEMIGIWYFSIWQQQKYPESIRFIEFGPGKGTLIHDIMKTFNKFVEKLLPSDQKRPKIEIALIEASHVLRKEQWKLLCNPEDPMETTGERXYSLASQWG

SEQ ID NO: 16318 - protein, 475 aa, Candida albicans
YYLPPAMIARQSYRKLFRNISITRAFSNSHLRILETKKEPQANSSSSPPPHTDDLYFGKFTKEEYEDAKKIIQEQISKLEGQIKGDYNVRENLGKFSQFPEPASQDSKPVKVENLSDFFRQTIKLTGPIPLSTYMRQCLTHPEFGYYTTRDPLNLRTGDFITSPEISSVFGEMIGIWYFSIWQQQKYPESIRFIEFGPGKGTLIHDIMKTFNKFVEKLLPSDQKRPKIEIALIEASHVLRKEQWKLLCNPEDPMETTGEGYNRSATKWNNDIIWFDTEKDIQQGDKNVANFIVAHEFFDALPIKSFIREEKGWRELVVEHTPSVNNTQPKLEESTSARGANKFETDDSLDTEFHLTIAPKETPSSMIPQISKRYRDLPVGTRIEICPDAELYIMKMAKLLSDSNDKGAILVIDYGTENEIPENSLRGIYQHKFVSPFWNPGEVDLSIDVDFQALKQLTEGIVDIYGPLKQGDWLH

SEQ ID NO: 16319 - protein, 65 aa, Candida albicans
TKSKNPTKKIWLLTFYLFLDPEDDETLTDKTRDLGLVVVRCTSLLTISPVDGSEIIDNPFIQPEQ

SEQ ID NO: 16320 - protein, 225 aa, Candida albicans
INHSMSSLSLQDGRTTPTKQMDDHSRRSAGTTPLGNFSKLKTSQSFANDSIEYDQDHSFNQSFDDRYSKPFTPTKGNVRSSKYMLSAMNHPKNKLTYQQQEELLRKKEKEIEYFRSMQQQQNYQVKPKVNDSKRLSFQHTHHSSPDVASRLHQMDYTSPTSIKSPSYGDVPHSQNGKYQHLLNNYVATSDFTPTKTSKRATMAFYEPEFLDEFDEIAKEESPVGN

SEQ ID NO: 16321 - protein, 203 aa, Candida albicans
LNIVMTLISQHSSRKLPQIRNFPTETKKTTDKSNPQPQQNIPPHTPPVYQTHEHPHSNKLSPSGVSTTEDSHTPNSMDSNNNSGVYSTEFEDLKFVNSAEIDSIWLQMMNLKSHNQNDGFNYNPTNSSNAPYHPNYNNGGDNNRAFYPNPNTINDAFGYPLPNQFFEQNFTNFANFNPNADNNEAAMFFDMFDNVPLDKFFNQ

SEQ ID NO: 16322 - protein, 91 aa, Candida albicans
  UNSURE (22),(41),(53): Identity of amino acid sequences at the above locations are unknown.
GFLKTPDFLNIEAHPFDPSSFXEQIESDNKVRREKGLTARXIPHEQMNEKWLXENAIRWRFHNAGNDDIVQQSNGHFCGKGVMGFGFVKKW

SEQ ID NO: 16323 - protein, 347 aa, Candida albicans
FFFLFFYFATDINSFTFPLLFFFLYSSFLIFTIMPSPNHNREVIIKLSITRTHTPPDSTTTTPTTFIEKTICVKRELFTKIKSKPALTEFLNKQLPGYLSNDDNYLVYTRKSKRNKDFVSLITQDDFKSLARSLKVKNHVKLNVIDTSTPPKVNNTNQDNKNNDNNINNNNNNNNNNQQYGYTYTGTTYKSGKPPSIDFGNLRDALIDAAYDHFKEIFNEFSNGLKKEMASTTTTTTTTTATTSNTKESPPAPISTPAGPVVEEPKAETKTETKTESKVEPEVEPEVETDSSPIHPNICCDVCHPYDFVPLKGIRYNCLVCSNFDLCSKCEAKQHIEKLQFGTHSYL

SEQ ID NO: 16324 - protein, 143 aa, Candida albicans
LVRCVSSVITIAITIFYVGVLFSHNLIVRFRDFRFCYIAFCIWHFILGSDSASFLCMVILCFTFVYLLCFLLVNLIYFIILTFGVRVCAVCCMTVFNLLCSIVSLALVILWLFLFGCGFIFMLLWLWLWLLEISLFSNFMKCS

SEQ ID NO: 16325 - protein, 159 aa, Candida albicans
ITYIRDKHKSIFEYFIRATDILINDHIKLLLKENDDSIKVKYTKLNDKLNKLIKENESLKSELEFMNQQQQQQNQNQNTNVDGDDYGNTSTNNDPLSKLRMNDLRNKWKAERERRILEDQEAKKRFKELELEIQRLNEVIGNNNNNNNNNNKQTTNDNN

SEQ ID NO: 16326 - protein, 92 aa, Candida albicans
NLHQALDFSCAESHLQHSNDNHVDHYQHHLYDCHIDHHYRHFLPYRNLLPNGTLHHNHYSNSNDPNPQLMVQWLVIFDKLEILNKAEYISQN

SEQ ID NO: 16327 - protein, 476 aa, Candida albicans
FVIIIQYPIMDNSLDQKLLAFISSQSSSKPLSPSKSNNLPKADIKSLESLCVTSLDTLLNNIGGSTTNNSILPLDSLDAIEVRLRGLYLIYADDPRKSFDILRKHQLYIVKLFNIKQIDYVYQNLNVLLAQINKVFKIEFTSKSTIFTGIEFTDFNNWNDDTSFFNVNRKDITQLIIAFHFLVLQWIAQYVSKNLKSILMQKNQFISLDEFCNIPQMFLNSSNFRKWQLLPSNENIGKYNTNNVKLISGFIKVFQSIKVSSSLSKYVGLTNCLKLKLYELTKDESLLESIGFSSNLIPFINDANININEFIRKHVPIESEGSNELQTRLLKSPQLVTDSDFLRNLQNDSQLSVDKCQIIISSFNGFKDNLKTLLNQQLSILDLITIHLKDSLDESVVPILSQLFQIYSHFKLMKRMRNISNLLFNLGNKVHNEIYRNLAIDYECAIFEISPNNDNFKQLFNKLNRNQVTGSLLSNV

SEQ ID NO: 16328 - protein, 323 aa, Candida albicans
HPIYMNYTIVKPKNFDKLITYTHNINSIEKICFSSSNQSEITNDLFRKMVYGSSNCFVYAIADLFRDEPVCWMTVPQPISNPVLLLDVNNIGDLSRLPVNRIKELTINCCNFQNFNKDIQHLSQNETNLKKLKLIDPPPPPSCFQLDHKPMNISELYLEFKNYRFNRNVLKNFNLRKIKKLNIFNHNNNKLPFEDLSINAQDFECLESINVNFSGTKFLQFIKQLPPNTLKEIRICDSYHKVKYFLDTLLQHNESLISIIVCPFHKRGYFIDYINSDKCYFLKSLNVTQFPKLNYIVEKSVMLAVVRQDGLKPKLEPIRFHPN

SEQ ID NO: 16329 - protein, 304 aa, Candida albicans
  UNSURE (300): Identity of amino acid sequences at the above locations are unknown.
SPLLAFFLSTSLVSMTGGSWLSWNAKKNESINQLSESNEDVIDEDEEHPNDEESEHDDTVPDDNGDEVDDHVKEKRGLGWAFWGNSNTNVESTLQNVKDSKSSGASDQDNVESTLKKDKAVHVGNTILSSTSKFLVKSESTGKAPQNTEQGDDAVLYKPHDKTAQFNQINTHKNEDLRENLIVPDWNTCLPQTATNPIFNTSTTSNQGNANQTVRTDITNWRQFLGQISSKFGFSSNPTLPEEEEQSQSPGIESNIERDVGLLYEKSYKLNGKSLAVSPENKRACLPNSNQSYFLLTGRXENTG

SEQ ID NO: 16330 - protein, 187 aa, Candida albicans
YFKPSSIRNYYYKERMTCQTGRKCSLGIEEPIDISSKNVPLNAFLIYTMSSTLPDHNSTNSWNEYHNNLSITNNTQVTTSCADNVKTTSNVPRCATDINSKMTTSEMETLHRCRFSVCDFNNLENYLYQSEREECSRVIEQLETHNGKSISTCCNSNTDINAQCNQMKNHKRRKSIALKFKKPQTLL

SEQ ID NO: 16331 - protein, 334 aa, Candida albicans
IITTLYISIMSSHIFKDIQDKENELKTSGIRRKGIISNENAGPLLSKDSNSRQVQQPQQTQQQQQQLKFTNKRIPLGGKNHNSNKLLLNRSQSSLNTKPTTQGITNVKPPSLPKSNSSLGFSVVLDQPTEQQKQLPQPFVVHNEQVLPVKRKLLQDTKDELSQNSKRVKLEKKESNANTFTDSLTKPTQNVLAHVDDLQTTISSKTDQLNSSNLTHNDINRNNVDPVKRNLRLKAIDDLVESHWQDPIETIPETVGAENNNGEQLEELDIKFFSTPNESFDIGDLDENHLANNEQKLSLELDFEDESNVGEIPIIEGIDEEIGLTSDDLDNLLG

SEQ ID NO: 16332 - protein, 437 aa, Candida albicans
KQILLNYKIYIDYQSTTRFITFLSFVLLIFQILTSVIKYLSLNHTPPDSIILCVCVCAIFSPFFFPSSYETIPISLPAKSQKSKLTSSMLNVRPPKLDMTSSSLKSATRFFWTSTIRSKNRKQENISLAAALNLLVKPTEPTKTYKPSLYDSLTKGSVEEQFNKVPIHVPIANDHVSDKFISNILHGIKSSNVSTNHRGVNYSQLYEMNRVDLSAFIANVDSQEILFDIMETFQNHNKLTPRVLTDIILNRRFHDLDKSPIDLIDLKQSTNFQDLDVYKIQIVLLKKYHDLKQPLNIVKNLKHNFDSIYLPLIETRKLTPFYERIIWHFTFDYLNQFKEPHYIETLSNLRTSFLIWETTKKRKSTQISQEILNFHTNLNDLQKLFLETASSVEDPTHISSLRKLSMKYRIYELHPEDAKLESFKKEFGDLVLTLNKI

SEQ ID NO: 16333 - protein, 905 aa, Candida albicans
NRISTIKRNQMCSKLKNFSEDVINELNNLSDQNQKSPKSTTNSESLNQLLKSAKVLATETPDVSKLTQPSDEEISNNVSTEDGSEKATLPPINNTTTDTTDNGTATTTAAAAAAAAPQSDLDQLPAPIKSKLKKFAKYEEKYPILLDAYKIEKKKNEIIRIFEKVLQENTPVSSSSEGKLLVEYLNGLNEKTKLLNGEIRKLTKDNNTMNFKIVKLEESNKELNNDVKRLDTMQKEKEVMGKKIDSMSEELEIINNQNDKLTKDLKDKEEKIESLKLEITDRDNKIKDLESNTSSNSKELNTELEEPKEVPTEKVNQDKSSSGEENTDKDSSVGDSSDNSDVLNTEISQLKSQLSTKETEVEELTNEVRTLKSQLNDKNEEIEDLRDLVKEIGNELVTSKDEIKSLKNSQKSTDNEDSTTKEDTNTQINDWELKYNSQLKENKELKEELDVATKESKEKEKERKKSEDQLRKQIQTLKQKLESTENKFESKTKDLKNLLEEKEKLEKRISELSKFKSNDSSLKLEISSLKSSLTNKDNSINELKTQVDELQQSNKSLNSKVEELSKSNNELQSNSMDFLKDKNELLTKQEVLMENTKSLNLQVTKLQQEKQDVITELEKTKNKLDIVIADKSQSANDMLSYKKQHEELMMKSKEYSLRIESLEDDLTEARNLLQERTRETSNMRRLLVDAEEMLKQQKQDSKLEIARALEDKAEIERNNASLIKRKQRELDELKESVQEYKLKVEKLENKVMTLEKEEKSKESLSTDNQTQMSKELSSTIETLRTALNNSTNKIRDLENYNNNLKKLSEDNTLRFERLSKNYKILNQQYQYMKERKGSESSTKQDKPVETAPESNDKQATNVAYLKNVLLGFFQHKEQRDQLLPVLKTLFEFSKEDEEKFLMALK

SEQ ID NO: 16334 - protein, 194 aa, Candida albicans
PVSGMKIALERKQRFPELFSGYDLVAQEDLGRPLSDLAPELIWFREQTEYLNLTIPFFFHAGETLGDGNSTDYNLVDAILFNSRRIGHGFSLCKHPTLIDEVIEKAVMVEVCPISNEVLRLATDILHHPLPAMIAHGVPTAISNDDPAILGQDIAGLSYDFYQAIQGFDNLGLAGLVGLLSNRLRPQAELTNAP

SEQ ID NO: 16335 - protein, 92 aa, Candida albicans
  UNSURE (3),(54): Identity of amino acid sequences at the above locations are unknown.
KKXKKRDGVSLVAQAGVQWSNFGSPQHPPPGFKRFSCFSLPSSWDYGHAPPRPXNFVFLGETGFLHVSQAGLELPTSGDPPSSASQNAGLQA

SEQ ID NO: 16336 - protein, 681 aa, Candida albicans
  UNSURE (11): Identity of amino acid sequences at the above locations are unknown.
HYDCLPSREYXEFQKIIDSLSDVNDDDNNNNVEEKYEWKFKSYKQLMKLYFDQQNFQLFLETLTQLIQLIPKFNHDGHYKSYIEESFSKMINRYSILANVTFVTQFYNTLLNYLDSNSNSSCRLWFKININLLNLHLDHQIYDDIPNLLQKVYSKLDIISNGGNNGCLETTLNSFKLQTIAIEIDYLTKINQFNLNLPRMNQLYRMSSKITTVVTHPRICAIINQCRGLIQFYRGNYHRANIEFYKSFQNYDEAGSTMKYKLLKYYALCSLLIESELDPFQSQETQIISKSSNQFNKLKLLIKYYNDLDLEKFENLVFSSLELDSSLPSSSQEIDEESIENDDIYKVAIQEILYNLKSKVLLNYIKAYSAIKFEFLYRKLRIDENQLRSILLQLSMAGKLKDSQIDYVNKVIFTQISINNSKSSNSDNKSRACFPQLSQKDIYYNVKYYEVVSFGQSDATNGSSVVSNAGNNSNDYRTDDNMDIDDNNFNFHIVPTENTNTDYFRKYFFVIDRPLKIQDWFIPIESWYLFLVSSIPHTYKQEISQKEQVMHEQKQVEIVNSNGITPSAPGATITTSTMSRADIELSNFNTGLLNSVVNIDSNNNFGNGVDDEQYEYDQSVQQLNKVDLLNDWYAQAREYYNLLIDNSDSNIDNSSNNTKGKGGSNTIRSNSIVENDMTISI

SEQ ID NO: 16337 - protein, 344 aa, Candida albicans
  UNSURE (10): Identity of amino acid sequences at the above locations are unknown.
QNSSQQKHLXKELPIYWKMGTPGGGKSRYPKKDIFYPKVNRTKGNPKSKSRGIGRFLEMFSNDREIISPKLDKEGSTLQNESIQVGYYISQDKHGDVRASPNNHLPDNEHNDSDFEFDNFDWPLDDVVTASTVVTYSQAQQQKLLPLRNANSHNDEISTDNEINKSKNVSNLSKRVNTNDMADSLEKLHLSETNNKRLPETNTVEVDELTKLKPIINEGNSGIHSQSPTKPLSELHDQIDLTRSGSSHNIIEAQEQKVDNERQQDQDIEPFTQETELLMFRLPSELQTPISRDILLKLTKRKNPNNEKSNDNGDVEVGDEIRVVDTVINRASGVSTSPKRSALG

SEQ ID NO: 16338 - protein, 215 aa, Candida albicans
TLIITRGGDSEYVKLGVIDGISLSEVGKESIQAALKVFPISCVELELSLFSQEVITTGILEELSKHNLPLIAYSPLCRGLLTDYAVENSDTFLASIPQGDIRHHLDKFQPDTFNKNLPALKELYKFAHEVKNTTLESLALSWIVTVSEARNFRGIEKVTRILPIPSGSTKKRVESNFGSLIELTDDDLQSIDEIFAKYPISGLRYNQFLEGTLFQ

SEQ ID NO: 16339 - protein, 185 aa, Candida albicans
PLQMEISKITSPEDWEYFAKGAANILFKYTGNNDYLKRKLLRLRLLKQEEEYISTCELYDFIELRCKDLFPNQIIDIQLTVLDSNFTNKLNSQGNKLMLNERYGLLLPNILDGDYRKISLLQKCQLYFNDNDQDINSVIFEIKPKWLYDNYTDNYCRTCSLNQLKKVQDIFAPWIYYIPRLLNKV

SEQ ID NO: 16340 - protein, 399 aa, Candida albicans
ISMGQTRFISPNFIDQFKVDDGVCDYDVCWDGSDEQGIWEDKCEFILGQYEQYKTQLESFINDALKKKQSLIELAQGKRKQLVNELRKLEAVLPLKKSHLYELEVQLENSNEQETSVFDVLGDHISDLATKLEAHKRDLLKQESRIQSLEKLLAKLSQEYNPNFNDPAVKESIHKYQEYLSNKDEDVVEDIKETNAILLELSEKAKSLVGNTDSTPLQPTIRNMLHHYFQLFTNTFLTKPQLQVKTTLSNDQLINLIDKQKQEISKIESKIDDIKKNLSNDYGSDDILRAFDLTTINKKLGGYTYRINLLHSVAQDDVLIGNYKKYENGKIYFDRGAKCWNGPQRSAIIEFECGKGPDLVSVSEPEKCSYKFIIKGEAWCHPITEQEIQNRFRINYDLL

SEQ ID NO: 16341 - protein, 172 aa, Candida albicans
SKVPVIVITSSNTNPCSLTSLGTAFFSVVPMARMADCGGLIIDVKAVTAWFIPKLEIQMVPPWNSSGSNLPTLALLPKSLTWLEISANPLDSALVTIGVINPVGVATATETSTFLYCLITPCSPNQAAFTSGILTQVLAIALINKSLIDNLYLSSAVAFNEARNFNNLDTEI

SEQ ID NO: 16342 - protein, 65 aa, Candida albicans
TNTSSTMHLMYTLDAEGKRIYTLKKISEDGEITKSAHPARFSPDDKYSRQRVTLKKRFGLLPTQN

SEQ ID NO: 16343 - protein, 123 aa, Candida albicans
EYSPLRIIGDKPFDSSRLGSNRLWHSSQLGNSFGGINQIISENTLLHSRDFKWSNKKPTKEKKFNHIPNNTYIVLFLMQKNNNTYKHMLSAGFEPTISSLLVRCLTNLAIRALHVDTKGAEFF

SEQ ID NO: 16344 - protein, 133 aa, Candida albicans
EYSPLCIIGDKPFDSSRLGSNRLWHSSQLGNSFGGINQIISENTLLHSRDFKWSNKKPTKEKKFNHIPNNTYIVLFLMQKNNKTYKHMLSAGFEPTISSLLVRCLTNLAIRAEEICKCCNCSQQDSNLRSPHY

SEQ ID NO: 16345 - protein, 211 aa, Candida albicans
KIKLNVSYVNLLYMKLILNNTLPKVLSLVKVKLNLDLKLYRYGHTLNRKKEGLDSYTNLMEAGYGKVWNVYGEEGRKEVFYGMLPLLHDLCERIINSDSRFKNKNVYTLVYVGSSKQGKGKGNLRKLFEYMFETYIDNDENSIAYLESSSPANIPIYNRFGFHVTEDIVLGEKCEGAIRGRDYAVMNVMIRGTKGHDWTKDENTFNSKGKL

SEQ ID NO: 16346 - protein, 461 aa, Candida albicans
GRSFLVELVIKSIGQNKKKEQSQLLSLYLLPRLNNAWRYKSKQIIAVLHIIGASFVCLLFVINTYLHSKFTSINSYRKSPLGNQPLTQQKLNKINLIRIMLLCHTKAIPELEVIVPVPSSNSSLGSKKARSNSLESVASNPKRTRALIYENTDKPKLVSSVSIRSSFSIPNQLDISIDVATLKDYRRVAKTLLMAFEDDPFTNFILNTTKYTKSNTSESTYKKKKLDLMLSYFEYTAYDCLSTEGTVFVIKDNNFEKSLSDFDIKNLDKFPFLGVALWNQIYGAKISDSSSGSDSDYDDEDYFAPESNSIFNKSVVKFNLKAVKGRCRFKVFKDKLPYLIKVRNEILIKELLCREDDDHHFPCDLDIWYLGDIATLPSMRGKGLGRILMEYAKTQFLQDNPKSYMYLESSNPVNRKFYLKMGYTLMKSYSIRDNKYVDLEKILHLDPKNKAVNMDALMYFP

SEQ ID NO: 16347 - protein, 391 aa, Candida albicans
  UNSURE (7): Identity of amino acid sequences at the above locations are unknown.
MQVGSPXRGEDLRLEEETKELGLWNMFLSKHYKEGPQYTNLEYGLMARYLGRSYTAPEATNTAAPDTGNMELFAKYGTTYQKDRYLKPLLNGEIRSAFLMTEKGVSSSNALNISTSAVKNSNGNYVLNGVKWFASGAGDPRCSVWLVMCKTDNNKQNPYQNHTVLIIDAKKALATGKAKLIRPLQVIGFDDAPHGHCEIQFQDYEVPADEMPNVVMAGVGRGFELIQSRLGPGRIHHCMRAIGAGEFALLRIAHRANHRLIFGKPMNQREGFLSRYGQSKIDIERCLLLVLNAAHKIDISNAKEAQKEIAMAKIETPRTISDILDWGIQVYGAEGMSQDTELARMYAHHRTLRIADGPDEAHLAQLARNEAKKFAKVDDFFANMETQRSKL

SEQ ID NO: 16348 - protein, 422 aa, Candida albicans
VFQWLKSIIPEAFEQKPESNTEIFKELLPYVIIHVAQAMRERQDEYVQTKFHTLILSLNNMLVKFLIDRDLPSSIDSIQQPENIPDSVIHHSQEILKTGGVDFIDKAFKELDKLKLECNHLLQECETRIDLDRSEDDMLRRKQGSTRWTRKSTDDAAQELIKKVDKMKQYLLQANNGDGFVLKKFYDIKPALDVYSSGYKALSQYIPNSQYIELPEQLLIVISDLRSCLARANTLESERKEFLQTLEIRSRDNSILPKLITEYNSNRSKYQTENGEFNFNAFESVYEKHMKLFDSDIKYIARTRDSQMTLEHEIDSINQKFVQEFKSLQNSSNEKRQQVLQYLETAYEKFLEIINNLTEGSKFYTDFIEKGSAVLQECEEYLYRRRVESRDLELAITNSCQQQQQVQEQNEQLSVPRNYSNE

SEQ ID NO: 16349 - protein, 362 aa, Candida albicans
TNPMNTNLLFIPLKQSSVLDLGDELRQVITNNYFQPASSFNSDLIYITQLRNQVAQIKNVNDELGKTSQDDSILLEYLQVLNTLQNKFSDDCVEFAWFDTLAYGPQGPYRYRSLKIEKLNVIYQIGSLYSQIAISELRHTDIGLKRACHYFQLSAGCFMFINNFLIETIKNKNDPLVLLIPLSMQLSTIQCLEYLMLAQAQETIWQKAINNNSMKDSVVARLSIQTSEYYSKALDFGNSSDLIKLEWINHMKVKKLHFLAAAHLRSSTIAADSFQYGEQVAHLRVASQAVDQALKSKKYVNSLVLEDLQGLADVIKVRLRTAEKDNDLVYLKIVPQEKELKTIIGVSNGKVNYSFFSTDWKD

SEQ ID NO: 16350 - protein, 98 aa, Candida albicans
LFSTSHKDIGILYLIYGMVSAMVATGMSVIIRLELSGPGPMFLHGNNQVFNVLVTGHAIAMIFLFVMPILIGSFGNYFLPIMIGAVDMAFARLNNISF

SEQ ID NO: 16351 - protein, 324 aa, Candida albicans
EKQLNPVLAKVIEKTQTGFLKERSISNSIYLLDMVLTRYQTSKTADAESAGFINLDFRKAFDSVHHDFILKVLQQVGFGPKATNFLMAITAKQKAKVSINNIEGPCFPLKRGVRQGNPISPLIFILILETFLARLSKEIEGIGVVNEVSLVAYTAYADDVIIFFKNKNDQERIQQLLEDFGRESGLYLNNNKTEVCYFNDIPEISFLPYVSKKLQLEKLTYLGVPMKKADEEFDPWTLFVLNLNAQIRMTPILDLPYQLIMKLMNIFIFSKLYYRDLHSPILTTAVSSIITTVQQRLPLYFKLQRLQTPNHLGLHHGRGRSAIE

SEQ ID NO: 16352 - protein, 233 aa, Candida albicans
LLFLDFELNFFFIFHFILSTIYFNLSIYLNKQNNLITYNMSARSIAKIVTARQQAEGVGARVRRSIGVINQKSFNPFLMFDHFSSSGTNGFPEHPHRGQETITLVLHGAMAHEDFTGSKGILYAGDLQFMTAGKGIVHSEMPVANEDGSPTVGLQLWVDLPDALKDTEPRYRDLREWEIPQVVTDDGKVTIKVISGRSHGIESIKEMAYTPINYYYYKVKAGGKFQQRITTRI

SEQ ID NO: 16353 - protein, 83 aa, Candida albicans
STLVGGKKLDQKVVHYGPFVADCEENIEHAIIDYQYAQNGFENRKTWKTLISDGVTKDMIEGPLDGNLDKREATKKSYLESKQ

SEQ ID NO: 16354 - protein, 195 aa, Candida albicans
IRFNYPKFLKIEFFFFSLLHQVYYIIKQKTNQQLQMSVRSIAKVVTPNPPRPGSPVKIRNSIGSSNQFNPFLLFDHFTIPSTGGFPAHPHRGQETITLVLKGGVAHEDFTGSKGVLYPGDLQFMTAGKGVVHSEMPVPNEDGSPSVGLQLWVDLPNDMKDVKPRYIDLREWEIPQVVADDGKVIVKVISGKSHGV

SEQ ID NO: 16355 - protein, 267 aa, Candida albicans
LYRLYPQIMSLRSIAKIVTSKQKTEGSGAIVHRSMGIYGQRKYNPFLLFDHFIGANNHGFPAHPHQGHETITYVLNGAVAHEDFTGAKGMLYKGDLQFMTAGKGIMHSEMPVSKDDESPTVGLQLWVDLPEDKRNIEPNYRDLREWEIPEVIVDDGKVTVKVISGKSHGIESIKQLAYIPIDYFHYKIKPGGQFKQELRSDFNYFLYVIRGTTLELNDNTTAEQYQNVYFEETGDFVIGKNVSTKPDEEVEFAIIGGLQNAVAGQLL

SEQ ID NO: 16356 - protein, 381 aa, Candida albicans
MVISPLILKIQFLILFILFYPLRVLSINNTNKESSDMSTRSIAKIVTANEQAEGAGARVRRSIGIMNQRNFDPFLMFDHFSSAGTNGFPEHPHRGQETITLVLNGAMAHEDFTGSKGILYAGDLQFMTAGKGVVHSEMPVANADGSPTVGLQLWVDLPNNMKGVKPRYRDLREWEIPEVVTDDGKVTIKVISGRSHGVESVKELAYTPINYYYYKVKAGGEFKQELQPGFNYFLYVLNGRNLVLNEDTKVDRYQNVFFGDKGDFITGKNAATKDNNETEVQFILVGGKKLEQEVVQYGPFVASSRDNIQKAFQDYQYGRNGFENIKTWQTLISGGVTKEMIEGPLNGNLEKRAAKKKAFLEKQQKKAAPVAAQPELVKDEL

SEQ ID NO: 16357 - protein, 529 aa, Candida albicans
IFKEKECFLLIHYLLLSLPLQKEEQPKVEEEKFDTITTTPVVAASPVIGFDNSKPKQILDKFNSIEIDLNSNNKYKGFRRSVDVAKAPIHVPIPQSPSFQKTHSNMSSSLKNILASTDDDNNNNNNNNNTNNFDSGFQTPRRLSFDPRRKNSSNPTTPKLSSSSSCSTFSKTETTTTPFESPRLSAVANGKFVSQQQQKDQGLEDVETDNEEFSTPRASRRGSFSESYPVGSLLHKLKKFQDPEEQQEHQEETTEDAISNKSEDSIDAAPFDPRMRRRRNKELNHKLIPSPESSEVDEQEEEEMLMNKLSPATETTHKDSKQSVPERSLSRGGLTGGTFDYQSFGLKGLAPIVEDDDASSKYESDGESSNNSPVKAVKNKLTTTKSSGQGSTEDGETNSRTSSLSLNNSDYKSSISSGTADADHYAIKGAGVRSHSRNLSTASSGNDFDFTAPVSKSRFRNAPQQQSSLYSLGRGPSASTSSINSTSRASLGFMRSSFVLKKEMQTQGYNEPENVCMSMPVTPRMSNKP

SEQ ID NO: 16358 - protein, 778 aa, Candida albicans
ISRTNSRANSLNSGTNYRFGFLTRAAHINLSKIDEDLQNFEYDYQVDNPALDNPETKLMLNLPDNSEQQAPKELGSPFLASDHPITAVRSDSLNSQGQPKPLRSILKNSQVPIIVEKPASPSKLPLVAAAAAASVTSSPRGDIRQQVVESDDSFKSPISRAPISPVSLQSPNKSRFSRVPGSPNQRIGGSPPSSIRFNEKVQTIPVYNEDSDTRVRAQRVKVSTPSAPAKTKQQTDADLYAAAMKAAMKKVYGDRDPNQQAAAQESVPTSKVAPEEPKKMKLGFIALSPRDKSHHERKSSFNSETENVAKTSEESADSDATPAKAIKGSLAQEVPPDYEYVNHHREFVTHSLRGDNKGSTRKDRVKEEKRKAKEATKEQAQEEKRKAKEQAEEEKIRAKEAAIEEERLAKEKAAEDKRVAKEQADEEKRKAKELKKEKKKFGFFSSIKRRTSTASAYSSGSGSIVRGTNRGQHDEDHALSDDISTTEAYSSHVNDSSLNPVLNSVTSVSDDLTEVQPPKIEKRPEISKKEDIPSNTEKLNKLAETKEVELEKLLEDDLAPEADVTQKDTADVLVEKPDNTEDNFGSVVIDDELYQVSIPRNARFSDGHEMEPSEGMYLTEKSHNEAYPLPNIVGSSPVINTSSNDKLPLPIDEQHTEDANEVFHSPETPSEVKADIPVPELGSIIDEEDEFEDVIVPEDKESVYENSEPEVIDEEAPHLESVETDRSPAHIDSDPNVENSYSKQVSEPINNTPTVEASPGADYELALMNQQTDTEREQ

SEQ ID NO: 16359 - protein, 236 aa, Candida albicans
LFSLNRKSAIQEIEHQFDSTIIPYKSTINEWINCSPNQLISSIIEKGANGQTVYEIYHSFTTKLAGLECKQSQKERVHNKFVEDSIYVLITNRYFLAIANGFINDPIDIPMVTTPQDVGVIMTPTEIAEILRLDKIDYQAYLLALLRLVDTIVEYTTTTVINESVASTGSKSSNYSIAIINLKIVSKLQNGFQLLDLKNDVLRKRYDSLKYNSQRLNKIVYDLSLRNLITTKGEVN

SEQ ID NO: 16360 - protein, 960 aa, Candida albicans
KFSNQDKPNQIKKNMKLLSKFIVTALGLTSIVNAAPTSSSSAEEAQKTVPVELSIGVKQLPNIHNDSAVDANAVAKGYSLVNVSLTARGLTGILKLKEATNIYGYDFEYLNLSVEYQSDTRLNVHIEPTDLTDVFVLPEELVVKPKLEGDAKTFNFENSDLVFEYDEEDFGFEVLRSSTREVLFSTKGNPLVFSNQFIQFNTTLPKGHSITGLGESIHGSLNEPGVVKTLYANDIADPIDGNIYGVHPVYYDQRYDTNTTHGVYWRTSAIQEVVVGETSLTWRALSGVIDLYFFSGPDPKDVIQQYVSEIGLPAMQPYWALGYHQCRWGYDTVESLETVVENFKKFDIPLETIWSDIDYMDGYKDFTNDPYRFPTDKFRKFLDDLHNNSQHYVPIFDAAIYVPNPNNATDDDYEPFHLGNESDVFLKNPDGSLYIGAVWPGYTVFPDFLANNTQEYWNKMFKDWYERIPFDGIWTDMNEVSSFCVGSCGTDRYFDNPVHPPFEVGYSGSDYPLGFDKSNASEWKSISEAAAATKTTTTTSSSASTSIDGKNTLAPGKGNINYPPYAINNDQGDHDLATHAISPNATHADGTVEYNIHYIYGLIQERAIYEALLEIHPNKRPFIIGRSSFAGSGKYMGHWGSDNYADYYMMYFSIPQALSMGLSGIPFFGVDACGFNGNTDMELCSRWMQLASFFPFYRNHNVLGAIPQEPYVWEAVMKATKTSINVRYSLLPYYYTLLHESHVTGIPIMRAFNWQFPYSKELAGVDTQFFVGDALLVTPVLEPGVNHTKGIFPGENAVYYDFYTHKKQKFTAGKNETLAAPLGHIPLHIKGGNIIPTQEPGYTTTESRKNPFGLLVALDAEGTASGKLYLDDGESVDVEEALYVDFVASKNKLVASVFGEYEVRQPLANVTILGVDSEPKKVLFNNETVSHNYENGAVYLTDLEKFTKEGAFAEEFSIQW

SEQ ID NO: 16361 - protein, 491 aa, Candida albicans
YNMAITNLLESQDAHSEASLHAVSKTKILFIVILFIVSLTLFVFQTEFTSQAYKLKFLEPVVLLAVTHGSWWLLWPIQIIFVSLWRTTLKMKKTDKEATISNSVGSGIQYQRLNSNSGLLENEGDSTQQQNQLQVPLHQINYFTYFKKCIVKQFHNVYHTSILIYQSNVKGDRSTTYLNQLIDENPHISNSSSIRECIKTFIATPSIRYVIIKAFIITVVLTLAGFTWYGAMSMTYPSDVTAIYNCSAFTAYAFAIPLLNEKFSWLKASSVIIALSGVFIVAYSGDDSKDQPKEENPYPLRFWGNLLILTGAVLYGYYEVLYKKYLCIPEHLSKITTPRRQLTFANFVMGFFGIYTLTILVTILIFAEVFHIHHFNLFDYGDNTTTIWLYISGSIVSNLLFSASFLSLMALTSPVLSSVSSLLTIFLIGLVEWWVFGNKLGFQQLVGDLLVIVGFVMLTIASWKEISEGNEDDEVDAVSTYSFALSTEENR

SEQ ID NO: 16362 - protein, 291 aa, Candida albicans
RGFPPVVKTPPPSLILFLTSEGSYSVNVQHSAPLLRNGIPESYLANNNFDVSLNVLQQLHKLKKNHKPDTAKVINDYLLHIPKESFKYDPDSIIFDYTKRLDKGEKLTIKELKYLQSLEYSKDKVAHGGPPKYFAESRLIGTTVGDHYDWRFFNGVQFGTVDQSLTLHRLIRTWLSFTRKSGITTWIAHGSLLSWYWNGMAFPWDNDIDVQVPIMDLHKLSLQFNQTIVVEDPEDGFGRYFLDIGSFITLREKGNGNNNIDARFIDIDTGLYIDITALALSNSETPKSDLS

SEQ ID NO: 16363 - protein, 409 aa, Candida albicans
ENGLNQTDLSRLNFYQQANALVDKTDRHFKYAWVFTDIIQGYTHHIAYPFFNRYISDRERQSVLHHMIRVWFQLMETYGYTSWINYGNLLGWKFNGLNMPWDTDIDVQMPIVELDRLAMNLNQTLIIENPRFGNARYWLEISPSYIRQGNGKNHIDARFIDIHSGLYIDITGLSTEEMIPEPATTTATTTKGEVNQSNEDENDVAASSSSIAVHCKNWNWHKLNELLPLKQAFFEGSSVYIPNNVSTILLNKYGDDALSDYKFHNHIYYPDISMWINNDICQLQRNTGVIGGINLGVNIKNWNPTTNTNNNNNEGEEKSPIESSCDLKYIQDEYNIIKESVMRHQYLENLNLEDKQHQHEQQQRQKEEMISRLNNLPIFRKDPWDYYYDINHNLVTNDRWYVKIEEIAV

SEQ ID NO: 16364 - protein, 302 aa, Candida albicans
SSFSQKIEIQMPIKELLRLALTYNQTMVVEDVTEGFGKYFIDCSTFVHYRGSAKLGNHIDAKFIDVDTGLSVEIGGVAISHETAPKRYTNIVTEAQHNGQLRQVYNTRRPRFYTSDEISPLRKSMFAGTPVYVPNNISAILNQEYHKKLIPFNAYGYYFVTQLNLWIHHSKLKFLFEKFENTSLLLENGQTDATELCELVATIDEEQIVELLTRHDDILLEYYLSSDLGDLHKKELICLFEDVNKIDNARICDKTTKIGESKHRVELANDPEYRELVTSFTFQNFKRISLYDYDQLARSKAS

SEQ ID NO: 16365 - protein, 308 aa, Candida albicans
YLNQSVIVDFGHDINNIRLGRYFLDCSSLMSQRVRGNGNNNIDARIIDMDTGLYIDITGLALSNTMAPARYNHLLHSSPNNGELARENSRDATISELARNEFLQVYNCRNNHFSRLEELSPIRLSLVEGEFGYIPNEFESILKIEYNEKSINNKDYNGFVFLPKLRIWVKKKPIVNFVAAKEEKEQQQKPNQSSKKTADVITIDLTDEEYSQYLLENQSELISYLITSNVTLFHQDELVHYFNGRSAKSLFFTDEESQQVQEELQSQLILKKGLIQDLSQDLFKFNSFQSNPNYAVFTTAWKIRRLRY

SEQ ID NO: 16366 - protein, 334 aa, Candida albicans
YVTIGRSIFPTMKMILKTIKRRKLICKDLDANKKKPRINQKNMLFPTKEYCIDDDEIDNILNDQEQLSSYDSYVVEQLKKIKQQNSPMSLGFHIFEFPGRNAKKYRPILGKAYVYEFMKNPSTLTMLLPTTNQEQQGFQMMYQMPVNQQNRNKISNSNQIFKLGVTIDLKQELNKLITSNKPQKLTSLTYEKHLSHDMFVDNSPAIIMSIQQQLQTQPLNQTDTNYLNSLKFSLLYENPGKYFHEANILTREANFALGGHYDWRFMNGIINNTPQLSVSINQLIKSWFRLTNQFGLNTWIAHGSLLSWYWNGLQFPWDSDIDVLMPILDLLLLS

SEQ ID NO: 16367 - protein, 681 aa, Candida albicans
STPYTHTTIYYKMPRLKRALLSPKLFVKSILLFTIVYTIYLSTSTTTSVYLSTTQSKLNIYTNQLYQKINLQFNQWYYNILVYDYNLFSDSNFQQQLTIIKSEKLQDENHKIDLWNLDDSFNLPVSVKVPNYLLSPSSSSSSSTDKKPLIQPFDPRLTLSVYYNYIETNKDNGNDLKLPFHWSDWVDFSKLHKYILNPSKTDLCSSLFDISNNDKLNKDSEIKSVDQYCQFIGNANNGNENKATNMLGYKIFAPAQAQTGANHELIGKSYLYTQAPSPKRLIFLTNTNGNYQFDVDNYNVNNISNSILYNEKLTSNLASKVNKENEQSSTLNVLSSYISLIKNSPPSLLPTKQQNNPKDNEIDSHIIEIPEEYFINDPQSIINQLESSNSQLSNSEKDFLSSIKYSVDCKDPPKYFYEAKYVKAMKENWSGEHYDWRFYNGLTIHNAQQQSIILHRLLKNYLKFTQSNNLITWIAHGSLLSWYWNGINFPWDTDIDVQMPIHELYQLARFYNQSLVVENAGTKRLGNSDKTEEFEFDGMGRYFIDVGSSVTHRTKGNGNNNIDARFIDIDTGLYIDITGLALTNEESPDRYNDFLTIDQNTDAGKQKFDQLKQNQKDGDKNNNYSLKNQQLKLYNCRNNHFSSYNELSPLIQTVVENQPGYIPKNFMYILNDEYNLKSLAN

SEQ ID NO: 16368 - protein, 769 aa, Candida albicans
RFHFITMSLVKSITSAKLSNKLIKVILFTLVFINLIYFTSVIHNNNKERISLITSKLTSSTSGNNNKQQEQHLTDADNDKLLSSSNQQQQDAHETVLEEQEKEQQTQQQQSLSDDDIQFKKLVDAKLNSVKKNQGKYYMTNTDLLETKIKVPIKQFLKKYESAESWINKNELYYDPRFTLSIYLNELYMQYQEMSDEQLIDGNDNQHLIGGKINSNELPDISLPFNWVDWIDLTMLNKEFSKPMYQRLKCQDIQANSHSNPDTSYFCTDNEDISEETFQEFFKMGYKYKTQFPGFIINDHERHEHYCDNDYRVMQAKAYTMTHLLNPLKVIILGADKKDGNGGTFEFSVDNSKTRLTSSKLIDRYMESHGYYTRKQDSNIDTVRNGKRFFFDSSEDQNEVPDIIEMDYLSTWNQLNEKVVPKYLSPNETGYTNFLHMRDKNSIALKESKFMEPPSIASQIEQYTGKPENELSPQEKLYLEGLQECSKYTDENEVRYFRMAVINPGDPRNRENEWGWHYDWRFFNGALNYEKPDWNQQELTHRTNIILDRLLRNWSKFAMEKGIITWIMHGPLLSWYWNGLLFPYDNDIDIQMPIDELVNLAKNYNQTLIVENPSEGYGKYLIEVNTYFHNRGISAEQNHIDARFHDVDSGIYIDITALSSSNAEVPKEYKQEKTIQLIDDLTKTNSNKEGAGNNGKQVNSENQLIFNDRRKHFYKIDQISPLKFSMMQGIPVMVPNGITNRLQFEYSKGLKSLEFDNWFYIKQSSPTAA

SEQ ID NO: 16369 - protein, 85 aa, Candida albicans
QRGSFQPAGEEFVMMFIPHQQNSMMENVYSFLGALIFSIYIIIDTQHIMKTLHLDDEIIGCISLYLDIINLFLFILRILNNNRDD

SEQ ID NO: 16370 - protein, 260 aa, Candida albicans
LLVMKTMCNRPEHYPPQHINQPHQDPNLNHQPFNYSHQYNGLPPIGMMMQLNTHYQPQAQPQVPQPTAIPHSQLPVHLQQQQQQQPPLVQQHHYIHQQPVFHQSNHMVTHDHKPSTSSSHKRGPWSREEDEKLLELIKIHGASNWVKISSSLETRTAKQCRERYHQNLKPSLNRSPITPEESAKIERLVAIHGKKWAEISRHLKGRSDNAIKNWWNGGANRRRRANLATTTLNINGNNPMREELQRKSPTPGNCYYQFRS

SEQ ID NO: 16371 - protein, 143 aa, Candida albicans
SDIITTTQSIMAPPVPVYSISEVRKQYKDQLDNPEKYKCQLKSITQHECTFRPTTIRNDNVQSEIICLPFKRIFQRCLVPIITKNTDGKKLRLEKWINIEITDEQTNHDLVDPDSKYGKDVQDFLNAEREFKKFMEIESDGNL

SEQ ID NO: 16372 - protein, 272 aa, Candida albicans
HQYFPYLLAPKGSLDRQFPYQDGFFPVVLYFLTSLLNNLVWQFDITVPMHIIFRSSGTVVTMLVGYFFGNKRYSKHQIVSSIFMTLGTIMATLPEGNSLLIEINIKFLTGILILTIASVISAFMGLYSELIYKQYGNQWHESLFYNHFLALPLFVFVSPTIYREFGVVLQSKQVTLGAFKFPRQLLSLTVNVLTQFICTKGVNMLAGETSALTVTVVLLVRKFVSLILSVIFYGSYMSTLGMIGSIIVFGSAAYYSISGISDRKIIELKKET

SEQ ID NO: 16373 - protein, 265 aa, Candida albicans
NCSTIVSRMVGHLNIDDLEIAEDLQGGEINLSILLGNEKLLNMIKDSYQADEYLLKVIKYLKEEEEVPSEMKSAIKKYKMHDDLLLYKSFATFKPVVGSEAAKEIIPTFHRQGHVGITKIYWAIQPYVFVPKLLTMITEIVNACDTCQRTKSISRYMGGLMMPSEVPRDCFSHIHVDFITGLPVTVEGYDAIMVVVDALTKYTICCPCKKTYSAMDVAKMLMNEVFSVFGLPHKIISDKDIRFMNLVFDYIYEYYQIQMATTSTN

SEQ ID NO: 16374 - protein, 1122 aa, Candida albicans
RQREEEGDVKDIKTVVGEEKEELHQVEDCVLKDQEELRNVEKKVLKEEEELQKVEESMEKEKQELYQVEDFILQRDETVKKLGESNQSQQEPYTTATSGSDQRFRSQQPNIGNTLAQDLALIPNLDPEICRIAIKYPKLFETKLRPPPPRDFQYKIQLTDHTQIYSKPYKCNQEEQALIKDFINEKLEAGVLVPAPIDAWLHPIFPIRKTNANQSSTKIAVDLRRLNKVTVRMYTYPTDTKDLLSSLTDSHYFSALDLKNAFYQVSIHKDSIKYFGISTSEGNYCFTTLPFGAINSPTIFTNFVRQILEGIPCIFIYMDDILIHTKTLHDHMSLLRRIMEKLNEHQFQMNYNKMQLLTTKINFLGYSIQANKISPDISKIQAIQNWELPTTTTQIRAFVNFSNHFRIFIPEIAKFTNPLNELLKNNNGKNIKIEHTQASIDGYKALKAAIIGLPTLQLYNPKLPTIIFTDASHMVVGGYLCQPTFRNDKEVLVPIAFSSHKLTETQSRYAAMEKELLAIIVILEKFRYHCSNTVEIYTDYQSLASYLDKKTTPPPRIARFLDLIGSFSPKVYYLSGKKNFVADIITRYQTQNIKELVDEDKILGQTFTVKRNLKQQLLPRLEAIELENLNESQVHKIQTSLEQQQQHDLEDNDEELPLQLFKLMNDELFVIINNQLLKYLPRLEYNDICQTIHDKHHPSTRVTDYLCTLAYWHPDHLLIATNITRKCHYCQLNTSIREAIRPYRPLEPLKAFSRWGMDYSGPYFNTVQHRYILVAVEYVTGLTIAVPTLHKDADNAISLLQSIILIMSAPTELVTDHSKEFSSQALATLCDQNNIQHHITSAHHPRGNGRVEKVNHLLKKILKALTNDTMQDWDLKLYDALRIYNATPTIFNYTPLYLALGIEPHHNLNQLQKDLIENLQKELPPEVQSTEEHEENPNDEQQEEGREQQISREEQQDGRDLVHLRIYELEAIKKARKLHTNLKTRRNAVQNMLKEPYGIPAPFTKGQWVYRIRAKARKYEPNFDGPYQVQEVLGKGAYKLRDITGREKGIYNQDQLKLAYSADNDPIQVFSSFNKEYDRVQQKLLDKIQSERDHQLNCLSVQHLHRQRRLLDISSCLEQILQ

SEQ ID NO: 16375 - protein, 103 aa, Candida albicans
PPVGIPTISPAELPLLNTIILLASGVTVTYAHHALINGNRTNTLYGFTYTTILIALFVYFQYLEYSYAGFTLSDGVYGSTFFSLTGLHGLHMIMLTIMLMICT

SEQ ID NO: 16376 - protein, 173 aa, Candida albicans
QLITTMFKQIITSSSTKSTRLFTSSTLKYLSTSSSLLKPTLAAAAAAASITTTTTDNSSEYLTTGGSTHSIPAKGFRLSQPKTWEESNESALSKATKFLFLSEIARGMYICLEMYFRAPYTIYYPFEKGPISPRFRGEHALRRYPSGEERCIACKLCEAICRSSPTGPGKSAN

SEQ ID NO: 16377 - protein, 130 aa, Candida albicans
LIGYIETQGKVSIINKTNKLVHRFSISTKRDPIILNALKRIFHISASVKYGNGLYSLDTTNNRSIHNIIEYFITRDHTILFLGMINLEFSIWKRSYYKYKNKPLALAKAQSLILKIHNAKPHLCGVDPYV

SEQ ID NO: 16378 - protein, 391 aa, Candida albicans
TMSKIEPVTEKEEEYVSEWDRRRYVPKAGEPELPPQLSEFSNKTTDEVIEELNRLPFFMTKLDETDGDGGENVNLEALKSLAYEGDPDEIASNFKNQGNNCYKFKKYKDAIIFYTKGLEVNCDVDAINSALYLNRAACNLELKNYRRCIEDCKKVLMLDEKNIKACFRSGKAFFAIEKYDEAIKVLEYGLNIEPENKDLQKLLQQVQKRQETLAQIKAKKAQEEEQERLKNIVLENSIKLRHIEIVKSSSPPEVLKTAKIRLEDPKDYQSQLIFPAMILYPTTDEFDFIAEISELTTPLELLEMVLNLPMEWFDDPKHNDFNVKKLECFMETESGGLIKVGKKIEVNNALMNEKPKAPLFDNALRLYVVPKLDVAKWTSEWNKETALAARK

SEQ ID NO: 16379 - protein, 1010 aa, Candida albicans
FYHNMSSSNSSGGGGPPSSRYNNDYLDYGKQRRKNFYSSNLTSSTSPTTSSTNLNSNTHISSNTVPGLSRRDFKNNGSGSSSIPHLKDSNSIPTTSRNGSYSSSSHYSNYGNYHDYYSGHGRNDTWRKSSSGAGDSRLTASNSSNAPGAGSGPGPGSGSSSSSSSSSSSYQQYRPNGDYRIKDRYDSYTGHDGSINTSKWKMSRSSVGSRYSAKDRMRGKQSSFTSGSNSIPLGSSSLVNSTNYRSTSGGGSGGDSYYGSGRSNGYSSSMNSMYSNPKAVDRYSSLLKNGGYSKPRDYKYRYVNKDYNRSTLITPVDKELKKEYEDRESPTPRDEDEEEEEEDEEEAEEEQEETNDSIQTIETKEIAENKLESDKTEIVKPVLENGLESKEVKAKTEPETKAEIKPETKPIEQLNESVEKPTLEVTVGYKPTPEMIEKATLEAATQLCRYPLTKIEYEFEELKKKFTQETKHHESGANYLKYSLARPIVDFNEFPFFSNNYQSFIKSKDSLIESFQKKHNVINKKKKSLWKDYKQGLEVWETEQLKMDQQLRVLHPPNDEMRREIDSSDNRKQYQQQQQQLQQQQQQQQQQNQQQQQFNDSNSGDNIHFSTRRNRRHGDLVTTEAEFQEILLSLGQEDDENPLVKAERVAAKIPDMILDPVKRDKVLFMDSNNIVRDKNEWAQRVKHDFMNNFSEREHELFCEGFCLHPKRFGAIARHMGGLRSASECVVHYYMTKKKVNYKELLIKSRKKSKPRRKQKAAASKKEAVPVSTTVESGETEIELPPSSIVPVEQLVSEELYTETGRRKRAAAPVFDGKEKEKEKKIQRKDGTNIVVVNEPTSVNTAGGTAIATATTANTTTTTTTPTIDNTPTATTVITTPNLAPNVNPALAHVNNTNIINDSNSAVTMNIPVAGSAVSSSEIPVPTTTTEENKDNKRKVISSYWSITEANAFPKLLEEFGMNWGLISDKLATKSTTMVRNYFQRNAEKNGWDAIVANQKSSKMSIMSLLN

SEQ ID NO: 16380 - protein, 511 aa, Candida albicans
LRSIMPIDYSKWDKIEISDDSDVEVHPNVDKQSFIRWKQRDIHEKRMQRNIEIKSILIQLTMYAKLNERVDYLLEKLTSTELLDSEKVMSKLNSEFDPQEKFDYDKLIKDKGLTLRKGLKDLKFDREEIENTPCYNEMIEDLFVQIKDDHPETKTDGDKLIEYLKEHRNRIDDVLSKQTIKLDDLLYQKAQLIVSDDLHTGFDRSFLNKDKPEEKEENLDKPKAPEAKKTTVTTTETINLPKPVEENTDKEILDELEILPATKEFAKIPSDNLSKAAEFLIKHPSICTEQQKDALIMTAFDLQLENKSDEAKHIVHQSLLLQYVGQLSGNGKAAPANVINAIKLFFSKIAAESSPAKHAFLEDVNQTFNHIKGRCEIIKEEQRQNAANKEGTGEEEEEALIQLKALDDNTELLVNIPQEGTKEYEIFTTKLPIEFQNAIKTESIDEVNKEFAKLKIEDAERILEIFNECGVIGISGYIEDEKEFEELKKEYAHETANQEEDQSASVEDTVD

SEQ ID NO: 16381 - protein, 108 aa, Candida albicans
YAIKIIKTSKTVITTPYNKGIPNKISNEIAVPTTSAKSVAIMAISAQKYMKRFNFGFKCNRHISAKSKPVMVPNLTHKACKMIANKLAMKIMKHNLYWYIDPDDTDVR

SEQ ID NO: 16382 - protein, 80 aa, Candida albicans
MTLPPINKLIELLIAEINDPISNIIIPATNVHLRPNAILILPYEGTRHAMGNMKPDVNQPIFSNALNLFPTVVKIVETMV

SEQ ID NO: 16383 - protein, 344 aa, Candida albicans
RFNLLLQVTMGSSIERNIGIIKYAIIYISSGIGGFLLGANFTPQGIASTGALGALFGIVATNIILFIYTGKKNTNMYGTKHYALFICIMIGEIVISLVLGLLPGLDNFSHIGGFAMGILSSIVVLKDPFWVFIDGIITYPKNPSTWQQFLNNWNPMYSIEDKIRSRFFIWCGVRIIALILMIIYLVLLCKNFFNNDINTGNNCKWCKYFNCIPVKGWCDIGQVSVTSTTTTSDSNSNSNSNSNPTTTASSSSSSVPTTRYSTMTYTTSMPSSVENPKSNTNSEGTNGGLRKRFASSFTGGNSGGTANIAARAGGDIQQQYGIGSGLYVIVIFFTISFLKKKKII

SEQ ID NO: 16384 - protein, 198 aa, Candida albicans
QLSWTPDFNKVYKDGLADENHTDSGVLLEEGISVTPVQAAFRVIEPLKGEIKLTDDEEEEEEEEEEKVANGNTLLVTIPKESYIYDRMTEPFKKLGYKITSDKSIINSNISTSIFHYGEYEDIDLDSISNENYFIPSYIYRKALIRKHYLANTVHHYVTKNPKSILKSAVPESYQLEVDYAEFLDDSLESSPRGGRTA

SEQ ID NO: 16385 - protein, 272 aa, Candida albicans
NLPFEICSFFILMFNRSIRISRSPLLRSRTILPRTFVTNTHRLSYRLKQRNPSTIFKQSAMTLITISQSLDEAYTKHKVIPEVVDQFDTQGLLSIEYGPTELVTLGNTLSVEGTQEVPKIQLTLNSPTEDGKIESISENDKFILVMTDPDAPSNSDHKWSEYLHWLVTDLKLPHTKNEDGEPEISHFIDVKEGRELVPYMGPGPPPKNGKHRYVFLLYKQDPNAGELTAPKGRPKMGLLDYQAVVSKDWVEKNATNSKLLSVNFFFAQNEDN

SEQ ID NO: 16386 - protein, 157 aa, Candida albicans
EIHYSTYIKLIQLLLMSSDPLTSNARPATDSLITVRIIKSFPYRNVKNYIIKDIDLKSTTPKQLLEKLHEIINTTGALRPYRNVEYNSIKIYTKAHGSKSMNLVINFDNDEDWVLVNPSNNGDKQSLWDLDIRNETELSLFNWDDYVAYKENPVEKW

SEQ ID NO: 16387 - protein, 650 aa, Candida albicans
SLHCHIYWHHPSPYSLVHSFIRSFVYQYLILRELCFFLPRMFSIPVSSKTVRLILVSLLLITLINILAAFQRSTLSSWFPSSRHIINKFTDLRLALSSQESVLRDEEGEIYSLVGYHHDFDSNLVVVQKQYLLEKTPNEDTTEHFWNFLQSNFETKSEYDLNLIDGYNYKKLIKHLNEQNELQLSHSFVEQYKMENQFIQSFQNFFVQLIDTIEDCKPDLDPINNDNHYPNGDKIVKYYELRNKIPLENMKQFNIERLIHRNGRIPIYGGHLREQYKDELIRNKEFLSMYLTLSDSEISALKKSHTKFLETMMENWPENLFKFNKFNNFMKGDGIVYLGGGKYNQLVLLSIKILRENGSRLPVEVIIPYKNDYDIQFCDRVLPTLNGKCKLMTDYLPQTFVDKISGFQLKNIALLISSFERILYLDADNIPIRNPDVLFTNAPFTTKHLVVWPDLWRRSTSPHYYTIAGIEVDSNFKVRNSYVDGDERGKYTDSMYYSYHDCKGSIPEASSETGQLLINKKIHFQTLILAMYYNYYGPDYYYPLFSQGAAGEGDKETFIAAAHKLDLPYYQVGEFNREFGPINDNTRKHEFYGMGQYDPIIDYYMSTITTTQKDTKKKINYNSPLPEKYAANDEDDTCSNYDFHLFQSSS

SEQ ID NO: 16388 - protein, 194 aa, Candida albicans
DELCNIKCIKKIKFKPISTLNMPITSLESYLFERKFANASSIEILQNAVIGIDVEHYLSRIYTFKKEQFLPAIGGAPSSLRDYIKSDLKVFQEFNIKPIFVISGLHTQLEQKYKNNLIEFDTQHVENTWNKVNSKDPYGHGFHHQHSHSHSANIDGFRNLNEPLPIYSMINYIIKFFLEFDIDYMSLTTGKNPP

SEQ ID NO: 16389 - protein, 336 aa, Candida albicans
IFPFWGVNGEYTSTKTVGTRSDIISTILLRALYLYGIVNDKSELSSIGKILVEFAKSVNSDISQEDFEHIILLVLLLDSKALKLNEPSKEYTDVSNYYKKSMVDQQQQQQQQQQQQQQQQYSNQFSKQGLADDIVKKITLISRIFSFKKLNVSPINYQGPISRSLLNFRSHVEFINYNLINTLQLVLVDFIVRQEQNSIKTDYETKDDWYKLIDQLPFYKSLNNTLMGVISEIYFEMAIKQKQGQPQLTKEEIIKNCQNHLADHIFSVNIPSFNINVNGINSTSKTQLNNDFKQGVEWWKKFIILVDIINKIDKKLVDNSLYQEIKQADEFLKEFV

SEQ ID NO: 16390 - protein, 338 aa, Candida albicans
CKCGSVQGVLKTLSPLFAITGQSPNMRSINGKRITRETLSEYSEENETDLTSEFSDQEFEWDGFNKNQSIYQQMNQRLIATKVAKQREAEREQRELMQKRHKDYDPNQTLRLKDFNKLTNENLTLLDQLDDEKTVNYEYVRDDVEDFAQGFDKDFETKLRIQPSMPTLRSNAPTLKKYKSYGEFKCDNRVKQKLDRIPSFYNKNQLLSKFKETKSYHPHHKKMGTVRCLNNNSEVPVTYPSISNMKLNKEKNRWEGNDIDLIRFEKPSLITHKENKTKKRQGNMVYDEQNLRWINIESEHDVFDDIPDLAVMQLQSPFKGLSQFYPTHHFHHCNSHCP

SEQ ID NO: 16391 - protein, 559 aa, Candida albicans
IQIYKYQPIISCSNVILEIFINQTNKNKNKNKNFKTFLTIKQDTDMTVKHSETDVLIIGAGPAGLMCATWLSRCGIPFRIIDKRSNEIFTGQADGLQCRSLEIFQSFSELSFDFASLNQSWKMANHMIEMCFWSPNSNGQLERNSRVADTIPGISRFTQSVIHQGNIEKWFVDSIDYFSEGKIQIERPLLPVSINVKEENEGKSNIDDYPVEVKVVKVSSEEARPEQYGNKNVANGLFRQFDGDQDKSYKEKPASEEEEEDGEVEEEDCEIIHTKYVVGCDGAHSWVRKQLDIDMEGEQTDFVWGVLDMVPITNFPDIRNRCAIHLKDSGSVMVIPRENDLVRFYIQLKEVERDPATKTDNKKFTGNVDDTQAKTKGRIDRSKITPELILKQAQKIFEPYTLEMTDLSWYTGYQIGQRVSPQFSKFNNRVFIAGDACHTHSPKAGQGMNVSMQDTYNLGFKLALVCKGLAKQEILSTYQLERLKVARDLIAFDHKLSRLFSGKPMIPNSDILDGVDMDEFHQVYLESNKFASGTIVDYEDSLLINKLKLNHDKNEEGEG

SEQ ID NO: 16392 - protein, 265 aa, Candida albicans
THSGKNEKKKNLLLQPNYIVIISRKNKFISFLHHNTKTKMSFEITILGSSGGPLEGSTCSILLKPANISYHDIINDNLPDQVLCIDAGSGMGKLTEIIHQETTTKTSYCNFLQYYPDCETVSYYYHPNVTITTPFSNFQPGRPILHTQNIFNNLQNYLISHSHLDHVCSVVINSAGFNKNMLNKILYGSHYTINAMQQHLFNGKIWPNMPSFKIVNLNYLESNRSERIGIYTVKMFDLSHGEFNKLTEDKEDAQHHSNSNSNSNN

SEQ ID NO: 16393 - protein, 393 aa, Candida albicans
QTMFLKNIFIALAIALLVDASPAKRSPGFVTLDFDVIKTPVNATGQKGKVKRQAIPVTLNNEHVSYAADITIGSNKQKFNVIVDTGSSDLWVPDASVTCDKPRPGQSADFCKGKGIYTPKSSTTSQNLGTPFYIGYGDGSSSQGTLYKDTVGFGGASITKQVFADITKTSIPQGILGIGYKTNEAAGDYDNVPVTLKKQGVIAKNAYSLYLNSPNAATGQIIFGGVDKAKYSGSLIAVPVTSDRELRITLNSLKAVGKNINGNIDVLLDSGTTITYLQQDVAQDIIDAFQAELKLDGQGHTFYVTDCQTSGTVDFNFDNNAKISVPASEFTAPLSYANGQPYPKCQLLLGISDANILGDNFLRSAYLVYDLDDDKISLAQVKYTSASNIAALT

SEQ ID NO: 16394 - protein, 383 aa, Candida albicans
LAPSCPAVKTLLNGTPINSIKIKKNKPITKKYLQFVEKLFEQEPEIARNFENGFDIIKVRQLFLQSLNETNGMNLLSIDSELSDQLKNLALANGNEGLSTTTKYIFVPIATIGCGKTTVFNTLNNLFPQWTHIQNDNISKKAKLKICDLTLLALEDDDQSVVLFDRNNSASRERRQIFTTIDQKRDEHLDDTVDLKYIAINFIPEDLSEEELWDITYNRVIQRGDNHQSIKSKLDENLVESVMKGFIQRYQPINTSRSPDDQFDHVIHLKLSKDENSLKSSLENVRIIIDDLVQNFPDLIKEKPADELINECFQKALDYKPTFVKNMTANTIKKDPTYYGIAMHYSSILENLEIVSHNEHFQNIRSHIQTDAFHRRKRSKLVN

SEQ ID NO: 16395 - protein, 598 aa, Candida albicans
PTLLTTIIIVNNKVVPQHHQRKRSLSVDVAPQQYLASDSTFMSPRRAPQPPSGESPIDTSYKFGAGSEYDRPPSHYGMYMTRTNASSHALGSSSPGINSRPASSIYDLFSNHNRNGSSTSKQHHKRNSSVTNNNNNNNGNSNHKHHHRRHSSVFSYLSSGNDDSAKPTPKLLSSKFQSNNLYKGGDDGHGDFTSSSNNNNNNSKLVSPAQIKRETTSGQSSLHESGSKSKGKSQIFDLSNSPVDIDDAKFSPKKLNSVSVRTKSMDAIGGNGDDRRVASDSTGLSQSKPNNSSRLKGIRATSTQSFRSLTGSKKLKTSAFQEGIREITPDEAIKTASHSGYMSKRSNNNLAWRTRYFTLHGTRLSYFQSLKDKKEKGLIDITAHKVIPIDSASDDTDKADRYAAMYASTTFAGNYCFKLVPPAPGFKKGLTFTQPKTHYFAVETEEEMRAWVKALMQATIDIDDSVPVVSSCSTPTVSLNKAQELLAKAREETKLRDEQLKANGYIRSLEDINDTSFLASLDYPNMSGDIGFGSTSPVAATSAPKLTLDTNFNRKSSGTMGTTGTIRYSREPHVGTVPTNPPKFPESLRQNGGFASPP

SEQ ID NO: 16396 - protein, 191 aa, Candida albicans
ILLLQDNFYYTTSTQITNITNYKMAIRNSHKESASESESNTNTHTRHTAGSSSNSKISQKARNQLALQQQQQYLAKHINSNGPQDKPKLQPLDFTTYSDTALLKYSERYGFHNFSRIDSLNSDILNSEIGKKTYSKRSKKNQKDTGRISKLEIANHVKNHFSSLPAKENDIITGFLYKVKHQDKEFKFTFQ

SEQ ID NO: 16397 - protein, 346 aa, Candida albicans
KKYTQKKSTLYLLSLSTSILFTIMNDTFLNLSDSHCHFNPECTASDTEKFAERLNEQSKQIPDNYFHLMTTQHLDLEFMDTLLTRLENPRVLVPYFGVHPWFSHLFYIEGTPTKEEHYKNVLKPEPSNELLATLPDPISLHKHKDRFLEIINKHNLEIYGIGEIGLDKLFRVPNNGYCGNLNFPLSTENKLSACRVDINHQLDVFKFQLTLAEQLKKQVSLHCVKAHGLLFDQVKKFSNITVILHSYTGSIEQAQVWIKSLPQNRLYFSFSNWINGEKIEALKALVTALRPTQILIESDIDVDRSFIEQRQTKHFDHLDGIYKKIHEHIFIDSLQIHNNMLNSIGI

SEQ ID NO: 16398 - protein, 87 aa, Candida albicans
STTSMGTTVQNVLEWNWQNEFTFLGIGNVGNVFVQWNALSSSGSIGSSQRNTQDSIGTQFGFVWSTVQGQQEFINLSLVDNIDLGFY

SEQ ID NO: 16399 - protein, 415 aa, Candida albicans
  UNSURE (339),(374),(375),(383),(404),(409): Identity of amino acid sequences at the above locations are unknown.
KSIMLKSIKRSDSYLLESSSSNNSTSNIITTSTNNTQNSLLKRTTKPNVSSTRAPSFTFSRLLSEDTFNYNTNSNSNNTNIHNPNNNNSKYSTIHGISSSSRRNNFLKVCSWPFTKIESFHDSITKNDNDNDVDNDNIVEFADDQSTLGNDDGNTKHLTIADYSNIKRKNFGGLISDSNGSGNGIHGYNYTLGGPNNGSSGPLTGINPSLENINHVANEKFHKVFNRVKRPPVEQNNKRRCVLLSNLNESMGLNSVLQQVCGGPLEKLTVLSNGKIELFFIFPEHAKQFYTYGKATGLLMVNGVKLKVEWLNDENNLVNSTLSSSLMSDILHNGCRRCXIISKNIPGKRIRNGDKMFYPETEYHYSTNLNFEEXXNDFNKFGXVLDMGSVISKKLCFSIILYDXRCAIXAKQNWN

SEQ ID NO: 16400 - protein, 1072 aa, Candida albicans
NSGPDNDLLPAVGNSYDRSFSTLKENAIMISPDFLDFINKDTMDLQQYPTVYQTFLDRLICATIDPHIKQSLKYRKLSGKKMLSEIISQFGSMTIKDKVNYSIIMATKIHSDVTTHLDKMNLLAQFYAFLMRQPQDLKPALLLIAGINDSRFNETYFHDNKELTISKLERYIINQNSKITPSVPTPSPRDAVTGLLVTQPTSALGQSEVFNTQCFNCFGLGHTARRCASPKRLGQINNLRSKLLAFETRSKSRKRFPPQPPPTNRSANSTIITNPSPTDDTISSTTEDSFPRDVFGWAASSDQIKSKDNLSLFFDTGASAHLINNLNLLHDYKPSKENKHVITANGDKIPILGTGTVKLQHGQHKISLRNCQYSPHLHINLISPRLLLDDSTSMTITQSGIYHSKIGQIGYYSTEDGNLIKCMFRPITIPHLSLYSQYVEMGLQSNNVLRNIPAFTVHIPQLHDSLGHTSTQQVSNVMKRFNVTTDNIGTDCETCRLGKAITQIPKISTHTISSHCLELLHVDVHGPISVPSIFQERYFLVILDDYSKYLTVQPLCNKSDATAEIIEFINHWEKFFLGNGNYHTKILRSDNGGEFLNKTLTTYLDSKYITHQTSNAYEHHENGAAERAIRSVKDMARVILLQSKLPVPFWSLATRCAAFVMNRLPHKTINGKIPYEVWTKQLVNLKMMKPFGSQVYVKIPIGVKSFSAQALSGIMVGYATNKKGYLVYDPTQNRIFTSSQIICHPSIYPAANLTFNEPLIISSKVTAAHLHPLTISNLVIPPTNAVSETPLANCVLSSNSSVCPKLCQLQTVLAHGEDKVYALIIPISIGNMRRTRTNENKICQLDESNNTTIPDSVILSANNVLLNLESRSSIPKSYKEAITSNEKSKWADAMDSEFNSLQSNNTWSLEPLPEGRKAIGVKWVYTIKDTGRYKARLVALGYRQQAGVDFLETYAPVIRGESIKLIFALASKSKLKIHSIDVTTAFLNGEILELIFVKQPPGYEDKKRPNHVCKLNRSLYGLKQLPLMWNIKLNDVLIKEGFRRLGGDLGIYISKDKRTISSPRGRTDRDKV

SEQ ID NO: 16401 - protein, 298 aa, Candida albicans
LANSLQIETFFQADEFFQALEPAHHFVYGYGYLTWEWKQQLRSAIHPLIYVLGYKLVGDNTTLVCISPKVINALIAAIGEYNLYKFIIVYDSEKLAWITLMLSLFNPFNWYVITRSFSNNLEMVFTVLALRFWPWNKKINGSWYISLGFGFVSCIIRPTNILIWIPLGIWLLISIRITLKWVALSFLEVVLILLINTALDYYFYQKLTFPLYNFLEFNVFKNLSIFYGTAPWYFYIFQAIPLMLMLYLPLMIYGLKKNILLLTGLFYIIGFSLIQHKEFRFIYPIHPILLYFTARGYV

SEQ ID NO: 16402 - protein, 248 aa, Candida albicans
FLFIKKPPHNLFKGMCDKGINCKYDHDKEKIRICHLFLLGKCYSKNCLLSHSPNDNNTPQCRYFLDKSCQNPNCKYRHFKPAHYNDPNYEIWTCRPFAIGGFCLRGKKCPFLHLLNCPDFEEDNYCVMGRECPLTHQFTLKTQDLIATKSNKYIRDETVVTEESTPTPVKTIVNSYTVDPKLLFVVDETGNYQFYIDNNGGDKSQFDLNLGSLNEFLIELSSSSEESDLEDSQEEDDEIEENEDYVVL

SEQ ID NO: 16403 - protein, 150 aa, Candida albicans
FKMEQPEATKLGAEVVVGIHGDAEVNQYKGLNYPIMNLWERSLYVWQGRYVDGIILGAPYVPTPEFFGKLGKSKVVKVYHGPTEIDRGVNDKIDLCVYETIGRHKYDDMDTEFIVNRVLADKQAYEERQKRKGWKAEIEKKLQQSEQSQQ

SEQ ID NO: 16404 - protein, 267 aa, Candida albicans
LTMSFPRTHSPRPSGSREQEDLTLMIKAFRDSMEAKLDLHSQKLTALVANIPRTDEGFEDLSQRITVLKNHQKAFLPKQEKEIGSLLHRQREEEGDIKDFKTVVGEEKEELHQVEDCVLKDQEELRNVEKKVLKEEEDLQKVEESMEKEKRELHQVEDFILQRDETVKKLGESNQSQQEPYTTATSGSDQRFRSQQPNIGNTLAQDLALIPKLDLEICKIAVKYPKLFETKLRPPPPRDFQYKIQLTDHTQIYSKRLHLGMDGPRLV

SEQ ID NO: 16405 - protein, 580 aa, Candida albicans
  UNSURE (553): Identity of amino acid sequences at the above locations are unknown.
IQLKFFTLFLISFIFFLNHHILIRSLPPSPIPYMSVFVAKVKNVLSGDSVVLTPSKTSQFPPPERLLTLEHVRPIDEFESKEYLRQLLIGKEIKFKVSAKIANREFGDISSPIFKSLIEYLLAQGYVKLRDNVNADTDDNIYELKEIENGARIKQTGLWSDKVKPVETVPLTQDVISKSQKTPVKVIVEKVISGDRVVGRLILNKKQQTQSTTLLLAGLKTPRTDDTTQPPHIVKVAQQAKQFVEDKLLTTKAELTCSIIGESQTGVPIAIINHPSGNNIHEKLLELGYAEVVDWQSTLVGSSTMSVLRKAEQTAKALGKGIYANATITRKSVPGTSGSKLKPGNTIENVTIAKVINADTLLIRLPHSDEEVTVQLASIRAPKPNDTTVTTDSAKQQALVATAREFVRNQVIGKQGTLYIDGYRDANKELGLEARLLVSFKFGNTDLSELIVSNGFGTVIKHNKATQHERSMNWDKLIELEEEAKKSSKKGIYGDLNKVLTVGTRIIDASENFTKAKTFFNGFKQNGRISGYYVEFIPSISRVKLFNPKERLXLTLILGGLSNNKSESLNDESVQYLNKR

SEQ ID NO: 16406 - protein, 130 aa, Candida albicans
  UNSURE (79),(114),(117),(123): Identity of amino acid sequences at the above locations are unknown.
FYLFIFVCSHNCVMPDNIEDRSEIPSDAKEIVTTNEIEATDSERTTNVDNELRQDESNEQTGDDSNDNLASKRQLINDXLHNDHFEERTERYIIPQNFLHEILNLPIEYFSELXDQXGPIEFXSILNETR

SEQ ID NO: 16407 - protein, 113 aa, Candida albicans
AIMTMSSSADEIEYLATEIITNSKPVSYHKFSRQLNIHVSKAKATLLEYYQKNKNDLTATFIVTGRNDNGKLIKLSNEDDLESDLKKFTTVHCVHVYSVHKKLIQFSNNELAL

SEQ ID NO: 16408 - protein, 250 aa, Candida albicans
  UNSURE (1),(12): Identity of amino acid sequences at the above locations are unknown.
XKHRTVLLLIDXTAMRSIKSVLVGDGGVGKTCLLISYTTNTFPNDYIPTVFDNYSASVMIDGEPIKLGLWDTAGQSEYDRLRPLSYPQTEIFLCCFSVISPDSFQNVKSKWIPEILHHCPKDILILLIGTKVDLRDDLHVLDELTARNLSPVTFDQGNKLAREIGAIKYMECSAATQVGVKEIFDYAIRAVLDPPNANKGEYVTNDSVPGMGVNNSSGSKKHNEKNGSGTATAGTGKKRKIKRAKKCTIL

SEQ ID NO: 16409 - protein, 485 aa, Candida albicans
VIMDTQVDRHVLPQSASSKNSQFQHQQQGQDLGQGQGQVHSTVNVNLEHTQKDSSIFKDYEDHNSSLIFGGNIINDDTELLPTIEDETIGDKTIEDITEADDDTISPFLKKLQEMINQEGQNNGIRTHSEYLKSYSCESSKDGGGNGNDDTQVLIQRHYHSDDNYNIESFNDTIQKQRSNSKLFIQDNIDTQDDQMGDTQIIRKPLPDTQIIGKALSDTQVINNALPDTQVIGKVLPDTQIIQKVLPDTQVIKKALPDTQIIQKALPDTQVIPKRLPDTQVIPKLLPDTQVIQKNNIPDTQVIQLPETQSQSLLYYDSQKVLHSSPADQSQIASKSPSHNNKNKKTFKSQTQVLNTQDLSDISTSEDTLQEHTTQSVIEIQTDSDDNDDDDDDDDNEDEKIESNYYDDSLTAHQFKRKLLLSPQKIKRRNTELIPSRTNKSSLSTTLLSSSLLSNNNNNNNNRDFLKTPGFRQYSVRLHHAAGKS

SEQ ID NO: 16410 - protein, 417 aa, Candida albicans
WKFIDDLVAIVFINYFTLFNYQRQELGIALDPDFALINHSCIPNCCQITNDCNEFQIVSTLPINNGEELTVTYVSLGMPREIRQFELFSQFYFRCLCSLCVLDYDPFFCIQCNKCGNKVKSPSFKLILTSPNLIMRQHLCTICLNNLNQSIYPKNIKIRNFFMSLVIFSSNGLSFNDQDYYRYLSKEFVSYIERFTLQELIRMLVDGIHQFEIPEIRTNLVKELMDVVIQDKAFPMYSFPFSIIIRELDLADSGRRIKSLKDAIDRLRIKQQRLFGVDIPSDLSSMLAFDNCLFLDMADLLFDIIRFIINSDLNPQTDSILGLFNGNSLGVFCQCAFYFYKQVKSIFSEEEIEDKLIEIMEIYDSWVLNHKLTLSECLKALFELANLNNIVVNDNKMSVKNAMGDIVDFRMDRDDFI

SEQ ID NO: 16411 - protein, 185 aa, Candida albicans
LFRVLNLFYFALFNYPTNFFVNMKTIESNIIINAKPAKVRSFFLNYQNYPSWNPFLFKFAKYTNKEDPELKVGDELQIDLKLKGFNHTSTMYPKVLQNNEDGLVWLGQLLSTWVFGGTHSFKYELIDGDKTLFTQKEEFTGILVYVFYLFGLFKKTQESFINLYEVLKDQVENNCSSPTGAGRIR

SEQ ID NO: 16412 - protein, 109 aa, Candida albicans
  UNSURE (93): Identity of amino acid sequences at the above locations are unknown.
KVHEKTLVYRKRKKKKNEQQKKNLVYSLHVMSDSTLSKISELIKLEDDLAKIGSIRQQFLKEKSSVDVKLSSTTQVQIDSIMKNLANLHNTMXETRFNKGEYWGGAPSA

SEQ ID NO: 16413 - protein, 435 aa, Candida albicans
AKIVILSPKKELQIIQLMSNFYKKWKLQDAFQIRNNLQPTNFHSTKSAKKRLDRIYIDSRIRRKLLNCRLLEEFKQISTHRIIAMSLQIQKEPILKVGNPRYLIPQWMSQDENIIKDLNNNEQSSLTPFSNWNGIINRIKEKVIFYEKYQRYIRAYIPHAGNFPDEKMLKFRFRPSFNFSIITEMQTESGNTVQDTEIMINLATKFYQDLFLVEDRHLESFTFVDQFDKKIDETDKVLLEKAFIEDNVYDHSLMINKKNAVGTDGISYQNLIELWPSLSESLIRAGNNILKYGTLPQQMSEVIITLIPKKLKTPIIENFRPISVISCAVRLLSSVIEKQLNPVLAKVIENTQTGFLKKRSISNSIYLLDMVLTRYQTSKTAEAESAGLVNLDFRKAFDSVHHDFVLLVLRQVGLEPKATNFFDGNNHKTKSKSKY

SEQ ID NO: 16414 - protein, 294 aa, Candida albicans
KKKTNNSFFLSTMDHNYKLALKQFINKNFEASFKLTSELFHSCFNEYANHTISQTLLTKIINLYLVEVGVCLKDGLLNQVQTNAAINSITSNEVLNQIRSVFGNDIPCEILYNYHLAHITNPKVLIGDGYFDQLHKDYLCPNNDKYKPKFMHLVVFEILPTFGKYKEAERLITDPKDLEKLRKIQHLHEEQKAQQRLAKQNQEKERAAALEQAKQQTLKYKSIKEIQNSYEEEHHEVQISQLSYIYNLVKTYLRENYLAVLVVLILGVSANRYRTHLKEKIVETIKMAFKFSYI

SEQ ID NO: 16415 - protein, 294 aa, Candida albicans
  UNSURE (267),(271): Identity of amino acid sequences at the above locations are unknown.
MGVKEKSEIMEVLEFNGEQPTSRKQFPLEISVLVFSKYYNEIIESDSTFANLVVNSLLSNINKLPTTTVIQLIDYTQDKKVADLSVILKSLQTRVQFNDFIEEYLFHLKENGKFNLKTFEELITLDEIHDNLITYLDEYIQLLFEDNIPEVHCYANLEYNLDRIQMLLNNLIEKVDFEDISVESLIKLFKLNWEILSVNKCEASARNGDRILNYLQDKGESVKSFIFKQNLDDESLLEIILVSGWSYPSKALAKEVSNFVIADDVKXSPYXRFQLDVYRLAHFKIPVTKIYLIN

SEQ ID NO: 16416 - protein, 253 aa, Candida albicans
ASVLPAPVGEDAYFQIPLDPKLGKYTSFMLPIGQMEFSVLPQGYCNSVLIFTNILHKVLKPLAEKVVIFVDDVCILGPNIQEYSTLTVSEQQKLHRQHLDLVLQVLNLLKQAGLKINPSKLTIGVNSATFLGYHIQPGSVTIIREKSNYISELPLPTTVKSLQRALGIFNYYSKLIPAYSVLSATLYDMLKGHSTTKNKKQKSSTQQSTRLSWTEENIQRFNHLKQLLSSPPILVPINYTDFLSICTDASIEA

SEQ ID NO: 16417 - protein, 414 aa, Candida albicans
IMILFSFSNKSTHNTHYYIKDNITTMHKDSLVVTPLADAPFGCSIELPSYCQNDPSLLNDEDFAKLDDAVQRHCVVLIPDQVELSPKSQYNLTKRFDPTIPEPKDTSGGYGHGKEFRHDQSVLKKDGCSVKSQPQVQILGQGTFSPDEPGNENGETINLTHPSHTTFHHTPLTEDQIKNKDQTRFYRWHIDSALYDLSPPKVTTLLGIRIPPTEYQKVVYEDDGSELKLARGATCFFSGAQAFKNLSEEDKEFALNTTVEYAPHPYIFISSAKATWDGLTMVSEGKERDFKDLPEWEESNVKKLPMVWTNPVTKEHHLQVHGCCLYKLHTKKADGSIETLELKEAREKAHKFLRPAIAPEQIYAHAWKQGDLVIFGNRQVTHSVVSELAHLGEAGKRLMHQCNIASGKDPITVI

SEQ ID NO: 16418 - protein, 334 aa, Candida albicans
TWIFHPWRIFGIFVLSTQAHTVPGLDSLLLQASLAKRGHLIDSIYNELSDAETDFIGTHLKNLTNYNATKCDQCKFRIRYGRSLIEEYPDKSHLVSLLLFKHCLVINNNTESKCDNVDFFVSTDSKNFQKFNDNFDSGIKQVGSVNFFDNDFLHMLKNFNVSSDLDLEYYCYFKGKGACKMPATKDVEELWGISKWWPEKKPEHYSEPKYKNNSEVFNVLHFSDIHIQLRYNVGAEANCTNLPCGAPDSYNKQLLPSSYNFSSYYQHFSPNVAKMEFSFYPDAHYDENSQYIKGDYYDLPLYRGWNFKNAPATSFGGYLTDSPAVLMNSSSISM

SEQ ID NO: 16419 - protein, 380 aa, Candida albicans
TMQANFLLAFICFAAAAVIAQVVPNVEQLKAQSLQKRDEDLMEPVFKNLPSKDYDYIMYQLKQLQIAKGNVSKCDQCKNKMRFVKKLIDEKPEKAHLTTLMMYKDCVLSTTPYMYCTIGNFFVTTKAYTDKKFDQKFESGIDGYEVVDFLDNDFLDFLGRFNTSGELNLEYYCHAQMRSCDLPDLEAVVDSFNIESWWPEKKPQHYSEPKYNKTNRERFNVLHMSDAHIQFTYEQGTEAKCSQLVCGLTKSFNKKLVEQNYNFTSAFAADNPNKSPKDFKFSFYPDAHYDGQKYVKGEYYDFPKSRGWNFNFQPATVFGAYLSDTPEILVNNSLIEMAKMHKDKNFEFALYNGDTAEHDLQSVTVDLVQSDEIRTVLTTR

SEQ ID NO: 16420 - protein, 254 aa, Candida albicans
  UNSURE (221): Identity of amino acid sequences at the above locations are unknown.
TNLFVTSDSYFFEITSLKVMFMDNQQQTLVTPRAHTYYPKMHTTPKQHTRSASSSQRTNLAPPASNRSYSQNHLLPNQPTTREPQENSMLTSDNKICQWYCCSCGQSYGSVLYKDDYREVRPNGQPPQKRARSLDSSNYILDSLKYYSQVVYRDHKHVISNASFSAGSSVNSNADTNYFDCKTATTDTEESHSPTITPNTPMLSPLHLNLNHNSFIDYREXIILNIPTMFTCHRCNHMMCPYCLKLRLKELDTS

SEQ ID NO: 16421 - protein, 254 aa, Candida albicans
RSRNVIGFNPTFYEFILQVDADTVVAPDSATRMVAAFLNDTRLIGVCGETALTNAKTSAVTMIQVYEYYISHNLTKAFESLFGSVTCLPGCFTMYRIRSAETAKPLFVSKEVVDAYAEIRVDTLHMKNLLHLGEDRYLTTLLLKHHSKYKTKYISSAKAWTIAPESWTVFLSQRRRWINSTVHNLIELIPMQQLCGFCCFSMRFVVFVDLLSTVIQPVTLAYIIYLIYWLVKDTSTIPYTSLILSSPRGWQAPR

SEQ ID NO: 16422 - protein, 136 aa, Candida albicans
EFFQSQIGGVQTVALSYNEKGQFKGFATIVFKSSKFATAAVDKYNGASIDGGAAKLRLELIIDTSKKPLVARIAPNAKAAAAAKTAGGKKIAAAKNALNKKKAGPGNKNNNKQKKPKQKKKTIEELDQEMADYFEN

SEQ ID NO: 16423 - protein, 198 aa, Candida albicans
TRISTRGEDYDDGIAQYYPTETRTQQFPQSNNGHNRSRRSSKSDLYINESGWMEPNLNSQTHNYNNNNYKKIPKSRSTYSINSATTDLYQIYKNIPLRNSEIDRRDEDSKSIKSMSRLPSARTLSIYQSDMNRRRQSAYFASTAKTNPKLNSDVKLNSQEIYRMLSSKPDKPVLKTPMNDHAVKNSGFAARIILAWGG

SEQ ID NO: 16424 - protein, 139 aa, Candida albicans
RVTSRCVDTRTTGYSLLSVLQLPQVNLIASGSSARHINLHDPRVTTTSDQTISKLVGHTNFVVGLTASPHNQNMFASSSHDGTVKVWDVRAEKSLYTITRQDGSTNAKIFDVCWDDRIGIISGGEDKKLQINKGSDIAK

SEQ ID NO: 16425 - protein, 161 aa, Candida albicans
KMSSTGENKNQIKIKFFTNEEDESLQVADTPLYVPVTLKRFGLSEVVNHLLGNFKGEDETKAPIPFDFLIDGVLLRTSIEDYLTKNGLSNEAFLTLEYTRAILPPSFLASFNNDDWISSIDSINPTSKNIPSSQLSISQPKILSGSYQGDSSYPITMSRDS

SEQ ID NO: 16426 - protein, 204 aa, Candida albicans
TCHKSFSFKSKQFIQYCCFSIIIIHYSLSTMTISPNKRQKRDSSSPKKHLILNAFDMMCPSLQTAGLWSHPEDKSRDYNTIEYWTNLAKLLEKGKFNALFIADVLGGYDVYNGPRNLTAAAKSGAQWPINDPHAIVPAMAAVTEYLSFAITSSTVNESPYHFSRRLTTLDHLTKRYIRLEICFPHILESCTKKFTPMAVHLPET

SEQ ID NO: 16427 - protein, 364 aa, Candida albicans
FILCNYKPKGLENFKGAYMHSALWDHSVDFKGKKVIVIGNGCSANQTVPALLNNPDYSVGSLTQIMRSQHYILKPLPRILYILYRLLSFNFIALYFVRLIVVFGAEMRVPLFKGDGFISKIVRWINTTASVSYMKGNAPEKFHDMIIPNYKIGCKRLIFDYNYIPSLNDPRVDIKNQGIDRVVENGILLKNGEHIEADIIVACTGYNLSKSYFNFEIVGRNGANISEEWKKDGPSAYRTLLVKQSPNLWTIGGTNSATGHASVVMAIENGVDYFLKTAKPIIEGKAKSVRVTDEAYDNWLTTIQKELKKSVFGTPFGGCVSWYSDAKVNSTVYPWSQFHYWWITHFPNYKDLVYEPLNEDKKRR

SEQ ID NO: 16428 - protein, 371 aa, Candida albicans
HITIQHYLMSNQKLAHAVLGAVGGAFTLGITYPLITLSTIAQTAAKKKEAEEASTTEDGKKPQPTVSLTTLEKIAHVIQNNAAYIAAKEILKEKGPLGLYSGLESALYGITLTNFIYYYFYELTSNVFLRANGKKRNGLSTIQSIITGAIAGAFTCVGSNPFWVANTRMMTEKKKEKTATAGDAADAKEENDNSSNSTFKALVNIVEQDGVGALFAGVLPALVSVINPIIQYTIFEQIKNIIIAKDGPKAFTAVKAFFIGAFGKLIATSLTYPYITLKSRMHIKRKKLNIDNQQQDEEKQLSMIQEIRKIVKEEGLEGLYAGLAVKLTQSIATAAFLFYFKEELFSGSVKLIEILRVFSFKKSLKSPVVQV

SEQ ID NO: 16429 - protein, 284 aa, Candida albicans
KYFCCIMNDIDNIAEIKKKLWNGSINVKILLNIEDQIIEYLLTIPRNSYFPTVFPQLIRYFQNFITTIELSKVPIWLEFEEVPLKWNLPVGVLYDYLYLPALLNDHDLGCWTISMKYEPVYPIEYIIPFNEKLAGDGQIDYMKTMNRILMNQLKQSCFVLNGTAKPIMQLSEANTNQLWKSLISRNLGDFNVLTKKIIKTIDMIPVKIYIAGSPIVVQAPISKDLTLQEILSLHTPNLSSSTSSMSHPYIQSIDVTSLMNQLIREIWQLFKHLDNFLYITLIIL

SEQ ID NO: 16430 - protein, 467 aa, Candida albicans
DKKMAIFSSLAGFFNRNKRKIFITSAVTVSIYLLINEFVIKKFRNYQNALRQQLLFKQQIKQRFIQTQQDCYYTILALLPVLAAPIIDSLPVELITQALRLKKNNSLQQVTSGSNSELTADNLNLLDNNNNPELKLSIYMSKSKTELWNLLKIKTITRTLTLSYTVSGLFLITRLQLNILARRSYLESAISNGWCQIQQIMTLIHMENYIIEQSYLSLSWWLLNKGWSNLSSIIEALVVKKFEKITPKTELSINEFEFDLIEIINEINSNNKEYILANLFPINYSDLLETILNTNSDLIHHLDSPESNLIKLINETNAIMLDNNLYFFDLLNALIMNTVSTLTANLSFSLGANNSLNNSLLMASSGNLAAHGENPKVVDITHNDQSFKLASFLAQLSVQNNIMIDNDNLKTEDILPKHESDLEEILNSLNGGTNELPTESYGNVYINNLNQLEELDDFSAGIYSNFE

SEQ ID NO: 16431 - protein, 125 aa, Candida albicans
QLDAYFTLIYLYDTKMAIFSSLAGFFNRNKRKIFITSAVTVSIYLLINEFVIKKFRNYQNALRQELLFKQQIKQRFIQTQQDCYYTILALLPVLAAPIIDSLPVELITQALRLEQNNSFQSVHNG

SEQ ID NO: 16432 - protein, 406 aa, Candida albicans
LSYKPQHSYNFHFSKLYIIQYTPADRIISIVMSNLYQSLGPQGRALLSQNGPGIPSTLLGTPNTNLSPQELDFLINELRNPKPDTTINKVLGYLYNYIPYIRHEHNLRLVIASFLNCPVCFGGSGTSISSSFEFEKNYLIIEVVKLIIDKKLKISMPVISIKQFYTIILKELQNFQHYNPIMNSWKILPIITGILLSNELRDQLYTEVNFVEYKWFFANLDKEIYQLFNNALPYSLSQSLDNNINYLSLMSLALVFKNSERHHKDSSDTVVHTKNISNIFMIQKLTEMIFLDRKVSMLVYQKFFQLNPHNENIESVILNDIMNKPVVIHLNKLSFLLEHYFSALDFTQLEDQVVGQSLIIITNFNKHLNHETKNYTLFNNFYNTPDARTGNNPLTQFSPPAWKDNA

SEQ ID NO: 16433 - protein, 65 aa, Candida albicans
YNEEGNENDFFRKIFKDVDEDSRRAMMKSYVQSNGTVLTTSWDEAKDKEFEVLPPDGMEVKKWDT

SEQ ID NO: 16434 - protein, 427 aa, Candida albicans
LVGDAEVKTRYLLQLNNNFDELNLLLRSFIEWYFLTYWQGTFTENFYGLKRVSQTPLSQGEYNSSRLTQLVPSMIEERRKLSKLQKLVSLFEVTGVSFVSEKLNYCYEVWYTKYVTNQLNTSDTLTTQENVKIKIKRKFVEIYPYLQSAYRAANFITTLLYLSGSSKSPTLLTYLFRINFSRLNQYDYSKNEPKQPLNDSKKPNRIHPPTAIEYILMLLSNNVTKPSWKAIKFVLGTFFPVAIFTLKFLEWWNNSDFSSKLSKNLGNVLDFTLPPPSSLTSALRSYKNEEKKDSGTEIKQQKKKQYKSGKVCPLCKKELTNPAIIETGYVFDYTCIYNYLEKSHIIVSKKLQTKQKDEEDDNIYSEDESEDENIENEKKEEAKEKENVVIDINKGGRCPITGRRLLGCKWNPIKEEWEIEGIRRLIF

SEQ ID NO: 16435 - protein, 118 aa, Candida albicans
CLLISLSSESVCDIIHCKTLKLFDLRQFFINFQQWQRKIESKATGKKCEEKKNDGKYSLLHTNFYITTTTIMFGLGGTTPQISSQQKLQAAEAELDMVTGMFNALVSQCHTRCINKSY

SEQ ID NO: 16436 - protein, 159 aa, Candida albicans
KNKQQQTHKFFLLERLFNHSFSHHYPKIMPRQQIKKQEVDEVAMQAAIDDIKSGKISSFRKASQKYGLCATTLRNRMNGVPSRSIAHANEQLFSPLQEDSIAQWILDSEREGTPRTRKDVIEFAGLIAAQEDKPTIHVSDNWFEKLKRELRKFIQSIKN

SEQ ID NO: 16437 - protein, 265 aa, Candida albicans
MTPEIEGNWDIVITSLQDICNSNESLTFDNIYNTTPDELKQLSKEDLNKLEQEIIDHQSNIGTAKRLIPTSSENITKLIEIITPETKAKQAAQKQTPTKKKPNADTKRIEKRNSSKSKQTKKVGRSYWTSKYNPLEPIYIGLEVAYKLRNRHSNEWIQCTVEKIIGDGIKFEIKDLEPDENNNPGQVFKANYKEILLIPPEGSDLINYTYGCKVLARYPDTSTFYPAIVVGHKKDGRVRLKFDGEEEVNKETEVERKLVLPTPEK

SEQ ID NO: 16438 - protein, 197 aa, Candida albicans
STITKSITLQQKVDLVTVEAMTLAHQVALGQKNKYDLIDEGINRYSFRDKDNLPDWFIDDEKKHSKLIKPITKEAAIAIKEKQKQLNARPIKKVLEAQSRKKLRALKRLEKIKKKSDLINEDSGKSERDKADEISKLMKKLNKKQKQKPKTTVVVARGSNRGLSGRPKGVKGKYKMVDGVMKNEQRALKRIAKKYKK

SEQ ID NO: 16439 - protein, 811 aa, Candida albicans
MTDQDFNFATTILTSKTPQQAAAIIPNVITGSTGLNKDLITWFKHYSSTLENYTQGLQQLIDEATKIAERSSIGFNNFPRNWNCLVNAVKTEHDNNEAVNKHLRQEIINPLRELIEKDVRISELMINGQELQEISGNLNREGEIQWNYKAPQSFQNLEDFKKIEIQVMFDIILNFFQLNNGKLTKDLKNNENSTNYLLGSFKLDAEMQNQLNYLVNTQFATPQRGLQQQGQHLAPAAVPNNKQRRNSSFAKLEKLASPKKPSKLKSKVGSIFGRKKKKEKFTGADSIAEDESLSEVSLPPTRTRNSSVLSRSNSTRRSFIDRFHRDESSTGISRQHEQHQQPLSDPLPHAEKPQPEIPQSPEAPQAKSLEPVSEVQKELFPPMQNGSERKGENQQSRVDVPSQTLSPVTPTHDGFGGSVKPLPEPVDSPNVIKYNDSDDSSTEERRGSLLEKHNLEVQPVSSPFTTQPPAPVPQESRSRQSSDGIYSFEAGDDSNPISATPRSEQNVFGQMPDPNLSPEKTLAPPPPPSRKVLHHEEPTVRDSALFHNLPAASHSGRDSVMAPLASQDTGHSLLKNDFKHENLASTLGLSSSIAEVINASFKDGQLIKSQVVGEVAFNYNGNASDPLVVTIPNSFDKVLVNKTFIEDLGLSKYKVNPTSITSKTLGGLKYLLKPTQVPVIIQQIWKFEPHQSSLMVSIRSTTPLVLENFVVSVALNQDIEATSASSKPQGAFNKEKNRITWRYPQSLALNGEERLIAIFMTNGLGSEHESGVQIKFQVKDPQVKYCSIYSENGEEIPTFRNLVSGSYSGHL

SEQ ID NO: 16440 - protein, 759 aa, Candida albicans
SLIPCIMSNKNRNRNSLLSSHNRSSHTNSTSKDELLKLKYLMETPNLPIYPLNDSSIINSKTNDNLKNSPYQKPKSQSQPQAQGQSQSQPENSLVYPDFMPWKDHTQLPQDETEIEHQKLSNVSYLNKGYFEPPQVANEYYSARNLIQATVFLSTDNCTNVINELSIHLSNAYKSRNEIINKIKFDSNKFKLPTRVTLTLSKKEIWLNELSNPNVSMTKLGEKIPHGIRNKVLIDCICTKKIPINRSIWFTKCVLYGELLALRRKHQNRLSTIPNNNSNTGGGGGGGGSGNSLTGMMDYNTAEKFEIHWLQEWTQQVSDYIYKFSREMNNIANLDGKNQYMGKLSYLLNYIQSLYVESLLDKSLFLSLIMKFLKDGLCLQSKYINGLIYSSMEENSDDYNDDDDDDDDEEDANNAENPESTSKSKKRNLAWMDEIDMNYGQRLVSLTLIKMFWNDILKFDYLSKELSELLWLNYFFINKLLLFSVNNDNGNSTAVIPDGLQSKILKVISDCVRYLFEYNCNIFIIPNHWTLIEPSLMRILLLDSKAKSEKEQEEIQKQLELVKYRNESLILNLKSELNNSNNTNNSSNLGTSKRSVRSGSFSNYTTTPIKPISNTTIEQDYSFINRNSDDVLNIVEKLDNLKLNKEFASFLKPTKKCNANWKLNLKVLLFWCVSPWRNSTNSNEDILFICNFLKNTVVKSLPKSLRTEFDNELLEIIYHIAEDNNSEEGDNLQFTSSRLYVLINELYQSKFFTRKSQER

SEQ ID NO: 16441 - protein, 193 aa, Candida albicans
PKSVSTENQKLISNILFIQKEENKPSEISQYVHRSNDYTARNYWYGYARHCDSTTSTTSSQSDSFNSQQIPQQPQQQQQQQPQQQNNSNNYLYYQGFQQPITNATTVSGATPATSTLTPAGTASASLLHQPQIQNPASACTVPQQRMVMGNMGYYQQQGAPQYFPAPQQSLLGINDVDSRNQIDDNKPTQPGI

SEQ ID NO: 16442 - protein, 458 aa, Candida albicans
SVASIFFFPTFNHQRFKPQNYNWPFFHSHIYILFSFLFDLYPLYIFNLTPQIPQVMSAPELTDIRSPLDINKLKDLLASATTSQSSKVVLGHKATVPTTFSEIKQFTFGQSNPTYFLSTPEGKNYVLRRKPSPNSKLISKLAHAVEREFFILNAINILNSESDNLTVPVPKVHLLCEDESQIGYVFYIMDYVNGIQIKNPSMPGIEESDQKQYWKSIIETIAAIHLLNVEKLISLLPKSHFPQFQNIEKLKSTSYFARQIKTLNNIHNLQSQHVPPIPDFDKITGWLQKYAPQDPDKLTLIHGDLKIDNILFDPKSKTVCGVLDWELTTVGNPLFDLANFLQAFQLPNKLNRMLYYPQKTEMGAENKNSTAFLYEKLHEYEKLVTWSKTDSKNNPSELWPIGHTFGLLRLSVISQGIAMRVKLGNASSANAKGYASMYPYLSELAMENVNKTKKTSVL

SEQ ID NO: 16443 - protein, 150 aa, Candida albicans
MSSSYYFSIIGTKDNPLYELEFSSFKSANISTTDNVPGKSQFPQSTKELLPFIANSSLDLIDDQAFTTNVLNLGKIDQFYGLSINAYVLQSQVKFILCYNSKEESTIKQFFQEVNELYTKCLMNPFYNVDDAIVSPDFDLKIKQLARKYL

SEQ ID NO: 16444 - protein, 243 aa, Candida albicans
SIIIHSPHMLSHFKTVFTSSSSSSSTEPKLAPKGKKVTGNHKDLIPYVKNDISITKSQLKKYSTKKQLITKVLQPMDNYYNFEKQKLEQKYSYNNLNEFYGELFNLYRKQLDECSELLELAQNNYTHSLYQHSLENRKSSNASRSNSVFSRNSLPTTTSSTEDCTSLEKEIPDHLLDPISFEMFTNPVITPSGITYEKTHILEHLKRRGKFDPITRQELTEDQLYPNLTIKEAVDAYRASSLS

SEQ ID NO: 16445 - protein, 493 aa, Candida albicans
NKTWIFSEDAVINNSPTRHQKLTISQELKNKESMHDFLIRLGQKLKVDGRTILAATIYLHRFYMRVPISQSKYYVVSAALTISCKLNDNYRTPDKVALLSCNVKLPPNAKPIDEQSEMYWRWKDQLLFREELMLRKLNFDLNLTLPYEIRDHIFKNFMLLDQEDELVKLFSTHKLDILKMTTSLIESLSSLPVILCYEMNIMFGTCLIITILEGKKIIDEKLNIPTAFLYRFLDTDSETCLKCFHFIKNLLKFSQDDPHIISNKASAKRLLDIRSRTFHEIAKQGDLKQPQPQPQQHENETTTKEKKPEDNQGEGNNATEKIENGHTTNSTNTDPKSQDNKVDEIDKKEAKEINKSETQDDHTQERSTIAAENKVPDTESNVTKSEITKSNNEIMAEKNPDVKNSNSNSDDTGYTSNQLEQGKDTKNEELEKTLDSEKISTPNNGTTTNKPAADLHDSTNGTNENSIGEKRVLEQDSNDTNVDSPSSKIAKVE

SEQ ID NO: 16446 - protein, 177 aa, Candida albicans
MRTFYARGEDAAWFRYFEFVGLSFFFYWFFYLLVFKTIEGGWNRFNYVMVSHITTMLVHVQITLSHFAMSTADLGVSESFPSRQVRTTMDVDCPEWLDFLHGGLQFQAIHHLFPRLPRHNLRKAQPFVIKFCEEVGLSYSIYGFGEGNEIVISRLADIGKQCSIFLDATKHYEGDLY

SEQ ID NO: 16447 - protein, 244 aa, Candida albicans
QNLLAKKFLPSFFRVSISMDFQRIIITLIPKHGNSIKEINNVRPISLINCALRLISSVVNRRIQKAMINSKIWHNNQHGFIPARTIQDVTQKLATTIDAIRRDTSSNHAVILIDFRKAFDNINCLYLLLTLTKLNVDDDTIRYCMAVMADHFGQIQLNNRLSSLFKLGKGVRQENPLSPALFNIGLEPLLHKIDQTLTAVKLENGYSVNVLAYADDITIFVDNEGGANLLRKFYTTLKKFLVYK

SEQ ID NO: 16448 - protein, 382 aa, Candida albicans
ISHTQKTDYKIPKGDPFIVLKELTSHVRVIPKTINLTNEAMSLKDLDNQILFENFIQRIEEKIKTGRELIKQVANATTLNNYHNVIPDIESDVAKRDQLYKPNRRRDIKQVSSSIKQYESFTLINKRSFTGTNTISGALYLSTPKVNYIIDYIPPKKYRTQSDVNSSWKLVIPLKISIKPFETPMKSQNLPTIKSISADMVVVTIKSPKYPIPIEFDHGMLYNNDTGQPFDETLFKNNIVEPFKEYALELYQLSQELGENNFNIERQLSEDIKSMCQLQCKISELHVANLKINGHSWNKKTTNWSISSKEANASVDVTIKLEYLSHQLLKSLPESLKSYNRFNFIPDFQSCYMSRLYHINLNIVLSCGTKCQLRIPLRVQKR

SEQ ID NO: 16449 - protein, 72 aa, Candida albicans
FILMQLGILIAIEDQVHKSLYQFNIKSLILKETVLGWFGSSNQIDDITSLIHDFYSKGIDRAFHIPCHIFKC

SEQ ID NO: 16450 - protein, 432 aa, Candida albicans
  UNSURE (28): Identity of amino acid sequences at the above locations are unknown.
IAFAYSHQFGIMTQLKKLQLYYDVHGSXTLSHAYKYFSLAISKLMYTRRSSNVASCVVKSHVQTRYKILDINGYKEMLLADLIKSISSLPSDDKRLKNLLLRNYLQFNLIYLTVQSGIEIVDDLVGCVLRQERFVEKMNTTLNWLRSPFIYQTLSESANRYVNFFHMLTSSDLKRMLVPTLDIDLMWHTHQLWNYGYFKDCLESPCHTGIDHDDSVDENKWDGGYEYTCKMYRKLFKQEYSVCYCHPCVVRRMAAASKFSILLKSGNKQSQPEEPAIINNPLFSKDEGFSHISTHNSIKLPTSRAELKRKKSITASMLEKDRNNSHYYYYHNSSMFVMAPGAPVDSANSELYSNTLCCSIANSTSSCGKCGGKCIGGSGCGNGCGSTGGCVSCGGSSSGGGGGGCGSSSGGGGGGCGGGGGGCGGGGGGGGI

SEQ ID NO: 16451 - protein, 315 aa, Candida albicans
  UNSURE (3): Identity of amino acid sequences at the above locations are unknown.
DEXRKLQLYHDLHNSRPLPNTYKYFSPVLCNPKQSRDPGVASNKVKQAVMKRWSSSKPVYAITKDVDGGLGDYAQSNLICYTVPRGMVIGEDLVGCVLRQEIFTMKMNSMDWLHSPIVLQSVSESLIRYRRFFLMMTDNNLTHMVVPTLDIDLMWHTHQLWMYGYFKDCLSSSCHAVIDHDDKVEAGELDDGFLFASKEYKKRYNEDYSICYCRYCSSHRPEVKLLFWKSSLKSRKKLEREKFSLVTHPLFSLNEGLCHISTHNSIVLPHDAAISIRLESDLPWTKKHFHLQDPANYVVAPLVPAGALIFCKIPM

SEQ ID NO: 16452 - protein, 303 aa, Candida albicans
RFVEKMNKLDWLHSPLIFKSKQEAVLSNSRFFEMLTDANLRQMLVHTLNIDLAWHTHQLTMYGYFRDCRGSAVHTVIDHDDKVDEGRLDDGFSFTAKRYKQLYKEEYSVCFCLYCTSKRSDSLSKFSQFFKTKKQTKKEEYFRQSHPLFSRGEGFSHISAHNSVRLPTELASSRREKTPAPWADNTYLLYTTPLLFVVPPIAPITEGQCDFYGNGLCTSATTLCSSIGGTCCNIAPCSGNGGAACFGTGLNPSNYGHARIGGSVVEIGGVCGADNNSTSAGCVGASGCSGGAAGNCTGGGSGF

SEQ ID NO: 16453 - protein, 680 aa, Candida albicans
YKPQFTMERLNKFIDILSNSNPHTTPLDFLSYRYIDTPLDPLPIDTKTVQPPQFIPTINEAIVHLKLLKAFQVMKNKVLIDYETDEEEYCEKRWQSFITLAVRRFIIFVSAIRVNAPGGQLGPGTESQIFNNANIKQDSFVKFMNDLMPPLDVIMVWHSFLLNPKTFYDTCLRTNVLRFANFPLPLYKLNQFIDNYTFEFNVNPTPQENYLNLIKSFTNDERDYQYDIATKFSLYKQTVRFYCPGCTKVLTDWVRISDENQMGLADRNLSVRKLRSRSFVVEELPPSTCPCINIYMITHESLRILHLIIDARRKYPLLPGTFKYFSLVICNPKYSARSPTTLSEDICLAVQKSYLATKDLTTIINDIPKEYANETTRRRVILRNYLQFNYISATVENGIEVGEDLVGCVLRQERFLEKINKMDWLHSPLIHESLLESLIRYKRFFLMLTADRYRLNILVPTLDIDLLWHTYQLSMYGYFRDCRTSPCHYVIDHDDKIDENRLDDAFARTARRYRQLFKDNYSICYCQYCTNYRTKYANNGLLTLFQTKKKLETKENAIRNNPLFDGEKQGGVTHISVHNSIQMPTKKATKRRQKNPVPWENNRIDGGHYVVVPDAPITTDHCQFYGTGLCNSVNAQCVSDSGKCCSFASCTSFGGSACVTDSGLACGGDGRDGGGCGGDY

SEQ ID NO: 16454 - protein, 664 aa, Candida albicans
IDISMDPPRYNQALDYIAILEQSDPTAFQSYNYSIQHEYPSIQRDKVTQINSKGLPTIADVVAHLKLLKAFGALKAKVLGTTSVIKDLNPAQHKYWQVFLTNAVRRFIIFVSALRNHCCGTVSTVVREDTFFKVIKNKKFESMMSQIMPPLDVIMVWHAFLLNPKTFYDSFTRTDFIVFAKYPLPLDRIHGCIDNTTFEFNVPEIYRENYSSLLQPFTNDPNDLIFDPIDDLLAVRITDKKVKIYCPRCQKPLTLYLVPLLTTLETGFADPGFEAYSIEDIDEQIRNNPHFQVECICLLTPVWNHDQLRKLQLYHDVHGDTELSHAYKYFSSIISRVISIRRSPYLASSSVKSYVKNRWNNLQLNMYKEMLLVNLIKSISSLPSDDKRLKNLLLRNYLQFNLIYFTVRGGIEIGEDLVGCVLRQERFVEKMNTTLNWLHSPFIYQTLSESLTRYGNFFHMLTSSDLKRMLVPTLDIDLMWHTHQLWNYGYFKDCLESPCHTGIDHDDTVDENKLDDGYEFTRKLYRKLFNQEYSICYCHSCIMRRSATTNKFSFWMKSGSKQMRLEEKTIVKNPLFSKDEGFSHISTHNSIKLPTSQAQMKRRKSITASSLEKDRNNSHYYYLPNSSLFVILPGVPVDSGMYALYANNLCCSIVIRHGAGRSAY

SEQ ID NO: 16455 - protein, 595 aa, Candida albicans
LRTFDSSGRKKTVVIQGKAYDEPSMFNLANTKNSQLVATINQLLPPLDVIMVWHAFLLNSKSFYDTFVRCNLLDFANVPLPLHNIVACIDDFSFEFKVSQQFKRNYLDLIKKYTSYSLDLQYDINEINLYGDEKLFIYCPNCYEKLSEGISWINNENTGFSNSDLNATNINFALSSECYCTSFPIITHEELRKLQLFADATKAGTLQGVYKHFSKVISAPGLVDRDPLNLSIEMALRIQEIWEDHKFEDLPTMVKSIISQLKNPLTGVLLMEYLNNQTISMTVPGGIEIGYDLVAAVMQQERFINRMNNINWLQSPFIKQISTDSCSRYANFFTMLSDPRLNQGILIPTLDIDLVWRTHRLHLSGYFFDCRSSACHSIIDDSLHEGRLDNSFKTTADAYQSRFGESYNVCYCQQCLISKSDAAEVPAANEHVVESNFEIKSLFDFDASSSFVGATSAKSGKNKVAKKRPRSKSSSSLSTSLSFDSNSYFTLDTIMNDPLTPIEEKLEDLISPVSCSGLSSPSLMPLSLYHSISSSDFSLFDAGTTVGEDSSCSLNDFDVGVDDQAITFDDIRNELLDSTLSTFFGTVPEGQFNFI

SEQ ID NO: 16456 - protein, 708 aa, Candida albicans
QIFCKMVLKDDNPPPPYHLISKEDNQNNNNNDSNNDDDIEDTSEPVSQPKLEDFRSFKYSIESIFLKFDKTKVQDPKFIPTTTEALAHLKLLKAFAVMKSKVVRDADAPKDFQINQWKSFITMAVRRFIIFVSALKTLYIGNNGKTTHRSFEELNKKEEFENVMAHLLPPLDVIMVWHAFLLNPKSFYDTFSRNSFIDFAKYPLPLDRIDFYINNETFEYKVSETYQTNYIDLLKRFTNNGSDLIYHMNNFIMYEQYVIINCPTCKIAISDPIPLVTDGNKGFADSEFMAKKKYQQKSIDSTDCYCSHIEYLTHDQLRKLQLFHDIHASEPLPGINKHFSNFLSHPRFSNRNTSIINYTIKDEAKKFWDNSSISVSTVMVSVISATTKSSDIKKAILRDYLQFNLIHLTVPNNTISIGEDLVGCVLRQESFVKKMNTINWVHSTTAQEKLETSLVRYQRFFRMLTDKNLKRMLVPTLDIDLMWHTHQLWMYGYFHDCLNSPCHSAIDHNDKIEEAKLDNGFEYTSKAYKKKFKEDYSICYCQYCSELRATKREKIKSFFKSSRSDDKKLYSTFKSASSENPLVLESPSHISTHNSIQLPTHTAETRRLKKPVPWSTANSNSQFYVVSPIAPVAEAHSQFYGNGLCCSVTASCASGATCCQIASGGCGSSGGGCSSGGCGATAFGGGGCGGGGGGGCGGGGCGGGGGSN

SEQ ID NO: 16457 - protein, 352 aa, Candida albicans
RIEKTTLFADASKEKSPLTYLHNSPPKIREDLEKTSESFQKLFIQIWRSIQAKNLNDIILILEQKCITELLPQAFLLNTYRDLDLISMTVPGDIQIGKNLVELVLKQESFGIKINNLNWLYSSNISNIVSEATSRYSNFFAIVTDPKLSQNLKSTLDIDLVWHTHQLCAFGYFHDCLNSPSHCIIDQSDKISNRLMDGSETFTENLYRALYGQEYFICYCHNCSSVRYGVSNHVFDSTINANLCLENKILGIDLNMVYTSPQSNSIVGITPQSQQYPCICHNTNDFLTNSVTEETLDGEFMENDQKIVNSNDFPNENIDSLIYSNMPEMNNAFLYGPSECSNNEFLRLWCMI

SEQ ID NO: 16458 - protein, 420 aa, Candida albicans
CGPSSRVVKTEVTSGLEDLHLPPNQNKNYGSGNIVNQSVNMPPQQPPGSNMQLQSISPRDQAQFNQQNIQLQRPISPRPPNQRLNNLLSSQRLFQQIQQQQQQQHQNQQQFSPSIKYASDGYSNSPYSPMDSNNLYQQDQFKASPTLNATPVKSPPVDAPYPVYDAPSPPPVFASKESIVISPPSVPLSATSSVTNLNLNQADIYHSQSENNLAVHTGNKFGHNRSVSSTSSFFSDRSDNASMIDFNQNMIQLYLGANSSHLLPRIKTLELYRKNAKKSTDPNVLFQYAQYMLQTALLLESELQNMVNNGNGNGNGSQNGNIAGINNATSSSQSSGSQNGTNSPFTRSIENSPRKGPLDNTTTTTTNGTKDKHTKSKSIDFNNIELEGNEKKLKKALLKEAVKYLKRLCLHPPGLEGTAI

SEQ ID NO: 16459 - protein, 233 aa, Candida albicans
  UNSURE (231): Identity of amino acid sequences at the above locations are unknown.
TSLTVLTMLLNLVIIVVIILIGYLTVSHFWFNPSHSSVIDNIPPVASNFKWETQQPLPIRPFVNKKNFNPSMAIKDISDTPQDWLLIENTYYNNVRQRQKHIALEPEILTFIHNNNRTKQAVGEFYDMVTQFLLLRYPMYFKYDFWSGIVTNTITNDKFPKYSKSLIPNYQSMVEILGRNIEEDFLILIKNNPHDKEEEYIMRASLNGFPAGFDPRVNFNQPIFTTGLAGXAI

SEQ ID NO: 16460 - protein, 229 aa, Candida albicans
DHNMEEDNQQDQNNQYVIYHPFILEECHFYFIISCTNSFIRVALKIGLIGDSQIGKTSLMVKYVEGSFDEDYIQTLGVNFMDKKIQIRHTTITFSIWDLGGQKEFINMLPLVSNDAVAILFMFDLTRKSTLNSIKEWYRQVRGFNKTAIPFLVGTKYDQFIDLSFQDQIEITQQAKKFGSAMKAPVIFCSTSHSINVQKIFKIILSKAFDLKLNLDEIVNVGEPILIYK

SEQ ID NO: 16461 - protein, 174 aa, Candida albicans
SIFGVIIQYYSFQFFQLEKVSTQMEYVTHLPKEDSSIATTSRYGLQFTYPVKYYDFHVYYYAHNEESDKEAKSLLNKLLNDFPEDSANGSIIVKRLPDTKVIGPHATQFWEADVLRPEVFIKVLSWFQLNHGNLSVLIHPQTGDDVKDHTSSALWLGEKLPLLLNVFGEPDGKI

SEQ ID NO: 16462 - protein, 126 aa, Candida albicans
NMGEDHEFYGGIKSYDVHTYYGNEKEEKLAFALREKVLKDFAKEIENGEIRVYKFWEKPIGPHPIRMWELDFKDPEIFKVVVPYFQLNHGPLSVLIHPRTDQGDLKDHTEHALWLGHKVRLDTSLL

SEQ ID NO: 16463 - protein, 404 aa, Candida albicans
LPTMTCLPAWLRTKKEKRKVQAPSPNVHHHQKKREQHKKSTMSRKVSISSLTLSEPMTKPARVQVNPEDIDDLDKTQQVNNHQYNIWYSKSLSDANNKSTTKLKYRVRISTDQGFTKANKNTHICLFFSRGCCYLGSKCQYFHRLPKESDNFKPTQDCFGRDKTANYRDDMDGVGSLNKVNCTLYVGGIHIKPNTEQLLVKNFQEFGTVEKVRVLQGKGCAFVTMKTENQAQFAKEAMQSQSLVEGSNEVLYVRWANEDKNPAAQKQEKKRQQELAYDTVKQLLEQESNKKPRLENGAVNRIETINIDDELEDEGAVEDDEADDDIEETRVNSLSAGVKKNVSTHQANGTPESSSTSDENDHNTILRNSLLKDISRLKKKMVYKREEPYLTNLLVDYSSDEDDD

SEQ ID NO: 16464 - protein, 271 aa, Candida albicans
TTTHIIAPFYTDAFYQLINKSISSLLLKMSIDYKPCWREFFNLDWGQLDSVNDISSYMNDLKSKTAENLRVILPLIIRDSYVRNFNDKLVEMLVTTIANNLKFVKPMTATSVEQILMDVSSLKEDALRFPLFSVKDVSKSYQKFVNHQFGDLQSLLKLLMVPSIPVENLIESYFALIGDKSVSNFVKVLKLKGVEKAQHHKYVDNFKLQLSVDDGSVTSCLLLQNLEEEEEASRAATPDVKLNEKFDVSKINENFKNFGKFFRKDIGNESS

SEQ ID NO: 16465 - protein, 201 aa, Candida albicans
ISFPRVISDYQQEVNFFQFINPKVKPKMFLLCMDFSPESIFALEWSLGTVLVDGSVLFIVCVIEDGDTNHHLKGNTSNETSREQTRLNMLNKAKQQVLNLLKLTKLQIHIVIEIIHHPIPRHLILEFIDNLQPTLVIVGSKGQSAIKGVLLGSLSNYLVTKLTVPVMVVREKLKKINRFKSGSSVFSNNVKPLTLSEARVD

SEQ ID NO: 16466 - protein, 233 aa, Candida albicans
EARYSSGPGRRPRAVEPHFHTEPRHDILLAKFRYLLLKVARLSTLLVPLKFELPISGYWPESKYLRLQGLITDVTQLYLMLLVAFNELEDPVHWLPTIFRRIGFCYAELEADIFATVHMAADALRTKEALPKITDANISVKHMELLRKQWGLEKISLSERFYSKVKKKCTQETGHDEITKELDYDKFFSNDGKLNIVSLLVAHMIYNRLDEIIIVVKGLVGEIYDLDENVLIA

SEQ ID NO: 16467 - protein, 1148 aa, Candida albicans
ISFRPFFKNFLKITVYIYIYRWLCSPLLGLLLFSLIIVVSTMPPEELHDSDLLSVASSTTPSTVQQSLENENIPVQLDELKIVGDNTENYIVNAYFPEGDERNLAYTIVKEEPEIKPSLWNKFVDFVWPDYILKHLDYPSFKITFRSWCQLWVCTVLTIIPATSHWMGGAAYLIIVLGFITVSGGTSIAMNTLSSIAGFIGVIIAFLHHVITTKIINHIHHGITPETLTKNLIDEGLCHFDSGLEQCIQDQIFTGRYITTTGSAVTILSIITCTFIVGNMREHMHPLWALVYVSGQIAICIFACYGHFLPLFDPLEIGYVVIKPFALGFIAKIVSALLVYPTTSNWTFFNGYTKILKGLKSSLEKNAKFFKTMKPSASNFGNYKMFKKEILKLRGSMAPLEIVASTIWLEYSYGRFDVGDVGEFRSLLKNLFTSSSTYTYFYQLLEERTHFVRNEFALVRKRSNASSQFARKPAFDKTDLSYTDVAEYELRQRLKIMKSRIILQGEEDSRLTTIVIDEMATRISQYFAGLLDNADTGIEVIAEWLEAANDFRIFSWVPGQWSKHVSLQERLNAKVKVVKLELEIELAKFDNVETLKKIMIDTSKPEKEVLFLISQGVFFLQIVKHQCENILKVLDYCLELDERRPTPKFITYFSKTKYSEPKHLSNKIDVTNPGLENIVRKRNADTLPPINLFQYIGYLFTKLYKYLISNEFWFWIKVGGIITIGAIPYFVRPLANLYYRNRMIWLVIVIAVSISENTGSSVYVVFARLCYSFFGAVVGMVAWYISCGNGQGNYYGYGAVTAVLFMYFIYFRHFSVHQTLLPQILYSVTAVLVLGTSWVDAKYNKLANVDVGYKPAYLRFIGVAIGLCLGMLAVLLPKPISSKAIVRNVLAKTISETGNIHCDVANFALARLETPDYNIKGRQDAVLSNYSSLLMRMAGLSKLMSLKLEVPIAGYWPESKYKRLLGLVTDVIQLYLMLSSALQGLDGPEKWLPVVIKRVGFCFPDLQAEVFATIHMASDALRTKQALPKITEANISLKHMELLRQQWGLRRISLSERFYCDSAINNNNENTLKELDHYKLFSNDGQLNIMSLLVAHMIYNRLDEIMILVKGLVGEIYDLNERILVDEDDYFEFKQDLEFSDDKENSAF

SEQ ID NO: 16468 - protein, 270 aa, Candida albicans
NLQHPQPIHHVSSHQPPPGAAGGQFNFLNDPAAALASQFARSGFEQSNQYLQENFGSLQGDIKYYFQVSNSYVFKKIILILMPYNHKDWNRVSTKETGTNQFLPPNLDINAPDLYLPLMSFVTYILLWAAFQGINGDFHPQLFGYLASQTIAFSVLDVVIFKTGLYLLNCPQSKIYDIISFSGYKYVSIIVLLILKYLVGNYLGSFYYIVVLLLIANLSIFLMRSLRFLILPQSTSMNNTITSKQRKIRIQFLFVYSVIIQGLIILYMSK

SEQ ID NO: 16469 - protein, 581 aa, Candida albicans
RQTASTRQDTMNGSTGEIKKDSLMMIYNIFNKKWIGPPDFALENCPSSRSRHACCLSRDGSKLYISGGLVKSTPLNDLYCYDLTLGIWLGPIEFVYRFDHTIMIYEERIFSFGGLDKDMNHVKSITYYSLKTKTMGEIYLNLDITNVPPTGFYDLAILSSKINPSTSLFVKLPLWNYPNNGLSISCFDLGNFEAQNLFSQNNLSHYFTDKNMNDYIWKTAFTNHEGKLYLLGALKRKKRNSHPFGACLNTSSDMNENIMTEDDDEGHEHESDIDGNGRRRDTGGGGRGEEEEDDEDEEQESTRLNYVLQIEMQKFGIPSQLENPLSLDYHRLLLSSAFTDFEIIALLSIEDKDKVEAQLEYQTESIRVHKTVLVARWPHFQRMILTGMNEALENKLFLPEPINRIKALIYYLYVGTIDFDEKYIGELTLVDYSGLLVLTNLYELKELGYLLLQKLFKLFIQFDNNFSDDETSISTLLTIWRDLAFSNESIFIVTVLELIKRKWAIITRSKTFLSLSKEEIVRLCQDSTDDSPLSKSPNHNRSLDTLDTNLIPETPTRNTNSPFVIDSPANHSNLLSTSVFD

SEQ ID NO: 16470 - protein, 289 aa, Candida albicans
LGGSCPPWARRLKSISRSPSNGTEMENSNETTNEKDSNAETLPPMSSGLSETATPKNNDAGEDISDSEISSMDNELMDFLTEHSVLVTPGRPLIPNQPETAPTTEKNQEKKPSGKLSSVLPKKQPNSSIPDSPSVDETYKILPRNVSPIVRNELHSIEDEFAPVDRMVFSLRDPLGGGRINLPVKSTSCIHFQCFDYENFCLFNKISTATKEITRRNLVQLNRAYLARIQQQVNQQPTVSSSFPFSSQNSQFPNPTSNPNVSNKLPVALTGNNGTHNYLVPPTFIPISP

SEQ ID NO: 16471 - protein, 328 aa, Candida albicans
LHSADRYLVNSKPKYTHCPATDCTSLAEILEDFKCFSSRLFTEKSSDRNVDLSRVPIIGCSEHHEFCFNCKYENHLPCPCWVSKRWIKKCNDDSETAHWIDANTHSCPKCYSSIEKNGGCNHMTCQKCKYEFCWVCLKDWSDHRNNYSCNRFRDSRVEDQIRKNRSRQTLERYLHFYKRYFIHENSMKGDQRILKKIDDVTRLYMEDRRENGLTYLSWNDIQFLPDAMKSLQNGRKTLKWTYAFAYYLSKSNFSDIFEFNQDFLNRTVEDLSEIFEKIMDKRNKNKVGTILKNKAKIINLSELVNARRTTLIESAEENLQKGLLSFQP

SEQ ID NO: 16472 - protein, 626 aa, Candida albicans
KNITIQTITMTRAKNNADFFTKLAKLPPKVITIIIDELPKCILAELLYFPSIREVVASTILSNVNITEGLQRHGWNYEPDVGYADCNCVSFNIEFGNLKKGINQWNIYPKVFHMKGLSQFVDVLLTCPELLTKASSVNSTFSGLEDTEVEILEKLLMDSNIKFDYLSLSEFPDPITLSPIVKNILLLNTTLISYVIPGVKKLDIVFSNGNEEGQNYVFASDLEELTIKDDRFTQLNLPPNLRKLSIESSLGSVNIISKELVNLEYLQLKELKIASFDETGITAPNLKTLNLENCQNITDFIGLRRFQKLKYISLKGCVFPAGLLEEGLFPELEIFEYSGKDFEPESEYDGPLPLPANLKHVSIKWASSVIIDLNTFVLPSRLKHLELWDIRFSQGHLQFNEDLEYVRIRTRAIRFPGDFRIPPLVKHFQIKATHLCFYKPDFMYHLPDGLNNLQLVCPDLGRMDGLDKIVQWPESLKVFRMHYLGLNSHSLQLWNFKESNLEEIDFRGGALGQLNADALPTSLKVLTMKNLRIEELVGSFGNLKKLEKLILGCNDIKYVSFLEFPSLKFLDLGYCKFDLIPPVTVMFLNQKLKELKLYSKTMDVTVLKQDICLDRNFKRVKRDLMD

SEQ ID NO: 16473 - protein, 289 aa, Candida albicans
  UNSURE (257): Identity of amino acid sequences at the above locations are unknown.
FYLTDANQMFVFLALITLTTCLQIPLNPTIDDFYNPPKDLETSQLGDVLKWRKMPFPVTSMFVNLPISNAWQISVRSQDTLNNSLAIVATILEPPNGDKNKLISHQAFENSPLLLCSPSYSMQVPSFETFQIQADLIFISGLLSQGWYVVVPDYEGPNSVFPVGRQSAYSVLDSIRGTIKFFNSTGNSTVKTALLGYSYGAVASLWASIVQPNYAPELELVGAAVGCTIPNITAFIEKVDEGPYSGIIVIYFSGLAXEYRHFRDRLIHFGALQPLGCLFPICRNSFSKK

SEQ ID NO: 16474 - protein, 285 aa, Candida albicans
QMLFLLFLLITPIYAGLIFPTKPSSDPFYNPPKGFEKAAVGDILQSRETPKSITGRFAPLKIQNSWQLLVRSEDSFGNPNAIVTTVIEPVNADPSKIASYQVFEDAAKADCAPSYALQFGSDLTTFVTQAEMYLMAPLLDQGYYVVSPDYEGPKLTFTIGKQSGQAVLNSIRATLKSSKITNIKEDAKVVMWGYSGGSLASGWAAALQPSYAPELSSSLLGCCLRWNWYPNLLLPHKQLMVLYVQELWQMPWVGGANEYPESQSIWPIDTDKKSVFDEFDNPCLS

SEQ ID NO: 16475 - protein, 424 aa, Candida albicans
VPICLLIQSRKMLYLILFLIAPIYAGLIFPTKPSSDPFYNPPKGFENAAVGDILQSRATPKSITGGFTPLKIQNSWQLLVRSEDSFGNPNVIVTTVIEPVNADPSKIASYQVFEDAAKADCAPSYALQFGSDLTTFVTQAEMYLMAPLLDQGYYVVSPDYEGPKLTFTIGKQSGQAVLNSIRAALKSGKITNIKDDAKVVMWGYFGGSLASGWAAALQPSYAPELGGNLLGAALGGFVTNITTTAQATDGTVFAGIVANALGGVANEYPEFKSILQSDTDKKSVFDEFDGHCLIDGVLNYIGTLFLTGDHKIFKTGWDILKNPKIGKVVEDNGLVYQKQLVPKIPVFIYHGSIDQIVPIVDTKKTYQNWCDAGISSLEFAEDASNGHLTEAIMGAPAALTWIIDRFDGKQTVSGCQHIQRFSNL

SEQ ID NO: 16476 - protein, 467 aa, Candida albicans
IILQMRDLILFLSLLHTIFASLFSLKPPSQDDFYKAPAGFKAAKPGDILKTRKSPNKPSSLYAPVDVQNSWQLLVRSEDSFGNPNAFVTTIIQPKNADPSKVVSYQNWEDASNINCSPSYGLQLGAPLSTILTQLDMTFIVPPLKSGYYVVLPDYEGPKSTFGVGRQSGKATLDSIKAVLKTKDFSGINDDAKVVLWGYSGGSFASGWAAVLQPEYAPELKDNLIGAALGGFAANLTGIAESVDGEVFSGFIPLALNGIANEYPDFKKRLYEEVKPGAKADLQKGAENCLAASLISYPMYQYFTGPRRVFEKGWSLLEDKTIGKTLEDNLLIALSKEHMPQIPIFVYHGTIDKIIPIKDSIKIYKNWCDWGIGSFEFSEDKLNGHTTETVVGAPAALTWIDARFAGKPAVEGCLFTTRASNFLYPNISESAALYFKGIYQTILRSKLGSGVTSDDVSVNGLRSLYHT

SEQ ID NO: 16477 - protein, 228 aa, Candida albicans
  UNSURE (219): Identity of amino acid sequences at the above locations are unknown.
SNNPFPSTSPLLPPSPTIMRGIAVFLALISLIFASPLTVKSPLVDDFYTAPDGYESAKLGEILKLRKTPSKLSSMFFEIDIKNSWQLLVRSEDSFGNATAIVTTVIEPYNADPSKVLSYQTFEDSANIECSPSYGMQYGAPWSTVATQIDMALMVPMLKQGYYVVSPDYEGPKSTFTVGRQSGKATLDSIRAILKSNKFTGIKSDAKVAMWGYSGGSLXSGLGCCITT

SEQ ID NO: 16478 - protein, 265 aa, Candida albicans
  UNSURE (24): Identity of amino acid sequences at the above locations are unknown.
NPTNSLGSRVMQKSPCGDTLVVHXLLGWAAALQPKYAPELKENLIGAAVGGFATNITAVAEAVDGTVFSGFIPLALNGLANEYPDFKKRLYGEVKLSARSTMEKGSQNCLAASLVGYPMSQYFTGQNRAFEKGWGLLQDEVFNKTIEDNLLLKLDKTYLPQVPVLIYHGTIDEIIPIKDANAQYQIWCDRGIQSLEFAEDLLAGHLAETFTGAPAALSWIDARFSGKPAVNGCQRTIRSSNVLYPGISITIRIYFEGISKTIFRG

SEQ ID NO: 16479 - protein, 461 aa, Candida albicans
QMLFLLFLLITPIYAGLIFLTKPSNDPFYNPPKGFEKAAVGDILQSRETPKSITGRFAPLEIQNSWQLLVRSEDSFGNPNAIVTTVIQPFNADPSKVASYQVFEDSAKGDCAPSYALQFGSDLSTLATQAETFLLAPLLEQGYYVVSPDYEGPKLTFTIGKQSGQAVLNSIRAALKSGKITNIKDDAKVVMWGYSGGSLASGWAAALQPSYAPELGGNLLGAALGGFVTNITATAQAADGTVFAGIVANALGGVANEYPEFKSILQSDTDKKSVFDEFDSHCLADGVIDYINTLFLTGDNKIFKTGWDILKSSTIAKIVKDNGLVYQKQLVPKIPIFVYHGSIDQIVPIVNVKKTYQNWCEGGISSLEFAEDGTNGHLTETVVGAPAALTWIIDRFNGKQTVSGCQHDKRLSNFQYPNISSSILKYFKVALDTMMLNGLGSDIQKDKITPDDLRKFLLGGW

SEQ ID NO: 16480 - protein, 422 aa, Candida albicans
SLSLFIFVHISKKMLFLLFLLVAPIYAGLILPTKPSNDPFYNAPAGFEKAAVGDILQSRKTPKPITGVFVPVKIQNSWQLLVRSEDSFGNPNVIVTTVMEPFNADPSKLASYQVFEDSAKADCAPSYALQFGSDVTTIATQVETYLLAPLLDQGYYVVSPDYEGPKLTFTVGKQSGQAVLNSIRAALKSGKITNLAEDAKVVMWGYSGGSLASGWAAALQPNYAPELGGNLLGAALGGFVTNITATAEATDGTVFAGIMANALGGVANEYPEFKQILQNDTDKQSVFDQFDNHCLADGVINYIGKHFLSGTNKIFKSGWNILKNPTISKIVEDNGLVYQKQLVPKIPILIYHGAIDQIVPIVNVKKTYQNWCDAGIASLEFSEDATNGHITETIVGAPVALTWIINRFHGKSAPQGPRSAHG

SEQ ID NO: 16481 - protein, 271 aa, Candida albicans
  UNSURE (117): Identity of amino acid sequences at the above locations are unknown.
IYRLGCCNTTLSMLPGLEGKIGWELPKSGLFNNIKPTAGANRMVHHRGDCFPKPLSGLANEYPEFKEILYQKVSKDDNDNLRQGTEHCIGGTILYFAEDQYFTGDDRAFPGGYGLLXEEVVNKTILENNLMQMDKDYLPDIPIFVYHGALDSIVPISNVHVTYKNWCDWGINSFEFSEDLLNGHITETIVGAPAAITWLEARFDGEPVVKGCKKTSRITNFSYPNISDSTSSIFEGILNSVTGSELGPGVTSDNITLDGLTGFLGNFIDLK

SEQ ID NO: 16482 - protein, 293 aa, Candida albicans
AILKSGSFSGINEDAKVALWGYSGGSLATGWAAALQPVYAPELQKNIVGAAVGGFAANITAIAESVDGTIFAGLITLALNGLANEYPDLKTAFYEELSDFAVPEFKAGAENCLAENIFHYPLHQYFTGPKRAFEKGWGLLKEDIFNKSIQDNLLIGLNKTYLPQVPVLIYHGTVDEIIPIKDPHAQYQLWCDWGIESLEFAEDLLTGHLAETFTGAPAALAWIDARFDGKTPIQGCLHTTRLTNLLYPNTSDSTHLYFLGIYQAVFGTPLGPGINGDNITINSGLLGLVSSII

SEQ ID NO: 16483 - protein, 437 aa, Candida albicans
GYESAKLGEILKLRKTPGKISSLFIPVEVKNSWQLLVRSEDSFGNAAAIVTTVIEPFNADPSKVVSYQSWEDAANIECSPSYGMQFGAPLSSVQTQVDMIFIVPLLDKGCFVVLPDYEGPKSTFGVGRQSGKATLDSIKAVLKTKDFSGINDDAQVAMWGYSGGTIAAGWAATLQPKYAQELKKNLIGAALGGFVINITATAEATDGTLFAGLIPNALNGLANEFPDFKKRMYEVVEKRYEGALQQGTQHCLGGAILHFAFDQVFTGDHRYFEQGYGLLEEEVFNRTILGNSLLYMDQEYLPDIPIFVYHGSLDGIVPIPDVHGVYKNWCDWGIDSFEFAEDSLNGHLTEIVVGAPAAITWLDARFDGQPVVEGCKKTTRITNFSYPNISDSTRNFFKGILDSLTASQLGPGVTSDNVTLSGLTGFMGGLSKFKKSV

SEQ ID NO: 16484 - protein, 266 aa, Candida albicans
MFTYPIKKMLYLILFLIAPIYAGVLLPTKPSIDPFYNAPEGFKNATVGDILQFRKTPKSITGGFVPLNVQNSWQFLVRSEDSFGNPNVIVTTVIEPVNADPSKIASYQVSENAARADCAPSYALQFGSDVSTLATQAETYLLAPLLDKGYYVVSPDYEGPKLTFTVGKQSGQAVLNSIRASLKSGKITNIAEDAKVLMWGYSGGSLTSGWAAALQPDYAPELSINLLGVALGGFITNVTATVEATDDTIFAGIAANVLGGIANEYP

SEQ ID NO: 16485 - protein, 194 aa, Candida albicans
FKSILQNDTNKLSIFNKINNHCLTDSFIKYVGARFLTGDNKVFKSGWNIFKNLVVSKIVKDNGLVYQKQLIPTIPVFIYHGSMDQISPILNPKKTYQNWCDAGISSIEFAEDLTNGHFTESIVGAPAALTWIIDRFSNKPPVDGCQHVVRTTNYEYPNVSSSILDYFKAAMDVVAQQGLGPNIQKDQLEIKSNL

SEQ ID NO: 16486 - protein, 203 aa, Candida albicans
  UNSURE (188): Identity of amino acid sequences at the above locations are unknown.
YYCSFLFLTTINKSSVAAIYISSMKGLVFLLGLLPTIYASLVHITPASEDDFYNPPAGFESAKNGDILKLRNSPNRLASFYFPIDVKNAWQLLVKSEDSFGNPNAFVTTLIEPYNADPSKVVSYQTWEDASNINCSPSYGAQFGSPLSTITTQIDMTLIVPPLRNGYYVVTPDYEGPKATFAVGRQSXQATLDSVRAILKSRS

SEQ ID NO: 16487 - protein, 190 aa, Candida albicans
QNSQQQQQQQQQTDSQTIPSPALSQTSDLSNFGPTEAAIKATEVLEQNMNLLVDSADKSIVDVFQQEIAERFFQIIVKSLKLKTISVMGATRLISDLNLYFKFINNNVKSNKRLVLPLYQALIKIGNIYLISGDDSKSIGKLVSDLSKFNGIFSQEEIYEFVQRRQDWPIIKKHVEKVMYGFGFGDCTIM

SEQ ID NO: 16488 - protein, 249 aa, Candida albicans
LHIQFHELFNMIGMNRLIFSKAFTSSCKSVGKVPFTKSITRANTRYFKPTSILQQIRFNSKLSTAPNIEANSNGSTNSQSDTKKPRPKLTSEIFKLLRLAKPESKLIFFALICLVTTSATTMTLPLMIGKIIDTTKKDDDDDKGKDNDDKDDTQPSDKLIFGLPQPQFYSALGVLFIVSASTNFGRIYLLRSVGERLVARLRSRLFLKILAQDAYFFDLGPSKTGMKTADLISSFYAPDAGTWEWAPPP

SEQ ID NO: 16489 - protein, 507 aa, Candida albicans
  UNSURE (95): Identity of amino acid sequences at the above locations are unknown.
LLQPNIMTYSIRTVTNYLNSLAPRFLLLKGDIEILESPITFYKTLLFKISNSKHRIFLSSLYIGKTQHELIPCIDDAMAKNADLKVYVLTDALRXTREAPDNCSALLLASLQKKYGQRIDIRMFHTPHLSGITKFLAPKRINEGFGLQHMKLYGFDDQIILSGANLSEDYFTNRQDRYYLFNNKPLTDYYFKIHTAISSLSYRIMHTDKLKQGFKLTWPTSNATCEPHLNIERFISDSSYLLTPLLKQQQLNAFEEFDENEEYDTIVYPVSQFTPLFPHNQDQLTEKPAILRLLSYADSLKTKWWFTAGYFNMLPEYQQRLLNGKSQGTVITASPKANSFYKSPGVSYYLPQAYLLFAKQFLQKVRDLGKSALITVYEWQKGIVNTPGGWSYHAKGLWITAPGEDEPSITVIGSSNYTKRAYSCDLESNAIIITKDKDLKMKMKHEIDNLMENVHELKLEDFSPKLESQVNGDAETESVDEPKYSVEEDRKISYGVHLAVKLLGGRL

SEQ ID NO: 16490 - protein, 62 aa, Candida albicans
YIYQTMSAFRSIQRSTNVAKSTFKNSIRTYASAEPVCIHFFEDPGNVLGILSCRHGAGRSKL

SEQ ID NO: 16491 - protein, 141 aa, Candida albicans
SRPMSYKRKSYNPSPLSSPKSNTSLRHDITVTSSEYNNSDEYEVEDNVPTIFLNQLATFPLFKNAPTSFHKQVAANLRLIHYRPQEFIIKKGDLSRSMYWILKGTVSVTSTDGEEVYAELNQRRFLWEKLEYCTIEQEKLR

SEQ ID NO: 16492 - protein, 368 aa, Candida albicans
QQFQFISMALVVVLGAGVIGLTTALELKRSNAKLDITIVADHLPGDIDHTYTSPFAGANWHSFATPEDKRLQEIDKPGYKKFLQLAAADPRSGIWAVDNLSMYTDYEVTSNNGNYRKFVPWFKDFVDGFEIVDKLKLPEGIAFAHKFKGVVISVHTYLNYLVQQNKEIGNVIKRIPQIHHIEDARKFHSSGKKADYVINAAGLNASKIKGVEDKKFNFPVRGQVLLVKNNAKIQLGVEGFPGLPNEMLYIMPRKEGGTIIGGCFLEGNTSVSEDKELTARIIKRAIKYAPELVDPNYKNNPSKIEIVKVNVGFRPFREDGARVEVDKKYKWLIHNYGAGAGGYQGSFGLSKLVVDIMEKELSKFKSKL

SEQ ID NO: 16493 - protein, 65 aa, Candida albicans
TRTVGKSIPGDKNGRTPAQGKEILENIGRRFKEVLRLKEADVVEFSGHTDSAHSGSTRAKAKYTV

SEQ ID NO: 16494 - protein, 288 aa, Candida albicans
YHHMRALNIIPVFFLVGSVLLLILTIINGAGTSSVLGKFYWSETDTSGLTGVPYNKTRWTFYRMCGVDHNKNAHCGKSQAAFPYSPEDNFGRNSGIPQNFIDDRDTYYYLSRVGWAFILVGLFFGVTAMVAAPLNFCYFVAGIVGLTTAFVSLLFTITAACCITAAHTKGRREWNRAGFPTVLGAKAFGILWTAVACLLISFVSLVVLTCLSRTSTRRRNRGVGVTNGSEVTPRGEQETYAKESSGEIPRGEYESGNHPVTGPGEGERLSNASKFRFFRVKRAKSEDV

SEQ ID NO: 16495 - protein, 233 aa, Candida albicans
HLLLNMKLLQYIIVFIITSLNGSLVVASVGSPFTLYKGSKPFYSCNNQISDTVSFCIEATDYQCLCTNKNYLATVAGCLQTVGPSPSAVNGLVTFCGTRDVYFDSYNWFNDSLQLYLQQAKSKNQIQNFNKSLPLETPFILNQTAVMLYQQTYNMYYANLDNSLYYGAACLGYWLLMLLLIGLVNWTKVLFPNLVKKLTSPIVNKWRKYISAPATFKKEKRRKNNDYSRLFLI

SEQ ID NO: 16496 - protein, 271 aa, Candida albicans
HLVFFCFATNLSILLYNFQHQEEFPKSMKFFQLITFLLTFALIEASGRKPRKYSKLDTAMQACNVYIGKYGTVCASSGKKKSINWKCYCNQDPGFGTISDCLVRGYNNDTSIIDKFVDKCNMTESKFYEKYDRIQKEFKTNGTHYANKTSKTKTSSASKTLSTKASGTVSVSSSTGKASLSTQKVSPTPLLINYKTFTPYKNAYAMSYNNYNISIYYGAGLLGYWAGIFVIAILANLFRKMFPRLTNYCTGAVSHAFRKVFHTQTVEGHAF

SEQ ID NO: 16497 - protein, 721 aa, Candida albicans
KYGTVCTSTGKRSTNWNCYCKTDAGFGTISDCLVRGFNNNTNIISKFTESCNMTESKFHAKYDKIQAEFKTNGTEYAKMTTKSSSGSKTSASASKSSKSTGLSNASKSSTNAHGSNSSTSSTSSSSSKSGKGNSGTSTTETITTPLLIDYKKFTPYKDAYQMSNNNFNLSINYGSGLLGYWAGILAIAIFANMIKKMFPSLTNYLSGSISNLFRKHLFLPATFRKKKAQEFSIGVYGFFDGLIPTRLETIIVVIFVVLTGLFSALHIHHVKDNPQYATKNAELGHLIADRTGILGTFLIPLLILFGGRNNFLQWLTGWDFATFIMYHRWISRVDVLLIIVHAITFSVSDKATGKYNTRMKRDFMIWGTVSTIGGGFILFQAMLFFRRKCYEVFFLIHIVLVVFFVVGGYYHLESQGYGDFMWAAIAVWAFDRVVRLGRIFFFGARKATVSIKGDDTLKIEVPKPKYWKSVAGGHAFIHFLKPTLFLQSHPFTFTTTESNDKIVLYAKIKNGITSNIAKYLSPLPGNTATIRVLVEGPYGEPSSAGRNCKNVVFVAGGNGIPGIYSECVDLAKKSKNQSIKLIWIIRHWKSLSWFTEELEYLKKTNVQSTIYVTQPQDCSGLECFEHDVSFEKKSDEKDSVESSQYSLISNIKQGLSHVEFIEGRPDISTQVEQEVKQADGAIGFVTCGHPAMVDELRFAVTQNLNVSKHRVEYHEQLQTWA

SEQ ID NO: 16498 - protein, 455 aa, Candida albicans
SHQYCLLKDGGNWAHCDWQNRNPLFYSAFLEFPLLNFNLVVETNFLPMVDWLGFCKFYQVSQRVSRRDGLLIMFQAITFTVWNKATGKYNTGMKRDFMIWGVVATICAGFILFQAMLFFRRRCYEVFFCIHIVLVVFFVVGGFHHLDDQGYGDFMWAAIAVWVFDRAVRLGRIFFFGARKATVSIKGGETLKIEVPKPKYWKSIAGGHAFIQFLRPTVFLQSHPFTFTTTESEDKIVFYAKIKNGITENISKYLSRLPGNTATIRVLVEGPYGEPSGAGRNCKNVVFIAGGNGIPGIYSECVDLAKKSKNQSIKLVWIIRHWKSLSWFTEELEYLKKTSVQTTVYVTQPQDYNGMKSFEQDSNSEKKSDEKDSVESPQNSFVSKIKQDLSHVEFIEGRPNIVEQVEQEIKETDGALGFVTCGHPAMVDELRSAVTKNLNASKHRVEFHEQLQTWA

SEQ ID NO: 16499 - protein, 170 aa, Candida albicans
RQCIDVDRRAPENKTIKLVWVVRNWKSVTWFADELKRLESTRVQAMVFVTRPDDLSGFDSSSNKALKQPYQYEKESVEKIETKSVDLSIYSHPNSIVENLRQELSHVEFIEGKPSMDAMVQYETEKADMSLAFITCGHPMMVDELRVAVKKNLDNTPHRVDFFEQLQGWS

SEQ ID NO: 16500 - protein, 166 aa, Candida albicans
VETFINQISKVEYLDLFVSCLHEEDVTVTKYRETINDAAAAAGGGDITKEKEIKREGETLQPAFRKKFHHKKEKVFTNFNDSKVNRICEAILNVLLKPEYFDKYLQTILTAYACEKPANLTQALTLIGKMDNQEQRETAVTHLCFLQDVNKLYKTCLGLYDSSQPA

SEQ ID NO: 16501 - protein, 87 aa, Candida albicans
LERLDQTQSDALKLIEGLLRRHMKEQAYQIQKNWCELIDFIKENIDEIHNMSEKDRERIDDNGEIYLIDEIPKPKVSEFPKFNILDY

SEQ ID NO: 16502 - protein, 434 aa, Candida albicans
VYPAINQSIDMRNLIVLNRGLVSPESRTYPDLHIIDSVFDVISDSITFVLSSEESQIIEVQQFHKTGNISVLASFPINSKLINFIHFVDSNQLIFVFSNGDIVTATYNNNNNNNNSNDTNGIDIDETIIEIVGSIDVGISAALWSIDEETLAIITNENKLLLLSRVFEPICEKLLDSSDIKITDSKHVSVGWGKKETQFKGKGFKALEREREALKHAGLDDNATQLRDPTVNEIEKGTLSPFDNQSVQISWRGDCDFFSVSTVEPVIVEDTGEMYERRVIRVFNREGELDSVNEAVDGLEHNLSWKPQGSLIASTQRHIDEEEEEENGEEQVLDLVFYERNGLRHGQFNTRLNPETETIESLTWSSDSEILLFQLHDRIQLWTTKNYHWYLKQELFAKDIIFAKFHPEKPLNFMIGTPTGIQIVDLTYKIVTGP

SEQ ID NO: 16503 - protein, 167 aa, Candida albicans
ENNVETFINQISKVEYLDLFVSCLHEEDATVTKYRETINDAAAAAGGGITKEEEIKREGETLQPAFRKKFHHIKEKVFTNFNDSKVNRICEAILNVLLKPEYFDKYLQTILTAYACEKPANLTQALTLIGKMDNQEQRETAVTHLCFLQDVNKLYILQPRRLPDSAL

SEQ ID NO: 16504 - protein, 304 aa, Candida albicans
RFYSLMILPFKITPFSNVMFPPPIIFGEFDINGNINDLQFSKSNEKYAVLSSEGDIYFSELSLNDMKQGNTLQINHKYSKDKYITDSNEVAKQIAFLKDLFVAVAIDSPLGSRITLFEVDDINNPFVNESVNTTTKTVLLKSRADFNTVIIEFVDNRVVELDSTLDCKEIVKFPQLCRDIEVSFKEDTQQYEAFGISRNGKLFCNENHVVSGVTSLKITESHLLFTTVQSKLCFIHLNSSQENYEIFLNLTNENIVDERIRQVERGSILINVMPTKYSVVLEAPRGNLETIFFQPLGLERPAIA

SEQ ID NO: 16505 - protein, 133 aa, Candida albicans
  UNSURE (122): Identity of amino acid sequences at the above locations are unknown.
KFRTTIHFMIQLEEREIPVIPGNKLDEEETKELRLMVAELLGRRNTGFPGSQPVSFERRHLEETLMQKDYFVCEKTDGLRCLLFLINDPDKGERVFLVTRENNYYFIPNIHFPLSVNETSEXPQYHHGNFIKW

SEQ ID NO: 16506 - protein, 268 aa, Candida albicans
PDIVNSPEFPFKVGFKTMLTSYHADDVLSKMDKLFHASDGLIYTCAETPYVFGTDQTLLKWKPAEENTVDFQLEFVFNEVQDPDLDERDPTSTYLDYDAKPNLIKLRVWQGSNVHTDFAKLDLSDDDWERLKALEQPLQGRIAECRQSTTKKGYWEMVRFRNDKSNGNHISVVEKILVSIKDGVKEKEVIEWCPKISRAWKKRENDRRQKHFNGVARPASVLHEEPLRKKIKTESNGNGHQTPPRQEQQQQLQQILNDIPTYEDSDDE

SEQ ID NO: 16507 - protein, 70 aa, Candida albicans
YQTRQHINHSHIPKNLMQYPYLISRTLDPIVGVGIGILSYYSYEQRVGRKPGHSLNELVLKKFYNWKNKN

SEQ ID NO: 16508 - protein, 64 aa, Candida albicans
YHYPFFHSLLINKTNYIMYGGPQPTEEQKKLQEQYAYDTLKFAGLVAGALWISPIIVNFIRKQL

SEQ ID NO: 16509 - protein, 152 aa, Candida albicans
LKTTRLPLLISDVNDEEIAELPTFSDDWENAKLIQDYHLNANTRKGGSSTKFQPPIFITIGVIGKNLILDPSFEEEQVLENGLIISFYNNKVITPISNTNFAVNSNNSNFKGLDQSLLIQSLTLCNKYCPNIIRALDSLIEEDNDDNDGSIF

SEQ ID NO: 16510 - protein, 110 aa, Candida albicans
  UNSURE (106): Identity of amino acid sequences at the above locations are unknown.
KKKAMGFNYIKLTYRHLLLPPTVYTYTMVQLSPAEKSYLYDSLTQQPIIRPDLRSIHQYRPLVAKTSFLPGSNGSARVTTEYGSECIVNVKSKVVLILEDEKDRFXYVII

SEQ ID NO: 16511 - protein, 117 aa, Candida albicans
  UNSURE (5),(113): Identity of amino acid sequences at the above locations are unknown.
KRPLXLCHNLIEVDIDIVGHRDDSHYVANLKFQLTNLIQQNLPFEVLKLTSKYTSKLYIDCIIISHSCNPISLNSITNYLTLKTTRITLLNNEVNEEQIAEIPPFNEEWEKAXIIPE

SEQ ID NO: 16512 - protein, 422 aa, Candida albicans
PPRLVLLAACVRQTTKPENLSSSKVGFSLNIIEPSVLLLADDTRENTEAVVFKVGQILVTQQNVISLAANNIGMYLMDMNEQDTSRYRIIDDFSISFAHDSRGSTATKFLTNIQASIDPLIVRVSLRDIRLALGIFNRANELYMKHQGVVEDTSNSEEFQFSKNFKKRLSQYAPSVLSTYSDDSDYEAPRIPEGVAIVKGEEMNANFGGLRFVLIGDVSELPVLDMKIKPFEARAINWSTDLNAEVHIEHYINIFNYARSSWEPLVESWPIAVYMSKSRHPKPQLLVEVISRQVAQVTLTSKAVALLSQVSDLITSREKLKPRGEDYPYVIVNETGLDLEVWNDANEFETKTGIKSWDSKPWSFEDWRSIRENLDADDASTLGIRFVDSEYQNIVRVSASSVGEELYITQPFSLTEAGRIRA

SEQ ID NO: 16513 - protein, 312 aa, Candida albicans
RSADFLGNPVGLFNLLSSGVIDIFYEPYQGFVLNDRPQELGIGIAKGGLSFVKKSVFGFSDSISKVTGSIAKGLSVATMDKLFQERRRLNTRRNRPKHALYGFATGANSFFDSLSSGVTGVATAPIEGANSDGAAGFFKGLGKGIIGLPTKTAIGFFDLASNVSEGIRNTTTVFDSEGLDKVRLPRYVNPNGVVKPYSQREAQGQFWLNNVDGGVYYNQKYLAHLLLPGEEIAVLISFKLIILFDINSLLSKWVIKFEQIKSISVEPTGLTIQLKAKKGPFIPIPDRTSRNFLYQKIGIAVQEFNKHCQVTL

SEQ ID NO: 16514 - protein, 652 aa, Candida albicans
RSSSMFNAFGNNRGIEDVDIEDSTQPISKPNAPTNKDQHQFEFDLNVKLVQISLSRCIDAVTLQTEPLAEIVGESMALNFYKTLADMYLTLSVFDISLLDHIEKSGVPEFQKLVSSNSEGEKKNLLEMKYSRKQRLVMFKNKEIEVFDQDVDMQIAVVKFVVTRKSYLSLLNFVLNTFTDPNAPATPADELINASSSEDTSPQKINVNVALESIIIVLNEDGIKLATLQLSSAEVKVFLLPDTMDIQGKLGAFALHDEVNQGSPRDSLIRNLIHIDGDNLAQFSYKAYDNVTQNKPSVVEFETGAITINFIEASFNRILAYLSQFLKMKAIYDSARQAAINQSAQLPAQLLFNVLIHAPTIVFPFVNHNTNKLVANLGEIYAHNQYKDSSNTIQVGIRNVNVMSHLEFENDIKQDLHMVDDLDISFDIAYSEKYVKDVPTFVVRGKMPELDLHLTEIQLKMLTQLSDSVNRAFTFDDSDSNLQDVEEDAVYANEVLRHNTQMIHAESPQQPEAIVSPDTEDTDIPGNHKMVDLKFDVPRVALTIYNGTSSTATLKDYSLSSFTMNKFICEFDMLHDGHFNANVKIKSFVVKDTRVNTDSKFPVIIPSVDGVDNQFTLLVTTEGPAESRNITAMLTIEKPQTILALDYSFVFT

SEQ ID NO: 16515 - protein, 219 aa, Candida albicans
KSYIMRPPVCGVHNRLSVDIMLREDNVKVIRLRSTVMIENDADIPIIIDISDTRGDKELCIGSKETKSLPIDLVYGGKLKIKPETNISYGWSEEQLYWKDAMKGCIALSCRATSKDDKSVYYFQAEAVYDKEEPLANVYPHMKLVVSAPLEIENLLPFDFKYRLYDKHARKDWTGRVEKGVKSYVHVVNLESLLLLSVEPVNTSFKKSEFAVINHPQEE

SEQ ID NO: 16516 - protein, 487 aa, Candida albicans
IIPKKSEFERGNTFTLQDVNNRILQLRIYYPRKKSDSTSLKVVIYSPYIILNRSNLNLAISERGNTIELLGRSDEERKITPVMFSFEKHGDTKNRAIIRAEDSIWSQPMSFDALGQSNEVKLQITGKQMEIDLGVTVSEGEGKYNLTKVISITPRYIFVNKLEEELQIVEVGTTKHLSIKSGGSLPLYGLRMLEKKNLMMKFPQASGSMSWSQPFCINDVGQMFVKVLKKDVGQVLVKATIMLEDATVFIHIENGNDQWPFSIRNFTNEEFYIYQNDPNINANGEVVKSETPYKPIYYKVPPKSVMPYAYDYPNAIIKEIIIRSHGRERAVSLAEIGNLKPFRLPATNDKEQRIVDLNVVADGPTQSLVISNYDPSSSLYQIKGGSTSSSSVANSHTGQFEAVENDENYHTKIVTKFDGFGVSLINTRDQELCYITLKGLEFRYNESNLYQNISAKLKWIQIDNQLYGRHNPNLIYTQVSFRKPGKS

SEQ ID NO: 16517 - protein, 797 aa, Candida albicans
NMFESLVANLVNRFLGSYLENFDTNQLNIGIWSGDVKLRNLRLRKESLDKFKLPVDVKFGQLGQLTLQIPWSNLKGKPVRVIIEDVYLLVSPKIIQDYDLEEEELRLQAVKKEKLAQLETFLDAKSQELGTDLENETFVESLVTKIVDNLQVTIKNIHLKYEDDSVLTETPYSIGFTLDELSAVSTDEDWVPSFINITQSLTRKLLTLKNLSCYMDTQGTELYSNLNREEMHDAFQKTLTDIEYLLKPVTGNGKLTVNKTGTTASIPHIDTDLFFEEFGVELNSQQYQNLLWTASKFHWFMKTEKFRKFRPKIAPSESPKEWFQYTAKAVLDEIHERNYKWSWAYFEKRRDQRKEYIKLWKLKLENKMSPEQQKSLDDLEWDLPYEDIKLYRSFTRNELKKEKKNISTLYDTESKSANDAQSTGGGGWLSSWWGGSKQLNESKEKLNNESQSSEKIDLSLSDEQRKALYDAIDYDENADAVTVDIPGEWVKMQVTMHLNKGGFTIKRNKTTTLGEIVFEGCKTQFYERPDSFLASFQMEEFRIEDNTDTSLYKHIVSVKQDEENHQGDSFEKPFLQLSFENNPLDQEADSILVGKLKSMTIYYNPKFIEEIIKFFTPPKIHLDTVGAIMNAAESTVEGLTTQTRMGLEYALEEHKTINVKLDLQTPLIILPLDPASVKSPVAILDAGHISVISDLVDKSKIKEYKEKQQYSAEDWESLKNLMYDQFHVNLEDARFLVGHNIKTTMEQLYSTDRSTYVLDTFNLGLLLGISIIPDAQNLARIRIRGFSPRVCRTALFK

SEQ ID NO: 16518 - protein, 455 aa, Candida albicans
IIISKSHQTLKPPMVTTTTTTTLNVNKTLKAIDLIETSIKNHILTIDHEYCLPNDEDSFFVCDLGEIINSVNQWQQILPMVQPYYAVKCNSNPQILTTLSELGVNFDCASKNEIDLVLSLGIHQAHERIIYANPCKTNSFIRHAADENVNLTTVDNVHELYKLAKFHPHCKILIRLITDDSTAQCQLSTKFGCDLHTAIGEILPKAKELGLQVHGVAFHVGSGAKDFSSIYQAIKDSRILFDEMLSMGFTPKLLDIGGGFERETFPQLSQMVKFALEKFFPIEFSQSNEIKFIAEPGRFMVANAFTLITHIIARRDLPTGGNNNNNDMTPSAMLYINDGVYGNLNCILFDHQTPKVYVLTNENQLFYKQEMMRSLLVNNNNNNNNKTDGFKFSIWGPTCDGLDCVSSLAKLSKNVQVGDWLFFENVGAYTSCASTKFNGLSSGETKTLYVNSNEE

SEQ ID NO: 16519 - protein, 256 aa, Candida albicans
DMAVINQPNSQIRLTNVSLVRMKKGKKRFEIACYQNKVQDWRLKVEKDIDEVLQIPQVFINVSKGQVANNDDLQKCFGTTNQDEIIAEILNKGEIQLNEKERNANLQQKQNEFLNIISTKCINPRSKKRYPPSMIEKVLNEVKFHLNPTKPTKIQALDAIKLLVEKQIIPIARAQMKVRITLSKKAYLKTFQDEIKPVIDQIVEEDNNGKQYEIVGIIDPINYRVLVTLIENTDGSNKVAKGEGSIEVLDMSAIKE

SEQ ID NO: 16520 - protein, 163 aa, Candida albicans
DRYLTQPGWNIEYPTNPILKQVYIDIMEKDGLNPFKMIRKQKEFSLTGTYRKLMAKANNLSFELIKYKTEEGEDGETGDGEKPLIRTDLELLNLKKEQEKKSSQKSVTTPIELPDRIINDDKEGGNKLAVVLRMQLGVSSYATMALREFMRIDTSRYRDGLCK

SEQ ID NO: 16521 - protein, 273 aa, Candida albicans
  UNSURE (262): Identity of amino acid sequences at the above locations are unknown.
IIFLYICMIRHWLRTITRIMSESLKRSFPQDQEILATQTNLINDGSGSSSNVAKKLKPTLMGISETKAGITQFINPNITGFSGLLKTLHSDFQVNEIDPLGNVIHLIDDGIDVGPSKRELKLQERAKFRQEIEGKTEEEIAEIKAAKQQEKEQQQRSKEADDNGGDGGESNKHPKISDEDREELLKFITVEELKQVEQLFHNGKNFETETKFDDKEQRTKLHQLFRKVFQNKLETITSLENTFKIAISSRNRNGGSRQDPTXFFTRRTTREMD

SEQ ID NO: 16522 - protein, 171 aa, Candida albicans
PSQLNKRGSVYPVVKTPDKPYLHFTVYKQNRDTMEVANNIGKLLRINHKFINYAGTKDRRGATCQRFSINHGKVLRVNALNKLKRNGFTLGSFSYEDHPLKLGDLKGNEFTIVIRDIKPHHQQQQQEQQPQDQSQSIESIVTSCFESLQKNGFINYFGMQRFGSFSISTHE

SEQ ID NO: 16523 - protein, 311 aa, Candida albicans
FSLNQQLIMQSELYSSTYGKGNVKFLKVKKDPSNPTVQDVLEANVQVLLRGKFDESYTKADNSSIVPTDTVKNTILVEAKTTDVWPIERFAAHLAKHFTTKYGHVDGIEVTIIQAKWSKIKLEGKEHAHSFKHEGPETRRTYLNYDKHTKKLQLSSSIKDLTVLKSTGSMFYGYNVCDYTTLQPTKDRILSTDVDASWTFDPTQIATLDDILSQPKLFDTTYNTARDVTLELFCKENSPSVQSTMYNMSHKILDTVKQVGTVSYVLPNKHYILFNLEWKGIKHYEELFYPAPDPNGLIKSTVGKKGDKPNF

SEQ ID NO: 16524 - protein, 613 aa, Candida albicans
RQNALTKDNSSLNGKFRKLSFLSTGNNSITSKRKESISSHLPSAVESPTGTGTGTGPTTRSRSRSGSKVDGSYFPDYSDKTTSPSKLTLQKQLSSSSSSSSLLLPPFNVIIDLSVYNTPQGIEKNFFAPNYQVFRYNSFLDVLSEYHQGDAINVSTIRYHLLLKFIIKQKNARDFIRNGNSINTSSSYHLTMTESVFSYQLYGPLRYLIRYLIKQKFQEQNHNNSMLPDNREQFYNHEELIQMNFINFIRYIMQLPDIPDPSILNETEQKIYEFKEIFEKTATALYVLKKDKLLQPTTTTTTTTTTETSVESKDESFQQQDSQVRIKLLVETITKICYEYILLEKYRLDIISKFHDNHLIDKDILNDLYDKYENNVKLKNSENVKVFLYNTSNLIQFGWYFALTIPFVRVIESHVYNEDPHLTKDYQTYQEAEISTTTSTTATTTPKTNFQQSDEELFENHIKKLSFTSYNEYKSLSMEKLVRLNRIIDNQSNKYSKINRREIPDPASNFSTKPMNFEYYNQSMLTIESNTFDMIHTPDLIIQTTPQNYKTLISEFHRILKPGGILNLDCVNFGGNNFEDFSLKYKEKGQFPKILNTEDYGICKHFNSISKFS

SEQ ID NO: 16525 - protein, 143 aa, Candida albicans
LLFYISFQRHTHVWFSMKDILVIHIGAGKHDPNKLKKYKTLLRNALSKTSIVEASDVIESSPLTNTGYGSSLNLLGKVECDASFITNDKIGAVVNMSCKNPTQGVVSWVSKSRYMVGFRGNRLNFASDVNISTIEKLVPTYSG

SEQ ID NO: 16526 - protein, 200 aa, Candida albicans
STDTVITMVFKFTIDNVLNKYIPRNRLSRLPRPIARLLGAHKDKPAADYFIWLEILIGTFAGVALLEGVFKSPNIFRDRHHAPMILASYGASAILCFNASQVPLAQPRNVLVGHFIASVIGLCIQKLFSLSKTGQDHYWASGALSVAVSSVAMSIGNCIHPPAGASALLPSIDEQVREMSWWFLPSSVRSSRRAGRYAIA

SEQ ID NO: 16527 - protein, 378 aa, Candida albicans
TSIRALVIEPLVCESRTLNLMIGRSSRDASHHNKKFRKLPITGTTSNSSQLSILKTPQLNLIAISSKDLLLTPIILTKSHFIDAYSKGKWNLSKVPCPPCMLNNGYMKPPESYNEPSRLNAVSQFIELPHWHEMTIFKRSLSKLRKTFQVPGVALSMIDNYKCHFKIETMLNTSYVPRCIAIDSHAILSQGYFLLLDATKDWRTRANPLVTSSPYIRFWCGVPLITSTQEVVGVLSIFDRFSKDNFNEENCSVLESASKEIMSLLETPLSEIMFKFSGYSARTNNTDFVYVNEDLKDLQKQIGRATSSKSSLVFEKDGSGGRYSQNNNYRFIKYGPSSIKLGITSNELENEELSNALIKERDLWQFLFSVGSMKKARS

SEQ ID NO: 16528 - protein, 194 aa, Candida albicans
ISLLKMSWFGFFDPDFDDFFGRPRKYATEIPPNFNPRKIAQGDNGKGQQVSRYGAGAGHPHRALARRDDFFDDFWKNFSSGKYFVGFDDNVKTTEESDKYVVSYDQENLSPDEVNVDFDKQENELIITVTQETEKDGTKKSSTFHSNLKFEKPVNFDDISAEIGEQGVQVTLPKVHADHEKIVNIPISKAAAKK

SEQ ID NO: 16529 - protein, 250 aa, Candida albicans
SIVTTTTIITYHISLTMASFLKISTLIAIVSTLQTTLAAPPACLLACVAKVEKGSKCSGLNDLSCICTTKNSDVEKCLKEICPNGDADTAISAFKSSCSGYSSQSSSSESESESASSEESSASASASASSSAGKSSNVEASTTKESSSAKASSSAAGSSEAVSSATETASTEESSSAAASASASASATKESSSEAASSTSSTLKESKTSTTAAASSSESTTATGVLTQSAGSAAKVGLGALVGLVGAVLL

SEQ ID NO: 16530 - protein, 95 aa, Candida albicans
CHLKKKDHHRKNLPPLPRLKVRKPVIGKSTNQCFVFMSSLLNCWASNGEGNQICNGFETDLKQCMETFKPQQESLSTINYHAQRLYPKLRGKVHD

SEQ ID NO: 16531 - protein, 403 aa, Candida albicans
LVINCKIIKKQILCKTLLFAFYLKHTTLLIIPFHNDLLYINPPLGFYLILYCYSLFNLMTKMSNPLKVIDISEDSITTARELLDAATSQGFLFLEGHDFTQEEVDKLFELSKSFFELPNNYKSKYPVDSSNHGYVMMGKENLDPNGQKQGDPKEALNIANLNFETGKSLNIIPDWISENQERDELISNTILRLYRLSIKILRMLARALEIEDDETHRIKGENWFASKYASDSESGSTFRLLHYPCQTSLNPESVIRAGAHTDYGSMTLLFQKENQEGLEIFSPISKKWEQVPFIPSTIEKMAPPLVVNIGDLLSYWTAGLLNKTIHRVKFPAKAQELGQDRYSIVFFSHPSDNALLEPVPSEIIRKIEGRGANKETTYITAKQHLQKRLAATYGWNLNDGLEG

SEQ ID NO: 16532 - protein, 278 aa, Candida albicans
IVVPSGARGEDDIGVTKLQDTEEVIENSPVDPQLKEQQESTTKMLLSERDLVDEIDELFTNSTKTVTENNQPSETNKRAYESVETPQELTPNDKRQKLDANTETSVPTELESVNNHNEQLQPIEPTQERQPSTTETTYSISVPVSTANEVERASSLINEQEDLEMIAKQYQQATNLEIERAMEGHGDGGQHFSTQENGQPSGSLLISSIVPSDSELLNTNQAYAAYTSLSSQLEQHTLASAMLSSATLSALPLSIIAPVYLPPRIQLLINTLPTLGNF

SEQ ID NO: 16533 - protein, 258 aa, Candida albicans
AANLVMIIVWLILSLFTSLCLSVLPDPNPSKIDRPILKISTRTHDKIIIINNLQEIANNISVGMTSYEKFNRLSSNEMRECVEGSCIKFYIREIKCTDRTFIASECRTNLNARFQSILQPTTNIHNLILRDEDSLDTQLKTNLVDHFSSFRQFKEFKFNDFNNNLNYDLQCLVDYQLLMQVHFKQTVVEVNLMGTTEVADACQFDKINPNFDGLRLVYTTTYLPVNGTFYCQKGKSQTCNRTIAESKNSRYKLPDICG

SEQ ID NO: 16534 - protein, 183 aa, Candida albicans
KELVVATDQRKKNDTVDSHFLFLFIKSIILSIMSSDWDSVTIIGQKARVGGGGPRENVAKTSSQLNAARRAGLVVGTEKKYGTANTKSNPEGQRLTKLDATDDVVAVKKVDVSVGKAIQQARQEKKLTQKELATKVNEKPNVINDYEAGRAIPNQQLLAKLERALGVKLRGKNIGEPLFAKKK

SEQ ID NO: 16535 - protein, 388 aa, Candida albicans
LYLQFCGEFSINTDMVSVNIISEELVNLEYLELKNLRIPFINEIGIVAPNLKTLDLEECRNTINLYGLREFQKLKHLSLKQCAYPIGLFEENFFPELESFEFSGKNSFERENAYRGSLKFPANLKRLSIKWANHITIDLRTFILPPQLKHLELLDVNFSNEPLKFSEKLEYVRICTPVFIFPGNFRIPPLMKHFQIQANRLAFPSSQFMYSLPDGLELLQLLSSEKGKLSQLTQKVNWPKSLKVFGIRRLRLHSHSLELWNFHESNLEEIDIQGGTLDQLNADALPTSLVVLTLQNLQMQKLRGSFENLKNLQELTLVHNNLENKTHMKFPSLKFLDLGYCKFDLIPPVSVSLIKERRSLLTLESASIDVVILQEDTCITQKPKRIKI

SEQ ID NO: 16536 - protein, 142 aa, Candida albicans
KAKPNLDKEMNRLFGTKSTAPKPSLNDAIKGIDERVGSLDVKLSKINSELSTYQQKISRMRDGPGKSALKQKAIKLLRQRKQIEAQKDQLENQSWNMTQASMTTDNLQNTMVTINAMKTANKLLKQTSGSLHHGAADPPYFP

SEQ ID NO: 16537 - protein, 254 aa, Candida albicans
QESNIKLIDIYKGRIWELSADALPVSVVQLKLIRMGIETLPESFEKFENLKCLDLSRNPLKRLRSVRLPLPSFKQLIVNRCDLHLISPFLTSMLEKENRKAEFAIMATNNWYLNTYDVLKMMKKLKHFTIYLSTFNEKFAKLHKHSRRIAYEIKHTAENSEETEFSGAGEYADEELYCEYDDFDDFDDDDDDDDDNKGAMIRRQLNDCWKVNDSGDEITHLDNPDNLYGMDDKKEGDDDEDDDYDGDYEDEVME

SEQ ID NO: 16538 - protein, 825 aa, Candida albicans
  UNSURE (8): Identity of amino acid sequences at the above locations are unknown.
TGGTRRNXDQEGEFSELKLLFKGNSNIVPSIYEQISRFREVIGLHYIDRLSNEIVSCGGVSKFNGILLDDIIPKEAKKEESTEKAQQEEEELSILKEEVSKISDFAKQFISDSFDGNDFTKLTKFDDINGKVKIPIKSLTISQWSPVPPFQQAKGDLLYLSLQTLEHETFNITCHFSGFFVNKSSTINFNPTIKINEKGKFNKSYLLYDLVCQLSPLFSKTIAENEINLSDSTKYPETYLLPGNSFPAYPWLVNEKDLQNVPDLSRSQLSSLINGVDGADYIKDWNNDIQSIKELPTTTVQERIIREKLIQKSLFEFNKTATETAINIIKGNIPPLNPDESSDKFIYLRNGIFYSSGTSTVNGFENTGGEEASRYVASKDLTGIKLINRHDIRGISSLVTCIVDYMGKRVVCQAPVPGILDTPVITSPTTDAEGKNEAEEPESEPVEKVVYGLSSDGSRILEDKSFEEPLKQIGDFFHLKPHKVQLSSSSSGDDVKTESNLVVSKDTKGLKGTDGRKYVIDLYRTTPRDIEFIEQHFKLDDDHQETSYPHGEALIRHEAVNEWWRRKVAVLFKKETEQLEKEGKLLDKNQDQDQENKPQIAIPTDQVVFNPDAFSSDNENEIEQDREEVREISKFIKEKLIEEFLDEIKDQVIPFDGQQLTDVLHRSGINMRYLGYVAERLVVKKEKHLVDLEELIKENEAKAEKKREEEKEKEEKEATESEDKKEKKEDKEDAEKEEAEAEEEVPTKATYQLTLANYSTLHRIIIQEMISRSVKHILRNLTKSLPSYLISTAIAHFHNCLFGGAINPTPKVDLYSTTAAGHTHA

SEQ ID NO: 16539 - protein, 412 aa, Candida albicans
  UNSURE (401): Identity of amino acid sequences at the above locations are unknown.
RIKERRKDHKKKEENLSPNTEQITGIMSAMNYPDFLNSSNQNGGSPAMSKGNDLRSQDTRESKQQDLYPSGNNYILNVATNKDYPPQQQQQQQQQQQFNNLLLKKLSALDDALPLDVSSFYTNASLNKDSFNLPAELQGGVSNISSSRPSYAAESFTRNNFYHQPSLNPQSPQLGAQSSNFFNNRKDLSSIAMFNNYANNHYQHNGDGNFDINDSFSNLNLNAKFNDFQSRRPSQLVDFSFSPFGDTRQQQQQQQQQSQSQSQSQSQSHVPNQNLQQLQPHLTNAGNSAPFIAYQNKQTMNSAQNQSMGQGNPIKLENGLMLRDQYIVASPELKSLYMKTIKYFQDQSITADILSKLNNLLTNPVIIKLITFIKNLNNLTFNHKILCLVINKNRKFDLLSXPHNSNIFLQKN

SEQ ID NO: 16540 - protein, 202 aa, Candida albicans
FFFFFFSYVLSSIVTATDQTNVELLKIRLENMASVIYDEHKGYCVTNEPINKVNENEGIINNGLQTLPWDLYLPEETDDLLLASDNTSTSTPKPLTKQEKREAKQLKKINASRRRKLKREQELDNKGESKFPDFKPYLAKQELKALFSSIVKSTCQNSKADAKILQYHSIALYKSDLEHILPGEWLNDNNISLIYALILQFL

SEQ ID NO: 16541 - protein, 248 aa, Candida albicans
IVTIEYFNEMTLPIQDLEPDYYISVNYPTTDNGSPTPQAEKSLKTLIDLLYDKGFAAQIRPGDLDHLLVFVKLSSYKFSEEAEKDLIKNYEFGVTGKDDVLASKLRIIYQYLTYPQSVGGCGITPNSGDWKFVTSIVPITNAFNETTLVEDLKINVTQPNLSIATIKKTYGVEVALYFEYIKHYTFWLLLLSIIGLVSHFREDKRFLLTFAFYQFAFGGFYSLHHGITREQHLVNVWGVQNSHLIGRT

SEQ ID NO: 16542 - protein, 539 aa, Candida albicans
FKINQCILYAQFFYFIVTNQVIQLVLKYILPLGLRFVFNFIETKIHNKPQLQTKYDNPDESIWLHNVRLSLKLPEYNVDDDFIGLVLQFGYLIMFGPIWPLAPLVCIIFNLIFFKLDNFKLLNGKYFKPPFPIIVDSIHPWNLALSLLAWIGSIISPVVTAFYRHGTAPPKSMGQFALDKASVHVSSSVFLVLLMFVSEHGFLILSYLLFEFSSLFKSQVEWENDFVDNDIKLRHDYYSGKVKPTYKVHSDELWEKFTPQSTLNFTVPKPTAETDDKVEKIASTEDAYLTSAEKSTTTATSRSDKSKILAEKEAILKQKEAELAELEKKKTKLNDFKDPTDSVIKTKSNANGKAVLSTIDNNKHVSDIDPDAAAAAATATSTANDSGANTSTSTSTSAATDTTNTAPSHSGPTPVTSSEKSNNNNNSKPSDSTKSTLSNDETRKTLDPKGVGSTTTGGKDTVSSDKASLPIEDKESSPSLAGSSTSTPSGTDKKTSPKKLVTNAVNKVENNDDFKKFINEAEKEAKKSKSGLKKLFNKK

SEQ ID NO: 16543 - protein, 330 aa, Candida albicans
QKTTISQITQLIFIYFFFFSHFGSFNLLMINPRRFLTIMTRTKFWKPRYYDIGVNFSDSMFQGYYNGSTTSKHPCDIQSVIERAHLFHVDKMLITALTIKESEDHFELCEKYSNQFDSTAGVHPCSVASEFYKLNDEIKQGDDGENSSSSSSRYTDELRDDVDTKLEKLKNIIIKGYKLGHIKAFGEIGLDYDRLHYSSKHQQCEMLIKQLDLLHDLQTELNIQFLPLFLHMRSACDDFIKILKPYIEKGIINPVNFFFYSFTGTEQELNQLLELGIYIGVYGCSLKTEENLQVVKKIPINKLLIETDAPWCEIRKSHAGYKFYKKYNLS

SEQ ID NO: 16544 - protein, 220 aa, Candida albicans
RSGFANNPFEDDLFNMFFGGGGGPRGSPFASGPTFTFGGNGFTFQSYGNGGADPFMRYRTTTRRPRAQSPNGREQTGPNGEEQPSLFEALKGILPILMLLIVPILSAIFSGDTSPGYSFVPSQKYNIQRNTPKYNIPFYVTDKFQEKHGSKSKRQLRNYDSKVENLFISDKRAKCSKEQIHKDQLIEDAYGWFSVDSEKLQRAENFPTPNCDILKGLNLL

SEQ ID NO: 16545 - protein, 123 aa, Candida albicans
KDDTIKFIFAYIDKNKLHITQIKPLQNYIWLIKKLIHRHYILTSIIPKNIRTPITNGKEKLDKLFPLTRPDICFAIKYISHHQLKPSDKVFNQLERILRYLKGTADKPIKYYTNNKKKWSIGI

SEQ ID NO: 16546 - protein, 494 aa, Candida albicans
YYLVTFVFNVIFLCDNRPQLDQRDDNLRIPNIPTDWIPYIPIDWIPDIPDKPPTPVSTPDIPATTTTSESSSSSSSSSSSTTPKTSASTTPESSVPATTPNTSVPTTSSESTTPATSPESSVPVTSGSSILATTSESSSAPATTPNTSVPTTTTEAKSSSTPLTTTTEHDTTVVTVTSCSNSVCTESEVTTGVIVITSKDTIYTTYCPLTETTPVSTAPATETPTGTVSTFTEQSTTVITVTSCSESSCTESEVTTGVVVVTSEETVYTTFCPLTENTPGTDSTPEASIPPMETIPAGSEPSMPAGETSPAVPKSDVPATESAPVPEMTPAGSQPSIPAGETSPAVPKSDVSATESAPAPEMTPAGTETKPAAPKSSAPATEPSPVAPGTESAPAGPGASSSPKSSVLASETSPIAPGAETAPAGSSGAITIPESSAVVSTTEGAIPTTLESVPLMQPSANYSSVAPISTFEGAGNNMRLTFGAAIIGIAAFLI

SEQ ID NO: 16547 - protein, 361 aa, Candida albicans
MVSQQVFNWLFNVIQPLYEHKKEVYAHVFQFLQLHLKKNLNFKIRTQIYTSSGSGEPNLLINLFGTIQINEQIGTPIEIWVPFAYPYVDYENKGAPIVYIVPDHSKGWYLKPNNNVDTQGMFYHPYLTRWHRECLRSNPDSLNMFSLVELANVIYRSVTTDSPIASKPPGITNTPQKPAKVPLDFNSISTEQPLNLHQLNTEQPAVIPVQTTGPPLPAKPPKAQNDIHSSTPLKYQAPLPLPHEAEKFNYPQERTSSPLPPLGFINQQPSRSPAIASAVPHTMTPPQPSPPVDLIDGENPLSETNTGVTNLTHELYSKINHFLSEEEKTIKDVNEKTMKIKVLYEQLNHYYSLALKNSSFL

SEQ ID NO: 16548 - protein, 437 aa, Candida albicans
RKIIYQILQYLSHNTLIELISVPFLNQYVTSYLHPVCLIDSKAKEVRHNPKVKVFKTITAFTKFQKLHNYSPQRLVLSNNIGTNKVGASTDWYSPYKLEIVNNLELITARNVVKVTLFSSFSLPIRAIPSHVTELSIFGDKLNLVHSNIQTLEINQFDLRYMELLTESIKELKLLEFKLPSSFPSLSVKFPINLTHLTITEGQHSLSLINLQSLLFLKLLNYKGNLKLNTPQMTSMQDLQLPESIERVCLKCLNLVSLQSISNLKCLTHLEIIDFPKLFTFFDTKFPSGLKTLIYKFDTVVPNLSYFQNQMVLNFDSSRLVRETTTGNMIFLKIDERFEIPNQLKVLILENIPYVKVSKSINIPTTLNELIIRKIPGVVPANNFNIVPLNTALYRLTLSNMMLDSLEGMKFPEKLSFLDLSPYPLQHIHGTNLHNLK

SEQ ID NO: 16549 - protein, 182 aa, Candida albicans
TMTQNVYSVILPAYYEKRYLPILIYLLNKTFTANKLDWEVIIVDDNSPDGTQEIAKKLIDIFGPEHIQLRPRAGKLRLGTAYVHGLQFVTGNFVIIMDADFSHHPEAIPEFIAKQKSQDYDIVTGTRYAGDGGVFGWDFKRKLISRGANFLASVVLRPHVSDLTGSFRLYQTDVLKKIHDVT

SEQ ID NO: 16550 - protein, 239 aa, Candida albicans
SKTTLFQLGKDYSYYSSEIRDIHPSSAKGSAESASSISRTTCPTNTNNWEAFTNLPPTPDKEVCECMSASLKCVVDDKVDSDDYSDLFSYICAKIDCDGINANGTTGEYGAYSPCHSKDKLSFVMNLYYEQNKESKSACDFGGSASLQSAKTASSCSAYLSSAGSSGLGTVSGTVRTDTSQSTSDSGSGSSSSSSSSSSSSSSGSSGSKSAASIVSVNLLTKIATIGISIVVGFGLITM

SEQ ID NO: 16551 - protein, 115 aa, Candida albicans [sequence omitted]

SEQ ID NO: 16552 - protein, 208 aa, Candida albicans
PNINHDNVFRVDSTTYIMGKGNSSEMVIPGDDNKVYVQSFEGYDSCTVIEAVSMTGNISPIGIVFSGADLRTKWINDGSPHWYYTATTSGSVSCQIMYSWLNEVFTPYLEQKKSEDEKCLLIMDKDYGTTNTRFQNSCELSGVVPLYLPPCCPHLLSPVDIQTLPRIVSPEYKSKLQELDKKFGFAPVKQRFFLSGYFKARQQLNMTP

SEQ ID NO: 16553 - protein, 238 aa, Candida albicans
  UNSURE (234): Identity of amino acid sequences at the above locations are unknown.
QAEKFFKNFKQLINENNINHDNVFRVDSTTYIMGKGNSSEMVIPGDDNKVYVQSFEGYDSCTVIEAVSMTGNVSPIGIVFSGADLKTKWINDGLPHWYYTATTSGSVSCQIMYSWLNEVFTPYLEQKKSEDEKCLLIMDKDYGTTNTRFQNSCELSGVVPLYLPPCCPHLLSPVDIQTLPRIVSPEYKSKLQELDKKFGFAPVKQRFFLSGYFKARQQLNMTPEEIVDRWAFTXDVSE

SEQ ID NO: 16554 - protein, 544 aa, Candida albicans
PILFPFCFNNTSIWQLNGKKKQVVDEVAMAKAISDIKNGLLLSYRKAAKKYNLCHETIRKRMNGVLPKQIAHRGKQLFTPQQEKEIVKWIIESDEAGNGRSRHDIVEYAELFLLLDRQLASIGGSWFERFKKRHKEIHVVQGRKISSLRVKAATPDQIKEYFHKYDLIVRQHQIPNENIFNYDESGFIMGQGKSSRVAVPSYKNRTYVKSTEGRDSCTVIEAINMSGEKLIPGIIFKGQTLRTGWFNDDASDYYYSVSKCGYTSYWLSWRWLEEVFIPQVKEKTNQGKVLLIMDGHGSHKTKKFRETCEDNNIIPLYLPPHSTHLLQPLDLGIFGPIKYGYKVKLSKLAHALGTDPVKQQLFLLNYYEARQEKLTKERIIRSWETAGLNPFDVDKVLNSSQMIAAKINKEIDDYENNRDEHTQQDDVEIGLYLRGTPDEELIDKLTKKIDFLELENTQLKTDVAHLQAELTSAKLEIDNYKEALKNKKPPGRSSAIPMDENQGFKRAAPYAKEYRQNPPKKNKRKALTDMTNCTNGSNSYIRSL

SEQ ID NO: 16555 - protein, 304 aa, Candida albicans
YLSITMSKVSITIIGLNGFLGKPVLEAINSGIFDDKINFPIKAITRKEPETKNDKIEYVVSEINEESIKSTLSQKLSGTDVIIELIGPNPEAFANIEKLIDAIKPKLFIPSQFGTDIPKVDEYAPGFLGIKTQHSENVRKLGVKVVDIITSLFAVPGAFLYEWVGSTGINADDKTVKLIGDINQQFDISKLEDVGKAVLSIATNPNPRELPDTIRIGSDRITVKDVIDRYSKDHNVELKVVSEQSAEDAKKEFTESLKAGFDGEKFLWYLQVIAAQGLDKGLLSSKLDNELVNPGESLWKWGKY

SEQ ID NO: 16556 - protein, 64 aa, Candida albicans
MSYNDNNNHYYDPNQQGGMPPHQGGEGYYQQQYDDMGQQPHQQDYYDPNAQYQQQPYDMDGYQD

SEQ ID NO: 16557 - protein, 692 aa, Candida albicans
  UNSURE (2),(18),(19),(44): Identity of amino acid sequences at the above locations are unknown.
NXTFFLPPKPLKKGKQDXXAPSKKTPVNPKLRDISGQIKETIIXSTTDLNEAYSILEEGITFLREIQKSENITDRQIFKEFYPLATELFNLAQKPETTIDHSLNDIIDMFVKNKIAHSMHFIQLAANALKQNSEAYDEVLQYWFKSFEYTKSHDFLYVNNFNGIKTKIEYQPYDFTNLAIYAYVQSCIAQKVTYSPVDAAKFSPSGKIPPFYHIKKTLEVLDIHDGKKFREYCNLLETDSQERFNPNGASSIKKIENTPDKKQLDKFYQNVVDICNKRNIKVDEKVIVALMQRYFQFDEYNEVFSLCETIMNSGVKPSIDAWNIVIKAMTNPSRIASFGGKAKQQELVQNFERTLQTIVSSGVQFNGETVGAIVSGYANFGQFDKAQEYIDKYAKGVKDNGAVISLCNDGILRGLVYNGKIEEAESKLKQFMETHTQYKPHTHVMNDFLNYYAKKKNYKAINGITNFMRKHNIAENVSIKTTMINAYFESLHAIGKTPDLSSFLAKMESSENAGKRGFNEQMHSTLLKGLIQGANIEAARQLFDILKSRYPRSAWLNTNMMVGELTLGNVKLGEDIFNYYIKEIRNEPIIWNTFIHNLLARDEKLADFYFEKMKQDSQVQPNFYTYYFMLQHYRRKAKKDRLQQLVNELAEVDWTSYGTSLPDFIKRLTNYLDVPASLLSKLDKQQATVDKQ

SEQ ID NO: 16558 - protein, 213 aa, Candida albicans
  UNSURE (32): Identity of amino acid sequences at the above locations are unknown.
NILFNLQDVSLGEELHNFKSFVTGFDSEMIGXTISNSDLIRSIHNSFLAPHSFVDEDKPPPPPDRDDKDDGLFHFVGYIFKQGKIYELDGLKQYPISHGECSGQDEFIQKLPTIVQERISKYGNELRFSLLAVTNNKLEQAQAMGDQEEIASQLHKRELWKKENELRKHDYTGLIVQLLKNISKEKSDKEWEDFLQKGRNKTQQLIAQSIKKT

SEQ ID NO: 16559 - protein, 94 aa, Candida albicans
GVFTELVEKLGVENIEINDLYSIDSDTLRALQPIHGLIFLFKYSKLDREFATSNQPITGEYEGNYLDKGIFFAHQTIQNACATHLHHGAGRSRD

SEQ ID NO: 16560 - protein, 167 aa, Candida albicans
QFSGVTDRFNLERIKSDFSSVQSTISKLRPPQEFFDFRRLSKPANFGEIQQRVGYNLGYFSANYITIVLGLSIYALITNFLLLFVTIFVLGGIYGINKLNGEDLVLPVGRFNTSQLYTGLLIVAVPLGFLASPISTMMWLIGSSGVTVGAHAALMEKPIETVFEEEV

SEQ ID NO: 16561 - protein, 178 aa, Candida albicans
IMELFTKTWSSFTGGFIPYKLKDKIVDPLAHTTSLDRNSIWTLHDGINPKDNSPVSVFEFNLKDPANQQRIGLARNAFKKLKLIKFPGVISIVDFIDNDYSLYIITEPVKPLLIYLEETGLKGDSLVAGIYSVAQSISFINEAANSLYGGLNYFSSRICYFVRRLEVNGVRIAYQFNI

SEQ ID NO: 16562 - protein, 196 aa, Candida albicans
VKIKSSNIFLVDGASTKLNLKNVKLVEINNNGVVAVLSGTKIMFSNYKTIELNCEAAQIICHPSLDFFVVLAAKKWFVISTDSIVASRNGVLSLGALHYDGEILATKNDDKIKLYSIVSGDELGTFTATHENIAKLEFATNGYWLLALSTGDNTSSIQIFDLRKGIEVQNLQFNEVATKKIGNIMFYSLHSFFKYL

SEQ ID NO: 16563 - protein, 234 aa, Candida albicans
NRSLENPKKKQTTLLMDIETAACFSIAFIATPILIVLVRLLFILPSLRLPTSVKKKKKLIQECQLSILLGSGGHTGEMMRIISKLDMGKVSRTWIYTSGDNASLAKAQDYERKSGTSLQYIPIPRARTVGQSYILSIPTTIYSFLFSAIAMLKHRPAVILLNGPGTCVPVAYILFLYKLLGLCNTKIIYIESLARVNKLSLSGLLLLPISDRFIVQWESLYQQYSRVEYYGILI

SEQ ID NO: 16564 - protein, 222 aa, Candida albicans
KWHLNLVTYSLYSKMTHPQGMWIIGYGSLIFKPPPHVSYKVTGYLKGFIRRFWQSSIDHRGTPEYPGRVVTLLSIDDLTSPKFHDEFYNVSSPDDLRVYGVAYYIEPQHVEQVKQYLDIREQNGYTAHKVPFYVGEEFIESDIYIGTIDNEAFVGPESLEDTAHVIRTAVGPSGKNIDYLANLVHSIKDFGIRDHYLEHLYTLASSNPDSSTLPTLKPAPTD

SEQ ID NO: 16565 - protein, 733 aa, Candida albicans
EIAREDSKSLPNSDQDICQIIKCKYHYSISIDGVVPADHGTARLDELNKNDCKELALFVLPLCFLKGGSTLNNVPKHDIKLLIDEIYDVIGDPDFDLNEALGRNKATLNYFLDNTRLTKRLFQEAFHGLVRLELGEAEEDKQFNGLYYIEGLLLFSSYKLRKKNMQSKAVELESAISLFENDIICGSNRFESWFLLGQSYGYLVEDDLIWTADKLTASDRKITTANLQRKSLICYLMAINKSLDESIKDVIKPVVGNLMSLFAKEMFSAVCEPMSMHAFKVQSHPRFINRVNGALFEPVSQFPAVDKTVCLKIIQQSLQLSIKSSCREWSDYYYLAKVQRKLDKPAGLVMETMASACRSAFKNKHADNIIEPHYNLVSFALKYVKSNRLDSKDALKYLIEDPLIKLEVGEETDFIKLIIKALNKIDLSDKKNWQHKAKYRLARLMQEEYHDVKGAIDQMSSFISLKTPNKALVLIWKPEPERPGKHFLYTFQYIHFYIELLKEIDDLDSLVAMLPKLRRSNSVMINLSIAWEILCSSVCKIIRESYGIGDNFEFTENLINTLPYQTFAANVKLLPDMMRRQSVPENLKSVLCFLFTVNDIKKLNNGYGPTSFIDDTLVTLYFMIYLNYFEKSSTEVTTDSPGLKKKIAKRDIFPLTNDILKAFKKDIEDVTKQKSYNELITAQKLKQGLNEDKLLENVPASANVNEIIVIDDDDDDNLSQEPATKKSKTESNS

SEQ ID NO: 16566 - protein, 245 aa, Candida albicans
VWYPYIIHARFRNQLIRSKRVQKLLKKLIPDQVKKIYKKFKKNTDRQSADEQLVYILKYLIKWFRKNFKHDSNGLRVLGYSFDPGKFPNNAKNISNESDLLAVIKKFQHNRDTGAQIFTAILSALGFESRLVFSIPLLSIKNTNTQPKLNHEILKVNKDNDLLYPYFWTELINPLDPSEIIVMETQCFYEEDKRLLIIKRHGGTLSQSFTDQFYPNTNQLCPNVNALCVEFKLGRTKYWMSARNI

SEQ ID NO: 16567 - protein, 111 aa, Candida albicans
IKFSLKHFFFLFASLFLPVSTISIQSSTSFFLDVNPNLMRVSNPQLSKTLFVNNFWGNSPEKSFEIVTTRIKDSLNTLNEIINFYQEKINIEKEYTKKLEKLQSKCILWTQ

SEQ ID NO: 16568 - protein, 67 aa, Candida albicans
TQIKPIMSILSENNPTQTSITDPNESSHLHNPELNSGTRVASGPGPGPEVESTPLAPPTDVMNTTSS

SEQ ID NO: 16569 - protein, 172 aa, Candida albicans
SQSLKPYLTAVRASLTAAICLEDFSSQLIERHNRPEIEVDSKSCHNPELILNPMIIARNENEKILIESSINSIRILIKIKQADEIENILVHKFTRFLTSRAENFFILRRTPIKGYDISFLITNFHTEQMVKDKLVDFIIEFMEDVDKEISEMKLFLNARARIVAESFLIPFD

SEQ ID NO: 16570 - protein, 94 aa, Candida albicans
QKFNPGTKHRMSEVNETCKPQACAIQNCLEKNGYNESRCTKCIDDLYKCCKEFYERQGPDASSVCCPKFKLLQLKLKQRSLGEIDAKVLETRRG

SEQ ID NO: 16571 - protein, 117 aa, Candida albicans
FPSHKLGSFLPGGVRHMIILPRHELYNNLVNAEPENTRRSSITSLNAEFRNTKAHNALCSVGGSLISGVTLTKLIGISVLAFTRSQIFEVYYFRMWLSLVVISFVHAFVLLPVLLSF

SEQ ID NO: 16572 - protein, 132 aa, Candida albicans
IYTIRMIFKLPLILLRLYITSFIIWIFQTTILPQTLTKLTNVSIKTQTFQHYYPYTSLVNTPKNSNSINTITNSNITYIIAHPDDEVMFFAPSIIELKKPKYNNQINLICFSKGNYIKSMDEIRSIGIDSIE

SEQ ID NO: 16573 - protein, 320 aa, Candida albicans
NFYLVVIMTFKQDARAAFRGLSITDKLLPLLIVLAIVIGVIISVYVPGSSEAFNGTKVVGVSVPLAIGLIIMMIPPLCKVEWEHFHKFFNKSTYLRPILISLVLNWIICPFIMLGLAWVVLFNYDEYRTGIIMIGIARCIAMVLLWNDIALGDNTLCAVIVFINSLLQVVLYAPYQLFFCYVISGDPIPIDSGVSYSIVAKSVAFFLGVPLGLGVVVRFALLYFKVYDKLIRFISPWALIGLLYTIIVIFIDKGKEFIEEVGTAFLCFIPLTLYFLIAWFTTFFVLRWSSKAPKLEDEDTRLLCGCEEKIEKSSPRVEDR

SEQ ID NO: 16574 - protein, 551 aa, Candida albicans
KTCIQHQLLLSTSEKKKKKTLANNNNKNSATQKKKIEPTFEIFNDHLEIFHSIKSNPTMQEPTDISYYIGKESAESLNLLDVPVGGGQIVSIDLRNELSDDPSELIQFLTDQQTEKQYWIIAASGYAKLGKLKELLEFINAALKLDYFNENDKKSFESFIIWLLVKNVYLGIDKDNNLNLAKKEISKLNFKIQTDSETSTLISTSNLLSLAILYLYESKDDDAIDIFDRILRIDPNNCFALLGKAQSVLNKTKNYSHALKLYQQVLILNPLMKPDPRLGIGLCFWFLKDDKMAIQAWERSLQLDPTNVKLRIFLNLAKFHTTFTNSLSDEEFLDNYKNCLQELSKLKSLNANDTTVTLALCSYLFSKGDYNTVIKIVEKIVKGITGSDNLKKFSTFSRITKYESNALSQCATWLARIEFARGNFTQSSKYFQEAIKLNETNIVAKLGLGQSQYNRGSIEEASLTFESILRSNVKCLEVNYSLGVLYSKQNSRSKKELAIQVLERYIRLSNNRGLSSNEEEFVLNKEPVALNAYLILIQLYEFSTRRSKDIV

SEQ ID NO: 16575 - protein, 425 aa, Candida albicans
FNMRGADTFLMKNNMYCIMARDTKGADEKKKKYYLRAIELFTKVLSLDSKNVYAAQGLAITYIENKQLNKGLDILRKIRDSLNDISVYLNLGHVLCDLKQFGKAIENYELALTRYTDGKDAKILSFLGRVWYLRGNAELSLPYLKKALGYAQAALDAARSTSTAALAFNISFVQFQIADFITKQPVNERNIEDIESAIEGLNKAIDILTQLASDEEKHPPYPREELRGRANLGTSTLLSRLANALEETKENNAEIEEKIQKAKQIRLDEEQARLKEEEERLNKLKEKELEMSKQRMLLQEQAQKWAEENSASVGVSDNEEDDDKLFDEESAQKENKRKKGGSSKGKKGKGRKKKGNIIDDSEEEPEKNITDDSEDEANGNSNGKRKAADDAGGKKKKKPLSSEFIQDSEEELEDDDLFGDNDDDE

SEQ ID NO: 16576 - protein, 70 aa, Candida albicans
  UNSURE (59): Identity of amino acid sequences at the above locations are unknown.
FLCNFFFLPHIHTYKPIFIRKSYTMSVPTFDDLSFYSNDQELTKSRYLKLVEIFQLHMXSRPDWPDPHYS

SEQ ID NO: 16577 - protein, 147 aa, Candida albicans
NLTNVPDTYIKRSLRVLETWKLLSTTQTSSNSKDDDESFLVKFGELMNQSQSDLDKLNESSNDKLNEICSIALQNGSYGSRITGAGWGGSIVHLTTLDKSKQLIQGLIKNYYQLEFPNIKLDELLNDAIIDSKPSMGSCIVTTKFLQ

SEQ ID NO: 16578 - protein, 171 aa, Candida albicans
FQSNFPNASIDFFARSPGRVNLIGDHIDYNFFPVLPMAISNDVIVAVNVNDEPEIVITNTDSKNFAKETIPLTNNNDGFEIDSQHHSWANYFKCALIVANNYLTEQNLKGQLKGMKLTFDGNVPTGGGLSSSAAFCVASTLAILHANGVKDISKADFTRITSSTPRRPSRQ

SEQ ID NO: 16579 - protein, 87 aa, Candida albicans
  UNSURE (75): Identity of amino acid sequences at the above locations are unknown.
DILPAPTDMSREALINRITNETKIQIALNLDGGKLELKESIFPNQSIIIDEHHAKQVSGSQYINVQTGIGFGRSXSPSGVDGPILIV

SEQ ID NO: 16580 - protein, 154 aa, Candida albicans
  UNSURE (1): Identity of amino acid sequences at the above locations are unknown.
XGNSITPSNSINSGTTKLTLPPRRVWVKKPQTNNPTTVLCYVNDIIDDLKVAVVNKYPNTIGRYEDAADLLVKIDLNNIRVPVSPSVNRVSQRTPFDNCIILEPDQNVWQILDNYFPNGMAMHDALIIETPTFKPDHQMLTPITANMNNNSNTF

SEQ ID NO: 16581 - protein, 385 aa, Candida albicans
LQILYLIMLRHLVFILIAILLLTFPPKIESLFKSFIINKPTKTTCYQYTIREQLKSILESDIHETNFCIEKPSTSPPKTNSTLLMLCQNSDIFSVLETIQNIQDRFNDKYNYDYTFLNDVPFNYEFIYLVSSIIPHGKINFGLIPIEHWSYPSHINISLATEIRQNYANVPYGDSESYRHMCRFYSGFFHKHELVKQYQYYWRIEPGIKIYCDIDYDVFEYMIINDKKYGFVISLFEYSETIPTLWNHVVQYINDNEIKSELLPLLTNKYNWYNLCHFWSNFEIANLDIFNNDDYENFFQYLDNLGGFYYERWGDAPIHSIAIALFLQKKDIHWFENIGYYHVPYLQCPQDIDLYVKNKCTCNPDEDFTWSDLSCTNHFLNILHN

SEQ ID NO: 16582 - protein, 98 aa, Candida albicans
HTHSIQMSKFVIPTALKELRFHLSQTGEASIPVRNFLTKNYPSLKTQLNYKLPILIRESYGIPPTLTARFERGEEVKTSLEGLDEAGVEKALNELLKR

SEQ ID NO: 16583 - protein, 175 aa, Candida albicans
GIFYFKTMNEELINSAVSFLKDPQVGGSPLTKKVEFLESKGLNQEEIEEALKRANDNSTTTSSSSSSVASSNLSNTTSSPSYQSQQQQQQQVYSQPPIDYYNVVPPPVPEKSWKDYFIMATATAGVTYGLYQVVTRYLIPSIIPPSQSSIDKDKETINEEFMKIDKILDQLTFEQ

SEQ ID NO: 16584 - protein, 275 aa, Candida albicans
LEASHSVLLFYFANNSKVNLDDVMRYVELVLEQFPQRISATQLSIAIETIGKKILSNPISYNNYNSRGNTIFINSAEKFFIFLLNKYSRIEPGVPIKPKSITSVLSSGSGEANVSFTSAQPVNEIEAHATLNTLEQEGKLANDVIDENKAKAPSKKIIKKYLPDLVGKTKTNSDNHPFEFFDTRLTPETAREATIVSLINLVPYFPLSVFIPWLNQVWDLIVRSDSKEQQFLFNMLWKVISESLDINRGDLAIRWWYEEKQFTFFTDRGWQETRY

SEQ ID NO: 16585 - protein, 227 aa, Candida albicans
SQTFSRNMNYLLFCLFFAFSVAAPVTVTRFVDASPTGYDWRADWVKGFPIDLSCNATQYNQLSTGLQEAQLLAEHARDHTLRFGSKSPFFRKYFGNETASAEVVGHFDNVVGADKSSILFLCDDLDDKCKNDGWAGYWRGSNHSDQTIICDLSFVTRRYLTQLCSSGYTVSKSKTNIFWAGDLLHRFWHLKSIGQLVIEHYADTSEEVLELAVFTTRAREGPSIPRP

SEQ ID NO: 16586 - protein, 119 aa, Candida albicans
SGISLMSSVASKKIITFEGHRNFRLRLVLATLSGKPIKITKIRSQDLNPGLKDHEVSFLRLLEAVTNGSHIEISYTGTTIIYRPGIIIGGDLTHNCPDTKSIGYFIEPMLMFPLFSKGR

SEQ ID NO: 16587 - protein, 236 aa, Candida albicans
MGVITSLMEKFGVREVSLHILKRGSAPLGGGEVHLLCSSLIPQPLTIHALDIPKFSAIRGVAYCTRVSPSIVNRMIDSARAVLKPTGCEVNITADVWRGENSGKSPGFGITLVAELKRGWRIVTENVGSAGSLPEDSGELTAYQLLEEISNSGVVGRYQLPLALVYMTIGKEDIGRLKIQKSEIDENLVSVLRDIQEVFGTEAFFKDDAEELDSDDKFMTVSIKGVGFTNVSKKIA

SEQ ID NO: 16588 - protein, 553 aa, Candida albicans
EKFGKRKVRRKKKKRPDKISLFQFKPNHNQTFFISSNMPGLDYLLFEEATGYGIFKVLIQQDDIASRLKEVQEAANDLSKFSKMVELVSFAPFKGAAQALENANDISEGLVSPYLQSILELNLPKTSSKKRIALGVSDKNLGPSIKEVFPNVDVLSNEIVQDFLRGIRVHGAKLFKDLQEGDIERAQLGLGHAFSRAKVKFSVQKNDNHIIQAIALLDQLDKDINTFAMRVKEWYGWHFPELAKIVPDNYSYAKLALSIKDKASLTDDSLHDVAAILNDDSGLAQRVIDNAKISMGQDISEQDMDNVITFAQRVVNLYEYRQQLYKYLTDKMHTVAPNLSTLIGEVVGARLISHAGSLTNLSKQAASTVQILGAEKALFRALKTKGNTPKYGLIYHSSFIGKASAKNKGRISRYLANKCSIASRIDNYSEEPTTAFGEILKKQVEDRLKFYDTGSAPMKNSDAIKAALALNGQDLAGAEEQKDVDMVSDEEQVKKEKKEKKEKKEKKDKKEKKEKKDKKEKKDKKEKKDKKDKKRKSDDGEETPKKKKKKSKD

SEQ ID NO: 16589 - protein, 602 aa, Candida albicans
KLKLLIQLTMERDLTYNAPKIKFTDTEGQEEHFYFNRSNNSTNDLTSHDSSSTQLQDANSRRQAPPPPPHNPFSDNSHENSTESLYQSETRFHQPLLHNDSNNSNSSIGNNRQRIPSQQHDTLSLYSASPISTSPLVSNFQSYLDNQDEMTRGKYNQNTNRSSSNYIQHSPTSAGYDRYPLKTQSSIGGSMLRIGLSSSSPSQQQQQHMYDNNSSNRSLYSPDSATDLMVYENGEFSPFGGYPASLFPLSIDEKEPDDYLHNPDPVQDAEYDKNRFLYDLKTMDKKSMNGLIAFIVMFLIAIAIFIILPVFTYTGYNPKAKNFENYEVLTRYLYPRLSAIRTSLIDPDTPEDALFWKSKNGEEWPLVFSDEFNAEGRTFYEGDDQFFTAPDLHYDATKDLEWYDPDAVTTANGTLTLRMDAFKNHGLFYRSGMIQSWNQMCFTQGKLEFLAKLPGYGNITGFWPGLWSMGNLGRPGYLALTEGVWPYTYDSCDAGITPNQSSPDGISYLPGQRLNKCTCPGEAHPNRGVGRGAPEIDALEGEIHGVIGRVSQSLQVAPYDIWYMPNYDFLEIHNSSITLMNTYRWWTLSKLALGGQYRIILE

SEQ ID NO: 16590 - protein, 155 aa, Candida albicans
INCLIIFLKFAIKKKYYKYHQIPPNISFIPFISFLLNSILSKKFSNTITIQIIMSEEIISFTNPALGPLPTKAPQLPSNVLDLFSLKGKVASVTGSSGGIGWAVAEAFAQAGADVAIWYNSKPADAKAEYLTEKYGVRAKAYSFQTRTGPRISSK

SEQ ID NO: 16591 - protein, 111 aa, Candida albicans
TNAVCHSRGEYPQLQAPYNAAKAACTHLAKSLSVEWASFGARVNSISPGYILTDIADFADPEMKKKWWQLTPLGREGLPQELVGAYLYLASNASTYTTGSNIAVDGGYTCP

SEQ ID NO: 16592 - protein, 290 aa, Candida albicans
  UNSURE (87),(121),(127): Identity of amino acid sequences at the above locations are unknown.
FAILNYSVMTFTSFIKPESDPNIIVPTKPFNLSPNIVERFSLKDKVTVITGGAGAIGSAIAEGYAQAGGHVIILEHASSDNGLTKRXSSAYGVKSKFFQIDVTNSQQVQQVIIEIDEEVGXIDVFVXNAGIAWYTGSILNEDSTPENWRRVFDVNVNGVFYCAKYAGEIFKRNGSGSFIITASMSAHINNVPNYQTCYNSAKAAVMHMAKGLAVEFAGFAKVNSVSPGYTNTLLSEPIPKPQRAKWWGLTPMGREAETDELVGAYLYLASDASSFTNGSDIRVDGGYCCV

SEQ ID NO: 16593 - protein, 308 aa, Candida albicans
MFKTIFSITSKLRILPINRHFTTTITIRMSKETTSYTNAKLGPLPTKAATIPDNILDAFSLKGKVASVTGSSGGIGWAVAEGYAQAGADVAIWYNSHPADDKAEYLTKTYGVKSKAYKCNVTDFQDVEKVVKQIELDFGTIDIFVANAGVAWTEGPEIDVKGVDKWNKVVDVDLNSVYYCAHVVGPIFRKKGKGSFIFTASMSASIVNVPQLQAAYNAAKAGVKHLSKSLSVEWAPFARVNSVSPGYIATHLSEFADPDVKSKWLQLTPLGREAKPRELVGAYLYLASDAASYTTGADLAVDGGYTVV

SEQ ID NO: 16594 - protein, 159 aa, Candida albicans
PRYKKMLLIYHHNQDQYVELSKRSTGSGGIAGIVIFIFIVIVIFISLLSYGNKKSKRRNQKNTTPANITLGSLNLESQNVHQGVARIQQQQQQQQLQQQQQNLGITTSPEHDYVPPYTQTPNDNDLGRFDKQGNFHLLNRPEGVQPPLPPPPVYLNPTI

SEQ ID NO: 16595 - protein, 342 aa, Candida albicans
NRGSFQPPWVKTRIEQIDLNTVEITEIPVKTWTNNVKEFLLSGFGNEKTQPWIKDMEEHHTTSIRFVIKLTDAEMQKSLRIGLLERFKLVSSLSLANMVAFDPMGRIKKYNDVLEIIKDFYYVRLEYYQKRKDYMTDNLQNQLLMLSEQARFIKMIIEKQLSVANKKKKQLVALLEEHNFTKFSKDGKPIKSSEELLTGEDADEEEETQEQEGDEDVGNTSVANIQEGEPEQAAHVPETIYSSYDYLLGMAIWSLTYERFMRIMQQRDQKEAELNALLSKSAKDLWNQDLDEFLAEFDKFLLRDEQERESLASNGKKKSTKRRAKATATKDQPNNTKVKVEP

SEQ ID NO: 16596 - protein, 168 aa, Candida albicans
KICHLKKAHPLFKKTNEKTTQLLPSPPAMSMYPQRTQHQQRLTELLDAIKTEFDYASNEASSFKKVQEDYDSKYQQQAAEMQQIRQTVYELELAHRKIKEAYEEEILRLKNELDTRDRQMKNGFQQQQQQQQQQQQQQQQQQQQIVAPPAAPPAPPTLSYLPTRGKSE

SEQ ID NO: 16597 - protein, 161 aa, Candida albicans
ESPIKQEQTAAKQEKHGLDENHPVLTDEQIQKDFDLFYQDIFVHVAKLGQINDMAVCENENHLSGHVYIKFNDYNDAIAANLQLNQEWYNGKPVYSELSPVNILADAHCKSWDHGHCDRGAKCNYLHVKQPTQGIKKSLWDSQTKTYTLKKLEMSKSSPRD

SEQ ID NO: 16598 - protein, 191 aa, Candida albicans
SNNLRRTISMNRSSYSSQSDNRYSRNPAVLCSFYSKIGACRHGEKCSKKHLKPISSRTILLANLYQNPTLNDDDYGHANGIGSETSQIIDNESVIKNSDTVGTVSQIDDSPHSNSGEVTKDETVETQEVETENSENIAETGDVKIDHNEDQKQIEDVKESDKVDTSEEVQQDDKLHKEDTLEKESVYTAGG

SEQ ID NO: 16599 - protein, 201 aa, Candida albicans
FTIYSPQNQSNTIALIFIMSTTEQSLQSKTAVLCSFYTKIGSCRHGEECSKKHLKPTITKTILLPNLYQNPRFDLVEYLSRNRKQHRVKKRKTGDKNSDDIAEINLETKDDVKDNEDKANVDGENKEHDETKEIESEDVISKDKEEVIVDRSGIAQQDKQKESNKEGKQEGESEKEEPNKESTEEELPPQDATQEVPNHNQ

SEQ ID NO: 16600 - protein, 65 aa, Candida albicans
LSALVRCILSIFEASTDTMFSVIVKHQGKRHEVELDPSANGETLKYQMYSLTGLESSPRGWQDPR

SEQ ID NO: 16601 - protein, 289 aa, Candida albicans
QKTMAYVLTETAAGYALLKAADKKIHKSSSLVEDLNTAEKVAEQFKIHRFEKFQSAANALEEANAIIEGKVSENLQKLLEDAKSDKKATLIVSEAKLGNAINKLGLNFQVVSDAASLDLQRAIKQFLPELLPGLDDSALKQMSLGLAHSMGRHKLKFSADKVDTMIIQAIALLDDLDKELNTYAMRCKEWYGWHFPELAKMITDSVAYARIILTMGVRSNASETDLSEILPEEVEEQVKAAAEVSMGTEITEDDLNNIKALAEQIVDFAAYREQLSNYLSSRMKAIAPN

SEQ ID NO: 16602 - protein, 229 aa, Candida albicans
TAMVGELVGARLIAHAGSLTSLAKAPASTVQILGAEKALFRALKTKHDTPKYGIIYHASLVGQASGKNKGRIARTLAAKAAVSLRYDCFDEERDESDDFGLENRAKVEGRLSQLEGRDMRTTSKVVREQPKVEITEARAYNADADSTAAAAAAAPTADSDDEESETEEVEEKKSKKDKKKDKKEKKDKKKDKKRKRDDDKEDKESSKKLKKDKKEKKEKKEKKAKKEKK

SEQ ID NO: 16603 - protein, 432 aa, Candida albicans
KVIRSKQKRKVPFFQPKSPVMIIPEKGTLDEPEVGSESKKPNNSTHVKGVAAIKAEYLVPTSSLTVVEYDDDEAEGGDREGESKPRNKKKQKGQNHKRDLKQKKDIIKLCPSLIDPEDDRICQVGADKCRFHHDIASYLESKPQDIDGICPVFEALGYCPTGIKCRWLKSHYNPETSKLIKDGDKMETAKTTNYEVNHIDKDQKMEMQKKKYFFKISQPVIKYLDSRIQNEANLAKQKEERKDNEASYVEAPFTIAEKKKLYLRNAKIVSPLTTVGNLPYRRLMKTLGADVTYSEMALSVPLIQGHNPEWALPKAHVSEYPGFGVQIASSKHWAAAKAAEAIYRNTTHVSELNLNCGCPIDMLYKQGQRSALLDQPSKLLRILSGMNASSGDIPLTVKIRSGIKERKNTAVDLVSKVLEERNAAAITLHGRS

SEQ ID NO: 16604 - protein, 97 aa, Candida albicans
YQLPKMPSKQLRDPKYRPTEVIKQCQEKGRPAYIAGPMVRYSKLPFRELCRFYDVDIVYTPMILAREFVRNEVARSTDFTTNDSDKCVIVTGGGTKC

SEQ ID NO: 16605 - protein, 254 aa, Candida albicans
QVGVQNVDEFMKFIEMIHPIVDGIGINCGCPIKEQVREGIGATIMSDPDLVAEVIKTATDKYGDSICIDTKIRIHRDINQTIDFVNKVVEAGTDTLTFHGRTKNTRSSVPVNLDAIKIIRENVTTIPVIANGDCFTLTDFQKIVDYTGVDGVMSARGVLANPALFTGLDKTPWSAVEMFLHLVTAYGLPYKLAQYHLAKLMEDVIPRKYVKAINEKKNMVDIIDYLDEHFDLKRKGDKGFATRIEPPWKIELKV

SEQ ID NO: 16606 - protein, 277 aa, Candida albicans
SSTRGGHNMMIATRRQSLQLTKRYISNHATKNKRFIQTIPISTNTGSNSFLSKLHQSESNDAPTSKWARHTLSFPKTETSNTTPQPPVRKSRTSRFANKSQLANETKPFNSSITPTPQSNIIEITSDPEIQKASNKITTSTASVPTDSNKSQSTAAPSVTPKKKRVLRPRKALITLTSSAVQHLQGLLDQPDPKLIRIGVRNRGCSGLTYNLEYVDKPGKFDELVEQDGVKVLIDSKALFSIVGSEMDWLDDKLSSRFIFKNPNSKGTCGCGESFMV

SEQ ID NO: 16607 - protein, 286 aa, Candida albicans
TLRTNPPSSLPPSPPIDMTKSTEATLINNLRHYIAQNYHHSSLSIWHKLPISRRSAVFILLFMGNLGELRVLLTKRSSKLRNFPGHVALPGGKADSGLELEWQVSRREMHEEIGLSDNDEDLKNLGISIEHLTQLPSYLSRTFSCVKPCVGFMHNLNGTDNDIASKLNIVLNPGESSSVFSCPLKDFLHPTIDIPALEALERTSYKVKWGGIPWDLRSYTFLQNNINELEWFKNIKDLLASEEESELDLKLGDELDSRDKASVTPPNCYSLQDPLSPAAAATTITN

SEQ ID NO: 16608 - protein, 399 aa, Candida albicans
KLKILHHFHFSSNTRYLLLPTMSTSASSSYLDDETTWDSFNLDPRLLQAIDQLGFSNPTLIQSSAIPLALEEKRDIIAKASTGSGKTAAYCIPIVNNLLTDDSAQGIKSIILVPTRELSNQVFQFVEKLLTFSTNKINVLNLSSSYSDQVLNSLLVNKPEIIISTPAKLIQILEKNEKNIDLSTVKNLTIDEVDLVLSFGYLDDLKKLESYLPVKKNLQTFLMSATVNDDLDDLKQRYCTKPAILKLNEDSANQNNLVQYYAKTTEFDKFLLAYVIFKLNLIKGKTIAFVNNIDRGYRLKLFLEQFGIRCCILNSELPINSRLHIVEEFNKNVYHLLIATDETNELNEEQDDDEDGDEDTKDKSNADTTPEKIEKVKIQTRTKNMVFPVVWISETSLVC

SEQ ID NO: 16609 - protein, 174 aa, Candida albicans
KAGMALSFVLPLSEFGKHKTASLASAKKDEKVLGRIVKQQSKNGFEIKPYQFDMKQVEGFRYRADDAFRAVTQTAVREARVKELKNELINSEKLKRFFEENPQDLASLRHDKELHPARIQSQLKNVPQYLLPESARQDVKNIGFVPFHKNKIHKHIKGKGKGRKKVDPLKSFRK

SEQ ID NO: 16610 - protein, 385 aa, Candida albicans
QGQKKNLIVFEKKKYEDNQIDKPQTQYYQTSRPLNISYIMAKGKNKTNDERSSKSRTSNGHKSKQHHIRKGRQEISASSTTSKPSTSFPAKLAMWDFDHCDPKRCSGKKLERLGLIKNLRVGQKFQGIVVSPNGKSIVCPNDKEIVETNGAAVVECSWARLDEIPFNKIGGKNERLLPYLVAANPVNYGRPWRLNCVEALAACFAIVGHTDWAELLLLNFSWGLTFLKINEELIELYQQCTDSESITKAQEQWLEKIEQEAKERKNQAHNEDVWMMGNVNRQEDNTEHDSDSNEEDAVDSESDIEYDNLGNIIQKKKYDSLGNEMIESKVKYDSLGNIISGEERSSEEDNDEVSTNKEDNNTVYDNLGNVVTNESITKHMNSLSI

SEQ ID NO: 16611 - protein, 776 aa, Candida albicans
  UNSURE (355): Identity of amino acid sequences at the above locations are unknown.
YTKKFWPSFLYYFTRHISNLKKIQKTFFFFFHIFLHILNQVYFSEHTQIINTEVMGFGQILLFACSILYLSTGGRWTVVALVFVLYILYNKDQQQQQQPPQPQQQQQQQQQQQQQQQQQQQQQLKPSVPPLAKPKKESPIYAVDFTFSSKAFTPSTTTTFPIRRVIAPRPKRSPKIFTASKPIVQQQQQQQQRQPVLTKTTVELKKCQIYIFYTTLTGSSQRIAKSLYEKLQNLENLELEPKLLSLDDDVDDLEEYFLNAPTQNDNNCIYLLVLPSYETDSPIDYFLEHLIDTAQDFRIDKYPLRKLIGFSVLGLGDSESCSHDNKFCYQAKLADKWLGKLGARRLYPLGEICMXYEGEPKAQEWIQNFASLIVNNDNEPFYIDDNNNDDDIDDSDAEESEGSDDADTLVDVEDMGDIIRKSGKATTIGGGGIETKEMVAKDSPTFKSLTKQGYTIVGSHSGVKICRWTKSALRGRGSCYKFAFYGIKSHLCMETTPSLACSNKCVFCWRHGTNPVAKLNWRWEVDPPEKVMAGALEGHYQKIKQLRGVPGIQMDRFEEAFKVRHCALSLVGEPIFYPYINEFVGMLHEQHISSFLVCNAQHPDSLAKLTKVTQLYVSIDAPTKKDLKKVDRPLNSDFWERLMSCLDILRTIQSHQRTVFRLTLVKGFNMEDIESYADMVERAKPSQIEIKGATFCGSSNGNGNPLTMQNIPFYEECKNFVENLNKELQSRGLDYDIAAEHAHSCCILVADKKFMINGKWHTHIEYPKFFELLESG

SEQ ID NO: 16612 - protein, 199 aa, Candida albicans
FNTFIKTHILPCMRRIMAPIEQKRNLAGNYSIPDSLNKELQKEFAEDVSTPMDKLQDDIINQNNYNKKRFQRSIVLDLDEQKSYKQIMNERNLEREELRVEKLIKEKDDGTTQTVENPQERLLPRKRKKRWDMTPEEYKKQKECENNKELVKKSTSSLIAELVEGKVPVVRGIPLTDSILEKILPPGYFFTHGRWKDPN

SEQ ID NO: 16613 - protein, 357 aa, Candida albicans
  UNSURE (194): Identity of amino acid sequences at the above locations are unknown.
PRTRMTRTFEPVAKMPRPLSSSNDIKIIHMKRVAAPPRRIESGSVPIKNITNSNNNNDNNGRGNNNSQQEKLGRATSLKRSISKIVKRSLSTNDANNKEREEIPNQSPAVKLETNTPKHQPQRHQSLQEHLRNQQLMKTPKREDLMLSKPPNTQRPLPQPSIKPTIARYRSVNGKKASIKKVDNSAIQYQLDCXMQFRKRLFQIGPQLLDFLNLQLNYCKSWESLIDEQQQQQNRNTFATNDPYIKSIYQSFHEKLLNQIEFTKLTIILHIADRLIIPIDECLKLCDQGKGDPINVNKFMELIVAQYNKLYRQWLEGIIGPNSIKEYQDLCNKIGKPNGEDIIQYYNQLTRLKSLVM

SEQ ID NO: 16614 - protein, 350 aa, Candida albicans
NTSLIQDNMRIPLINRNSIEGCKDYKPPSSFPIGPFKKWHHNPIMKPDPNVEWESSYLYNATAIVIDDKVFMLYRAQNKDKLSSVGIAWSEDGINFVKHKKPVITATESYEQGGGCEDPRIVRDPVSKLFVVTYTSYDRITARLCVATLEDLFHWTKHGPIVPPYWQDIAVASNGTNMIRNNWLKSGAIFTEKAPDGKYYMIWGDSELHLAESVDLVNWNLTNNSANWNTWAKAIFTRENKLLESGPAPVKMAGNANQWIFVYNAATTGGGDLPKNAYTVNQMLIDYNDIRKGPVARLEQPVLKPELANEREGQVNQVVFCEGLVQFKGQWFLYFGQGDSELGVAIAPVN

SEQ ID NO: 16615 - protein, 569 aa, Candida albicans
QTIYIMGKKKQEMSQVYNGSKNEFIFGEQGGKGRNLSSFLRNLSLTGSSSSVDSHRDSYEEVNSNIYGSLSYSKNNRSSGNLNSGSIFQPRPASSGNRTVSLGHIGRHQSPKSQHRRSHSNTRYADLDDDWDAGLDEVVVKPNPPPMLDSLYPDLTVQLPLQVPEKSQHKESMDDIDLEAKAEISKLNQLNSKYAKFRKILASDTIINLQDLRKLAWNGIPNELRALSWLLLLGYLPTNKSRQSSTLKRKRQEYLDGLGSVTIEFHEDPPDNNSNVSLSNVNRDKQLYHQIKIDVKRTNPTIKLYSYPATQVSLRKILYLWAVRHPASGYVQGINDLSTPFYQIFLNNYIWQLQRKKQGEVEDEDLFIPGYMAGTDEEDPEEQKLLNDPQLMQYSLENFNTEWLSARVMSIIEADTYWCLSRLLENITDNYIHQQPGIIRQVNELKNLISKIDVELLNHFEREGIEFIQFSFRWMNCLLMRELPMQLIIRMWDTYLSETPLGFNTFHTYVCAAFLIKFSSELKEKDFQEIILFLQNPPTSSWTEKDVELMLSEAYIWQSLYKNASAHLR

SEQ ID NO: 16616 - protein, 209 aa, Candida albicans
LPRYYVLPRRVENDIEKAIVQHKLKMRFDSDLLNWTNYVKLFDLQNSQVLNNDEPVAINILPEENLSDNEISDNNGRETMNENTNSDADENLVIDNQLEVEPTENIPKEDNKEPDDYELTQLHQFDESLMRNLTQIQATKTANFLGVEDLSYLDDFSFTSSQSQSDFKNFQITDNTYEVPIPDQLKPENIDQTFPAGRVAKGELFRSIL

SEQ ID NO: 16617 - protein, 247 aa, Candida albicans
TMQSLLLLLLIVSIASMESTPIEGVSYQDDSTLLAPQFFYFDNLQTLQPKLSQIFATSIPTQIIQLLDTTHYLIPDDNESSSENHFNNTIPLNWIEFYTENVSYEMNRQAEIIVMTHETVDNKYAHGDLAYTWSMLKKLAVEYNMALSLYAGFYYMVGLLTGARISPEFDITSSLSIMYACPVANGKTVQLKVYPTLAKLTPYYRKLKWNSKLQKFIVKNKFTKHKKIKLLALTGLEDVECAYVHNE

SEQ ID NO: 16618 - protein, 138 aa, Candida albicans
IFFHNFEPSINFPMSSTNSIYDPIKFVKLDFTEFDNICSIISNMCHSVNTWLQVNDIEVVTYLHICLEAYIVINQQNLRNRAGRYDPAIDFLPSLVHIFKLPTYFKSVIREMARPMYDQNGTTYIPDIQSAGHHGEGV

SEQ ID NO: 16619 - protein, 578 aa, Candida albicans
YYVFVTFLPYPNTIFHKMTSNKKLLKHIRTTNALSSIPPVLDILDRNDTSKLIVKYTYEIPVVLLRISDLGSAQGIIVFTDFSEIKTNTCMKYGRVPYSIAKEDYSVGGVIIPKDRLFNSSIRRDQYDTLAKMIERSVQGDPEDDGFLIAKLNFDLKIKNCKYLEGYFNHAEIATKKNLHDLFEKDLQYEFLEMLRRMKGFCEPDVYNELRVKYDFSSFEIFRKNRNRGDIELDSQLPDQKRRNFGGGIAANMLSNKIVKDSQRMNFDTQATQIHKTDFLQGPIIEEEVSNQPLNLDSQLPTVTNAVPPDPTDSYVSNAFEALNNTSSRQTGSNLLFHRPVSTRSSTTNQNTSNEGKSKGISQMVIPCTPIQSSNETNLEAPSFASVDTAAMSQDLGSQLEMVEPKIEPSNGLNLTSITVLPDWDNVTKKYLDRHENAKIRIKSIYAARNKMKSFQENVPYTLEKIKVKGMFPFHPIIIKPYARTWKIAPFKIIAEDVEDKNLTLAIEISNDDEICKFFNINEIEDVVRKGQRIKAQLQRLLNQKKEVSLNIKRKIRTLPNNFKYTYWTIDSPINQII

SEQ ID NO: 16620 - protein, 1261 aa, Candida albicans
YPSQGFQQKGEKLHVAHRRSPSELTNLMVEQYNLQRQLEEVQAQQKLLEEKQKQQQQQFTYPSAQGSSELAPPPISSGYGGNRSSHSRSSSINTHRRTGSGSGGTAHGHSRRHSLGLNEAIKAAANQKQSNRNSLSPTIPNEAKTDLSDDIGSFKFPPSGGDQGDTSGQSSSSHNRSRSLAYGQQSFKFPPTPDQSNDTRGNSLLPPNPNFSVTQSPDRGHNRRSSHFRTGSRGSGSNTNTDGINSNWRAQQQSPQQQQRQGGLLEPPQVGFTPGHKPRNSSYGGGSSVSSLQQFLPNNGGSNNSGQQGGHQGGGNNGRKTLFAPYLPQSSLPELINEGRLVTGTLRVNKKNRSDAYVSTDGLLDADIFICGSKDRNRALEGDLVAVELLIVDEVWESKKEKEEKKRRKDNTLHSRPLTDDIHNDATSAPNTAEGSVTGTSKEDGAGSNEEETGGLARRGSLKQRPTMKKNDDVEVEGQSLLLVEEEEINDEIKPLYAGHVVAVVDRIPGQLFAGTLGLLRPAQAAQAARDKKNGKEYTVQNPKAPKIVWFKPTDKKVPLIAIPTEQAPKDFVENHEKYADRLFVASIKRWPITSLHPFGTLVSNLGPIDSPETEIDSILRDNNFLCDEYPDDDNDDIVSVNAYDLPSIEPEFENTQREEYLNDYIIAFTQNGEFVDHALHVKRISNTKIELGFHVADIAYFIKPGSSLDRKSKKRSSSVFLPQKTVNLFPKQVNKIVSFKENEKNLAVSVVFEIDTSNFEVEDLYIHESVIVPKQLVTYDAFDTILLGQSVDSISSATSDYVKTFSLIAKEFRRHRLSNRSLGITPNLTLLDQLDDEKVRLDLNIFKDSLAFDVISEISHKVNSAIAAKVHAGLGDQAILRRHPLPTLQKMETFVRKATSLGFKIDTTTSSTLQNSILKIDDPVKRKCVETLLYKCMSRGRYYVAGKQDTDSYAHYYFNLPLYTHFTAPLRRYADLIVHRQLKAVLNKQVEDKDLDSLKAITDYCNFKKDCAANAQEQAIHLLLSQTINEMSETAGQLLCMGTVVQVYESSFDVFIPEFGVEKRVHGDQLPLVKAEFDKNERILELWWEKGVDSATYIPPDEKSSLSYRNSIKNKYRTSALQAAKIQSKTALEKSTTPADSVAEKLAKLNLEPPKLVVPSLKSNELHEVEKDETKSMPSSPTQSEIPKNVRTNSSSRISSSGNTFSLEPYLQNTITRIEGDSYIQVIKELTQVPVLLRAEIGMALPCLTVRVLNPFAEEQ

SEQ ID NO: 16621 - protein, 313 aa, Candida albicans
IYWHGYHMGLFISVFPFVLAAIIFLFGPPTALRSFGFAFGYMNLLGVLIQMAFPAAPPWYKNLHGLEPANYSMHGSPGGLGRIDKLLGVDMYTTGFSNSSIIFGAFPSLHSGCCIMEVLFLCWLFPRFKFVWVTYASWLWWSTMYLTHHYFVDLIGGAMLSLTVFEFTKYKYLPKNKEGLFCRWSYTEIEKIDIQEIDPLSYNYIPINSNDNESRLYTRVYQESQVSPPLRAETPEAFEMSNFSRSRQSSKTQVPLSNLTNNDQVPGINEEDEEEEGDEISSSTPSVFEDEPQGSTYAASSATSVDDLDSKRN

SEQ ID NO: 16622 - protein, 206 aa, Candida albicans
IRRLKTEEQQAQQQQQTPLYGQQGSPQVQTQPQFQADYSYANYQPQAQFYDPYQRQVIMQQANFASPSQYPIQQPYSFANGMTNMAQFHPQTLTSHSDFDQQQMQQSTQPSQQVQVQVQIQPQSNLNLFPAEQKRGRRFRRRFNQIERKYPCSFPGCQKSYGSLNHLNTHMLTKKRVNRKSKADFQHSLHSERGKQTIRNFTIRSP

SEQ ID NO: 16623 - protein, 404 aa, Candida albicans
NQVELKHQLIMHGTNDAELHSIVQNLQKNLGSINLPIRQSPNTDMNATSIDTRASTPSTINLPEQEKTPSPVQHLRQATPSESTVQSNSPKTSTLIDNTPLAINPVIQTSLSPIKRCRHCKQPKPSDMPLECSSYSTCPRCIIKSRLQKNNLQNLSKFMKLYGFYQMTQEYDKHEKLIKLAMEQDSYLADLGSRKFDYPTELEKLRAVVSSQIQPPESQQSANINFNSPVSSPVNSPVISATTSNRRGSTDLEDVETNNGIMILADRPQRREETPQQEDSSNIVNSPHSENSPIQEDIVNQENASIQEDSYHQNENQSDQHNGTDKNTSSNENIDIVDEVVNTVEKHAEGDIKIEKNAYENDTGHSNENNPEISDEQEESGNIIGGSNNNENVDMNIDIDTNDN

SEQ ID NO: 16624 - protein, 1060 aa, Candida albicans
IAGPSRPCGGRKSSSPSSYSPIKSDLPNIYSHLRSNDSESPPQPSPKQQSSLSSSSSSSSSSNTKSSTTKNIFKKLLRINKSSDNIDESRSIVLNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFVLDDIKSIYIQNEGSGYREELNISQKLEKNWIIIIYLNHKKNSLKSLHLITDNDHDFKKLILAIYNLKQLRSQLAKEFLIDLNELHENYVNMLLNKELLAGDNGNVDGNEVDIQKSHKHVREFLSFNDILKYSKRLNINVNTNHLQQIFDQVLLLLSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPLGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYCSIFIKIEYDEDLLNEFINK

SEQ ID NO: 16625 - protein, 72 aa, Candida albicans
VLTMDKIRAVISGGEKPPVDTDNDHNTDFEADRKMPDLDIVVSKSQEFDPVTSHLVNDIMEDEYAAVVFTDG

SEQ ID NO: 16626 - protein, 766 aa, Candida albicans
TKSPFHVIIICDIKTITIIMSKEAEFVKTISKEGDPQVDVLERDAESNSENALEPDVEELPKVVREIVPLEDDPTIPVLTFRYFILSIIFIIPGAFIDTMNSFRTTSAAYSIFFVQIASHWCGKWLARILPKKQVGFGRLSFNLNPGPWSIKETALITITANSGATGSMGTNPLALAELFYGETVNPAVAIFFMWMIVFIGYSFAGIARNFLLYDPQFTWPQALMQTTLFQTQSKSDKDAKQASKQMKVFFFVLIGLCIWQFFPEYIFPMISSLAFLCWVAPENYTANFIGSGLGGMGFLNLSLDWSNITSSIMLYPYWVQVVQFAAFVLGAWILIPAAKWGDLSSYPYGLMSNSLFLGNGTKYPTTELLTPNLRLNETRYEELGPVHLGAQRAWNMFFDYAAYVSGFMWVVAFGYKSLSGSLKRLVKSRKQKGSINLQYTDRLNKLQAAYEEVPLYWYAILFLCAFVTLLVIFATDSLFMPWWCLLVGVAFGAVIVTPLVWLYALSNFQLPIGTFNELLYGYMIQNKTSRHPAGAMVYGAVGGDLFYRAQYILNDQKIAHYMHISQRAVFFSQIFGELIGVPINYAALRWVILSKRDFLDGTKVDKLHQWTGQTIVSYNTNAVQYVILGPDRLFKNYPVLPYGFLLGAGALLVLYLLHRLFPKSKLKFHLWNTTVFFSTMSTFYGNLSTGYFSRFIGGTITMFWAFRYKHSLWKKYNYLLAAALDTGLNLSILLIFLFFSAGKTVNFPEWWGNNGKSVERCFAMS

SEQ ID NO: 16627 - protein, 386 aa, Candida albicans
  UNSURE (47),(49),(54): Identity of amino acid sequences at the above locations are unknown.
ISKVLPLVFIHHLCHFLMGLSFASILATITHTICFHGRDLIASLKAXEXPDVHXRLMKAYKPVPEWWYIMVFLVFFGMSIATVRAWPTEMPVWGLVFALIIAIIFLLPVAIIYAKTNIAVGLNVVTEFIVGYVLPGRPIAMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 16628 - protein, 701 aa, Candida albicans
ILKRMTSIYTSYLKNHRRAPPPPNGAAGSGSGSSSGSGSGSGSGSGSGSLTNIVTSSNSLGVTANQTKPIQLNINSTKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLSSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSAKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQQKQHQYQQKSQQQQQQPQQPLSLHQGGTSHIPKQVPPTLPSSGPPTQAASGKSMPSKIHPDLKIQQGTNNYIKSSGTDANQVDGDAKQFIKPFNLQLKKSQQQLASKQPSPPSSQQQQQKPMTSHGLMGTSHSVTKPLNPVNDPIKPLNLKSSKSKEALNETLGVLKTPSPTDKSNKPTAPASGPAVTKTAKQLKKERERLNDLQIIAKLKTVVNNQDPKPLFRIVEKSWSKC

SEQ ID NO: 16629 - protein, 160 aa, Candida albicans
  UNSURE (148): Identity of amino acid sequences at the above locations are unknown.
LLRKCYNQSSIFSHSSISTKKQPHHSFFFTFCQMSRIYNDSFIYCSEIPIDLNRIDTNFLYPLLELYFCPICQYPKAPYQTSFKIDYKFCSNCLTDYTKNNDLKLTKCIKNCFICPECTILNLNIKVFDHDNNGNASEFKCWYGQYIXKTTVIYKPQPLL

SEQ ID NO: 16630 - protein, 162 aa, Candida albicans
  UNSURE (12): Identity of amino acid sequences at the above locations are unknown.
LIAGLAAPVGEXRGAKANGSSSSSTTNNDLWQLQIILSDGVCEDHETILRMVRKAREEKIMMVFVIIDGITTTTTTTTSGTSGTTTGKHESIMDMQQVSYVTDDNTGGMVLKVDKYINSFPYEFYVVVKNIQKLPEMLALILRQYFSEISSIYRSCVRDFFN

SEQ ID NO: 16631 - protein, 215 aa, Candida albicans
TYIVSLPFYKPTMKLFDQFKDAILDEQKEDIALTTSYINNYPPKKLAQLGLGIINLQIVNIRTGLGGKTILELQFDSAFSDGEINTSTLRTGDIVKLAKMTSSALSNKSEKKKPSKNHKEESQTQDQSDVGIEAVVIKVSTQTISISVDESTDDSKILQYYNNTNDLARMWLVKLTNSITYKRMITTMDKVLAMKESDKNDIHTIRFHFGVHDPR

SEQ ID NO: 16632 - protein, 199 aa, Candida albicans
ISRVNLYVSPKLVHLRCFLSFLDVVLTELFYPVFVLSLIGACYLGFALIHLPYDKLIHFSTFCLLTLEFFFVFDTQYKSLKVLRNITLIICTFGGSVGLEIIQNLVNPKRVFDVYDIVANILGSLLGLGISVGYVTWSKNRARHKRSSYRQLNTHIIEASEDDGEESTDQNSLDIRERADTQSFTNEDYVNIQLEDVKH

SEQ ID NO: 16633 - protein, 362 aa, Candida albicans
SQLCRTSTDSVDSMVSAVSNITESSVVNSTTPESSINMTKPPPISTSNKIKHHPPKDDKPLPITPNRDEHKTEDKGTSTSSKGEPSSVTNTNSQKTESANKEAKNGSESPSEDDTEYRLIAKRLFDEEFVSIKPQEYTQFLAAGDRDSTKIRNYYMNLFTWPPNLLKSTRMLCSKLYLKGESQEIDRILSSFTKSYLKQHPKNVFCTKNFEQIYIIIYSLILLNTALHNLELNKKSRISQSDFIRNTFTTFVQQNEKLLKSLSVKQKIAIENELSNFYEDLSKNELHLKTADEAGSSSISQSQHHHSHHNHHHHHHHHNDHGHHNNTLGNRLSKASQDSAATETTNASTHSPFSHTPAKDQV

SEQ ID NO: 16634 - protein, 518 aa, Candida albicans
KVMSYSENPGSIPKSKSAAPSSSETKMLFGTKLDHEIYPPWKDFYISYNHLKKLLKEGVILKNNWTDKDEQNFVSALDENLEKVFGFQHKKFDELNDGLNDLQQQTERTDTFNLESFLKKLDKILDEAQNLEHFQRLNYTGFIKIVEKHDRIHPEYSVKPLLNVRLKKLPFHCEDYSPLLYKVGTLYQFLRDNYEVDQCLSKLSSFNEGATNGEFQSFKFWIHPDNLMEVKTTILRHLPVLIYNSTNNGDDDDDDDDDDDEDDNNKHITGGQTINCLYLDNDHFDLYNHKLTKLNNSSTVRIRWVGKLADKPKISMERKLFDVNSNFFVDDKIELRQKYINQYVIQKEIPKKLVKLNDANSVKKLLDFIKEYNLQPILRTTYNRTAFQIPGDDRIRIIIDSNLTFIREDSFDSQLPIRDPQQWHRLDLDNSKSPQQFLRKGEFVKFPFSTMEIKIKKSSAKNFKKLQWVNELINSSYLVKEIPNFAKFIHGVASLFLEDDKLDNIPMWFNELEGDIND

SEQ ID NO: 16635 - protein, 210 aa, Candida albicans
YLFSDLWRFKQQQQKHITMPGLFDLESHLVFYRSYHFNHTNVTIHLICIPIILLSTIAFLTPVTINFGGLINNSNYNLGSLLAWSYGIYYILLDWQIGLPAAGVLFSFAHYIKQYYLTLSETSVPTSNEFVKIAVALHVFSWFAQFYGHGVHEKRAPALLDNLLQALVLAPFFVAFEIAFFLGYRKDLKKNMDNRAGVLIRDYIKQKKQT

SEQ ID NO: 16636 - protein, 74 aa, Candida albicans
DLLEKKNVSKNISHLRILKSNKPNKFLVLIKFRDVMKAAEFQYHFNGNPFNSNGTRNLSRGLCKDRTSDEFPQG

SEQ ID NO: 16637 - protein, 434 aa, Candida albicans
LGNIDQILLIYLRQMVAMPRGMVKKSFKKIKVKFWIWIKSKFIQLVLISYKDKDIVERKKTPRFLFLGAEALRGEGGIIFNSKGERFVDELGTRDWVSGEMDKQIKQGNFPIRLVLSEKAGENLKFHVKHYTQRGLMRTVSGKELVEEMGCSEDIVKQQLDTYNKAASGAIKDPFGKKYFPATPFEYSPDAKYHVSFITPVLHFTMGGVKINDKTQVIADNDSPFEGLYAAGEVAGGVHGHNRLGGSSLLACVVYGRLAADQASSYKFHKLSFGDGDSIASASQRLKMINLHIDPSNGRIFIDTNGNGGEGNTASTSTPDNGGSSSSAAAPPPPPQKKAPKQPKPFSVPDKEFTAEEVAQHNKPGDCWCIIKNVVLDLTPFLGDHPGGKESIANFAGRDATESFAMLHDDDFIPKYVANCVLGRLKGKTSELQL

SEQ ID NO: 16638 - protein, 221 aa, Candida albicans
INNSVPKMSDTSPKGILRNKPEGYVEETEFPDKLDRNEVIKNTRLNAQLASESSKGDEIRAKIAEKKKEQGLNSAELPEHLKWDEINLYKNEQEKTATMKIDEPKTPYEGGFNPEGEYYRDDDDNEGNGNGEVDDIPAFELGEGEFDKLPHETLGSLHGSRVIKDTNQQEKGEDKEEDSGERELTAEEKHKRFEEMRKQHYHMKALPLKQKIEIPDEDDEE

SEQ ID NO: 16639 - protein, 327 aa, Candida albicans
TVLLPMRICLDWELRAHQMVEMPLPLVSFRDSSPLNQFVYTDYTTAKEKATAAYKSGDYTTALESYTICLGCLPPNHELRIVILSNLASVNKLLGHLKESLDNIKDAEALFLPQEILSDYEIADKLIKYWCTKLFMIKAEVLELLEKYSEALEQYLVLIRQLNCNDKKVMDGKRRVDKIVNPQNYKPPKPSVSSRASTPSNKTPAVETKRPTKSGDDEVDALTKDKIEDKIRSWADAKQNNLRAMLTNLNEIIPPNIRMSEKLRNLTTNDLMLPKQVKIQYMKVISSIHPDKLASQTKDNRELGLICNGVFITLNKRWEAFKQEENI

SEQ ID NO: 16640 - protein, 1064 aa, Candida albicans
YLFLLCSIIYFFQMKTTEEKTNFRNQFLKLGQGHIISTDESNDVFWSLFWLMPTCANDVYELITVADIKKVRQQNLMNIIQLTRKLCHKVIFIAKESKKFGNNKKETIELLNCVRFLIKVLPFIFELAIYPTELEREIFWNNDFDPMQFLQRLEASRNEDEPEDNNNWERVLSPDQATNSIAVNLMSSLVDLLFIRNFTVASSVSKSSATGKDNKLLHVWEPGIGSTSKYQQPNVMIDSNRTEILKLLLTLCSNSLYQQVSSVTTQGSKFLTLLVTVTPKIELLTLVSSLLNIACRSSKLTGSENGLVFEKQEYSETRHLCVTYSIQLLTLMVVYPLPQKSELKFLSEGGLCSKPYNMARAFMGKIHKENELLFITSSLIDFLKVPLINAKDQETDTFSLLRPGSNYKRPSLWSLEAVMLIWELLQSNRKFAAIVGKKYISELMIILLYYVFAYHNQKTFKNLVFLCAYLLLYLSSVQQDRFLEPLFVPLNSATSLFEFYNCLPSNYKLSITPGNTRDFLVTHICTMLINNQVNVSLSNYLLNSLSLSDLLIKTLIEILYNLIPRVSIEETTGLKTDKLKKLNNPNPRGGLSYQSSSLITQLVGILSNKKFLLEKSFHPDLVALLIRAICAAVTKFPVPSRMLLFCILKNEKVYDELWNTIFSFSGVFFRGNSLTRIEDESDELQSENTEADASIAPYDSKKDEILESTVNPIPIPIPIPTPTNKYEDDGTIKSTSAETENIEASLRPSLPTGMSFKAREKLKKDSPLNKTWAGNDALAILLTIVIPHLKVVLNEVWSRVEGSSVDSYELVQRIEKAGFSKVFETNKSQLCYDLLPNTLLDQLKFNWSHLSLGWYISLLYGQIYNSGAQVQNYSGNSIRSYKIVKTFSSGMSKLTLNWTSFLKQDPQRELNSSEAVVPNIDENLVWVNNALCDVNTWSGSEIKLFNVETTEDGFFANLNSRIMSNYTKNENAAQTSAYGYAVPSTPGGLTDMSRRFSDFRINNGSNPSIRSIGNSPAPSALSTPVEEKELYFSKRSFRNSVTSLHSLNNLNRSRSNTPRNSISQ

SEQ ID NO: 16641 - protein, 400 aa, Candida albicans
SFLMKTHLLVVPSKKTEEVNWVKPLNNYLLSIYGNTLQYQDDINSLNKLRQDIRGVNADDTGLKLYYSYYSKLELIDLRIPFHDLNKSKKLQFEWFDSFSSLPYTQNSLAFEKANVLYNIGAILSKFAQFKYNELQQLNGPEGETAFKQLISMLQQSSGIYQFINENFLHAPSQDLAQSTIKFLSKLMMAQSQEIFTLKVISGDLNQLKNSLIAKLCKSTSVLYEDCYNMINKNKKEGFKITNESYDGNDYEDDLDDDDCDDLEGFLERPEDTEDSDNRYVAAELDSSWISIIYFKYEYYKSLAYYFNGLHLDANRKYGDAIAYLTKSQEVLNGVHSSTLKQVSKGSGDVYELLDNYKYQKDAVTIRLNDLNKDNDLIYHDIVPNLVSLLHRSRTREYEG

SEQ ID NO: 16642 - protein, 230 aa, Candida albicans
IHEQKFINSLIKVVGENDDVLSLTVMFKDLTDSKDIYKSLITVPTANYTLLNNSFEFNPLILEKKQWPNIPNNEDLHEFKLPVVLQDILTEMTNQYQTLDVKYKNRQLDWTNYKLHQITMSAQFDQGEKEITGNLLQIVLLLLFTAEDDNGYTIEQLSSMTGINNTQFLTKIVNSITNDKYAILRYDGNRYYYNSSFKDKSTRIKLPMIKELSRSEQQQQQHEKQVKCLK

SEQ ID NO: 16643 - protein, 227 aa, Candida albicans
VRIENTRSLLKLYRSISPADLTLGLRQFSEKYKLQIIKMSQIDSDAQVKLNILGICCELLRLGFLEEKDTRQVIENFPFSGPSKLQIEGARFVTILNEENLTGINDKYRLFIETYKPNQFETDLPFCLDIKSLINLLKFVADKPLHLVFQNMSSHYEGNWEMLVKYFLLDISLIKFSKKDEEEEEFVEGEEIEEFRQFIDLNSDERLILLKFIQGFVEYVYTKKNPE

SEQ ID NO: 16644 - protein, 77 aa, Candida albicans
SLIVCASIVSTTGMFGLGKLFYVIVLVINGIAVLSEDRFLNRIGWGSTTGQQNNGNIQAQFNQFNSGLDNTDGSVKT

SEQ ID NO: 16645 - protein, 143 aa, Candida albicans
KLLLTMIPNHILILGSPNSGKLRIANLISKNEEIPNLEDVESHSGLIVKTSLRTKYYFLKLNILIDEYSESKEATDEKKLSELHKWYQEFKSEEFGELREVLDGLMFTINMKTDSISFIGDALEIIELIKISLGDEENLHDWG

SEQ ID NO: 16646 - protein, 278 aa, Candida albicans
RPVSTQRQLARSSTSNSSIAHTANDNNNTNKGNRSVSPLASTDNHTHAPAAVSTPVKVLPPGLNHDTSMNSTLRSESSSPLVGHAKVNNNHELQISRSQLPMVSNENKVFSDTISRIVNVAHSRLNDPLPLQSITGLLETSLLNCPDSYDAEKPRQYNPVNVHPSLIDYPQEPMYELNSSHYMKKFDNDTLFFCFYYGDGIDSISKYNAAKELSRRGWVFNTEFSQWFSKDSKNGGKNRSMSVIQREEENGNIIGDNSNGNEELREKIDDNGGIPSNY

SEQ ID NO: 16647 - protein, 93 aa, Candida albicans
ALEAGYESKNLKTFSSSWLLADDLQIKKSWANATINRIKSDVEKLNVNDPMKNKQMNEKFIKLWQEWLEDETSLFTMIHFEIIYQKPTTTRQV

SEQ ID NO: 16648 - protein, 371 aa, Candida albicans
KSLDKAFDVLNQLILNLIMASDFLTNWINRPLIKSLSELVAIYKTKESRNPEDLDSFIEDDADAFGGTTQSQKSCLESLVITFRKACQLSLGDKNLDSELTKRNDVYYFLANFVKYCFKLGKLDLAKSVIKAVKNISNRLPALDSTVKTKKYGVIYLYYQALMALDDGDYIESEENLEHAMKLMDDYQDLKSNQLGQILLVLIPLKLHNHGQFPLKKIWLKYPVLRSLYRDNFLKAILEGNIARFNQSSEKFQIILLKKHLYVLIEMLRPLVHLQLIKKTYRLIMELNSDSKSKHLVPISAFQLALEYSTFNKDYECDFNFAGDHLYAISKSETECILGYLISKGRIRAYLSTLKEGYVVFAKTDTFPKPQ

SEQ ID NO: 16649 - protein, 232 aa, Candida albicans
RGHTLIVSEYCSNMQNTSLKFNEFNLDQQLKYRYYVARYYLIKYQLIESFNHLQWCLVNTSSLKNQKLTLELLLPVSLILGKIPNFNYLSQQGFNFPFVQMYQTLSKSIRAGDYSKFKQVIDSNYHYLKDKNLLLLMNKAEILILRNLIKKVWIVLDKPSTMNYLNIPIEGHYNDELYLENVFVTLIDSNLIKGKLTSSKTVVLSKTDTFPDVFNIYKLKYGNNNGNSNQWV

SEQ ID NO: 16650 - protein, 503 aa, Candida albicans
EDMSNSISEAESRGHKSLEIEEYQIEEYQIDNHTNDESSEILDPHQLNKVYRKLDLRIIPALWCLYFLTSFGSNCYGLTLTMNRAEGHSLAQQLHLTSKDTSTALALYYVGYIIFDVPMNLIMTKVSPQTWLARIVITVGLVYTCYHVLHNAGGVIAVRFISGVVGAGTWPGLSYYVSLWYPNDRLTRRIGYYFTAAQISAAVAGLVSAGFQKMDGVHGYTGWQWMYLVYGVINMTVGIALLWWLPDRPFIGVKSESNRLVEFYRKFTTPPHPLNEQEKELHRKDLEHRYKLLKWTWKDVVNIITDLRIWPLIIMYFGVVGTGFGLAVFGSTIIATNNPNLTSIQVSLLYAPIWLFDLGGILIITPFADRFKKFRALIFSGACVIIIVGMIVTTFAHGSWNKYGGLLIAGFGLGPTVPICMSWSAEIFQKRYGDVGNAVSAALVSGLGNLGSVTSTYALYSGWPEDKARLYRNSNMMLVLMLGVSIIASGVCQLIKDKVRQPK

SEQ ID NO: 16651 - protein, 185 aa, Candida albicans
SMSAAAVENEVLRRKEALKDVGKIADVGKPDKITLELPPASTVYFVGDTPESDIRFANSHDASWHSILVKTGVYQAGTEPKYKPKHLCNDVLEAVKYAIEREHAMELAEWNETAQDVNEDDKGSRLNFADLVMTPSDKKENDTTEKKPSGASSTSKSSIAEAEEVEVPDILAAQIEKLKDVSVSK

SEQ ID NO: 16652 - protein, 262 aa, Candida albicans
IVIELYQNSHGENVDQDQVYLPLRQLIKKPRGAYDILTQAYNRAQYIKQNKVIAKREQEESKARQLHYALIDWQDFSIVAKVDFNAIDAVKELSMPLKRDDLIKRSLDARSKDIELPKVAVAATTTSPVQVEVIDTKNQGLTQDQTDNNTSTPSAPPIKGMKIKAAGTSRLKKSLEANTSTTTTNTIKCPITGKLIPENEFDTHIKTLLRDPRYKKEQENYIRKNFSYASNITTDQVYENIKRFVKKRANVEDENPKKKKKA

SEQ ID NO: 16653 - protein, 230 aa, Candida albicans
  UNSURE (42): Identity of amino acid sequences at the above locations are unknown.
GLLGIISGKGSMMESSLLFAYIVKCIYETFPILSGAATKALXNLFTLNTQNVKKEIPKIPPSILNPISEVIPFITSTLPSSFKGVWKFLIMAIKTLTLPLLLNLAYRIGVFYAATKIIPSLYQSASYPLITPPKTPQPGSRQVSTTSLSTFTSSTTSTVLDQHSKLRTKNSFRLKPPHHQPPSVIIRLIYAYSPCLIIAVYTHLMLSYNGELGTELKLWPLCLHLRKVAR

SEQ ID NO: 16654 - protein, 233 aa, Candida albicans
CWFVINSQKKKPNNSMFHFFLVEVRGEKTQFFLSRVSNIKKLSALSLNQTMPKKNVQRDILSMFGNNVSKDSKIKKPSVSQSVSTITSKELLVQKLSNSNSNSTFENNWTIEGTFLIRNISFNHTSVEIESLIKIAAFDLDGTLISTKSGGTFSKSPSDWKWWNDKVLDKLKDLYRDNYLIVIFSNQGGVVATPSSKSYLNFTTKLNSIVKELKGRDILDRILIYAAPKKASI

SEQ ID NO: 16655 - protein, 227 aa, Candida albicans
RLLGPKLSNSNFNSTFENNWTIEGTFLIRNISFNHTSVEIESLIKVAAFDLDGTLISTKSGGTFSKSPSDWKWWNDKVLDKLKDLYRDNYLIVIFSNQGGVVAIPLSKSYLNFTTKLNSIVKELKGRDILDRILIYAAPKKPSTKNSKSTTNTINEQMHAKMRKPETGMWDTFLVDLKRYGITLDINYKESFFVGDAAGRSKDFLDSDALFSKNINLKFITPEELFT

SEQ ID NO: 16656 - protein, 446 aa, Candida albicans
  UNSURE (422): Identity of amino acid sequences at the above locations are unknown.
RSSLLFYIYSLFCHHNYIFIYLVFTVCFYWYTVKSYFNLLNMTLEKNRHANKGTSWTWMIYKFVVGVITVAILVLFITQKLVSQAQDKLRVEQQAIFSDQDTLQLKHIFHHGTGPKNYRLHRRLDITSEYLAKHQPYFTTLTQQLLKPVLEEHIASDNLDKIYQLSDWPEIHKGKNPFSIELPFQKADIEATRLKERNTLNFIESYLNYARDIKGDAQILNRINLDWIHDEIKVPNVTDRDTVVTLATISSNAYVRYPKDDDEKRKSDWIDLGDWDPNREDDDVNFGWDDIGLRGHVFVSKDNKTVVIGIKGTSGAGLPGGGSDETGGNDKTNDNLLFSCCCARISYMWTTVCDCYEKTYTCNQDCLEKELRKDDKYYQAVLELYRNVTDIYPPELTDIWVTGHSLGSALASLLGRTFGLPXVAFEAPGDMLANKKIALTFSSWNS

SEQ ID NO: 16657 - protein, 273 aa, Candida albicans
FSAIFIVLYEAYMFALINIHHDKFAKGKYSEYSIYFALFIFAGFFQVLMTLIALYCRHLLLLVFLMGFYCCMLIYTGIQYNEVSDKISAVLFGKWKTATFAMNIATICVLAATLVLQSVLLYFGLRRYVSWFTFKKIGASLELKRIYTYFQIHRSILMFDFFFFAGFTIQFLVIMVKDRKSVEFILTVIVIPLTIILLFISDISATREFIYGSIFAIVLFLCGIAYVLFKIIRLYTKYTSAYDLAIRPGEYFMGRKSLLTSGIITLVLLVATI

SEQ ID NO: 16658 - protein, 103 aa, Candida albicans
DSNLKEFSVLPRSFPMHKLKTFFTIEIKNTDEQVKDSHLVSQLYKVGSTNLQYKVMTLQNEGYKIGSSKQPCAICNKRLGYSVFTITKDHEVVHYGCAQSRKK

SEQ ID NO: 16659 - protein, 678 aa, Candida albicans
NPANLIFLFFFFSKLTSLQPNSPSKRKRFSTLKRFLLIKTISPSTEEPTNTDTSDQFHIDSANTTTDSYISITMAPPTSLDSRQRQSKRDDAIRKRIENDLRKKKASTSLSTRRSRGAPGTVLWLKPGEPIICKPTATVYEVAQLMTARRENCVLVVNEIGELLGIFTAKDVAFRIVGSGLNATQVTIDTIMTKNPICAYAADPAGDALNLMVERGFRHLPVLDEKLQIVGVLDITKSYAQQMEKLERMHSSSKKLHEALDSVHNEIGVGEQPHHVFQYFETLKNKMNGPTLEDALDANTVPTYVNVKASVHEATMLMKENRTTAVLVKDTNEQVAGIFTSKDVVLRVIAAGLDPKKCSVVRVMTPQPDVAPIGLPVQDALRKMFDGHYLNLPVVANEGDIIGVVEVLKLTHITLNQIKQLETSETSNGSTAVDSTNEGPAWNKFWTSLDNTDGDTESAHSDSLMETSRGSATAPDITPSEFHSFNVDIKPSDSVSHVNTSPLKASSFKMTSSMTVDEIPFIFKFKSPGIEGRVHRITLKASDGIIKLRELMNEKLHDKDFAFLNVPKPDGNSSTQETYAISYVDDEGDVVSITSDSDLAECIRINLNLQNEKADLYLHNPHEPAPIENIKLIHKSAKNRHGNADNGLIFGIPNEILIPSALAVLGASIIVGFTLSRK

SEQ ID NO: 16660 - protein, 868 aa, Candida albicans
YYNSLISQTSGKTHFDQLVMARFNNEEILNSVGLPSQLLQQIRNKENKGDYDDDESEDRFTKFENIRGTKRKSEPISRKDQRKVERELKKPQRIKKDTHPQKVQPKKQNEKTADPLALLAAKKNKSKSKKAEEDNPLVALRKLKENKNSKKTSKAKEDFKIVKEDELLEDEVSDLGYSEDDLGSENKEDFDEDENIDIDPMEALRALKEKKKGVNKASSDIRIVKEDDLEQEDDDISDFEELEEENDPLEALRLLKSKKNKPTKTSEIRIVKEDDLEQENDDDVSDLDSDENVDDQNEEGEDFEGFEEENFDESDFHLSEEEDPLAKLKAIKEAKKNGKSEKTKKKQEKEVYPIDPHFQEQFRKDDEDIEYYAKKLGLKNGKKAKLSKTDDNDIIGGLLDGLDLDFESEMENISDTSDEHISEEDEEDDEYFSDDVDDSEKMKENPYVAHGLEETKSSEELGLAPQRYIPPALRKKMALEAGESVSEETLKLRKSIKGPLNKLSEANISSIVSEINALYLSHPRQTLNEEITNIILDSIVQQGRLLDTFVYLHATVVVALYRLQGVEFGAHFIQTIVEKFETSKTESSKTKEASNIISLLSSVYLFQLVSSKLLYDLIKELINNLDENNADLLLRLIRNSGNQMRSDDPSALKEIVLLINGKASTLPKDAVNTRTQFLIETISSLKNNKLKIVNEANHQLSIKLKKFLGGINENKSGDPIQVSLEDIQNVATRGKWWLVGSAWKGHETDKPKDVDVVAMSDILDNAEPNWMELAKSQRMNTDIRRAIFVSIMSANDYIDAVTKLDKLALKRNQEREIPKVLIHCATMEPSWNPYYGVLGNKLCDSHSFRKNFPIYVVGFDQRIGWWQC

SEQ ID NO: 16661 - protein, 131 aa, Candida albicans
ATMFGSKDKEPTEIFKNNEKLSIKDLPIFTRSQLAQYNGTDKPELYVGIRGYIYDVTSNSNSYGPGKAYHKLVGKDVSRLLGLNKLKLLEDSDEYTWYTDDLDEKQQGIIDDWVKFFKMRYNIVGVIVDHN

SEQ ID NO: 16662 - protein, 482 aa, Candida albicans
HRSDTPPTMSSSQFYNKGVDESVVSRQEIEEFTKRNEFFLKPSSRKYAKQYFSMYQYRLKNLRDRVHKTAMEKWGHGTKKINGNTIEKQDKILDIASGKLCWVIGTVFCDAKYKLDILNDVEKGTDDVLPLEPVTYVNEDEQPIVMLEDESGRAILNNDNFLAKNLLVTGCIVAVLGIEIQSGIFEIMDIAYPDCAPQKPLPLGENKRGKIALVSGLNIGDVGHYDLKLEFLKQYLLGELGNAEDKLDGSLISQLIIAGDSIMPIQNLRAEMDLKNFVTTNNYGSKNISKYNVESFKKLDEFLTDILVSLPVAVMPGKNDPAEICLPQQPLHRSLFKNNSSLLDGNRLTRLTNPQWIDAQTVKILGTSGQNVDDIQKYIVPKKDHQFTSIEIMENNIKWQNFVPTAPDTLYCYPYENYDPFIFSDDLPHVYFVGNQQQFDSKLFEHDGVNVRLISIPKFKESGQFVLLDLDTLETEVVTIEI

SEQ ID NO: 16663 - protein, 208 aa, Candida albicans
PRVYFQKQFLILAIRITSLTKSITMSISGAVLKPDFLKIIQSQSNELPFEVSSDGLEVLKYKSKTSRQSLEITSSSTTNPNPNERKVSIQAQDGFIYLTTKRLVFITATQGDIQSFVIDLNLAPLLQLSHKVQAPWIGSNYWEFMFRSSSQDGIATDGLPKNQYFVGKLRFHDGGLFEFCEILNKTLNDAVNNRDIDDTLPSYNEVQQ

SEQ ID NO: 16664 - protein, 143 aa, Candida albicans
KDLFVYVLMLFSFFIGGNFRTWTPTPPERGSFPLDHDGECKEYMTKYLTCMKFTENKNAPNCRILAKQYLKCRMDNQLMEKSDWDSLGLVNLPGENDVELDHHHHYHLNNNNTKADGKSGSSNSNQNLANTTNNNTGTSSGTK

SEQ ID NO: 16665 - protein, 161 aa, Candida albicans
PPSFQNRIMDNLQQQEQNTIAYSYFVDESGKLRVKSQHVLLVIIILVCLLVFHFRHKIIELHDRYRTRSRIDSGYYSNLQSFEDDVASGLSSSNFDLESNNIATNDNRAGLSESAKLQIKKIMEEKGVSFDDARLEYTRNELSKNNIDENGVPRDPKLVMF

SEQ ID NO: 16666 - protein, 738 aa, Candida albicans
  UNSURE (154): Identity of amino acid sequences at the above locations are unknown.
VSQNNIRIPLLPPFHHSTHTHIHTYSYKNTYSSIMTSLHDTTTPTTPAPHQHNDSDSDINEMSRDLDEIGLLNLNNLTSYFSTDRFFSQMPTFEMKNFPLEFTKYVTKYKNYYQNQYKKYNKSFGTTAKTESTDTDEVKDILSEDDSNILDSIXTVLSTRIQMDKFLNDLKLGVNITTAIDRLQPLTDVINETIFLPTDDFSDIENDENELDIEIEEITEPSGIGEIVNKSQPLINEIVKPRVGEMRNEIKRNNRRKRKRKQYKNIYSNNDSVTSQTSDIDGLTIYEVSELTELNSLDDFVKQDLLRSKIKKIHNLSISQDSKNKLVTKLMMGNYYKYVDEKLSNNDKQLLQPLRNQKLIIKEEKEKDEEKDNDEEDEEDDFDEELPSRLSLGPVDEAIIENDGENFESESEGSNDEEEDDEEDDEEDDEEDDEVMLTEQDLQPTYHDSLHTIFGCSHYQTNCKIECPTCFKWYTCRFCHDSHTLDHKLIRNEVTHILCMYCHTPQIPESNYCINCAQELANYFCSKCILYDNDQTTDIYHCDKCGICRLGLGLEKDYFHCDTCNTCLSIDLKGHHKCLSDVTHSNCCICNEDLFSLIHKVVFMKCGHSIHEQCYSKFTKFSSKCPICKKTITNVESQYRILDVEIAQSPLPEPYNNWRCIISCNDCGGKSNTMYHVLGLKCKYCKSYNTNQLKLIKPEEEEEEEEEEEEGSKKRRYWERVKKERKVTKITIQLLNLM

SEQ ID NO: 16667 - protein, 693 aa, Candida albicans
VDPRRRGEESKSDWFPIGGSRSSSSLKKGSSNYHKKTTPTSSTSTKSTIEILKNEFRNSSTYTLLRWPILIFVFSWIGILGIFYFMIRIYVAVVEYLFTWRGERKRLRNKLRNSKTYEEWINNALELDKFLKLDKWLENPKFSYYDYKTIKLTILKLQKLRHQGKLIELMVILQGCLKKNFAGIENRQLYSHRYYGTKNLVEEYYQEVVKCLELINQDNNNGDDNDNDDNDNEKIDIEKKWKFFKIVLKNYGKSALCLSGGACFAYTHFGIAKALLDQNLLPQIISGTSGGGLIAALLCTRTNEELKKLLVPQLARKITACEDPWYIWIPRFLKTGARFDAIDWARKSNFFTHGSTTFEEAFQRTGRKLNISTIPADPHSPVILCNDITSPHCIIWSTLLASLAVPGILNPVVLMMKNPINGKVIPFSLGSKWRDGSLRTDIPIEALNTYYNVNFTIVSQVNPHISLFFFAPKGTVGRPVTSSTRKTRSKQQYASFRGGFIATALEQLLRLEIKKWLQIIKSLDLLPHFLQQDWLNIWLQNFTGTITIWPKNKLSGFWYILSDPTEFRMKEIIEKGEKCMFPRLLFIKHRASIENVIEKGKKLTLTKYKQLKSGGVNYDEDVDVDIDDEEEEGEFGGVVSDYDAQSFQKVVGWSNEDKKLLDELDNEDEEEEDEEEEEVDVDDDDDDDDDDDS

SEQ ID NO: 16668 - protein, 600 aa, Candida albicans
  UNSURE (1): Identity of amino acid sequences at the above locations are unknown.
XKGPNVFAKESEQVNSDLLQVALNFQNDLRKEIKYKLLIEQRIQFKNIEIAKTASSLNKTILERKKKLHKCILNSKNDHIDSNMIDSEVNQLLKTASETSHKVKSLISRLTDLDKKLRGENKDNLVMVRKEIYPNLYRLMNKQEIQEDEVQDVETHDVTAPYESYFDSSLVSTGRRNNFIQDSLNEINSSVDTDTSGVLTTQEGQPEIIPTTNSLVLLNSLHSISNLNQDEEDKDNNSKDITEEEYLDPVQFESFMKSSIAKYRKSQNKKHLDPFKNITTSETNSEPKNQASNPLTLLYSQLISNPKYIDSQRNGQYPFSNIVTIKSSATTKLTELISHHKKLRINGAPITSESLRRNKEKCKCSIADMEASNKTLEDALLEQLNISDHDLDGDEVWNSSELNSEEDDYNEENTVDELLSSESSDLDSSSIDEYSPINSTNQYYNNFKSDLKQKKRDKLSKRKTTTSKRKNRRSISLDTRELSPTPKHVPSHRILKPKRSILKSNSNNTQRFSKENSPFRKAGFVTDQLDDILSEEVSALSEVNNAYGSKTDNKTTNLTVQGTIIPFKNTNPNDEDSEQDTTKEGIKHMNSLSLLRTYVL

SEQ ID NO: 16669 - protein, 435 aa, Candida albicans
  UNSURE (2),(3),(5),(7),(337): Identity of amino acid sequences at the above locations are unknown.
VXXGXWXIRNAQALGLHRKFINESFRDHNYRTHRRRLFKSLYMLDRINSVLLGRPLIIDDYDWDDFDSEDIYDLDAEGNPIKDPRFECIIQACKISKLAGKVIRNYYLDGIINAYKAEKLAIELKLWSLSLPEPLQIDKIFRPETVNKMPLLTMHLSQLYSIVLLCRPFFMFVILNKKHKKHSTKKANGENLQKRPKTRLETSMCNFCKATTKSSTLIIQMVENYIISTNRLKSARAELNGLIHTCLMASLIVGLSILFLESNGYSIDDGYSSSQLMKYLNSSKQIFKFFDRLKNALSMKFHNIIEQMQLALMNKFNLDYNGDKIINSQESQNQPRXHGHDTLPQAQQATPAVPPPPPHQQTQPSNNMTANMNFNYNNNDYATMKAEMLTNQQTSSNEDYDKFIDTFGNLPNFDSSNHNYGYKSNSRNNSHQYQN

SEQ ID NO: 16670 - protein, 203 aa, Candida albicans
  UNSURE (203): Identity of amino acid sequences at the above locations are unknown.
RRQWSNEVGGVRWKVDGDYIASISTLEAALSAVKLYEQNKDDSLLSFAKKCLSWLDDNLLDKLDGFYYDGLNVNNKTNIDKGKLTYTVGVAISTYSYLYKYTNDEQYVLIATAKANGTLTSKTFLNHNGYWNNGLRYVHLLFDGFSDLITICDKRGFIDSVWKQGQYIYENDQLPRGNNVGNYLDLSKPIESHLTSSFHKIEX

SEQ ID NO: 16671 - protein, 156 aa, Candida albicans
EGKQISEDLAKAGINRGVFFYDRDFDNSKRYWRDSSYFVQLLIEGLADYLLYVGNDVPDELVGKIQEEIKRHLIIFYEFMKDPKDGMYIQSFEPHNTYREVYDQKYKNFFGDGKGWGLKGEDKDENGNPLKCLMGYAAAARVFFQGARVVPHIDSY

SEQ ID NO: 16672 - protein, 101 aa, Candida albicans
WVFIEAYELTNNTKYLTTANKLMELIQGQWSDKVGGVKWQVDGDYIASISTVEAALCAVQLYEQNKDDSLLSFAKKCLSWLDDNLLDPLDGFYYDGLNVNN

SEQ ID NO: 16673 - protein, 456 aa, Candida albicans
LRVGVGTTAMHGFGILVLILPLCLSAPANVRTVVVTAPVEIVTVTQVGTQIYSATSLEAPTSSLAESFTSSAKTTSLESSVSTSLSTSSSSSVPTPGNSYYNTMFKVWQRFWGDGKWNDNDSNCNDGYTLPVLWTMAVLGEAIVKTGDVSGVEVTLDRIMQYYDSATKAFLASPNDGVEVYSDDIAQLAWVFIDAFKMTGQQKYLDHAKDIVLYIQTQQGPNGGIIWKKDKNYIASISTVEAALAAVRLYDITRDNSLLEFATDCMDFMFKNLQDPQDKLFFDGTDKNDLGQVDKGKLTYTIGCSISTLVYLHKFRGDQDMLDKALELALAATNPGGAFYDGNGNWNNNLEYVHLLFAGFADAFRLSDLFGQYRDEVVKQGNYIYQYLQDPKDLSLYFTLIAASTRSTFDRYSKLFRGSFDDDDSVYCNNDPSQHAKKKLLVNASAVQILYFMANY

SEQ ID NO: 16674 - protein, 540 aa, Candida albicans
MIFKRYLFKGKPKPKFIEKTEFHHEYSIRPDTFAFKVPSTTKKLNPLQSIYRYATNFPFDQTPDTVYNSYPMTNSTKLARLSHRPSRVKMTTGDFIEDSLYHPKYGYFSQQVEIFQPEKPFDYNNIEDIDEFMDTWHKSYERYDVITPPALPAPNSSSKFASMAHAIQQQDSQVAPKYRKSLQLWHTPTELFHPYYGEALARYILVNYKLNVYPYNDLIIYEMGGGNGTLMCDILNYIRKHQPEIYEKTQYKIIEISSQLASKQMKNALDNKLTSQGLDSSKLEIFNKSIFEWKKVVDDPCFFIALEVFDNFSHDLIRYDNDSGKPYEGKVVIDENGDFFEFFTPELSYYSNAYLNLRENSKYSVLKQSSSVGGYLSALKSFYSDDVHPLLHSSAKLKLKNTILPYDSNLTPGEFIPTRLLQFFQILKHRFPNHSLISSDFNYLPKTIPGCFNGPVVQTVLQNRMVDVSTYMVHQGYFDIMFATDFNIASEMYKQVTSRVPRVELHHDFLEQWADTDITTTKTGENPMLDFYRNVSFMVS

SEQ ID NO: 16675 - protein, 219 aa, Candida albicans
GTTMLFHRALDTFNCINSQLNLFQIGIQCTCAILILVLVLSVTKDSIKQDKDEYKRIERVGRFVAAHAAVSLLEIALGFSTNSAVLYTIANVNGLMSALLTVIKYVPQIYTTFRLKHPGTLSIGMMCIQTPGGFVFTATLFFTKGSHWSSWVSYLVAALLQGTLLSLCIYYVYFQGRHVGEESAEELEREAIERIVSENRHEELDHNSEVRDPEREQLL

SEQ ID NO: 16676 - protein, 288 aa, Candida albicans
TSMSSSSTNNTNNNNTSALNLQAELLEFQNLKYPTIQETITNNASILYKRKKFFLIELRESIQFLECFLIVLIYLRDLSFLKLLIRSTIHLSIININPPLLFKLQLQLLDDYKKSLVKISLRGLIIGNLFCLLTHLIFGIYRESPSGDGYLHGGITIQFIGDRLPYSRFELIILDLLVFFIQLVFHSLIGVIDDSEVLQVTPTQHGNGNNDASMVEEQLDGTSGLDRVHIEEDGYNGNVYLLTIDILGNIKKVFDYQINLQPPSGGRSDLEANQTQMPGAFPGASFSL

SEQ ID NO: 16677 - protein, 795 aa, Candida albicans
  UNSURE (678): Identity of amino acid sequences at the above locations are unknown.
VPTVYKYHSIVQLDYFTFVSEFPSDKNTIPILLTMLSDFKQQQQQKHHSHNPPNSHDDTQTKLQVAKLTQVIQKFFTKAAQIILESRAYPETTTPSLYPTKEESSKINKWFNLYMTNIPDLCKDDLKLWKGVDLTSIPPMIIETYIDLRSLPADQTLVLMDDERHRWTVAKSRGKKQEVVLERWLIEFEPNTTDATVMVEELPLSYKQAIVLFRSIYGFTRLMPAFKVKKNLQNKLPLGNKILDGNQPISSKGRIGLSKPIINTRTNESHMTQKYFQPVHTSLGTLKISVAYRMESDFCLHENGELLLSHFHKRDEEEPKKKVSSSVSLLSSGTSLKETSISPRNHSLPIGIQPFKVGSMSTSPPVQSPSISQPGTAPIQNQPSVPSSSLERRVSITSNKSTSNASLAAFLRNARSSTPSANNIPIINANPISGTSVPRSFSSSTGHEDSIFVNPDSASNTPRFASSFGSRASRRYSSTSIRQQTPQSDLMGQTNSVDAALSGIDADDDISDFVRMIDSKSDLRLGGGGGGGNSSVHNMSINESSYHGDALNKCQSLRSQYQQLSDSVSASLILQSRHSSRKSSLNSPAGSFDLHHHQHQQQQQQQQNQQQSQSPHTNTTSSIHSHAHSYSHSRMKDARPRSEDHQQTKFSAARRSSNISPTTAVPSSIGTPSLISSXIPHVTTIISSSDVSSTGGNRTKSAATTAIVSGMATSLPIYDYRSPRYQNVFDDDDEDDNDEEEGDREGNQSHEGRNSTESSQNQSKRIMTHIKKDEEDSEDDEDLLFTMSDMNSRNF

SEQ ID NO: 16678 - protein, 497 aa, Candida albicans
HSIMKFAKTLERTLEEDEIPQEWVEAAIQYKALKKCINKVVNELEFLGLQKNTLKILLNDKVVEVNEQETNPSNPIIAEYILSKTSTDAHNIKPMLKITLDYSSEDYTKDHIVELGKELKQKIEALLNDSDTEYEEDKIIELKEDDGGDLQIVTSREGSLSPPASRMASPPTSPTLKVVDSLNTNIDEALLSPDDHHKKHEIFIMLNSDSKFFEMLNDELNSLDTLTQLEESKIIEEVKKIAKYVNELKLKQSELYKWRELFKVYLDSEVYFKYNETALPSQQKSSEQIKLNLDLFVTNLNKSGIMTRFKKKQSLETFNQFMEMNYHLLKILQFQTINNEALRKILKKFDKQTSLGIQKTFPKLISNDHIFMSGSSLAQSICYIIQESVIKVIPQLDDYSCPICMNIAYKPIRLSCGHLFCVRCLVKMKQDDKTSCPLCRKENAILYADSSNLDLESMELMKKYFPREVKEKLRERDKERYNELRKNANSGEKCIVM

SEQ ID NO: 16679 - protein, 163 aa, Candida albicans
NPFVADINNPQQTKYTMSNQPSRTIVQENNVLRLKPGSEPTPSSSNQQPPQQEQQQETTSTKKKKKKKAPKVRWTEGTVDNEHMNKKKTKICCIFHPQRSFDEEVEDDKHNHSCSSSDESSDSSDNEGDKDEDESRPSNGIPKPNAYEYQPHYENRSKLPEQG

SEQ ID NO: 16680 - protein, 311 aa, Candida albicans
QKSFSNQDLGVQPEHLGLKHHTNSEIEVSGSWIDKQIHILGAKFRFSSAMCQIVLLAFVVFLTPGMFNALSGIGAAISDKKTADLANTALYVTFSTVGFFAGTICNVIGVKMSLVFGGFGYAIYAGSLLSFNHNENKGFVIFAGAFLGFCASLLWAAQGTIIMSYPTEQTKGRAIMVFWVIFNLGAVIGSIIPLAENMHNQGSSASDGTFIAFIILMICGSVLANFMLPISKVWKSDGTRVMTKTHPYWKDELIGLGRTLIKEPKILLMFPMFFASNWFYTYQFNNVNYGRFNLRTRSLNSLLDRGPQMFV

SEQ ID NO: 16681 - protein, 185 aa, Candida albicans
LDFKKFKRSTRAKIGWAILFVTSLAIWGGGLKFQMSFTREEVESKPPKISQLDFKDGAYIGPMFLYIFYGVFDAIFQTYTIWVLGAMSNNPKKTALYAGFYKGIQSAGAAIAWRLDSLEVKYMSLFASSWGLVQGSLVLAIPLIFFMIKDHTALEDDNMGEVVDDAELDVVESTTVLVTSREDHR

SEQ ID NO: 16682 - protein, 77 aa, Candida albicans
PTLWLYGDKDWMNDEAGLEMTNEINDLSIKENSEKLASFHIISNAGHHLYLDNPPEFAKTVFQFLKFKKAKVSRMYR

SEQ ID NO: 16683 - protein, 212 aa, Candida albicans
RQEIEVDLTKTIPSLRNKQFIKNYNISDEEEKHMKKLFWLRNSILENLVGSWKLGRRHGVIDLRPIRLTTKMANILSYENIQVHNTVLTDDDLQVDSIGKSYNLSTDQFYVLKTTIINHSKKPINGIVRQLPFPIHNTPTKSSSLRPQLSIDKKMLVNGTLQNKFPEIAPGDQLVLETSFVIIQNGEFEWGTVVDLFSDKIICREQLYITAN

SEQ ID NO: 16684 - protein, 602 aa, Candida albicans
  UNSURE (398),(399): Identity of amino acid sequences at the above locations are unknown.
SILFNWEFWLSCNYMMINYCDHVQSLLRNFAFLFNTWDLIPDTLSSFVTINENGDNDDDKKNTKRLTQESLKWITETECSFKLNFVNFLISDEVFERFFTHWNPMVRSYYIKLLIWRIIGINNYQSSTLIQVSRNVQFKLNRAFEMLSRFTMTYNGKIELNYKPDNPLVNRKFGVVPINIKDDYLSIDERSNDIYIPTATSLKPSELKKTHPYEVFDEAIYTCSNSALTNGTRSDPTTPRGGSTDLLPNKPNGRIGSNNSLVNSLGRLFKILSTDDNDNTTKATTITNNKRKLQLNDIQENVTSDLTDMATVNRVKRNSISLTSLSTTYSFKSRSSSPSVMSYRSTPTSLTESSASTDDESVYSMDTLKTKSSSASTASSSSSSALFPNSYNIPPPEXXRLPPEIIRPIYKFDVIVCHDSLNEKFAMIHTKNTLISRGIVNNNNNAGSTMYMSKSPVTSYFPLSPQIPFISIFVNSDTFKNRIYMNEEDGLFLETEFDTYYRDNNMNENNESFQNATFAQMMNLGKSLNEFNLMVEEFKQFLSNRVEIDSMNYSETDENSIFKQQPPQIQQLYGHYIQQQRGNDNSDKVIFTTRLEGPELGV

SEQ ID NO: 16685 - protein, 530 aa, Candida albicans
RGTNADNQELHQAPNDFLHDMDGDYIAPPKQVQAGVLSSLLRLYQNPQEQKSASSLSRVSTGTSGTALSSFDDSYDSDDYKDSKSSLNVDLQHKLKLGIKGGSKAMFNKAANKLKHHSHTRTNTVETQGSSNLEEFSNDKDEFSNGYDDDNKMNANLPSFQNARPKMPKKKTTEPVQKLKKLRHKQRAERLRITVHIADILQRQRFIMNMCRALMLFGAPTHRLEEYMVMTSRVLEIDGQFIYFPGCMLVSFGDAATRTSEVHLVRCAQGINLSKLADTHKIYKAVIHDLIGVEDASKKLDDLLKSKSRYPPWLCVLFYGLGSLAVTPFAFEGGWLDLPISFGVGLCVGYLQFYVSSISNLYSSVFEVSAAIVVAFIARGIGSIKGGDLFCFLAIAQGSLAIILPGYIILCGSLELQSRNLVAGAVRMFYAVIYSLFLGFGITLGAALYGWIDHNATSANSCALGHAIDEKWRILFVPMFALCLGLINQARWSQVPIMIVIAGIGYIGSFFAGKHFSTVTVFTTGWKEPQ

SEQ ID NO: 16686 - protein, 201 aa, Candida albicans
FFFFCFSGNIQRLGLSINKPQGLYNYPRPIWIDNSFFFSLYHNMSSKLPRATLAQKLQIIDYYHKSDRPQLETVDKFKNEVSISTSSFSEWLRNEPELRKRYNQADFKFSKNSKRKVKFKYGEINKAMDKLVTGMIERNDPITEPILRQHWAVYAHQFGVDDPKRLHSFSHGWLSQFKKRHGINTKSKNVPHLDQGAGKSA

SEQ ID NO: 16687 - protein, 136 aa, Candida albicans
NFNLNNMPAKGPNIIPKQAPSPIAIAGSPPSSSASTPRSAASPPVSVNTKSSLNTNSNTIMPRQVMSIQTSKEWVLPPRPKPGRKPSVDTPASKRKAQNRAAQRAFRERRATRVQELEQKLMESSPRALEGPTLGH

SEQ ID NO: 16688 - protein, 196 aa, Candida albicans
KTLDRKPAKREEANLKKKKIELKESSTKSTTSEPATQAALKRISKKAMSKSRTVTGSLDQKIYNLIHDLLQEQTEENKRAATADEEHDPFSCMASSHNLTVSQVLAYVQMKDFQLKRMKKNYLEKSIAASLKVIRQDETEEFGDRENGIGDESEAENDRECENDLMEVQDLNAINKSVVSLWNQEKTDGESDGGKQ

SEQ ID NO: 16689 - protein, 272 aa, Candida albicans
RWSFHPACVKTIASESVLTGTTSADVSGATTIGSESIFTGTTESTGTPLPTASGTESLDTTVATGTSVSEQSGVETALSTQPTTGTEATVTSGVSQSEQTGTSAVTGVTESSEQIQSGATTPATTTASDATAVTNASEASAESQATTTAASEATTGSQVTTAASEAATESQATTAASEAATESQATTAASEAATESQATTPASEPATGSQVTSEVTPATVPSSVTAAHTAATSIITSPPASAEPSSEVTAVAPSTATTSSTKNWLPSLVGYC

SEQ ID NO: 16690 - protein, 96 aa, Candida albicans
LSPVNDINDACCEEYRDYHDCQRGAMCNYMHVRLPSSDIEESLYESQAKSYMLKQLEELKKELPGDIRSSSSTNDDETNGNENGISSTMAVLEQLS

SEQ ID NO: 16691 - protein, 296 aa, Candida albicans
  UNSURE (286): Identity of amino acid sequences at the above locations are unknown.
LLLKLYSYRKQPTLAIQMPTKRTLLLNEVELLYVKSKVCLHPSPSKKDNIAGFLTLSRPPRATNLEILLSYVPESQLSTEELKIYQQVDVEDLDLNLGSVNNINHDHHKQNKASTSRIVSKPSQSVLTGYAFNVQLSFIYSIQFRTPSHGYWYGSIVLNLQDGEKLPILFFHDNESPLSLKSQKLQNQRFDPFGNDGELYWGGLDFLKVLQQLINVQRSTIELSVYLVNPESNDLRNFAPFKEKQKVPEPSQEPFKLPDVAKFFNTAKWKVLSTVDTLSAKTEHQXLFTSDMFRVT

SEQ ID NO: 16692 - protein, 311 aa, Candida albicans
TRIKTMASKYTPATLNTVHISSSVLLSLLRHTSEHYPQLFSGALLGFEDESLIDVTHGFPYPYPDQYEGGSFRSRIGGHYQKDLLENFKKLGYGIEFLGWFQSTVSGNFVTNQLIEGLAQQQLINSNAFILINNLSSVGQEVSIKALRLSTGFMNAYVDGKWKSKDLESNKISYLNIFEELNLEISNQKLVDVYLSSLSLKPSTESELDVLNLLSNQNATGQLLESLSGQVDSFNYDQNNFNYYQRQYQKEQSKIQQWKQQRKLENLERAKKGEKELDTEEWKTIFKLPNEPSRYNNMLYSKAIDFLPDDI

SEQ ID NO: 16693 - protein, 207 aa, Candida albicans
VPGQFAAPSRPVCEKRSLARTTSNTSFRANLADSIGSTQIATNSNHSNKRSYIPFRSSRHGNKARAEVFSTPKIPLSAGFDANDLDQTPSSIQSTAISSPTISVARNDGDHELASNANENVTRFEGILGTKKKSKKGIRQNSPNESTTNISPDLTANNSFRNSHVSSIASPKGAAAVISSPIQVVGSNTAVTPNSGKEKKRISQKFR

SEQ ID NO: 16694 - protein, 231 aa, Candida albicans
YIRFLSVIEDRSYNQPTHTMLPIKLLIFILGYLLSPTLQQYQQIPPRDYENKNYFLVELNTTNSQKPLIDFISHYRGHYNFEHQLSSLDNHYVFSIDKSHPHNSFLGNHNSNEYNLMKRQLGHEQDYDELISHVESIHLLPMKKLSKRIPVPIEMEDVVFDNRDDTGSDNHEATDEAHQKLIEIAKKLDIHDPEFTTQWHLINLKYPGHDVNVTGLWLENILSSPRAEIHL

SEQ ID NO: 16695 - protein, 384 aa, Candida albicans
YIRFLSVIEDRSYNQPTHTMLPIKLLIFILGYLLSPTLQQYQQIPPRDYENKNYFLVELNTTNSQKPLIDFISHYRGHYNFEHQLSSLDNHYVFSIDKSHPHNSFLGNHNSNEYNLMKRQLGHEQDYDELISYVESIHLLPMKKLSKRIPVPIEMEDVVFENRDDTGSDNHEATDEAHQKLIEIAKKLDIHDPEFTTQWHLINLKYPGHDVNVTGLWLEDILGQGIVTALVDDGVDAESDDIKQNFNSEGSWDFNNKGKSPLPRLFDDYHGTRCAGEIAAVKNDVCGIGVAWKSQVSGIRILSGPITSSDEAEAMVYGLDTNDIYSCSWGPTDNGKVLSEPDVIVKKAMIKGIQEGRDKKGAIYVFASGNGGRFGDSCNLRWLY

SEQ ID NO: 16696 - protein, 176 aa, Candida albicans
ESFASNTTITNPPDGTNSVIVKEPHNPTVTTTEFWSESFASTTTVTNPPDGTNSVIIKEPYNPTVTTTEFWSESFASTTTITNPPDGTNSVIVKEPHNPTVTTTEFWSESFASTTTITNPPDGTNSVIVKEPYNPTVTTTEFWSESFASTTTITNPPDGTNSVIVKVLHDEKEVSV

SEQ ID NO: 16697 - protein, 569 aa, Candida albicans
NLCAGSVHIPESEESSFDSSSSLNSDSSSLPFSDESDISASSSFSTLVAPSFSLSSSSSLSLIYPHYVNSTTYHASESESSSVASPSMASESANDDTHTLLESTDTTSSIGTDSSTVTFCRRDNGDGCIVTGIPSSSIDSEQTSDVTTTSSFVASSTPTSAEQSITDNPNIDSLQTSASSSTKSSVSVSDTVVNSILLSETSTLSSDDSTSSDTSISSTTNSDTGNINAGSLHTSTASIKELSIQKTGVTLSSSYLSTKLSSTSDITIELITTELITTELTTIEDNEPNTFTSTPSSHSEIFSSDNSVLSKQVDRESTIKTSPTTDVTTVSSLSVHSTEASTATLGENSFSNVASTPLNIATSLRSTSSSSNHATESSGTVKSEASAETIPSPPTSTDNRLSYSTEEAKGITYANSGSTNNLINESQVAAPTDSTSVLIENPVVTSTFDDNSSAAVDQPSKTKSIEESIMNPDSTNETNNGFIATLSQAQVPSSSIHSELILTTTAKTTDASMNGDSAASNSQPTTLIQQVATSSYNQPLITTYAGSSSATKHPSWLLKFISVALFFFL

SEQ ID NO: 16698 - protein, 229 aa, Candida albicans
QDITKTFQMLLQFLLLSLCVSVATAKVITGVFNSFDSLTWTRAGNYAYKGPNRPTWNAVLGWSLDGTSANPGDTFTLNMPCVFKFITDQTSVDLTAEGVKYATCQFYSGEEFTTFSSLKCTVSNTLTSSIKALGTVTLPISFNVGGTGSSVDLENSQCFKAGTNTVTFNDGDKKISIDVDFEKTNEDASGYFIASRLIPSINKASITYVATTMCKWLHIWCNGVHSSHW

SEQ ID NO: 16699 - protein, 823 aa, Candida albicans
PHNPTVTTTKFWSESFATTETVTNGPEGTDSVIIKEPHNPTVTTTEFWSESYATTETITNGPEGTDSVIIKEPHNPTVTTTKFWSESFATTETITTGPLGTDSIVIHDPLEELSSSTAIESSDSNISSSAQDSSSLVEQSFTSADETSSIVELSSSSDIPSSSIGLTSSESSTVSSYDSYSSSTSESSIASSYDSYSSSSIESSTLSSSDRYSSSISDTTSFWDSSSSDLESTLITWSSSIDAQSSHLVQSVSNSISTSQELSSSSSEESSTSATDALVSSDASSILSSDTSSYYPSSTILPSDDFPHTIAGESDSQSISFITSTVEISSDSVSLTSDPASSFDSSSSLNSDSSSLPSSDQSDILTSSSFSTLVVPSFSLSSSSSLSLTYPHYVNSTTYHASESESSSVASPSMASESANDDTHTLLESTDTTSSIGTDSSTVTFCRRDNGDGCIVTGMPSSSIDSEQTSDVTTTSSFVASSTPTSAEQSITDNPNIDSLQTSASSSTKLSVFVSDTVVNSISLSETSTLSSDDSTSSDTSISSTTNSDTGNINAGSLHTSTASIKELSIQKTGVMLSSSYLSTKLSSTSDITTELITTELTTTELTTIEDNEPNTFTSTPSSHSEIFSSDNSVLSKQVDGESTVEIPPVTDTTTVSSVSVHSIEAFTATLGENSFSKVASAPVNTETSLRSTSSSSNHATESSGTVKSEASAEAIPSPPTSTDNRLSYSTEEAKGSTYANSGSTNNLMTESQVAAPTDSTSVLTANPVVTSTFDDKSSAAVNQPSKTKSIEESIGSLDSVNETNNGFIAILSVFTTGMPGPP

SEQ ID NO: 16700 - protein, 77 aa, Candida albicans
SFATTETITNGPKGTDSVIIKEPHNPTVTTTKFWSESFATTETVTNGPKSTDSVIIKVTTQPYCDYHQVLVRIICYY

SEQ ID NO: 16701 - protein, 646 aa, Candida albicans
EISFIDLYKHHQHHHSPTMKTVILLHLFFYCTIAMAKTISGVFTSFNSLTYTNTGNYPYGGPGYPTWTAVLGWSLDGTLASPGDTFTLVMPCVFKFITTQTSVDLTANGVKYATCTFHAGEDFTTFSSMSCVVNNGLSSNIRAFGTVRLPISFNVGGTGSSVNIQDSKCFTAGTNTVTFTDGDHKISTTVNFPKTPQSSSSLVYFARVIPSLDKLSSLVVASQCTAGYASGVLGFSATKDDVTIDCSTIHVGITNGLNSWNMPVSSESFSYTKTCTPNSFIITYENVPAGYRPFIDSYVKKSATATNGFNLNYTNIYNCMDGKKGNDPLIYFWTSYTNSDAGSNGAAVVVTTRTVTDSTTAITTLPFDPTVDKTKTIEVIEPIPTTTITTSYVGISTSLSTKTATIGGTATVVVDVPYHTTTTITSIWTGSTTTSSTYTNPTDSIDTVVVQVPLPNPTVTTTQFWSGSVPTTETVTTGPQGTDSVIIKEPHNPTVTTTEFWSESFATTETVTNGPEGTDSVIVKEPHNPTVTTTKFWSESFATTETVTNGPEGTDSVIIKEPHNPTVTTTEFWSKSFATTETITNNPEGTDSVIIKEPHNPTVTTTKFWSESFATTETITNNPQGTDSVIIKEPHNPTVTTTEFWS

SEQ ID NO: 16702 - protein, 780 aa, Candida albicans
  UNSURE (493): Identity of amino acid sequences at the above locations are unknown.
YQMLQQFTLLFLYLSFATAKAITGIFNSIDSLTWSNAGNYAFKGPGYPTWNAVLGWSLDGTSANPGDTFILNMPCVFKFTASQKSVDLTADGVKYATCQFYSGEEFTTFSSLKCTVNNNLRSSIKALGTVTLPIAFNVGGTGSSVDLEDSKCFTAGTNTVTFNDGSKKLSIAVNFEKSTVDQSGYLTTSRFMPSLNKIATLYVAPQCENGYTSGTMGFSTSYGDVAIDCSNVHIGISKGVNDWNHPVTSESFSYTKSCSSFGISITYQNVPAGYRPFIDAYISPSDNNQYQLSYKNDYTCVDDYWQHAPFTLRWTGYKNSDAGSNGIVIVATTRTVTDSTTAVSTLPFNPSVDKTKTIEILQPIPTTTITTSYVGVTTSYLTKTAPIGETATVIVDVPYHTTTTVTSEWTGTITTSTTRTNPNDSIDTVVVQVPLPNPTTTTTQFWSESFISTTTITNSLKGTDSVIVREPHNPTVTTTEFWSESYATTETIXTGPLGTDSVIIKEPHNPTVTTTVFWSESYATTETITTGPLGTDSVIIKEPHNPTVTTTKFWSESYATTETITNKPEGTDSVIVREPHNPTVTTTEFWSESYATTERVTNKPEGTDSVIVKEPYNPTVTTTEFWSESYATTETITTGPLGTDSIVIHDPLEELSSTTAIESSDSNISSSAQESSSLVEQSSSIVGLSSSSDIPLSSDMPSSSSTGLTSSESSTVSSYDSDSSSSSELSTFSSSESYSSSISDTTNFWDSSSSDLESTLITWSSSIDAQSSQSVQSVSN

SEQ ID NO: 16703 - protein, 529 aa, Candida albicans
NVGFLGVFNGAIKYNGPAPNPGRPSICQACPGIHSAPGAEPSTTTKSIITTKTDGAVCTEVDTVIVSSDKSGSWYTTTSGASINCGTTSEAPIPNPRVTITTTWTEITTATVTETGTKTDTVIVQVPTTPNPQITVTKTWTESFITASTVTGDKTDTVIVDIPETTTSCLTTTNTWTGDYITTITTSGWIIVEVPTQNVVTIVYTDSQSTSGKTTTTPVVTAETSATTGNDNTASTTDATGKTLTTVTSSNDNTTSTGDDSTTASTGNDNTDSTTTTATVNKNIDSTTNATDNTSKATTTGNDNTDSKTTASGTDSTTTTGDNNSESTTASTGNDDNDSTTVTTGDDYTTVTTDNDNTASTIVTTGNSNTTTLTDATGKDSTTTTDNGHDESTTVTTGDDDTATTKDNNTASTTTKTGDNDTATTVNHSIESTTVTTGDDNTATTGNDDTASTTDATGNDSTTATTGNHSIESTPVTTGDDNTATTGNDDTASTVSTGNDNSASKTVPPTPKMILTLLEDDDTGNNYPY

SEQ ID NO: 16704 - protein, 375 aa, Candida albicans
RLMITLSVPSGLLVIVSVVANDSDQNLVVVTVGLCGSLMITLSVPSGLLVIVSVVANDSDQNSVVVTVGLCGSLMITLSVPSGPLVTVSVVANDSDQNLVVVTVGLCGSLMITLSVPSGPLVTVSVVANDSDQNLVVVTVGLCGSLMITLSVPSGPLVMVSVVANDSDQNSVVVTVGLCGSLTMTESVPSGPLVTVSVVANDSDQNLVVVTVRLCGSLMITLSVPSGPLVMVSVVANDSDQNSVVVTIGLCGSLMITLSMPSGLLVIVSVVANDSDQNLVVVTVGLCGSLMITLSVPSGLLVIVSVVANDSDQNSVVVTVGLCGSLMITLSVPRGGSLCVSVVKYLPDQNCVVIIVGLGYGIFTMTVSTKSMSSK

SEQ ID NO: 16705 - protein, 293 aa, Candida albicans
DITLITNEEITLINNYLHSGNMDAQMTLLKAFIKYIANLKKHTNHNIIYGGDYNHIMLLDDVQLPLDQTRYIISKKELEIIQLMSNFYKKWKLQDAFQIRNNLQPTNFHSNKSVKKRLDRIYIDSRIRRKLRNCRILEEFKQISTHKIIAMSFQIQKEPILKVGNPRYLIPQWMSQDENIIKDLNNNEQSSLTPFSNWNGIINRIKEKVIFYEKYQRYIRAYIPHAGNFPDEKMLKFRFRPSFNFSIITEMQTESGNTVQDTEIMINLANKFLPRIVLGRRKALGIIYLCGTV

SEQ ID NO: 16706 - protein, 222 aa, Candida albicans
  UNSURE (29): Identity of amino acid sequences at the above locations are unknown.
VDGNEACAGSAGRASRERTFARRDHGRRXGLRTGVDRRPGRRGADAAARAGGRHMSIHRRAVGQEHGPARPDRTPRLRASRRHPGGGSPRQNREIYRRAVVERKPAQGTRHCAREPGGEDRHRLGRRRNGIPRIRCDRPLRAAADRRAHQGRDRGGPCQRQASGPATGRSGQGRGRPETRPSRAIAYGSGAPGRARPRHSISRNGPRRDRLHHGRGKSALAL

SEQ ID NO: 16707 - protein, 173 aa, Candida albicans
HFNERKPIQDTTYYINSYKHYTMSNNKRPVLEEVDDDDIDNMDMDIAEFDPSLTTPIAPKRPEPTVVRSQDSEPSLFPNIPLNQVQPPPKQASSRNGIMDPNSFTEEEKKQFDQFQIIYPCYFDINRSHKQGRRVSIDRAVENPLATTISDTCRRLGLPVFLELDKTHPQDFG

SEQ ID NO: 16708 - protein, 117 aa, Candida albicans
IKLIHKILGNPGRVKVLFKAVFDNGKLINPKLQTKRVLFNVIAEYLSEHPTTLESIGPKSGVPRPPEFENEFQPEDFPKVKGIKMNTIVPIHANLTLETSMDKTHLLIQKPETPAAG

SEQ ID NO: 16709 - protein, 81 aa, Candida albicans
  UNSURE (28),(76): Identity of amino acid sequences at the above locations are unknown.
SCLQLAPPPGLLGSLISTMSFPLPPSSXWTPPNAQYWSQFHSVRPQGPQLRQQQHKQNKQVLGYCLLLMLAGMGLXYIAFR

SEQ ID NO: 16710 - protein, 136 aa, Candida albicans
  UNSURE (122): Identity of amino acid sequences at the above locations are unknown.
LEPWWVDVISMGPGEGQAKGDKGSPAPPQLHPDRDPGNPSLHSRFVELSEAYRVLSREQSRRSYDDQLRSGSPPKSPRTTVHDKSAHQTHRYSNPAFSLPHPQVSWVVSFPQCPFLCLPAAXGHPPTHSTGPSFTA

SEQ ID NO: 16711 - protein, 120 aa, Candida albicans
CLLFGCVLLGLLVIWVISTIVQCLCMGVKCIEACCCCCCRSQSNTAYQQPPQTYINPNMYPDAQYNQRYAYQPQPPMSAYPGPSNDSVKSEYGYNNHDGYEPVSNNNTNYQSPFNDRYKY

SEQ ID NO: 16712 - protein, 447 aa, Candida albicans
RGISILVVAETGYLKSSSTSLESGSEPSYGNVKTGFHVYKSKKPIFLDYGGHLPEYEIAYETWGHLNKEKSNLVLVHTGLSASLHAKSQPENPKNGWWENFIGPGKYIDTDKYFVVCTNVLGGCYGSTGPSSIDPANNEQYATRFPILSVNDMVRAQMELVKDQFGINKIHASIGASMGGMQSLAYGWEFPDEVEKIISISGCARSHPYSIALRHTQRQVLMSDPNWNRGFYYNKIPPHVGMKLAREIATVTYRSGPEWEYRFGRQRADESRPPALCPDFLVETYLDHAGEKFCLEYDANSWLYVSKAMDLFDLGFKSRSKALEARSKAELLYSGKVSSDIPKLAIPETPYQEKSTKAITTVEEGLLDLKKGMSRLANKDVLVVGVESDILFPVWQQREIADVLMENSVSGKVEYFELGNDISSYGHDTFLLSLNDIGKPVKKFLEE

SEQ ID NO: 16713 - protein, 121 aa, Candida albicans
PTIMSFDAKNYSDYEFFTISQIEPGFVHVQYTNPKTLNAFTEKNWRNYGEIFKRLDQESDVQLILVSSGVPRSFSSGLNLKAAMELFGSDEPRDQAIKHLHEHIVDFQSSPRTLAGSELKC

SEQ ID NO: 16714 - protein, 295 aa, Candida albicans
CQLQQLAKKKKNRATKKQHPQYRYIVTLNNRQMESLDEIQWKSPEFIQERGLNTNNVLEYFSLSPFYDRTSNNQVLMMQFQYQQIQIPPGVSFHQYFQSRLSEMTGIEFVIAYTKEPDFWIIRKQKRQDPQNTVTLQDYYIIGANVYQAPRIYDVLSSRLLASVLSIKNSTDLLNDMTSYHISDGGHSYINSIHGSSSKPSQSSAVSKPLSTNTGTNATTTPITLTTPLGATVPSTVSNGISTSTEIASGVFDTLLNDVVMNDDHLYIDEIPLYGEGSTLERLGLKGNKDAGLSL

SEQ ID NO: 16715 - protein, 317 aa, Candida albicans
TELKTMSSVRKIAAYLERKEDLSQEYNSLKEVFKDEPDYEGLANVFEILKFLDQLIYEYHVHKSYLQCTKGPINDFERKLLAEMEKTIKQLEDDVSLPYLIENAQNLALIRRELFENAHEGGRLIHAYELQNPSSKMMIRSSQPLRPFTTLLDQLHSSKLTPSHSKSPLQLSSNVLEHHALIQSPKEMRNLARAMTWSKRCTDIVFEAGKLDANLTQKYQYISSHIEDEFGYQFCRDFSRYLYLHYIEGDAAKFREDFDKAYIKYLDFSTQKVSELIEKDLKINRKVCRYGIWLREIFQRTYGKITEPPENFLYTDH

SEQ ID NO: 16716 - protein, 68 aa, Candida albicans
MSLSKENSNYASGDTKERANSDLSESDRSTPPRDPNSTFQAYRLTIDEVAQEFNTSIVDGLGAHDAEN

SEQ ID NO: 16717 - protein, 469 aa, Candida albicans
QSLKGNSGLIRRVDKSNDRKPQKREYGQAAAGTIYDVVGNILGVTVGTPLQRKLSWLAIFLFCVAVVFDIIVMGSQKFHVNKEVAIYAICVALSMIPSALILVLTITMAVGAQVMVTKNVIVRKFDSLEALGGINDICSDKTGTLTQGKMIAKKVWLPNIGTLDVQNSNEPYNPTVGDVRFAPYSPKFVKETDEEIDFNKPYPDPMPESMHKWLMTATLANIATVNQTKDEDTGELLWKAHGDVTEIAIQVFTTRLYYGRESIAQEYEHLAEFPFDSSIKRMSAIYKKDGETRVYTKGAVERLLGLCDYWYGERTEDDYDSQTLVKLTEDDAKLIEENMAALSSQGLRVLAFATKELGDADMNDREQVESHLIFQGLIGIYDPPREESAQSVKSCHKAGINVHMLTGDHPGTAKAIAQEVGILPHNLYHYSEDVVKVMVMSANDFDALTDDEIDKFSHTGPGRSREWRK

SEQ ID NO: 16718 - protein, 191 aa, Candida albicans
  UNSURE (181): Identity of amino acid sequences at the above locations are unknown.
YLPTGATFMRDSRTKFSFLDILRILGGILFLNAFLSWWFTSTSTWGYRGKWLNTDYLKFRLFNANNPLNLTISELSLYNGTDKHLPIYLAIDGIVFDVSSSPKVYGPGVPYHELTGKDAARVYVTGCFNKKDEYTYDLRGLDETEAENDIQSWQQFFFDHDKYWYVGTVQHEPITSDPPAXFTSELTDRNI

SEQ ID NO: 16719 - protein, 303 aa, Candida albicans
YLSAVRPVPPGEKKPIRMSWYLDLTHRVSRDFGKRMKNSSVYLYTVVARDKVTGMGVPCAFFITNTLKEDPIILFLGFLKLHSVTLKQVMIDCSMPELSAIKTVFPESSVSICKWYILRNVRTEARSIFNDKESQDYAVAKITALFDNSTKDEIAQKIHEFKEQFADYPKWLNYFKYCENLLRCWTNNAEVSLNQENSTNNCIESYHHTIKIKFIKSIRKHTPDDLLCVLYKEVTPFYMKWYDDVRIRGRRPNLNKAELGYFDAAYSLSEDDLKKYVTIQKEGEIQEGETQEEKETQEEKETQ

SEQ ID NO: 16720 - protein, 434 aa, Candida albicans
ILKISVTYLLSLDSSNMILFQLPVELIQKVFSKLSNNELRHYFNLQELLATTTDQITDSSYLPIRLIALSAYFYNKSVIISNTVGEHYKHIQKHNTDIYVSLDDLQSLFINNFIIRPKQIFIYITDDTDQNSCGCQLNLSHISFIHKLTQFLPIMMTQYCYGSGTKVNLSVSLSTTDGLKSLYELLHNIKAFQKLSIKYTAKGTLDIAKDQLQDLKIDTMELQFFNQYKLIDNLQANNNQLLSINHLQLSYNLISNLYFFPCYSNLKSLNLSNNNLVCINNDNFNWEKLYNLEVLDLSNNNIIEINLTNRRGTGNYKLRSLNLSTNNLRALPNFQQCKFFENLQDLNLSRNAITQLSIKSFPNYLETLWLKGNYLSQLIDELNGEIFPKLLQFLDLTYCKIISLDSDYQYQATVIEKLILVEKLNNLKVLQLEF

SEQ ID NO: 16721 - protein, 250 aa, Candida albicans
INFISHYVFMHMTTNPKKHSRSDDDEEDSLHDYSGKRVKLDSLLKNLSLKDQENEKRYIINPKITYENIFSKSGSRYSSFTESQLASNLNEKLTRSFKNVLESGLRLIPWYNSKFLIKYRYQTWFIKLFNRFIKKYNERNRVSISTFHSFADIVKLVRDKLITLEDLANIINQENQLEMKRLELKQEMRRLEKRFEEVTAEQDAYQDLKYNYWDNLKFDKDLDMLDVSDDEPDNLKFEELDDDTVMVQDL

SEQ ID NO: 16722 - protein, 467 aa, Candida albicans
ILTLTIFLALLPLLHPASTKPTHHQKFYHTSKSTFFFVSLSFIFFLNNIIQNMSESQTETAASTPLVSSIEDIPAELVERIKARILAEVTTELRDSNNETESNFSASESDEAIKESNEHNYLELINESERIENQDSDLSPSSMGYHTITPSFIDVNNPADYEVVEDFDSFAIWSEHQNRKLLSLFNDLPVYEPDNGEIVVEWISAFNRFFESYSGIKKAVLGRETFNFESEKVKDIPSTGYWLKKCIDSLDERIVRFLQSKKVSEYPICNLENDIRLSKIWNWLHHTRVNFSRVFTSRLSTIAGFIYGPGYKNRFNDENRKFMKHSFDPINKFLIKLDHVTIGMKYYFAVKESVGDVLCLVLNKHFQIWLASDYLGTPSLDEILQEFREHPSYEPKLISQREAVNSVFAIVKSDRSKKQIRAGRLRTVNSSGTQLGSHHISLGATLSRRRYAGKSLRSSRWNRRGRI

SEQ ID NO: 16723 - protein, 337 aa, Candida albicans
LIVSEFEGTEFHKMSSAKNDDNERKVMESVDQANAISKVDEHIKARFNMLFIKFNDLPKLAVGNQKSVDKWNEEFKYFHVAYPDVLEFLLDYNPKDKFKVKKVEGIYFTGWCLQMCLQSIFDRFRLIMISKLPKHLQKEANLIKAAYDAVTKSKDYTITSKILLKFVNVEHELVVCYNLPYLLQVEEKLEEILYNTSNVVDEYVRSLPNLIGQVLYFNHVKKSEALSLFLNIHTSYYSKWIQADNDTSVLPSCSTIAEEMCDHPDYARLVDIPSNKYELNLIVSLPAPEKPKGKPEENSLEQSQKKNLKSRKRNKKHPKSDNDKGEKEKEKEKTSLE

SEQ ID NO: 16724 - protein, 89 aa, Candida albicans
TSVLPSCSTIAEEMCDHPDYARLVDIPSNKYGLNVIVSLPAPEKPKGKPEENSLEQSQKKNLKSRKRNKKHPKSDKDKGEKEKEKTSLE

SEQ ID NO: 16725 - protein, 329 aa, Candida albicans
ASRGPSSPVVKIHNDGLFHIEYEDGSVIYLGLYVDDILMVGSSQKVIDNFVDQLRDHFEVKVFGEISNYLGIEFRKTESGYILSQEKFLKKLLKDFKLDDSYGKNIPWIPNDKYEKVAIIRENVNPENDFEKVPNETLLDPDAKKLYQSGVGLLLWAATNTRPDISVVVNSLGSKSANPNVHDYEKLIYCLRYIKNSMGYHIEYKRNRLNIPPKSFVIECFSDASFAPGLDRKSISGTLIYVNGNLVQWATKKQTVIAQSSAACEMLALNYTMLKAIEIKNNLMDLGFEVGKIHCHQDNQAVIKVLRNNYCHPHRPIVFPARLEGPNLR

SEQ ID NO: 16726 - protein, 184 aa, Candida albicans
RSVAMLETYFQLQYFGEATEYLGIQFRKTPDGYTLDQIPFLEKLVATFNIQDSYGKDIPIIPKDINVVKQLRKSSQINDFVKLEKPQKLINSVSKTKYIDDYEENEEHDFKESPQAEPLSAKGIKLYQSAVGLLLWASMNTRPDLAFSVNQLGAKCAHPDVDDWKRLMYCLRYIKKDMDFKLEY

SEQ ID NO: 16727 - protein, 190 aa, Candida albicans
RRRLNNKSKDFIIECFAQASFAPDLDRKSITGTSIFVNGNLVAWATKKQKIITHSSAACEMLALNYTILKAFDLRNTIEDLELKIRNLHVHEDNQAVITILKNDNFHPHRPIDICYKFLRQKLKDGFFSISYVESGDNLADSFTKALGRNKLIEHTKRIRERKDYDNNATLIVDVRTLEEIKINKKLVHH

SEQ ID NO: 16728 - protein, 474 aa, Candida albicans
  UNSURE (367): Identity of amino acid sequences at the above locations are unknown.
STTNTKYHDYGEGNYPGQQVRTDIIGQFRDRGLTTLNTPIDLGVPDETDDISMTSENPIDSPNSEMIISPSLPTNELEHQIDISSGEMSLLQTNMEADNELKTNEMVLYKSKNDGIIIQQQQFTENLSDENEEDSSTDEETLEDKKQQRLEYNISPNDEWINNDVQNEDDTQVPHVKEPINYETQSRNETNMPRIEMGIIENLSDDGKNTPRELRMVTYDNNKKIQKYQNSNIEILEPRNENKNHTFIESNLELLDNQEMFQEDPQVEDIRLTTPKKDKSLSPDFNQTHNEIQLFMADINEDMLEEYDENINMNEVLADSTETLDKELDLDEESGRIEYIADRVRKKNRGTDGAPHGKYLKKNDKDXGSIKSQKKSDAQMDDEVGIAISKIRNFPFKLKDGRASFFSPYKTKFGRSVHPPKRILNAIVKKIDYNPKEWASNMEEEFEELKANPVYPVKKTQKTCPLEKPGGVHT

SEQ ID NO: 16729 - protein, 879 aa, Candida albicans
  UNSURE (29): Identity of amino acid sequences at the above locations are unknown.
ETSFVILSVQFSSENNKWYLTSVIDEHTXYIEGIITKDRKVKDLLIQRLKIWNNRFNDKVAYFRSDNAPEFPQPSDLAEFGIWRETIAAYLPELNGLAEVVNKLILQQIYRIVVTLGPQILKLIYYVIQYSITMINHTPRRSLKGQTPYGCYYQLSEGNFYRFPFAIDCVVTFSNAIEKNRYGVTSTKGAPSSIMGAVIGYASDCFSYYVLLKNMRCDIILSPNVRILRSYEVINSYLKNLSTTPMSHIVPMAEGIQGRQLGAQYEVRGTYVESEYDNTNDVMHMPKESYSVQPASFTLTTGNSSNEYVINDDPVQITIENPDDSSNPLQPTEESHDMVSEVKSDENPKPSLHELTPGDNPVSKPPQLGTETSVIGKSKEPITNHTKDAPSIQGRDHKRLEFTAQVGLSHQPQTGTPASEESKLSGTDHFGVDVVKETVSEDWHTSDYPETSAEDEQQNPSLLANKNRVTEKIDEGENISFPGGDDDSVVINSNVEQSNVETEDAGNSSIQDEVSQEGRIVNEQTDIVDTVAKAIENEEISPINSLDDHTELATDSGNDSNSTESDIQSKNEISPVINEKNTEIIQKHIESILVDKRLDEFETYNVDEIENVINDDDIAEANPLPDENNNVQMNESSDNNHGMSRAKKKYTFEKEVNEKIAGTKHSLDTTDPREAIRVLNTGETKRIEPKKREIPITVKLNKRSQYKSPYVTRSGRTVINPKRYLHAVVNKIDYNDPGWIKSMNAELEKFRSKDVYEEVPIPTGVKPISMGWVHTEKIDSLKGVVRKSRCVVHGNRQKEKLDYDPFSVSSPVIDLVTIRLLTIIGCELGMTIQHLDVESAYLNASITHSNPIYVFPPKSVTFEEKSLLGYETFCLWGKN

SEQ ID NO: 16730 - protein, 85 aa, Candida albicans
KMVLKLRDFQILCLYQELDKRAYHRYELSMLMGILVNWATKRQKIIIHSSATCEMLALNYSVLEAFDLRNIIQDIGLKVRKKHPY

SEQ ID NO: 16731 - protein, 169 aa, Candida albicans
KTGAASINCVMNIHNCSKTTFPVENSHSLNASLNVMNFKGLRFNKYLVYDTGATISVVNNKDILLNVKDATIEVSVADGATLEADCIGDLIIRVGIVSITLENTLYLPESSFNLVSLKQIEERGFNVLITKESVIVFNQNVAPTIIASRKNAADLYMGPQFSEESLECD

SEQ ID NO: 16732 - protein, 235 aa, Candida albicans
  UNSURE (190): Identity of amino acid sequences at the above locations are unknown.
KTGAASINCVMNIHNCSKTTFPVENSHSLNASLNVMNFKGLRFNKYLVYDTGATISVVNNKDILLNVKDATIEVSVADGATLEADCVGDLIIRVGIVSITLENTLYLPESSFNLVSLKQIEERGFNVLITKESVIVFNQNVAPTIIASRKNAADLYMGPQFSEESLECDFDYDGLADMLSNANRDDEDKXSMNGMSEYQEHDYSSRALINSLTEVDVLDVEISPYGIEKLVPTGE

SEQ ID NO: 16733 - protein, 208 aa, Candida albicans
IDEGENISFPGGDDDSVVINSNVEQSNVETEDAGNSPIQDEVSQEGRILNEQTDIVDTVAKVIENEKISPINSLDDHTELATDSGNDSNSTESDIQSKNEISPVINEKNTEIIQKHIESILADKRLDEFETYNVDEIENVINDDDIAEANPLPDENNDVQMNESFDNNHSMSRAKKKYTFEKEVNEKIAGTKHSLVFTTGLEGTKLAL

SEQ ID NO: 16734 - protein, 389 aa, Candida albicans
  UNSURE (5),(9),(10),(21): Identity of amino acid sequences at the above locations are unknown.
DQKQXIFEXXNAKKAKHTYNXSSYTVSLPMQVRYIMKRYWDRMRGDIIVPLSTVAGNIAMALILSSVFYNLQPNSSSFYYRTSVMYYALLFNAYSSVLEIYNMYEGRAIVQKHREYALYPPMADAIGSIISDFPLKVVCSVLFNLILYFMVNFKREPGAFFFYLLISFCSTLFMSHLFRTIGAFTNSLAEAMTPSSLLLFALSTFSGFAIPVTYMLGWCKWIRWVNPLAYAYEPLISNEFHGRVFDCSNIVPSGFGYPKTGNSVVCASIGALPGEFKVDGDLYLKLAFDYSYSNVWRNFGVLMAFIIFLFGTTIFFVQTNKSSILKGETLVFRRKNIRKMRKMEEDEEAYMDGMAPLDFSGSTEISDYSYDYMDRKFLHPDPDLSILLA

SEQ ID NO: 16735 - protein, 114 aa, Candida albicans
CGSFQPRGEYQKCQDYMGAYISIAGGYLLNPEATDNCKFCIMDKTNQFLDFMNISIHNFGRDTGIFIVFIVFNMAATVFSYWLFRVPKCNIEKGSFFDKLPFLNGGGDTNHENV

SEQ ID NO: 16736 - protein, 261 aa, Candida albicans
  UNSURE (11),(29): Identity of amino acid sequences at the above locations are unknown.
QTKGHSLFQQXMAKASQAEGHLYKGYYNXKSQGQPYHGYYSGFNKSASAQIHHLARSLTQGVQSHYDDTYTTATMHPNGINPISDKTDPTLDPESPSFSSKRWVQNMWKLYQSDSEYYKPGKLGVAYRNLRVYGDAIESDYQTTVSNGVLKYARNIFNKFRKDNDDYSFDILKPMEGLIKPGEVTVVLGRPGAGCSTFLKTIACRTEGFHVADGSVISYDGITQDEIRNHLRGEVVYCADTETHFLKYIATQPWKFRNRAR

SEQ ID NO: 16737 - protein, 77 aa, Candida albicans
RRQWEEVVIPLNDFVMTNWGVIQDGSELNKGEVKSVGIGLLDKHYGPYSLKIDWIKVMTGAEVAKVATKSRMERLHS

SEQ ID NO: 16738 - protein, 165 aa, Candida albicans
IKLYTYLSKMSMKALGLNATKSIFAKQAELTRPVQSVLNFKREPEKSLDQVLTRSDQELGGYSTVNFDIDPKEHCGHFYGNLSLDLPKDNPQVTRSGYAMFRTKDQNQSWLFGDSFWDWNNYSSLVLRVKGDRRQFLVNIQANTPLVTDLFPHRLFLNHPGTWET

SEQ ID NO: 16739 - protein, 175 aa, Candida albicans
IYTMSSVIASNIPSDVSPVKVREFFSFCGKITDLKPLDDNGKVKKYEVVFASPKAVSTALLLSDAELENTFIKVEEVPEITEGETGLAPEQGGAAAAAATTTTTTEKDIKEEPVLTGDKTYDEVDQEEKPKYAIFAQLLADGYVISDQVIAKGIEFDKKNGVSSRFNDLFTTEWK

SEQ ID NO: 16740 - protein, 512 aa, Candida albicans
FKPKPKAKLKFKLKPQGKFRPLVYGVSIVATGLGTAYYIDNHYYSSLMTRSVRAVYVLLWIAYAYGFNSNSYQNIDDLHEIASDKLLHLLTTNKGLYIKLRQAIANQGNLFPLAYQKKFSQLYDQAPVQSWQDIDRILKENLGDDYQIRLFETINHEPIASASIVQVHYGKLKNGEEVAIKVQHGYIEKQVVVDLMIYRFISKVYEKVFDIPLSMFTKYISEQLIKETDFVHEMQNSEKLKKFIDKDSSLKYDNIKLPKNYPHLTTKQVLTAEWINGIPLTNKQTLLDQNYDLTLIMKQYIKLFGRQIFEYGFIHSDPHPGNLLVRFDSKNKQQLVLIDHGLYITLSDSFRLQYCNLWRYLFLLNTKGIEQIGREWGISSIDLFATVVQLRPVLLSPEVQSNANANANANKNEDEDNRNISDLFRDFIGDQKKFPGELPFLSRTMRMIQNLNQSFGSPVNRINLLTKELINALLQEKDLKFGNYWDLVRIKITLLLSGFMFYIVRLRQILSG

SEQ ID NO: 16741 - protein, 912 aa, Candida albicans
IIIAVEHFFFHTTFHLLSSIMASSETLHTSNTSDSHITQKKNGFFNKLIKKSKDLKGLSKTLTQSELKSISLASRRSSIKNGKRDSIYSKQFVDDDNSSLYNDDMDDSTSIIDDETDDSMFETVDNSDSPASFEKIVTGNNSTFDNHTLSEKVMFPASTEGLDMDIPIDQEPPYVGLTYESFLSPKYVKTTRRNKQSPRVVNNLFLAQELNVNETAVNSGDAEAETEDEHDGLLHDEDFGGDTRREIFVMEFSKDGKYLAAAGRDSVIRIWKVISSPLARMEFNQLEKENGQPLRSNKRDSVFDTAPVFHRQPVREFRGHSSSVLSLAWSKNNFLITGSMDKTVKLWHVDRDRCLQTFEHEDFVTSVKFHPLDDRFFLSGSLDNGVRLWSVLENSVSYSKNLGDEVLITALEFSPDGLHCFVGGFNGSLFILETKGLFEVFRVEIKERSIVHPFVNKNGNKITGIKVFDNNLYQGSGVPGQLDKWTVLVTTNDSKVRIITTTQKRLITRFRGLTNNSSSIVAHSSDDQKYIISGSEDHYCYIWENNNSIINNKLKQSLKEFMIDGKQHISDFHHKHEKYSKFVSLNKFLNKFLEEDKDRKYDFVANENNSYTCFHAHHSRCNVAIFAPESTKKHLLLSDDLIYDLKRRGESCRISPSSCFTCNSKNHKLEDTVQSGDIIVTTDQFGLIRVFRQDCAYAYRRMFIDFYRKGQIKNCNDIQLITQSEKTLPIRRALTRRDRSTSRIRAPSLSPVRQSENSKSIRNILASKINSSVPSTPSSETSFSSTIGSSSIDTRHYPGVAVLPKNPMLSISAAARNPLFMQPGVSVPIDHDNVVEADRTGSDTTLGAEYGTQTPQPTLNQDDMQSSRTSTVPQIVFSKESESPDATNNNHHSQLEGVKINSQSQSRGRTKS

SEQ ID NO: 16742 - protein, 239 aa, Candida albicans
  UNSURE (234): Identity of amino acid sequences at the above locations are unknown.
NRTLFEEEKLLIMSSTTTQTPTVLWAQRSSEDDAAKNIIYLTIQISDPIDLKIDLKSDHLIIDSKSNDSVYSSIDYHLQIDFFKEIDPDQSKINTENGSHIFMILRKKDQQEEYWPRLTKEKLKYHYIKTDFDKWVDEDEQDEVKDDPNDFGGPGGPGGAMDFSQMLSGMGGLGGAGGSGGPGGVDLSALASQLGQAGGAGGAAGLDGEEGEEGEAEAKEAQEESNTTATEKDXSQITK

SEQ ID NO: 16743 - protein, 239 aa, Candida albicans
ITHTSFLSTKLISLPTNLLMNRTCMSIAYLLDTLPTDQNTPPPPPPRNILTEISNMNDNAGVNNSSESSVVTSISNTNQSVTVGSSYNPESDDYVHDREGFKRRIERLDETFVDLTSRENPSEEDTNRNIGKNGSPVKKKNKRDKEILNLLSLPPKQGSSRDSLGSLKLKERNVAKTKKIESQASIEFKEIVQSLIELGSEIDAKGLDTHPDIDKILESLSAIRMDFLHMLTNKKNLAQ

SEQ ID NO: 16744 - protein, 349 aa, Candida albicans
HFTMKRAFGDNSKPGVKKAKLHQDKEAVHNNENNDKTGLDVEIHPLLKNIGLTNIPKLPKDHNPLRQSNQKWFDPLALNPYLDQSDMVINNKKSRHIPPPLKFISQGKYVAQGEKLREKLKVEHEQTRELEAIKQQGLIPDETIGEQLYQLEVQPLIEWWDRPYLRDNNYMNINDESRKVLDDETQPITSYIQHPVLINPIWETKDSNSPIQPVYLTKKEQKRIRKNERQLKQQEKQDRIKLGLDPPPPPKVKLSNLMNVLTNESIKDPTAVENRVKREIQQRVDKHLAQNEARKLTKEQKHEKLWNKQEKDLANGYHTTVYKIDKLVNPKHLFKLNISAQEENLVRFV

SEQ ID NO: 16745 - protein, 647 aa, Candida albicans
KLFGPPVRSEDIVHESKELFTPKDKLINFFTNYIEYLPLNTVIFVLQYYSDSKMCSLLNPFWRENSMKLLNHFYLPSDIDVTVKMRCIQVILDAYNTSVAIFNDNDIKYEIILEIAKRSLRETNEELLRYLINNLFGVVFLKCPNPVFIQLMTVFLPLFQPQIPPPPKSLHLVFEGLITLSFVTSTRVLGTVQEHGSIEFTEAITKLLCTTFIKATPERAQECYNFLIQIANLSKHNCNILLIIAKCLVRIRTTTENYIYFTQPSDMAGLALAFRRDNSTTCSGNTNVLWVYPETVDYLPEELFDSPNRSLLLSRVDNGNVDDLGSDKYYIDIQKWLQLVLFIMDQYIDWEIYSYVWAHFVSQLSNTQLFYDCDLEINELRKIICYQLTLNLPTNIKLPHKTTPTTTTAATTNVNIEVTKADLQVVFVRSLSSLTGYFNKFTKPDQDQIVNSLIFGLGSWDKTAVPCINILTVCCYEIPLSIKKYLNSILTKLQTRITSANAAAHSLEFLISLSQLPNLTTNFTIEDFKLGFGIAFKYIQYAIDLEKRSHQQQQQQQQGHLQLAQIIQQHGVDADVEETPLTQQQTITPILSEYILMLSYHIIASWFVTLRMSDRVELQQFIIKNLKLCSEINENLQDQTIGFLDFY

SEQ ID NO: 16746 - protein, 383 aa, Candida albicans
KKTMVVDQLKNNIVLISSNIGTHIKDGYKYTESEFKNISYNIEDTVTFHTRDYDKDDELVEIYYHDIKQSVSGLKYITSQNHHLSKSFLPHVLSLNIKIIKGFINLIGQDSLRFDKINEYYQEFDSWQATQEIPHVHPKEMQFLNESINEELNNYLITVENLKFDLENNWEAYDESLKYRIDEMKKYLKKTLKLIKKRNMKRTEQDHLHRKIEKLNQKAIPLDEKDNDKLEKLETTYQTVDAAFNSLNKKCIQLLPNIVSFLDEFVENITKMILCQQLETFKKLTDTFQYFTEFYGLIKENSPKSYTEIIDDWELNSTATRLQIESLLTIVHEKHPDLLDKEINDEDSLLNYYRFWRNMSNKFVEKKHVVNTKDKVNGIFNDT

SEQ ID NO: 16747 - protein, 260 aa, Candida albicans
VSHRDAYEDMKDKEYEAFIAVEERYKLNDQYNKKLKSFQNNQHAEYIKLTNKLKSLQNYESDLIDNKLKYIDNLKNYQTNGLAHLYTHNYSDYLRMRSQKRSLEEIKDAEDMKQELEEIKKNGGQVASTNTNTNTKPSTYSSGVSELATTSVETPKSTTTTTTTNDTTDEPVAKKSKLAKEIIIIDLPPTVKQSLQEKIVELVENSLGIKDEFLIQVINENLEASNLDNKQELIDELVQVLDEDAESLVNELWDYIETMV

SEQ ID NO: 16748 - protein, 112 aa, Candida albicans
SHIWCLRISSQLDKIPLFSRNMSENTSQELKDELSSIQKNSINYSILTSDQDFHNANIKLNNPKLIKDELLHYQNIFSKLKFLYLEQETRDIFLREISEINYKLPPKRSNFH

SEQ ID NO: 16749 - protein, 414 aa, Candida albicans
LGWKRNCIKKIGEPAPPYSSLSAPTQFRFLFPFPHEINPTHINTTGQLPSHLFLFFFFFQITNYLLLLLSYIDLNPLTTPPSMPIPVSMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEVKRLGATEVINFETEPDGIKKYITEETDGVGFDAVLEVVGSAAAHKTSFDAVRRNGFISSIGMGHEPFPFNGLDVYLKNINMSFGRCHSWSLFPDLWLFLKR

SEQ ID NO: 16750 - protein, 460 aa, Candida albicans
  UNSURE (273): Identity of amino acid sequences at the above locations are unknown.
TARTAQLFHHSPIMTDLTKQPLKGYDNLSTPTLFNDRNLHPIARSFTTNILIVGGAYSGLSALRSLQLHLAEQIQRFKQEQPSTPIKKLSLTIVEPRNGLLNILGIPKSIVDSAFARTQFIPFKDLNNCKFANIFSDTPGEYDISWFGDDNEWLDINYVHGRVTYLDQHKAQYTLGSPVSEKAIIEFDYVILATGRDRNWPTTPLATTYGQYMLEMDNARQEIANADTISVIGAGAVGIEFAGDIKTKFPHKTVNLIHPHECFPQEPLSNEFXRLTQDSLERAGVNVYLNTRIRAESIETRHGDLTTTNNKTIHSNLNIWSCSKHNNIGFLSQHIYENYVTSNKNISINQYLQLYNAETNTTIENFFVLGDLVELPIIKSAGWAMYMGRQVANNLSNLIFNGIFVELFPDLNAIPYGMVIVGGNNEIISELAGEVEVDNEHYKQEYEDYCIGKIRATIDM

SEQ ID NO: 16751 - protein, 330 aa, Candida albicans
FANIFSDTPDEYNISWFGNDNEWLDINYVHGRVTYLNQHNAQYTLGSPVSEKAIIEFDYVILATGRDMNWPTTPLATTYGQYMLEMDNARQEIANANTISVIGAGAVGIEFAGDIKTEFPHKTVNLIHPHECFPQEPLSNEFKRLTQDSLERAGVNVYLNTRIRAESIETRHGDLTTTNNKTIHSNLNIWSCSKHNNIGFLSQHIYENYVTSNKNISINQYLQLYNAEANTTIENFFVLGDLVELPIIKSAGWAMYMGRQVANNLSNLIFNGIFVEPFPDLNAIPYGMVIVGGNNEIISELAGEVEVDNEHYKQEYEDYCIGKIRATIDM

SEQ ID NO: 16752 - protein, 318 aa, Candida albicans
PLNAMLTFQAAVKIGRKVPAFVLDDISDKDLATVARRIAWGRFVNAGQTCIGVDYVLVAKSKHDKFILALQEVIEKEFFQDVDKTRNFTHMIHDRAFEKMESILNTTSGNVIIGGKLDHGTRYVGPTVIDNVTWTDSSMKDEIFGPILPILTYTDLEKSCREIIANHDTPLAQYIFTSGPTSRQYNSQINTITTLVRSGGLVINDVLMHIALHNAPFGGVGTSGNGAYHGEFSYRAFTHERTVLEQHLWNDWVLKSRYPPYANKKDKLIASSQQKYGGRVWFNREGNVRIGGPPLLFSAWNNALGVAELVRDFIGAGL

SEQ ID NO: 16753 - protein, 316 aa, Candida albicans
ACTSLSPTTMSKPSAIKKCKASAIKPSGNSKSKTPKIETPKLQQVETRLEGEVPTTKVSIKRNSITTESVKASEDNFTPQSTDTPAAAVAKSNPKTNAEPAKIPNEKLLKTESPLSQKQNGATTTKEKSDVLLETKSTSSTTVSNNNSVLQYTELSEIPIGVERITKAFHSGKTHSLQFRLKQLRNLYFTMKDNQEALCDALQKDFHRLPSETRNYEFATGLNELVFIMSQLHKWSKPQPVDELPLNLSLNPVYIERIPLGTILVIAAFNYPFFVSISPIVGAIASGNTVALKPSELTPRFSKLFTDLLSKALDPE

SEQ ID NO: 16754 - protein, 495 aa, Candida albicans
  UNSURE (477): Identity of amino acid sequences at the above locations are unknown.
FDYKYQGIFILPSSSCFFFPNFPQLFVLSNFPFVQKMSPPSKIDESFTDIGNTSTSWYTEIKSIEPGVKHLTDSLFTKQKTHDIQFRLNQLRNIYYAVQDNVDALCEALSKDFNRSASETKNLEIVGGLNELVHTIASLHEWVKPEKVTDLPITLKSNPIYIERIPLGVVLIISPFNYPFFLSFSAVVGAIAGGNAVVLKQSELTPNFTRLFSEILTKALDKDIFLAVNGGIPETTELLNQKFDKIMYTGNNTVGTIVAKKAAETLTPVILELGGKSPAFILDDVQDKDIEIIARRIAWGRFTNAGQTCVAVDYVLVPKKLHDKFITALKKVLNEEFYPKLDKTDKTYTHVIHDRAFTNLSKIISTTKGKIIVGGETDPETRYIAPTVIDNVSWDDSSMKGEIFGPILPILTYDKLTDSLRDIIRYHDTPLAQYVFTSGSTSPKYNRQLDQILTTIRSGGLIVNDVLMHVALINAPXGRGWSIRVMALIKVSFRS

SEQ ID NO: 16755 - protein, 202 aa, Candida albicans
VIYIFLFFSLLTHSINIKIKTMKAAVVPESVTETKLAEVKEIPKPTIGDDQILIKAEAAAVNPTDWKHIVFQMSKPGDVIGSDVSGTVEEVGSKVTNFKKGDTVSSFIIGNISPDSGAFGEYVIAYPQATIKYDHSLSHSSATNSSTIKSYEGAASVTLGLSTIGISFSHYLNIGKHKKEGDSILIWGVLLSSHAAGRNRTC

SEQ ID NO: 16756 - protein, 141 aa, Candida albicans
IYNFIIYYTINLKHYTTIMQTQSGYGYVEGYSDIQKFTDIPIPTPKGNEVLLKVEAAGLCLSDPHVLIAGPIESKPPIPLATKFVMGHEIAGSVSAVGEQLVNDPNYKKSARFALQIAKACGMCDSCHKRYDGVCDLSHQA

SEQ ID NO: 16757 - protein, 290 aa, Candida albicans
ILRDISNLKNRKTSYQENSTHKLAMSQLFSINGQVAILTGGTNGIGLGYAKGLASADLDQLILTYRSESTLEKAKKIIHEVNPNVQIDGIKIDFLKDEEDEIITKIVEESYKLSKTSNIDILVNNAGITERYPFEDFPQDKFDDVIKVDLNIPVKLTKAIGRKMLETNTKGKIVFTASLLSFQGGMLSTPYAISKGALKQFTQAVSNEWSSRGIRVNSIAPGYIKTNLTDSMSEENKKIVDLRIPMKRWGNPDDFMGPIVYLTSDASKYVTGDTLLVDGGWMGRYIHEIY

SEQ ID NO: 16758 - protein, 93 aa, Candida albicans
GPDADYIVVYAKTEPEKGSKGISAFVVEKTFKGFSCARKLDKLGMRGSNTGELVFEDVFVPKENLLGELNKGVRVLMEGLDLERLVLSAGPLG

SEQ ID NO: 16759 - protein, 545 aa, Candida albicans
STTDLNFFHPPRRKMKTEAAVEEAKKKKICARSDLGSLSSSIKHNIITNNTMSSFQLTDESDNDQDSVLEFERLESTLPPALKRSASSLLEAIQASPTTPLHNPISQSGNHHAHDESSLRSPQPHHVRENYHASTYQTIPGRTPLATPNLKNSNFRQHLISKLSKLENGRESSPIPLPKPRFNESTFKPALNTKQSSTGVLWVTERAAEYGYDSEHVGDWANLGQGAPEHGDTIPGSFPRPKQINLPVDYREYAPTAGIKELREAVANYYNEEYRQGKASKYTYRNVCIVPGGRAGLTRIATIIADCYLSFFLPDYTAYSELIATMKNFSPIPVPLKEMDNYEMHLDLIRDELARGMSALLTSNPRNPTGNCLSRDQLQELHRMCREKCLIIMDEFYSHYYYDEGCTGSSISSAEYVEDVNRDPVLILNGLTKAFRLPGWRICWILGPEDYINALSSAGSFLDGGSNSPLQHVAVDFLQPLKVKQEMMALQLHFKMKRDYIIGRLSKMGFKFTKKTIPNSTFYLWLNLSHLPGKLSNCLGLFSPR

SEQ ID NO: 16760 - protein, 205 aa, Candida albicans
HVGLQVKPEHYPKLGQVLINVIINLFPKQLVHDEFIEAWTLAYQNLANLLIKLESEQYVEKPWYGFKQFKVTRLQRECSDVKSLYITPVDGSPIPKPKRGQYLCMRWLLPGEKHEITREYSISEYPKNNEYRITVRYIPGGKVSNYIHNNINVGDIVYSGPPCGDCVYESSLKNLVFLAGGNGVTALLPMIEPVSSPRVAGKRLG

SEQ ID NO: 16761 - protein, 99 aa, Candida albicans
MTVASASIINNYIESKPLTPVHIQIIIDSVPILEHLDVQLIEKFYRRLLKQYPEFKPFFNETHQKLLRQPRIMIHFLIQYAKNIQDLTPMIDFIKKIDS

SEQ ID NO: 16762 - protein, 422 aa, Candida albicans
FYVVLYHYRIDNFTLDNFRTEQLNMTVEYETKQLTPAQVKIILDTVPILEEAGETLTQKFYQRMIGNYDEVKPFFNTTDQKLLRQPKILAFALLNYAKNIEDLTPLTDFVKQIVVKHIGLQVLPEHYPIVGTCLIQTMVELLPPEIANKDFLEAWTIAYGNLAKLLIDLEAAEYAKQPWRWFKDFKVTRIVQECKDVKSVYFTPVDKDLLPLPKPERGQYLCFRWKLPGEEFEISREYSVSEFPKENEYRISVRHVPGGKISGYIHNNLKVGDILKVAPPAGNFVYDPATDKELIFVAGGIGITPLLSMIERALEEGKNVKLLYSNRSAETRAFGNLFKEYKSKFGDKFQAIEYFSEDNNTDDKIVIDKAFNRKLTTDDLDFIAPEHDVYLVGPREFMKDITEHLGKKNVPVKLEYFGPYDP

SEQ ID NO: 16763 - protein, 307 aa, Candida albicans
RKLGSCQPAGEEHYLDELDAAMNEKFSDKLFANSSETEAKQWLSKTANAQPAILASTCILSNLVETEHQISIIDNASYLLGHSLGEYTALVLSGIIDFTIGIKVVRRRGQLMEDLCLGQNYGMIALLIKPKFAKEVIELAQEHNVLGNINSNYQVVISGEITKLKEFIDILRKIQKMALIKAVQLPVSIPFHSEILKPVVPELKLLLDGALNDQKIPIISNLNGQVSYEKESTIRNILEANYQPVQWQKSIAYLENSPVSTIFNLGPGEALHGINKKYNIKSVSLDDVKSLDKNSEFMELKQQLKQN

SEQ ID NO: 16764 - protein, 262 aa, Candida albicans
LLYNMSSITLAPESQIKGKTAIITGGTKHLGGETARELAKLGANLFLHYRLDANQAETFKQELTKEFPDLKIEIYGSKLDKAKDLTKLFTTAKLKFPQGIDIAINNVGKVLKKPITEISEEEFDEMDIANNKSAFFFIKEAGISLNDNGRIVSIVTSLLAAYTDSYGLYQGTKSGVEYYSKAASKELHGRGISVNCCAPGPMDTPFLYGQETEQSVAFFKTMGLHGRLTKVSDIVPIVRFLVTEGGWMTGQTLYASGGFTAH

SEQ ID NO: 16765 - protein, 361 aa, Candida albicans
EKKMSSKQQYLKKNPDDVVVVAAYRTALTKGGRGGFKDVGSDFLLKKLTEEFVKKTGVDPKIIQDAAIGNVLNRRAGDFEHRGALLSAGLPYSVPFVALNRQCSSGLMAISQVANKIKTGEIECGLAGGVESMTKNYGPEALIAIDPAYEKDPEFVKNGIPMGITNENVCAKFNISRDVQDQFAAESYQKAEKAQKEGKFDDEILPIEVFQEDEDAEDEDEDEDEDAEPKEKLVVISKDEGIRPGVTKEKLAKIKPAFKSDGVSSAGNSSQVSDGAALVLLMKRSFAEKNGFKPLAKYISCGVAGVPPEIMGIGPAVAIPKVLKQTGLSVSDIDIYEINEAFAGQCLYSIESCNIPREKVN

SEQ ID NO: 16766 - protein, 193 aa, Candida albicans
  UNSURE (8): Identity of amino acid sequences at the above locations are unknown.
GMPTLAPXYLPDNIHVTLQSENGILGLGPYPKKGEEDPDLINAGKETVTLAPGASLFGSEESFGMIRGGKIDLTILGGLQVSSKGDLANWGLPGRVKGMGGAMDLVSNPSATRVVVVMEHVDKKGRPKILEECQFPLTGKRCVSRIITDLAVFDIIDEKLILVEIDPETTVDEVTSKTGAKFEVAKDLKKIEI

SEQ ID NO: 16767 - protein, 302 aa, Candida albicans
IVMKLLAKKTTFLVRFVSTTRPKSKVVTTTDEALKGIGSNITLLSGGFGLSGVPDTIINAMVNHPAIKNVTAVSNNAGLDGRGLSQLLVTGQITKMISSYIGGNRTFEKLYLTGQIDLELTPQGNLAERVRAGAAGIPAFYSSAGVGTWLEEGKLPVRYDSTGEKVLKTSDPREVREFNGRKYLLEPAIQGDVAIIKAFKADTLGNCWFRGAARNFNSVMGRNAKLTVVEAEHIVEPGEIAPEDVHLPAIYVDKIIQSTTPKDIELFTFSDEKSGNESNQKLEVELKRAKIVILTPGLPIPR

SEQ ID NO: 16768 - protein, 402 aa, Candida albicans
RIFQPRGWRRPLIQLRYRSTKPFYITTPIFYVNAAPHIGHLYSMLIADTRNKWEKLNPLKESFMLTGTDEHGLKIQLTAEKLGLEPKVLVDKVSQNFSKLAEQFDVNYDRFIRTTDNDHIELVRYFWNLMMEKGFIYTDTHSGWYSISDETFFPETQIEEVVKNGKAVKISSETKNEVVYQKETNYFFKLSMFQEQLIQFLKQNPEFIKPKHRYQFILKELEDTKLPDLSISRPSSRLKWSIEVPNDSTQKIYVWFDALLNYLTATKFPHGFEVQDSKFVTPENSIWPATHVIGKDIIRFHCIYWPIFLMAAGIELPKQVIVHSHWLCDGFKMSKSLGNVVDPMEISEYYGVDPVRFFLVENSNIDDDCKFSEELLQRSRDAVLGKYCNLISRIGGKNFSIE

SEQ ID NO: 16769 - protein, 300 aa, Candida albicans
IRSFHGCCEYPNPTEWALLTPLNSLKDFTTEVDSQLHFIVTMVPEGKHVKSVVSELVGHYKSTGNYDPSIKTTFLDSSTIDIPTSRDVHQLVKSSIPEFDFIDTPVSGGVAGARKGTLSFMLSRETHDDIDPSLTALLSKMGINIFPCGATHGTGLAAKLANNYLLAITNIAAADSFQLAESFGLNLQNYAKLVAVSTGKSWASVDNCPIPGVYPDNNLPSDVNYEGGFITKLTRKDVVLATESAKFNNRFLMLGDIGRHWYDKACEREDIANRDLSVLFEWLGDLKQNEKGDVIDVKRK

SEQ ID NO: 16770 - protein, 539 aa, Candida albicans
ASHNMLLHRLIPRVIPRVGNFIRPFLVSHYLTTSDADNLTYENRKGIITNDGKNHVDSKYYPLLSVVRQRLAGSEKLRVKEFCKNFKDVVKFLDIDNNRLCEIYLLEGRITSIRKSGKAMYFIDIVQDDCSVQIMATNKLMGMDPTAFNDCHSFFKIGDYIAVRGYASRTKTGELTLKLNKQIEMLTPVLLKMPNRLEDRGLINNNRVLNYLVNRDSKDAIIVKSKVIQAIRNFLLDRDFLEVQTPILSGQGTGANATPFVTKFKGEPVHLRVAPELWLKKLVIGGFDKVFEIGSNFRNEGIDMTHNPEFATCEFYQAYTNLDELMKMTEDMFGYVFDKLGVTDKFPTGNFPKYEFLPTIEQKTGVSITDLTLDGLVNYHKRLDLAVPPNPNPVKLLNNLSEIYLESICSEHPNTPVFIYNQPEIMSPLAKSITDAAGNRISSRFELFINAREMANAYEEENDPCKQLEKFKLQQKMKADYNDQEMLIPDHNYVWAMEYGLPPTGGWGCGIDRLAMLIAGANRIEDVLTFGTLLSVLKN

SEQ ID NO: 16771 - protein, 620 aa, Candida albicans
NLHLNYLTRLFPSTTILFFRKQLKRFMNKYPKSIMSKQFMKFPSRRSTVYSAKGIVASTQPLANAAGLKILDKRGNCVDAAIAVSAALTITEPGSTGIGGDCFALYYKLKDKLDPKSGVVLGLNGSGRAAQNVTPQDVWNEHNEGKYMPRIPYTSVFSITVPGAIAGWFDAYEKWGSGKVTFEEILTPAVQLAEEGFPVSELSSHAWRNCIPKLLKQNPDVKENPFVLEGNRGPEEGEYVTNHRVAECLRLIGKHGKKVFYEGAIAEAIIKTTSGRNHKLTLDDLKNHTSTIVEPIKLNFQDYNVWEIPPNGHGLVALIALGIIQELHNLGKINLHELKHNSSRYLHILIEACKLGFYDSDEYVTDPTFKDIPIDGLLNPKYLKARSELVDSNKIIDGDKMKHGVPDPKFKSDTVYLTVSDSNGEVCSFINSVYEGFGSAILVEDYGFCLQNRGNNFNFTAGQSNCLEGGKRPYHTIIPGMITNNDGSLYAGFGNMGGFAQPVCHVQHVLNLTVFGMTPQQLIDSPRFVLNSNNDDSADRGRGAGGPVRTPITVVQLEEGIEPNVIDDLKKLGHEVEVLSGYGRETFGRAQIIKNVSKDGKLIYAGGSDMRGDGAAVALI

SEQ ID NO: 16772 - protein, 430 aa, Candida albicans
FIHPCYQGLIWKNNFFINKNRTHIGVSKLATRNKSIICYSSTTTEYPKGHTTGNGEPYLTPSFVNNEFIKSESDTWFDIHDPATNNVVSKVPQSTLEELEDAIVSAHKAFPKWRDTSIIKRQGIAFKFVQLLRENMDRIASVIVLEQGKTFADAQGDVLRGLQVAEAACNVTNDLKGESLEVATDMETKMIREPLGVIGSICPFNFPAMVPLWSLPLVLVTGNTAVVKPSERVPGAAMIICELAAKAGVPAGVLNIVHGKHDTVNKLIDDPRIKALTFVGGDKAGKYIYERGSQLGKRVQANLGAKNHLVVLPDANKQSFVNAVNGAAFGAAGQRCMAISVLVTVGKTTKEWVKDVVADAKLLKTGSGFDPKSDLRPVINPKSLTRAEEIIEDSVQNGAVLELDGTRYKPTNDPETKFTKGNFLAPTILT

SEQ ID NO: 16773 - protein, 783 aa, Candida albicans
FLLDPKVNHHQDGSQEHGGDNDNNDEDDDGDEDLKAIFNFIRHKLRNISSYSADSKRLILKDFKRVKASANSPGGGGNSDFHVKRNYLEIVMDIPWDNYVTKFKSNKDIDLKLAKKQLDDDHYGLEHVKKRLIQYLVVLKLLGINAEKDQALQSKDEENSKNPAHYDSNSNSNCNSNSRSLTKSPTSSLASKTPSYIVIANNDETYLAKQQAKTRNQKSITEAKTNVSTKMVPSNESIQVSKNNKSPIIMLAGPPGTGKTSLAKSIASALGRNFQRISLGGIKDESEIRGHRRTYVGAMPGLLIQALRKSRCMNPVILLDEIDKVIGGNSGGVNKFNGDPSAALLEVLDPEQNNTFIDHYLGFPVDLSQVIFICTANDPWNMTRPLLDRLEMIEIGAYDYNEKLIIGKKYLLPRQIKRNGFPVTKVGKNNTGNQDEFIKINDDTMKKVILDYTRGEAGVRNFERRLGTLCRFKAVEYCEWLNKDIKNYNPIIDENDLPIYLGVPYSLGDVTTEGTVGVGVVHGLSYNSDGSGSVLVFRSIGFDRRISNGNKEHNGGDGSGGNGATLNMTGRLGEVLMESGKIGLVFIKLMIYKNILKFDNNNNNNTNRHLLLDKYNNLDIHMHVPMGSVSKDGPSAGVTMALLFLSVLLDKPVPSDIAMTGEITLRGIVLPIGGVKEKLMGAHLNANIKRMIVPRENRKDLIKEYSRSIEEAGEVLDHHLINDLIKDNEDNEFKLTQVEDYYQNKYGISLFYAKEFYDIIKIVWNEDEVLLKENNSRLLEYHI

SEQ ID NO: 16774 - protein, 201 aa, Candida albicans
TMLSSLRLSSIRAVNSGSIRFVSSTVPKSNAKLSVGDSNDTSSKTNIDDMKSKTSWNESYTSGSSIQVNLNENLNKITENISSSDPPIYVSPNLHRHFTMGDTYNPFDFSMNRFDMEKKMKSTKKLSDPFEKSGIDPKNLYLMPEILSKFLTSTGQILPRQVTGCNAKNQKRLSMAIEYARSLGLLSSQHRHARYMPTRNL

SEQ ID NO: 16775 - protein, 247 aa, Candida albicans
  UNSURE (240): Identity of amino acid sequences at the above locations are unknown.
SNKYHSKSINCYQNSYIEWLFFFQLLIMQSGFSKNKQFYTYIPAVNSSSTKLLLFLHGLGSSQNFYYPIARKFPQFNVLLIDHEGAGQSKLLHHTNLSLQDLSENVVSVLQELSLNKLEITLIGHSMSGMLVSYMNLFTDLPIIENVLIAPVHPRKNLVDIMQKRIDSLQVSKSLIEFSNTIPEAATGSNCGDLQIAFIRQLIQGNSVDGYIANCQAINSGINYDFDYARINKPTLSSTXGARRSAS

SEQ ID NO: 16776 - protein, 734 aa, Candida albicans
INNFMQPTVPHFKILGISPTSTLDEIRRAYRKLSLRYHPDKTPRREDHEKFKEINIAYETIRDYYQENGQKNSQPIPNTNTEHNSHQKPHYNTGPYSTYRFTTSSTTTDNTNHTGHSSSRFTYYNFHQKAQENNRKQDEERAAQRERLKKELFQRQQAEEAQRKKEFEQKAEFIKASLLEMRRREIERRKQQKEREQRQKEHEAKRDIRIQQLSEQDSRSNQTKEEEEVFKKARSTDSGADETGLMSDKEFDDSAYSPDYLFEENLWNKPNHPDTNHKTKKYTENVVESLDSPPNDTSAYNSSFHDETNIQNEIQIPENDEYVPQMKATSSVNNTTIPAQRRHESLSTSENKRRKFETADVGVDGLDSPVRAQPEISAKSKSPIIPDVILLLDEETETPEANAVQDNSTYIPQGSLGHEFRNILEEHPGQVKNKQNSGVAFAFPNASKNTENKLHSNFKDKDEGIIDVEAYVPDVKAATSNTTPATGQTSARLEKLPPLPTHIPNPLTMNEARPHPTTPHKRSKVIFDLKDLEQKLGNDIEDLDFKEMYESLPDHSSKATPRDDIITRSKRRLYTYTDGTSKAETLSTPMNKNPVRGHSTKKKLSMLDMHASSKIQSLLPPQPPQMSIDPSVSKQVWAKYVDAILTYQREFFNYKKVIVQYQMERINKDLEHFDDINDGSHTENLDTFKHCLEQDYLVMSEFNEALRQFGTTIATYQQNLQWVNTFMERDPNWL

SEQ ID NO: 16777 - protein, 197 aa, Candida albicans
KILTYQKSMAFPPEDIAQIVLEIATILRTRNQTLAVSEAACGGLISAYLVSVPGASDFYIGGKLLYSMKTRLKLSGWSENEINNYMGPSEQVALKLARTTKYELGSTFVLSETGFAGPSTALHLKKDEETKDNNNNESGVVDADGVGTVYIGLSGPNGDASTSYHTGKTDRNVNMSEFAKLGLQFLLEQLQQQQQQK

SEQ ID NO: 16778 - protein, 185 aa, Candida albicans
SFSVQILLPLPKLFFFFPFKTQTIIITTLMTIDRSVTIGVLALQGAFREHIAYFKHLIESNPDEYAVYDFDIKEVRTKEDLELCDSLVIPGGESSSMSYIAERTELLPHLYKFVSDESKSVWGTCAGLIFLSKQLINGIENQRVLGALDIEVSRNAFGRQIDSFEQSLDFSSFIPGCTDFPTVFN

SEQ ID NO: 16779 - protein, 392 aa, Candida albicans
IIRSTPMESNKFGIKNKMRKRQVDYVLLKLVNAISGSLLGGPTSPATPDLLQMKLIDGEYQFDRKKLIFYYWTSRRIDFRDLVRELFRIYKTRIWMCAVIGLPYQITSSNAMGPTTTTTTTTTTLTSLSSPSSRRNSNSPPLAPSQQIQQQQGIARSGNFINPLMQQPVQPPQQQQQQQQQQQQYTSNRIDRRLSFQMPSSCTSSTCQQQQQLQNRSNSCNYYPPSLISFHNNQQSQQQQVPQQPQEFIPRRYSDSRSGTIQQQQQQQPQSFGRFGGGSLKFQFPDHQHQQQQLNPQQNLGSTTTSYLQEESMMLLSPSIPIFSQRRTNNENNDDNVKENDENENVNDRDKNENEDGDRDEQEEEEEVEDIFNNNHSGESFVLKSLVDSINH

SEQ ID NO: 16780 - protein, 370 aa, Candida albicans
  UNSURE (12): Identity of amino acid sequences at the above locations are unknown.
IRILGAPCPVVXTDVLLSHHSLTHSINDPHSMAITNVLFRKSLDRLFNGNAPKKVAVALSGGPDSMLLTWFLLQCKFEIYAITIDHKYRPESSREALSVYERVKNWNLNHIIKSLDYPAGVDPTKLNNFEEIARGKRYEAMAQVCYDKDIPVLFLGHHRDDQLETFIQRLQGNSSIFGLAGTHKVSPLPISKDLSPTSALFNQTSQVRILRPFWDYDKQDILETCQLNNIAYVTDPTNKDVSLTRRNYLRHLINDIIPAKNNQSHSPYLLIDKSQLIDLHTKCLEFATMFENRAMALSESLQSSGLIKEFPALGSLQVKFPRQCLDQTNGIVTSRFLYRILHSYSTLKHYHWAYAKLDRQLILHNIVDHG

SEQ ID NO: 16781 - protein, 330 aa, Candida albicans
LIPYSSSVNHSTDYLTSTVMGRVQDILEKRKLVIDGALGTELERLLPTTSTYLPSGSPLWSGQVLIKNPGLVEQVHLDYINVGADMIITSTYQTSYASLHKYIGYDMDQAIALWNLALNVAKNAVKKSGRDDVIIAGSIGPYATLLANGSEYNGDYQGVTDEELIEYHTPLFEFYENSDVDIICIETIPSFQELKVIIGLAKKYTSKEFFISINPQTGSALSDGTSLIEVAQLFAEINDPRFVAVGINCTSYENVDQISTYLTDFPLFIYPNLGFVYDTTVHKFVSKVLQESTWSKSVAKWLAFPNVKAIGGCCSTTPAEIKQVAQLINQ

SEQ ID NO: 16782 - protein, 160 aa, Candida albicans
SRGDANKPLTVHETYRNTLIISILGIPGSLIGGILVELKIGRKGTLFLSLILTGIFLFGSTTAKTSKANLAWNCMFSFMSTIMYGVLYAYTPEVFYSQIRGTAIGLAASFNRIMGVFAPIIAIYADLTTSAPIFVSGALFIFAGILSLCCPYEPRGKPSY

SEQ ID NO: 16783 - protein, 97 aa, Candida albicans
LLSADSASLVVNIYCALYIYYGVMYAYTPEVMPSAARATGNCLCVFITRISTAMVPIIAWYSDTSSAVPIWICGALIGVIGIVALALPFEPSKQRVV

SEQ ID NO: 16784 - protein, 308 aa, Candida albicans
SLIAKCPEQAPRAMYLLVKYLIEAGVPVNVLQLVHLKPEDHPKFLDALLATGAIKKIYFTGSTLIGKKIASTAAIYLVPCLLELGGKNVSIVCQDADITKAVGNIIWSAWTHKGQICMSTDRVFIHDTIYNDFKLKLIKVASEMVQDPDYSIAHRDPLGANKVKELLNDALQKGASLVFGNPDDSELKRNNVVSPMILEGVTPEMKLNDTESFGPIFAIEKFTDVNNVVDVVNESDFGLKASIWSSNLMNAIDLAKRIECGGVHINNSSIGDASHLPHGGVKASGSGRFNSKWGIDEFLFIKTITANP

SEQ ID NO: 16785 - protein, 324 aa, Candida albicans
VKVEKLSKEPNPKKPGKEKLVTTPQVTCHQFMKVPPMASLGLAEIIESKSEKYQKGDIASGRIYWADYAVVPDVVFFNKIDKSLGLPLEFFLSILGMTTLTAFFGLTEVGKLKKYLDGPKEGEKGPVVCVSAASGATGSSVVQIAKHLLGASKVIGISGSDEKCKWVESLGADLCVNYKNSEWKQQVSDYLAKDNEGIDVYFDCVGGEILSFILTKMNKFGHVAACGAISGYNDNKAFAVTSWPFIITNSLNVQGFIVGNFAAQFPEAIKILGAAVKEGKIKAQGAYHVEKLSGDEPSKRLADIPINLEHVFRKITTHTGKLFI

SEQ ID NO: 16786 - protein, 198 aa, Candida albicans
VIINTNKDIQGLFILFLILTFFFLFLTAGSVIGGEISEHFGFIRSMESLSVIWIIGIIFAFILDTITMLIIGKIINGIAIGMAFVTIPIYQYEIIPVQNRGRILSIFIFSCALGNLFIYVIRLISERFLNESKYSRLFWAIEVIPLVFAATFIASIPESPKWLAANCEWTSAADVLKLIEVNNSSILKRPINIERRIR

SEQ ID NO: 16787 - protein, 207 aa, Candida albicans
ELNEINYINRGRIPLPYLPFPSSCFFSLNIHFISNLQTINMPRIKQVDVFTNVKYLGNPVAVIYDSDNLTTQEMQKIARWTNLSETTFILTPKSSIADYSIRIFTSGGNELPFAGHPTLGTAFALLEDGKIKPNDNGQIIQECGAGLVKISVEKTPNNNSNELPFLLSFQLPYFKFHEIDDKVIEELQHSWNGTDLYCLHNGWKTAS

SEQ ID NO: 16788 - protein, 232 aa, Candida albicans
ELNELNYINRGRIPLLYPPPPSSCFFSLNIHFISNLQTINMPRFKQVDVFTNVKYLGNPVAVIYDSDNLTTQEMQKIARWTNLSETTFILTPKSSIADYSIRIFTSGGNELPFAGHPTLGTAFALLEDGKIKPNDNGQIIQECGAGLVKISVEKTPNNNNNNNNNNSNELPFLLSFELPYFKFHEIDDKVIEELQHSWNGTNIIGKPVLIDAGPKWAVFQLGSGKEVLTLEC

SEQ ID NO: 16789 - protein, 141 aa, Candida albicans
  UNSURE (128): Identity of amino acid sequences at the above locations are unknown.
HLNVDLAQIERLSLENGWTGIGVFGKHNENGDSVELRNIAPAVGVAEDPACGSGSGAIGAYLANHVFNEKEKFTIDISQGKPIERDAKIQVKVNRLSTKNGDLSIHVGGHAITCFEGTYFYLKLDIIXELYLIYLIHLSLE

SEQ ID NO: 16790 - protein, 176 aa, Candida albicans
RPIVTLAIPYLANLHLWDLLWYAPEQFYLSSYFLTMQIASVYRPKLTESNDYLKYLWKYWSPSYNTSKEEIDEIRNAFTKDNVVDAVTSYYRHLFRPFSLVKSRWPVDFNRVPTLILVGKEDGCMSPRIAELEKEKLKDFPKAEVKILPNAGHFLQREQPEIVAKISIDFFEKYSK

SEQ ID NO: 16791 - protein, 170 aa, Candida albicans
NLTLDNARVGEIASAIKGQDAVVFTVGSAGKNLLQVDLDAAVKTFEASVEAQVRRFIIISALHADNREFFSKLGLRNYYIAKHYADRILVDEFSDKLDYTILKPTSLSDDAATGKIRIIKSTDEEIGTITRADVAKVIYEIVNDKDTFGKSYNIANGDLDIRDKRIYKSV

SEQ ID NO: 16792 - protein, 298 aa, Candida albicans
DIDQHIMSWKRLIRFVARDGKIYRGEPIFTDTNYDVGKKYLAGDQLKAKVIKGTNIFENTIVTDEILEVVKLLGPLTPEDVPIVKCIGLNYTKHIEESGIPAPPYPPLFYKPRTCVADFNEPIPISKIAQVDQCDYEGELCVVIGKSGKNIAKENALEYVGGYVVGNDVSARTWQLDPKYAGGAPQWCFSKSFDKYAPLGPQLVSPAVLTDPSALHLQTRVNGELRQDSPTSDLLFNVSEIIAFLSQSTTLERGTVIMTGTPSGVAMGMKDQKYLQDGDEVEVSITQIGTLVNKMRFE

SEQ ID NO: 16793 - protein, 140 aa, Candida albicans
IDSYHLSFDYHNYSTMSTTTRTLQAIKFDRDNIKLEILDQLLLPYSTSYIPINNIEDAFKAIKLMQVRGAPAIAIVGAFSVVVEVSNYLKQSDSNQKTIKNLNDSLNYLITSRPTAVNLANALNDIKQLLQKYNETDIIG

SEQ ID NO: 16794 - protein, 251 aa, Candida albicans
EHDLHRLVKNGTFGHTGSVPTSGHGTALGIIRSTYQALQKNNSKQDFWLDHIYPCETRPYNQGAKLTTYELDYEQIPFTLICDNMVSSLINTLSDDNKKPIKTDQSAPVKFIIVGADRIVENGDTANKIGTFQLSTIANFFNTNRFNAKATNKQIKFIVAAPKTTIDLNTKTGDDIVIEERPANELTTLVGPLLNESGKVGEKLTVGIATPGISVWNPAFDVTPHELIDSIVTEDPHVFTKDKNGEFNLIK

SEQ ID NO: 16795 - protein, 164 aa, Candida albicans
RRSEVYITSRKAKACDEAVAALNALPNKRPGAVAIAVPADNARMDDLDRLVAEVKKTTDHVDILFANAGATWGERFEKYPESAFSKVMDLNVKSVFYLVQKYVPISFWCISTLTELWLGLPPYSRPKQPVSRPRASSSLVPSLALGSALSAKMPPLRTPPPKQP

SEQ ID NO: 16796 - protein, 416 aa, Candida albicans
RKILLQSPKQLTTLIRPTNSFIIKRRNYSGSSIFKGARNYFLGFRNNSEDSQINNNNNNNNNNSSMHYDSVDELIPYVKYPLFTKEQLKKIATDKFKLQVGHASFGYHSDSIVPSINSLSDLTDPTLLNSLLPRRRPQGSPSDTLSIKAGDDTMLVSPSVIAVADGVSGWESDGITSSSGIWSRSMVETFSRLMTEYKLNHFPHYLNQRDIQEILDDSYLHTSHLMDLQKLNGSSTLILGMLNGDLLSIVSIGDSEIFIIRDGEIVLTNGGQTKAGLCPGHIGTHTLDHLLSDIAWIKSFKFMEGDYILMCSDGISDNLYEWEILNYLNEWINTKRNNNNNNDVQNIASKLLIKATEVAFDDYAYTPYNAKVNSLNNTNGGSNGTNHSQGGTVDDMSVIIAKVELNTKDNTKLVIN

SEQ ID NO: 16797 - protein, 96 aa, Candida albicans
DSISNCLLWFLSMSSGPFYRSYSFNALWALVFKFPLFAYFVGFVEDFVISIIKTGPIPKHVAMIMDGNRTYAKKHRLPLKEGHFAGANALVKVCKD

SEQ ID NO: 16798 - protein, 516 aa, Candida albicans
EDMSDIEKKQTKISPASSVAHDEDTLANDELFQLTDSVLNKKLKLINDAIDEIGFTPYHLKLFFLNGMGYWTDTQLTYLESSVRTFVNYQFGYKYPVSNEMLAAGLLVGALFWGFSADLIGRRLAFNLTLLLSALFTILTGVMNNMASYCIFVFLSCFAAGGNLVLDTCIFLEFLPHKDQWLLTFFAFFWGIGQTIAVALAYAFLPNNSCESADNCPSHINRGWRYVYYTNGSIVLAMAILRLTLIRLQETPKFLVSNNRDQEAVEILQRIAQKHNRTCSLTIEDLESLGKVEINDDYRKHIDIKGTFRLVTHHVQILFSNRTMARSSVLVFVSWLLLGISYPLYSSFLPVYLATRGANISAPDVHGVYRDNLISNCVSMGGPLIAGALLFCFPWLGRRGVLFIGGVASMAFLFGYTQIKTRAQNVALSSISFASMYIYYSALYAYTPEVFPSVARATGNAIAIACTRVMTCIVPVIAYYSNTSSSVPIWVCGAFVGVIGFLALLFPYEPSKQRVV

SEQ ID NO: 16799 - protein, 393 aa, Candida albicans
GEFTVPIAEELAHELINNLDSSSGYSGGDVDPSKKIAKVYFANSGSEANEAAIKLVMQYFYEQGKHTKTQFISRHQSYHGNCLGGMSLSGHIARRKPYESIIDQSRFHKVDPCYEFRYKQSNDESNESSDQYVKRLLEQLENKILQIGPENVAAFFAETIVGATTGCVPATPGYFKGVREICDKYDILLVLDEIMCGSGRTGTFFAWQQEQEGEEQGGKSIIPDITTCGKAITSGYCPLSCVFFNKKILDVLSNGSSCFNCGHTYQSFPIACAAAHAVQKIIKRDNLLDNVVKMGVILQELLMMKIDPLEIVANIRGRGLFWGIEFCKNKSTLEPFNPSCNVSIKIGEYTKRNGVVVYPGKGTIDGIKGDHILIAPSFTITKEEIFTTGWKIH

SEQ ID NO: 16800 - protein, 368 aa, Candida albicans
VLEGFPKGFRSIILTKPRLGNFFKHTICGLEIIISIIRGSEDDMRLQLNVAKVTDWYPSYNIAPTNSALIIYMTESGTQFNAKYILEPLKFGIVPSWAKPSDSTPVGKGTDKEGSKYSRELGRMQAKYFNCRRESLKQAKSLWNSCKNNRCVVPIQGYFEWMKTKTGKIPYFVHSTTAPLCFLAGFYSHNYNYTENQNVSGEYLSTFTIITVPAVKEDANDMSWLHTRKPMLIAPGTKVWYDWLDPKIHWNDKFVETVLNSTLNQAYTDIEAYQVTKEVGNSSNDGENMIQKINVKKQSSLSYFLSAQKGQNKPKSTSRSNPVKSETEVKQEFKKEGNSKKRVKSQLLNSQKKRKTVTGELFEVKKEV

SEQ ID NO: 16801 - protein, 800 aa, Candida albicans
GLHTQKKKHYKPHRIKKINYRKGDQVVHHKCILLPSMNNSTPWIPFFQQSIKIFQEINTHLTFLSSHSRSVVPSLDLLQKLNSSITPLDLAVIKYLFPEDEIFFDYVDENQIMLSFIEEVKVDQSGYHQTPIADKYDEQTRHSKQILIFSFQDAKVHGIGKMKKSNNRKRLKNDSGDYKSDQRSGLFLGDNRFLLQPLTQSQLSSMIRSRNDKFILLLERFVDKYENQEKAKKSLLKKAAELIPQEPDLQDMVEVLQEKKSVTTDSGHNFSTDEMIQILENSKFYCDQIASTQLLNRNRPADFRKLTTETFLYVHPDLKDALLKTKNICLEDGLYSHQAGALETLLNPANKSHVIVSTLTASGKSLIYQIPVLNSILWDISSGLKGRHTTAFFIFPTKALAQDQIRHFREFLKNLPTASSRPIIVNTYDGDTPFKERDKISKESDIIFTNPDTIHASILPNHSFNNWKEFLGALKFVVMDELHVYKGTFGVNVGFVMGRLSRMKNLLLRDDSIQYISCSATIHNPVSHFRTVCSLPENELIVHVDQDGSPCCEKKLIVWNPPPLMNQRGQKEDTVDKYVPRVGMISELAKLLVNLVTANDSLKIIVFCPIRVVCEMLMKEVRHLLQNSFKNSGITQSDIMAYRGGYSKSDRRIIEQKMFSGQLRAIVATNALELGIDLSHLDVVITCGFPMLKLNLHQQFGRAGRRKNANGSLAIFVPGKNPIDQYYLENPHELLGNDYEDLCVLGVRDMECGKMILERHLQCAAYEEPIELDDIKWLMPGGSKKDFEDVLCLTTGLKGP

SEQ ID NO: 16802 - protein, 159 aa, Candida albicans
MFKQLFKPTTTTTTTTTLIKRFMSASTPIKNSPFKAKVTSIEPLTNGKWIQTKKINYDDPNGNSRVWEMAIRTTRSTTTNIDAVSIVSILHNHANDSKEIVLVKQFRPPTEQVVLELPAGLVDPNESIESTAIRELLEETGYYGTFNSQSVPIFSGSGD

SEQ ID NO: 16803 - protein, 379 aa, Candida albicans
KSHQFDLSSVMENNNTIPALFQPIKISDSITLPNRIGVSPMCMYSSSPTDNQATLFHFVHYGSFAVRGPALIILESTFVSENSGLSIHDLGLWNDDQAHSLRKIVDFIHDQDGICCIQLNHAGRKIGEGVPFQQIQHGWQEHCVGPSTEPFSDSHNTPRELTVNEINSIVEDFANAAWRAVEISKFDAIEIHCANGCLIHQFLSKLTNKRADQYGGSFEHRVRFLLQIIENIKRQIDTPIFLKFPMSDNCSDPEAWSTEDALKLADLVIDLGVKVIDVTSGGNVAHCKSRYLLNDDKQLPSQVPLARKLKSHIRNRCLIACSGGLDRDIFKLDEFIANGDFDIALIGKGFLKNTGLISRIADQLQAQFRTAPQYKLALS

SEQ ID NO: 16804 - protein, 430 aa, Candida albicans
PNCFNKLFATMTVPYQVKPSDEIKGAPEVSYYTPEQPVPAGTFYPQSSDEVAPKIFQPLKIGKLALPNRIGVSPMCQYSADYNFEATPYHLIHYGSLVNRGPGITIVESTAVSPEGGLSPHDLGIWKDEQAEKLKPIVDYAHSQKQLIAIQLGHGGRKASGQPLFLHLEQVADKSVNGFADKAVAPSALAFRPNGNLPVPNELTKDEIKRVVKDFGAAARRAVEISGFDAVEIHGAHGYLINEFYSPISNKRTDEYGGSFENRTRFLKEVIDSVKSSIPNDVPVFLRISAAENSPDPEAWTIEDSKKLADILVEKGIALVDVSSGGNDYRQPPRSGISKELREPIHVPLSRAIKQHVGDKLLVSSDGGLEKDPELLNKYLEEGTFDLALIGRGFLRNPGLVWEFADKLGVRLHQALAVRLGFLAQQTTNC

SEQ ID NO: 16805 - protein, 158 aa, Candida albicans
SSKRVLPQHSTNTLSNRIGKGLMVLVGITTTDTEDDIANLSKKLLSLRVFEDLSEPPQTATKWYGKPWAKSIVDIQGEILSVSQFTLYGTVKKGTKPDFHRAAKGHHAVELYNKLLEQLRAGLGQEKVKDGEFGAMMDVALVNDGPVTIVWDTQDSSL

SEQ ID NO: 16806 - protein, 379 aa, Candida albicans
SFIHRALYNQKYFIKSMNRSNLHLHFFVQKRWNSIDYLLKSIPQSPRTTNIYQSSKSSKSKKSKNLPSERQLKSYRNSIVSPLRLNEIYSPSWRTSYKENDLVKSRQFFGNARVELDWTLADYDEIPDVKYAKLAKEREEKLSSIDPYSRNETTESMLNSRKTFGIRPELLRALPEVLFMGHTNVGKSSLINGLLVKNKSITGPTQLAYVSARAGFTKTINCFNFSKKLRIIDSPGYGEYGDLKQGKVVVDYISRRHQLKKVYVLIDSVEGFREEDSYIFNLLIDEGVPFDIIFTKVDNVVLKYIPKNAFEANNCYDLIQTCNDRVVEHYGKLITSSGLQDIAMTPTFLFSNANTNKFLPKPAGMNEIQSNILDSCNLL

SEQ ID NO: 16807 - protein, 243 aa, Candida albicans
TPMLIVGLTGGIACGKSTVSKELKDRYGLTIVDADLVAREVVYPNKPAFNKIVAAFGDEVPNLINEDGNLNRAALGQAVFGNKEKLAILNSIVHPAVKWEIFKQIIRAYFSLNKLVILDVPLLYESGLSLLCGLTVTVSCERNVQIERLLARNNELSESDANKRIESQMSNKERNYRSDIVLDNSGSLDSLKESIKCLVPEMKPNLIWYLLDLFPPFAVTSALFTFTIRRIAERFKGTKPKSD

SEQ ID NO: 16808 - protein, 364 aa, Candida albicans
NQSISMTVITLNWGILGAGNISSQFVHDLVLNNQRDTQFHHIVKSIGCSSHDKGLDFIKKNNITLENNFQTTPIVESYEDFYKNLDIDVVYIGTPHTFHKEQSIACLNNNKHVLFEKRFTVNKAELESILNVAKSKKKFFMEAMWTRFFPAITELKKKIYDEKVIGEIHRLFADLSYNCDISNIPLSFRIRNKDLAAGSLLDIGIYPLTYSRVLLDDSLGENHSPFQIKSFLTIDSQDQVDHLYSAIVKYQNGKHAVLTASELIDGPKAYVRLEGSQGHVEMYSDNPARAKHFKIFNAKGDEIFEYKDGSGYNGFIYEANAVAKDITEGKLSNDTMPHDESLLIMETMDQIRHENGLVYPQDEN

SEQ ID NO: 16809 - protein, 323 aa, Candida albicans
YVDAILLLHYLFLRIKCGYDVFNFISTLARELLGFAKDGVAFLTNKDVSQLGMFFFTVLPSVAFFVAFIHIWYYFGVIQWAIRKFAYFFFWTLRVSGAEAITAAASPFIGIGESAILIKDLMPYLTKAELHQIMTSGFSTISGAVLVGYIGLGLNPQALVSSCVMSIPASLAVSKLRYPELENPISSGTVMIPKVEDPEEAREKSKDEPQNVLQAFSNGATLGLRIAGTMMIQCMCIIGLVALCNGILTWFGNYWNIDHLTLELMLSYIFYPIGFLLGTPRNEILLVSKLIAYKFIQNEYVAYNLLTNDAPSSPRRLEPPSLV

SEQ ID NO: 16810 - protein, 386 aa, Candida albicans
LGIVTHFKILLKQVTINSNMSKEKSKQVVIIGGSYAGILALKTLLKSSPIELNITLISPNDSGYFNAAAPRLLIEPESIDKTIFPIKPTIEKLTSGTIHTAKFLQGVVTKVDLTNQKVFVDNESEIDYDNLIIASGARAKSPAFKLTNNNDQNYTIKAILELGDEIKAANNIAVIGGGSTGVETSAEIAFKYSDKNVVLYTGASRPLPSFPKSTSSKATGKLNQLGIEIVNGERVNVKDKTIEFADGSTKSFNLIIETLGLLPNTDFLPKKVLNEYGYVETDEYLRLKDHHNVICLGDVVALGANSIVDLVYTQKPVFEKTVEFEVVDNEATQLKAYQKASGITTFIPIGRNGGVGLLFGYCVPSFLIWFAKARDFMISKAGEHFT

SEQ ID NO: 16811 - protein, 91 aa, Candida albicans
SAGSIALSYAAHSQLCVNQLSLNGTEEQKARFLPGLLSGEKIGALAMSEHSAGSDVVSMKTTAKAVDGGWVLNGTKMWITNVSSNQTYNSS

SEQ ID NO: 16812 - protein, 476 aa, Candida albicans
GRMSDIFGGKNVIMTCLMILVIGDIACSVARNGIEFFVFRALAGIGNGGVSSLSMVILSDIVSLKDRGKYQGILGASVGIGNAIGPFIMGAFIKKSSWRSYYYFLAPLGFVVNVILYFCLKNNKKLDDVISRKEKFMSLDYTGILAATASLTLILIPLNGGGSTYSWDSNIVIIMFTVGGVLLIVFLGIEWKFAKLPMIPLRLFKSPSLCLLYLATFCFGATYFSFTYYMPYHFQMIKGKDEIGTAIFLLPLVLMQALSSIICGRIISFTGHYFYVVQAGYLLWLLSVCLLILWKKTLPDGIHILILFIMGTGVGAAFQPSMVAVQANCKKAERAVAISTRNVLRSLGGTVGIAIGSTIVSNSVLKELKPLNSSNSNLSPETINYIKGHIYEKIPLTNLNNQQINEIKDIYTAALRNYYYFLIPLMAICVITAMFVKDNGLKALDEQTPIDTKDFIERKKDLESSASSMTVKCENV

SEQ ID NO: 16813 - protein, 302 aa, Candida albicans
DAGFPPRGEDSLPEHESNTSLHDMEKKQLADQLGDIHYKILPIKKLLICLFSLSLALFLSFVDQTSVTIALATIGKDLNAETTINWAPTASLLANCICQVLFGRLSDIFGRKVMLITCLICLSLGELICSFAKSGVEFFVFRALTGLSCGGIQSLCMVILSDVVTLKQRGKYQGILGASVRLGNSIGPFMMAAFIEHNTWRNFYRMMCPINILAFVIIAIFIDTKQQTKQLNQLLSKSEQFKKLDYLGMLIGCSGLTLLLVSISSGGSTYNWNSAPVISMCVIGGILLITFLFVEWKVPELP

SEQ ID NO: 16814 - protein, 221 aa, Candida albicans
PEGSPGLGMEGNVSEKLIRVDFLGSFFLVSSLMVFLSAASLGGREIAYSSFTFIGLIISAFVLLTAFVAVELYVSEEPILPIELFANRTVLASSLTNWFYTMSIFTTLFYVPIYYSSVIGLTPTENGLRLVPNFFGVSFGSVGAGIYMKKTGRYYKLAVLAGIFAIFGIGKIALLTPNIPTWQQFLLLIPSGLGYSCILTVTLLALIATAALSATKGEIPR

SEQ ID NO: 16815 - protein, 226 aa, Candida albicans
NQMISPKYSATHYYLSAKALSGAKTAPHIINLYLDYNCPFSAKLFLKLYNTVIPNLEKTHPGRFQFVFVNVIQPWHTNSNLLTEFALAYAKLLREKETEVDGDIDSIKAFWDFSEKLFENKEKFYDTANIELTRNQIYEQIYNVVTSGLELKVSKEKILTELIIKPSEVPSNAGNGVTADVKYFTKYLRGVGVHVTPTVSIDGIVDDSVSSGSSEDDLVKLFESKL

SEQ ID NO: 16816 - protein, 443 aa, Candida albicans
IRIGTGESPPVDCVLVEGSTEFDESALTGESTPVKHQEGHQIFSGTVNIGNSSVVGKVTSLEGDSLLNQIVNTVRDGQMRKAPMERTADLITGYFVPLIIACAVITWVIWLALGYSGALPQSYLDIDVGGWTVWSLEFAIAVFVVACPCGIGLAAPTALFVGSGLAAKNGILAKGGGVAFQDGANVNIVCFDKTGTLTKGELTITDFHFPDKSSIAKTFALQVARDLEVPSHHPLGKAVKSFVTSYDGKSLTANKIPQVETVPGKGLRGQIIYDEGDDIWNEYKPTQAILGNEKLMEENDIEFTEKERQWLKKWKGECKSVILVGLQCESYFKDSKFHLALIMAARDQLRPETKKVIEFLKHKDIECWMITGDNKLTADAIAKEIGIENVVSEVLPDEKEAQIKKIRQLNLGGKKEPVIAMIGDGINDAPALASADVGIALSS

SEQ ID NO: 16817 - protein, 130 aa, Candida albicans
NKQTTMTTTTTATTTTSEVPLLYTLGFIRCKDNNKILLLNRNKSPWMGLYNGVGGKLQSGETALDCMIREANEETGLHLTNFISRGIMTWKIDYSDNVTSHQQPSIEDYIYLAADISIELYERYRTPVGL

SEQ ID NO: 16818 - protein, 252 aa, Candida albicans
MRISTRAEKVYQKSQVPILVSTFIFTNMISRTSMFRSIVENAQLTLKQQITNIPKSAGINYQNFVNLNDVQKREVLTAIQSLKSYETSSKAQNDRRRKLFQRMSYKQQKACKDIGYLKKLDKIDNAISANYKFVNDVADHAIAKYGISLKDFDLLNSEKKNASTTSASNYRVIEALGHYTRDWHPENIGLELLPIYEYVALQLSALIPYDAKKDTCLVFPGSGLGRLAHAFAKWDFGAVHSIEYSRVDECFC

SEQ ID NO: 16819 - protein, 280 aa, Candida albicans
PCIIKGAQIPQNFAVLYIPPSTMSTNPEKPTRNEDLFENSSSSSSVPHNKEASELESVNSTAEREGGEHGNILAQYTEEQVMQMGRNYAHKYDLDPDLFGRAAALARAPSAFNSMPFLTDEEKQGLYLEATKKWHIPRKLIEVIAVGAIAAATQGMDESTISGATLFYPKAFGVTEMKNADLIEGLVNSAPYLCCSVIACWTSDYWNRHLGRKWTIFWTCLISAVTCIWQGFVNNWWHLFIARFFLGFGIGVKSATVPAYAAECTPKHVRGALVMLWQFF

SEQ ID NO: 16820 - protein, 189 aa, Candida albicans
  UNSURE (9): Identity of amino acid sequences at the above locations are unknown.
FPFTLVFSXSPLFGVLFCSIFRSTINYLPMLSVSLENNSGLFGTDVYDETKENKPKYEHEEGLEFGSDFDFDGEFEKYAAMGAAEKQSGAWMTNFKNLEFPLGVSPSVLVQTLGIFAAFCGILSGVDQSLISGASIGMDKSLHFNSHENSLVSSLMPLGAVAGSILLTPLQRFGRKKALMASCILYTYV

SEQ ID NO: 16821 - protein, 109 aa, Candida albicans
GRNPVDNYKTLISAIVPTPIGFVSTVSKTGDRNLAPFSYFTMVNHDPPIFTLGFSGGKGTPKDTCKNILETGELTINIIIEWFVEAANYCSTNAPPGIDEWNLSGLTPL

SEQ ID NO: 16822 - protein, 354 aa, Candida albicans
FDNIFNLHRILIYSKPNIRMSSIFPKLSFQEWYQVLYGLWPSNPQFTEKDISSNTLKDKVVVITGGNSGIGYETAKVLAGNTEARIYIWARNRQKSIEAIEKIKLEVAEKHLKDVGDRLQFIQIDLSDLNSIEPAVKEFLQREQRLDIIYHNAGVMESPLDQKTKQDYQMELGVNCIGPQLLQTLLDPLFIKTAEKNPPNLSRIVWVSSTAHMFSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKLYVR

SEQ ID NO: 16823 - protein, 309 aa, Candida albicans
IAATVKHKFFFLISHFFYKFWQNPLNSISYLTRLGVVSLNLFIPYSIMSYNLANKIAIVTGGLTGIGLATTIKLLKQGSKVIVGDFLHEHEIDTVLNHIHKQVPENNRNIKFLRINIANYQDNVNLVDFALDEYLDLHYVVTNTAITTTTAIASNKTETIDQFTEVIDTNLNGVFALNKLAINYWEEFHKPGSIVNVSNILGLTTTKGLTSYRVCQGGVQSLTQSLALPYANKDIRLNSVIPGYVEISPMLGQINQHIATTAIKQHPMARLGNPDEIANAIAFLLSDEASFVNGTSLVVDGGYSAQMGN

SEQ ID NO: 16824 - protein, 502 aa, Candida albicans
TQMKVNHNHISNTSVNNSEDVLEAQDEISNDNNKNQESIWNKKSIFHTWLLLCYSTGPVASMSRTYVPASIQSIAKNVGKTKMNQPCGTQGNDCYVKFGFMTVHHTSYVLYLRAVSTAIEGVVAIFLMGIADYSNYRKLFLIFSILVYGFLALPFIGLTNNDYQTLVLASILYSLLIIDDSIYQILEGSYIPLFMRADKENPMQRGSVVAVLGLFLGNLGGITALVIGIIISYLSATPELKGYHNFLLAITIAGCLTIGLSLFSALYIPNVQGKQRIDNFLVLPFKRFFNLLKDIQKYPMAFLYCISWVIWNVSFNNFMSMFLLLFRSTLGLGNSDAEYTVYTFMSYICSSWGSLLWMFLYQKWNSNIKYWGYSFLLVSLLANFWGCLGIHKLTPLGYQNRWEFWVFEVFYSATSSAMRSLNRCVYSLLLPEGNEAQYFGLEVTLGIASGWIGGLVNAVIQDRTNDDRFPFLPNMFLVVVSLIVYYYVDLQKGKNDVNNGNS

SEQ ID NO: 16825 - protein, 151 aa, Candida albicans
EVLLKVGQNRYLVKIPTQKKTRATVVNQLQIGGSGILIVGDPEEVTEELIRWHEISGVDGFNFTYAVTPGSFEDLVEYVIPLLQEKGYAQKEYPTNENGKPLTYRESIYGAGNGFLKPDHPAYNLRWKSEESKEEFEEKLQKTLKEKFGKT

SEQ ID NO: 16826 - protein, 406 aa, Candida albicans
TCHKSFSFKSKKFIQHCCFSIIDIHYSLSTMTISPNKRQKRDSSSPKKHLILNAFDMMCPSLQTAGLWSHPEDKSRDYNTIEYWTNLAKLLEKGKFNALFIADVLGGYDVYNGPRNLTAAAKSGAQWPINDPHAIVPAMAAVTENLSFAITSSTVSESPYHFSRRLATLDHLTKGRIGWNIVSSYLDSAARNLLNGGPLPEHDERYVKAQEFVEVVYQLFLSSWADDAVKFDRKTRVFTDPERIREINYKGEHFIVPGPSITEPTPQRLPVILQAGASKKGLEYAAKNAEAAFINGMTPEALKVKIDQLKKLVKQHGRNPDDVKVLSLVTVIVAPTHEEAIAKYEEYKYYSNPEGAQALFGGWTGIDLGKYDYDEPLDQVESNAVRSFVESWTKPVPGEDPNTKKN

SEQ ID NO: 16827 - protein, 539 aa, Candida albicans
PNFNFLVLFWFLLYFLYTITNSTNQSNHKIVPLSMTASTNSTNDKQNRAPLIWNSFCMGCLGLQCPGLWSHPDDKSRDFNTIEYWVNLAQLLEKGKFNALFIADVLGPYDVYDGPGNFRSVAKSGAQFPTTEPSAVVSAMAAVTKNIGFGITFLTISENPYHFARRLATLDHLTKGRVGWNVVSSYLDSAAKNLLNGESLPPHAERYERAQEYIDVVYKLFLSSWSDDAVELKNRVFTNPDKVREINHKGKFFTVPGPSITEPTPQRLPVIIQAGTSKAGKEFAARNAEVVFITTFSPEELGKQIKAIKTLAKEKYGRPEGSIKFLQLITPVVADTHELAEEKFKELQLYGDLDGAQALFSGWTGIDIGKYDYEDNITDKGTNAVKSFLELWNKTSPGEPANVKKTRRDIARQITVGGLGPVFYGTPEEVTDEIQRWVDISGVDGFNVTYAISPGTFEDFVEKVVPLLQERGLTQKDYPQDLDHSLTFREQLFGSDRKEPYYLLESHPAYDLRWRAGESKDEFERRLNKKRKSETQEIA

SEQ ID NO: 16828 - protein, 412 aa, Candida albicans
THKSTQQQKMKIFFSSMKTIRYLSHTTRLLAKSTSTPKVLGRASNNLSVGLVGLANVGKSTFFQALTKSTLGNPANYPFATIEPEKSIVLVPLDKLTHYAKLYLSQKTVPTNLTIWDIAGLVRNASSGAGLGNKFLNDIRQVDGILQIVRGFVDDEIVHIEDNKVDPVRDLVIVNDELILKDLEIIELEIERVNKMKNKPGIGGSYEINLQTLDKLSTLLYDGIKVVNGDWSDEEVDVINGLNLLTAKPTVYLLNVSKEDYESGNNQFYKEVDQWIATNSPNDKLIMFSAEYETALNNPEELLGTGSAIGTVVEEMRLVLSLISFFTCGEMEARQWTIRKGSTAPEAAGLIHTDLQKTFINSIVYKWDDLKQLDTFDESKLKSQGKQHKCGKKYIVEEGDVLIIKAGSGKAR

SEQ ID NO: 16829 - protein, 92 aa, Candida albicans
LIKFKTDDEVIKLANDTTVGLAGYFYANDVAKVFKIADALNVGMLGVNTGAISEAALPFGGVGESGFGREGSKFGVEDYLVIKSAVLGGIEN

SEQ ID NO: 16830 - protein, 228 aa, Candida albicans
MFTIRRNRNGAIGSWIVMFMQQFCGINVIAYYASSIFIKARYSEISALLASWGFGMINFVFAIPAFLTIDKFGRRNLLLFSFPLMGVFLLIAGFGFLIHDRQGQLAMVTTGIYIFSAIYSSSEGPVPFTYSAEAFPLYIRDLGMSWATATCWFFNFILAFTWPRLQNAFTPTGAFGWYAAWNVSGFFLGLWLLPESKGLTLEELDDVFAVPMFVHAVYRTIELLNGFQ

SEQ ID NO: 16831 - protein, 118 aa, Candida albicans
SISVYSYAPLYITAYISIVAKVSIMSFIYLNIHLFSTQLLILAFYLSVAVAAYTPLYQVNIKSILAYSGILNFGYLLTAVLTNDNAYYIYIIQYSLTHVTIFLCILAITEYTNKPASY

SEQ ID NO: 16832 - protein, 90 aa, Candida albicans
YGIPLLPLAIIFFIGCVAECARPPFDNVEAESELVSGHMTEYSSSIFVLFFLSEYASILFLSTLTAILFMGGGTGIILGLKANLFAFTYI

SEQ ID NO: 16833 - protein, 274 aa, Candida albicans
LYIIKMVDFNVNGKIAVVTGGTRGLGLYCAEALLLNGASTVVITSRKAKACEEAQKYLEKLAKDNNKNCKIISYPADIAVEEECEKFYAEIAKQVDKVDILVANAGASWGAPLEDHPVSAVKKVLNLNVVAVYHTIKLFTPLLEKAGTKEDPSRLILMSSVISYSTNDMVGVYGYLSSKAAVSHLGRNLSVQFAPRHINVNSIAPGFFPSKMANGLIEAAGEALTSTNPRGRLGEKEDIQSLLIFLCSKQSNYVNGIIVPLDGGAHNNQPAAHF

SEQ ID NO: 16834 - protein, 107 aa, Candida albicans
AMVRFAPLLTAKATRESPSRVIVTGSVAGIGVGSIGENATFAYSASKAAVIHLAKNLAVELGPRGILCNAIAPGFYPSKMAHGLIEKQGGLKQLEEHSPNRRICMPG

SEQ ID NO: 16835 - protein, 425 aa, Candida albicans
IKFQRIFNGSVFPTFPSRLDFDHQAMPIDINTKAKCYFDTRPLTKGERKIIKDSIPILEYLDIQFGEKFFKRLIKQFPQYKPYFNETHLKLLRQPRSFHHCLLEFARNIDDLRPMKDFIMRIASKHVARQVSPDQYRVFGQVLVEVMMDQFPKEFVDQEFVEAWTMAFRILANILINIEVREYQDKPWYGFKAFRVTRLQPECVGTKSFFITPVDGTPVPIPKRGQYLCMRWKFPGEKQERLREYTISEFPKNNEYRITVRYIPGGKVTTYIHEKLAVGDIVQVSPPCGDCYYRSSKRNMVMLAGGNGVVALAPMIEKGLAEGRKVKFLYSNRSTETRSFGQFFRDLKQKYGDQLEVVEYLSRRRVIDPIDKYYRRSLTVEDLDFIVPEDDVYLIGPRTYMKMIEDYLKGRGVNVTLDYFGPQEV

SEQ ID NO: 16836 - protein, 292 aa, Candida albicans
HWIRQRRGEDYFRKGIYKASLPYVFGREASGEVVAVGDEVSTLKVGDKIAYLSPNTFAQYTRITDDNYKYIKLPDNASDEELKIYGSLFLQGLTALTFVNEAYKVQKDDYILVWAAAGGVGKILVQLISQLGAHVIAVASTPEKLKIAQDLGAEFLINSTSDDIVEKVKEITNGEGVAASFDSVGKDTFEISLNSIKRKGTFVSYGNASGPVTPFPLSILSPKNIKIARPQLYAYIGNADEWDHYSTELLKLFESGKLKFDIFKTYDLKDYVQAAKDLEGRKTTGKLTLKIS

SEQ ID NO: 16837 - protein, 302 aa, Candida albicans
YLHHMREEYQSNSSHVEPINLDEVYGVTKIGPNTYRGNRPLTKPDRRSRGVYGGNLCGQAVLVAMEASPPEFKPHSFHSYFVKAVRDDEPLTWKVQEVSTGRTFANRSLQALQLGNIVFTAEVSLTKKNSISKTKSAENKPSFLFETPIGKTFDAYNNASLPIVSNDLVLLDYRLFPKQLDSDKISYSLKWGNDNQNSWDMLHVKTDYQFVGLAILSDTLDVGAFLKHLGYESNPKFNASLDHSVYFHDNDFDVTKWCTTFIKVSRMGNDRALIKGEIYSNNGLHIATIVQERLWITGGAKL

SEQ ID NO: 16838 - protein, 390 aa, Candida albicans
YYFILEMLELTAGPNPVPDFEEALRVIKLDETHYVGAHPLRLPVTGGRGVYGGHLIAQSLLVAIESTRDSTTNQVFIPDSYHLYFINAGNAKTPMNYTVTKLYDDSISSKRFIVVQQNGKNRLTCLVNLRKPGTKTLHQEGSGPNISIPVPPIQLKYPNPDELHQVQHTDFVRNAFGKEFIDYRECPEEKDQYAAERWLTVFTGLRNHAEPGASLEAVTEELPDASGKIHKVEKVILRPKDSQSVRDPIYNYVGLADLSDSAFLTTMARILHIPWAPSLEIDETYDESRDATYIMRTTLNAAHIFHYNAMSLDHHIYFHNQDYTPDDDSNFDICKDWLAFTYQMKRLSNNRTLVRGFLFNEKHKCIATVVQEGLTIVYNGVGNTADKSRL

SEQ ID NO: 16839 - protein, 333 aa, Candida albicans
ICKICYTMIQNVTRDKLYPEGKPVDLEEEFGVEKIGPNLYRGKKPIAKPDKRSRGAFGGFLAGQALVVAIESVPKEFKPHLFHSYFVKAVDDLAPLEWAVDEVSNGRNYANRSLKAYQYEDIVYTANVSLTKKISTKKAIEETGVKPFEFQTPKHEWFNRHKLEDLPVADVNSRLLAYHKFFPEVVSLEDTREEDNISPAERQLSWYFKWGIENEGDFHQPLANLDSKYQYVGMASLTDTVYLTRLLRILRIEDADHSQFIHYFSVSLDHTIYFHDDDFDVTKWMSFTFKVTRFSHNRALCQGEVYNDKGVHVATIVQEGLVMLNGLEEGAKL

SEQ ID NO: 16840 - protein, 96 aa, Candida albicans
YLHHMREEYQSNSSHVELINLDEVYGVTKIGPNTYRGNRPLTKPDRRSRGVYGGNLCGQAVLVAMEASPPEFKPHSFHSYFVKAVRDDEPLTWKVQ

SEQ ID NO: 16841 - protein, 380 aa, Candida albicans
DSSHDYFSFTLSSFYLSKNQLSLYLSRMFEYNYKFGETVDVQKEFGVTKISDNKYVGVKPLIKPSPQSRGAFGGNLVGQALLVAIRSCPEGFSPHSLHSYFIRAANVETPVEWEVEIISNGKSFSNRAVKGIQEGVVVYMANISLTKKNSYKEALQKHEEHYAKIQQRGKDGDVEEDVDEDDEDEPGPPKPFSFQTPPSSLLKKYDIDKLPVSAMESTLLLYYKFPPEFVKLSKSLEENSLPPAERRLTALAKWGIENEQGYDQPLTNLTKDFQFVGLANVTDGLYLGTLLRLLRVKDIDTKIHSTDYVGISLDHVIYFHDDDFDVTKWMEFSYKCTRYAQDRVDFEGEIYNDKGVQVASFFQQGLVRFENGALLEKAKL

SEQ ID NO: 16842 - protein, 139 aa, Candida albicans
KVRGVSWSFLFHTSPCSLFLSIKHKIMAENIPPEEYIKQLNHASDTIKHKIDQFPELTQPRVMIICGSGLGGIADVSQAEPKLEIPYSKIPGFKISTVPGHAGKLVFGLIGKKKVPVMCMVGRLHFYEGYSFQLNYFSR

SEQ ID NO: 16843 - protein, 409 aa, Candida albicans
WQGWEFRVSPNSREGFAIYDCWFKGRQTFYRISLSEMTVPYGDPRAPYHRKQAFDLGDCGFGVNGNKLALGCDCLGVIKYLDGHGIHANGEPFVIPNTVCMHEQDDGLLYKHVNYRTDNAVVAKKRIFIVQTIATVANYEYIINLKFVTDGSIDIEVRATGILSTMPIDENVKVPWGTIVGPNVMAAYHQHILGFRIDPAVDGHMNSVVYDDAIKLPRDEFNPYGIGFVTDRHFVEKAGYIEQRPFDNRTYKIINENVINPISKTPVGYKINMPARQMLLADPDSFNAKRAKFATQQVWVTKYQDHQLFAAGEFTNQSKIDTGITEWANGIDPVRNEDIVVWATMGFTHIPRVEDFPVMPVETHNIQLAPANFFDRNPALDLPQSNNGFNKSVLVADNSDEKACCKNKI

SEQ ID NO: 16844 - protein, 466 aa, Candida albicans
QHRCIIIHSLTPTMFLRRALPRNLLLIQRRRISNVNVPFEDDLTGFEDDSLADFQHYPGLQQSTPVDQNNTPSTKTDKTIAQAPLQETTIIPQLSKISQLRNPVIFVSKLTNPYMNLAIEDYIYNAMPKPEGAKDNSFDRLMFYINTPCVVIGKNQNPWQEVNLPVLNSLGVPMLRRRSGGGTVVHDLGNVNYSYMTTKANFDRHKFASYIVEAVNQASPRFKIETNERGDIVSEKLLGLNYKISGSAYKLSKGKSYHHGTMLLNLKLDVLGKLLHRDEKKLGIVDSKMSIPSVKSKVINLEMKSDKFIDVVSQKFKSLYNVVPEEDTEMDEFNEMFGLTDFAKSQEVTLFVIDEATTIPEEIHITADELKQWSWRFGHTPKFTHSFKNQKHGLEILFNVEKGCLKSFKLTFDDSNSDTKEIEKSFQYLESHIKNNDLEYTGSNVAGFVLHDEISDWIGESIDGTI

SEQ ID NO: 16845 - protein, 87 aa, Candida albicans
FKTTRFHKPGHILPLRAVPGLLIKRRGHTEAAVQLSTLVGLQPAGVICELVRDEDGLMMRLDVCIQFGKKHGIKIININQLVEYISK

SEQ ID NO: 16846 - protein, 125 aa, Candida albicans
SLCDNCWVFEVTYKFLQLQKKIKKKEDLTKFKMSLVNLEDKDFDKQHIWHPYSSMTKPLPCYHVKSASGVRLHLDTGQSLIDGMSSWWCAIHGYNHKDLNDALIKQVNIMSHVMFGGITHDPAIQ

SEQ ID NO: 16847 - protein, 283 aa, Candida albicans
ERCPASRLLGTQNSRHSSYTSYGPDNIFAEAPQVGFGDEWDETDIEDFKQKIKKHHKIIAAVILEPVLQGAGGMRTYHPQYLKRVRELCDKYNVLLVLDEIATGFGRTGKLFAQEHAGICPDIMCVGKAITGGYLTLAAVISTRNVANVISGGRTGCFMHGPTFMANPAACAVSVRNLEIIKTGAWETQVHNIEKILQKKFKPLMESGHRKIKEIRVLGAVGVIEMNNQIDVALYQKSFVDLGVWVRPFGKLLYIMPPYIISEEDLNHLVDSLISVATDDSLP

SEQ ID NO: 16848 - protein, 900 aa, Candida albicans
IMEDFTDNAIKIINNATELAKQQANSQLLPLHFLAAFIPSDDTEGSTQYLKTLVKRARYEWGDFERIVNRHLVKIPSQNPPPDEIRPSYQAGQVLTKANKIKQQQKDSYVAQDHILLALLEDQSIKDIFKEAGMSVDTIKTQAIELRGSQRIDSRQADSSSSYEFLNKYCEDFTEKAREGKIDPVIGREEEIRRVIRVLARRSKSNSVLIGDAGVGKTSIVEGVAQRIVDGDVPNVLAGSRLFALDLGALTAGAKYKGEFEERLKGVLNEIEKSKEFIILFIDEIHMLMGDGKSDAANLLKPMLARGALHCIGATTFAEYRKFISKDGAFERRFQKIDVPAATVQETVAILRGIQPKYEIHHGVRILDSALVTAAQLASRYLTYRALPDSAVDLVDESAAAVAVARDSKPEELDTLERQLHLVDVEINALERDKDADSASKERLNLAKKKKAELEEKIGPLNERYRQERASHEQLTAAKRKLDELEIKAQDAERRYDTATAADLRYFAIPDIQKQIEELEVKVVEEEASNLDSLLKNAVGPEQICETAARLTGIPVTKLSQAENNKLINMEAELSKEVVGQSEAVKAVSNAIRLRRSGLANPNQPPSFLFLGLSGSGKTELAKKLAGFLFADEKAIIRIDCSELGDKWSASKLLGAAPGYVGYEEGGILTEPLIRRPYSVVLLDEVEKAAPEVLTVLLQILDDGRVTSSQGKLVNCSNAIFIMTSNLGANYINAAKGSKIDANTKEHVMDAVRAHFRPEFINRISSIVVFNRLSRKAISKIVKIRLSEIENRFTANGKAIQLKLDDDAMEYLCKNGWSPDLGARPLNRLIQNEILNRLAVMLLKGQIQDKETARVVLGEKGLEILPNHEPEDVEMNDVDNWQDSEDEDDDEARFTSPGLD

SEQ ID NO: 16849 - protein, 574 aa, Candida albicans
IILIKSFTTTRNSNHYHYHYNNLILLISKMVYSSEASKWKAYQFNDPFAAGSFFVCNKVSQIYCRPDCDARPTTNLKLEIKFTNTNEEALLLGYKPCETCDPIHSYAIDVNLLIKCVATVNERIGFIQPLLDENEESNSQKIKENIIGTRKDEDSLRSIHDFGDLKNSQHRGSVPNITSKDLSLSKNDSDHYRLVDLACRHLALAAAINVFQPKQQSTNTDEPSSPTTNGNGKRRRRRGGVLGFKELAAKSKLSAWHFHRVFKSVLGLTPKTYGDKCWDFIKKVKESGEYTTFEVYSTPKSTTSSSVTSPQLTATTTKKRQHHHSSSDSIFSLHDDTTSNASIPLTPISQTIPSLSNPNTAASDMATISHPTTLDDQLLNMNFVDESSLQTKMLSYSDYNLLPNNNNSISNSDEQFQYGVLPSQQNYQLQQQQFSVPSSAAPALFDSMPSSSSTTNVSVTDSIPNNNASAPMFNTDMFKDLDYSQPTQSSSIDYGLGEDLNSYSSIFDENMFTTASANPYHSTANINGLSSMFTFGAGADEDTTANINNDDTITAGLFIPQLASIATPTGTHHN

SEQ ID NO: 16850 - protein, 186 aa, Candida albicans
LDVYITMRFTDDETKYQAILNRDPQAEGEFVYGAISTRIVCRPTCNCRVAMRKNVVFFDTITEAVEHGYRTCKRCKPEKCSGWNKSREFINKSCFMISRRAINGEKLNIDTIIAAVGVFKWHFYRMFKNYSGLTPRSFYIQCQLLQENPLDTTPLREIETKRNLKRVKEILNLYTTPNSNSNSSSS

SEQ ID NO: 16851 - protein, 567 aa, Candida albicans
WWIVGVHGGCEAATGSARSQTRITLITPYINKIGTASCNLFMGGVGKGTLLREVDALDGVSARITDKAGIHFRILNASRGAAVHGPRAQIDRKIYLEEMQKEILNYPNLKVLEAQVEDIIIKPVLSNGEDFSGREFGEVKGVILLDGRVLKSEKVVVTTGTFLGGEIHIGLKCFPSGRMGEDATFGLSKTLKQAGFRLGRLKTGTPPRLSSRTINFKGLIEQPSDFPPQPMSYMNDKVYLEDQLMKCYQTKTNPEFHKIIADNLDKSIHIRETVKGPRYCPSIESKVIKFPHKDYHYVWLEPEGLDSDLIYPNGISCTMPEEIQEKLVRLMPGCENVTMTQPGYGVEYDFIDPRELKSTLETKLVNGLYLAGQINGTTGYEEAAAQGCIAGINAGLSYLQKPLLELKRPDGLVAILIDDLITKGVEEPYRMFTSRSEFRFSIRSDNADDRLTQKGYELGVVSEERYQFFKKEADQFKDIKNALSVLKLLGKQWAPGLQGLKTDTIENDKVSGWKLLSYPGVLINDILPHMSHFMTQVPPCLQNVSMRLQNKIDVVSDYDPIMYREKS

SEQ ID NO: 16852 - protein, 221 aa, Candida albicans
KTRCFCFYNTIEFLFIFFLQIMSVEYPNSVTSLDKKPQVDLENVIEDASTSSEHRVAQTENLNRSLGARTINLICLGGVIGTGIFLGMGKMLLNAGPLGLLLNYLIMGSMIYFMMLSLGEMSVQYPISGSFAVYTKRFGSDSLAFATLFNYWLNDCVSVAADLVALQLVMQYWTNFPLVCDIYYILGIFIIVKRVTCEIIRRSRIFTCLVESGDNYYIFHC

SEQ ID NO: 16853 - protein, 198 aa, Candida albicans
CNIGPIFHWYVISIIFWVFLLLLNVLHVRLYAEAEYSLALLKVVTIIIFFIVSIICNAGKNPQHEYIGFKYWSYGDAPFVDGIRGFSKVFASAAYSFGGLESVSLTAGETKNPSRVIPKTVQMTFFRVLIFYILTAFFIGMNIPYDYPNLLTKKVATSPFTIVFQMVGAKGAGSFMNAVIMTSIVSRPEIIPFMCPPG

SEQ ID NO: 16854 - protein, 81 aa, Candida albicans
NFILYYAPFIFASLGLSGNTTSLLASGVVGIVMFLCTIPAVMWVDKVGRKPLLISGALVMGLCHFVVAGFHNGQEGPHLRK

SEQ ID NO: 16855 - protein, 87 aa, Candida albicans
KFMPIVNSISTLGVFTSIISACSIDVYWINVVSSVVFTIFFCFNQVLKFPITSSFTTIYLWPTFSPTRINTHFASPSNSVIRHYGPN

SEQ ID NO: 16856 - protein, 166 aa, Candida albicans
VFTDVRSGKSMDRPGLTELLAYARRGDTLAVVRLDRIGRYIAELLSSVNLLKERGIALVSLEEKIDTGSAAGEMVFHVFGAIAHFERRLIAERTKDGIAAARAKGKRPGRQPVDPDKVVAALKLVQAGLSPTEAGRQVGLGRATVYREMALAGIVFTTGVENPHLR

SEQ ID NO: 16857 - protein, 210 aa, Candida albicans
  UNSURE (176),(178),(198): Identity of amino acid sequences at the above locations are unknown.
TVIMLGTKYFAISKRILTLKSFKPLTLGGTTIITLRYNSTKPSTTTTNSNANSSRLKPSSFAFPSSPTSQQSSSTTTSTNDSITSSQQQEDINDFRATKLIHGKTNLSFAITERASKKLNEISQQDNQDSGLLIQVESGGCHGFQYNLKLTNIDKELQQQQERDANDLVVFERKSXGXVIMNESSLMILQESKLDYTXRIKLVINLKIVE

SEQ ID NO: 16858 - protein, 147 aa, Candida albicans
  UNSURE (12): Identity of amino acid sequences at the above locations are unknown.
GGISFVRHLLVXICGQRTPIVRTHPVTGWKYLFVNRSMTVRIVGLLPEESDLILNYLYSVIETNRDIQVRWSWQKELGSVKNNKKDEPKQYRGVSALWDNRISNHSVVHSEESIVGRHGTRVTSLADTGYYDPNSKSQRESLGLSLD

SEQ ID NO: 16859 - protein, 279 aa, Candida albicans
VEYKLSPLTFKTLLYIMLSQIISKPNVYRQSGHVFYRQFTNRGPLSLLSSTTPTTPTTTPPPPPPPSPPRSSSSVQPTSSTSSSIATSIFPSTTTSTSTITPPTFFQTKPLPTNTIIKFVPQEEAWIVERMGKFHRILPPGLAILAPIIDKISYVQNLKEMALELPLQNAITLDNVKIKLNGIIYIKIIDPYKASYGIDDYKYSILKLIESRLNLQIGKLELSKILKNRELLNDLIVKIINEAAMENWGIECIRFEIKDIIPPQNVVDNYIDKFINLQK

SEQ ID NO: 16860 - protein, 121 aa, Candida albicans
INRLDRDVYCLDLRNWVLIRHHLRMEYPILPADIENWVGLQNIPESAKPILIGHSMVAKAVMAVALRRPDLPKFICSVDNSPITYPTLDLLFGKYVNQLRLAIEKYKYTNIKDVDAKLARG

SEQ ID NO: 16861 - protein, 355 aa, Candida albicans
PARTYLKKVEENLVAQQFQFFFAIKTKLHMYISPGNPYLFLPGIEYRRLSISPTMSPSKLSNDETPPDLDFRFTGIKQRLIKSENVKQVTASWKRLLVEINKEFTEIAKIGPSYVPKCDFIDIKDNKLPQQVSELFKQRGCLMIENVIDVDRIDIWFNELVEFCKTHPETAGYTFPNPTSWYNVFWSKPQTEARFHPNMKAIFKAMSKEFYVEDKENCLIDLDTQLVYGDRIRIREPGKAAALPLHLDSSSIERWEDIMYSEVYKSIFEGDWENWDAFKLDERTYSKENLYKDEDDTGGKSTICSSFRTLQGWLALSNNKSGEGTLRVLPSLKLSMALNNARPFFLERPRVREHR

SEQ ID NO: 16862 - protein, 190 aa, Candida albicans
IMLDHFFWKDPESGNIDDMEIDLITPKFLGTVPGTGQLFLDKFYPHLHQGIISIPDVKKGSFVFWHCDIPHEVDRAHHGNGHSSVLYYGHTPLSITHIQTLLDTRDAFLKNISPADYRSQLNEEEKQKEFQGANIDDLKNDIDSKRSMGLEEFEKPENMSGGQAKIRSIANQALKSSGFNVDKYIHHAAK

SEQ ID NO: 16863 - protein, 232 aa, Candida albicans
DKGGNRSHTLVICLLCKDNLNKSMKLYTAPTGNGRKPLIFLHILDVPNEIHMFDWPTKEIKENWYLELNPHGLVPTLVDGDVTLCESNAILQYLADNYDTENKFSYPSTDPLYWQQLRWLFYQSTQFSDALSRLFFYKKFRSDDQWLVDKGFEQIRKVYQVLDSHLAQRKWFVGDKFTIADLAFAVGHFRRIEKTTGTKFEIENFEEKYPHVTQWYNDVLSIEGIKEGFELK

SEQ ID NO: 16864 - protein, 500 aa, Candida albicans
SHCSRGTLLQMESYNQQEIIRILLCERYPDNPIPEEINLEINKLIRWQNDNKLHTSVQSLTNNYNIANTTVSLWKGDITTLSGVTAIVNAANLALLGCFQPSHKCIDNVIHTAAGPELRQACYNLMQGKSEPTGSAKITPGFNLPAKYVIHTVGPIIRDGNVTEREQEQLANCYQSSLKALEMVNDEKDKSIAFCCISTGLFAFPKELASTIAINTVQHYLEIHPDSTIKHIVFNVFSDEDKEIYEKNLQSFSVDSSRISLKADDIINHNLNKAHSWLQEADCLIISAGAGLSASEGLDYTSKELFQREYKPFLKYGITSLYGTIGYPWPTKLDFWNFFVYHYINLYKKWGKTDTYQRLLNLSLRFEDSFVITSNADGFFVKNGFDKDRVLTVQGNYANIQCLKNCRFDAYRSMEEMVDKYPLTAKDQIPRCEYCGSEMTVFLRMGDYFNPAIVKNQRKNYNELISGIVRTNQKAVILELGVGLNTPSVLRWPNESSPRG

SEQ ID NO: 16865 - protein, 306 aa, Candida albicans
  UNSURE (6),(51): Identity of amino acid sequences at the above locations are unknown.
MDKQLXGFQGYLPKCRKIIALVGAGLYVFSGLPTFRGSQGLWKNFNMIDLXTPDAFYIDPGLVWQFYSWRRYGALRAKPNKGHYALSKLSHKFNSDEYITITQNVDGLLSRSGHNLDSLYEIHGSLFDLKCTSFMCNYVDHNNFKQPLTKALEDTEFEYSNLSTRKRTFGDSDGNDGVDISLSPQFNPVKTILEKDLPSCPVCHDLLRPGVVWFGESLPLNLITEIDSFVELDPSVDLILVIGTSGTVYPANSYVERVRLKGGKVAIFNTDIEDNILNGKVEDTWGFKGDAAELLPIALKPLIGDI

SEQ ID NO: 16866 - protein, 432 aa, Candida albicans
SDHLLHHKPMMLLRRSLRGLSRSCRIYTTTTPQPYYPVHKPYTPTTTTEPINILPENTYTQPTPKPDDHIIVAMSSGVDSSVCAALYKDYPNVHGLYMANWSQLATCTERDWKDVQRVCQDLGISSCERVNFEHEYWQDVFMPMIEKYEKGLTPNPDIGCNKFVKFGKLIDYLHKKYDGTGKDWWLVTGHYARIMKHNETGEYHLLRGLSQRKDQSYYLSSIPQSSLSKILLPIGHYIKPQIRELAHDQFKLHTATKPDSQGLCFVNPQQSNFREFLNDYIPENPGDIITEDGKVWGQHKGLWHATIGQKSSVCMPQADPQYQGIWFVSDKNYEKNQIIIVKGHDNPKLFKQTVELTQLEWLHPKEKVLCLQSLQFQYHSLLKSIPVTRIIELQDRLTVELETPVRALAPGQAGVLYKGNQVLGGGMINRTM

SEQ ID NO: 16867 - protein, 253 aa, Candida albicans
IQLYLHFLILFFFHYLSTHPLEMSLKYLDTARKILCIGRNYAAHIKELNNATPQQPFFFLKPSSSVLKPDSGPFLVPKGVIVHHEVELAFTLNKDLKNLPSTFSPEEAIDSIEGYALTIDMTARNVQDEAKKKGLPWSIGKGFDTFLPVSKFIAKEKIPDPYKVELVLKINGEVKQQDKTDLMLFPIHKILSHMSAIMTLEKGDLILTGTPKGVGQVKPGDKVEAQLLVNGKVIEEIKFDAEEKPGPYEYKQI

SEQ ID NO: 16868 - protein, 127 aa, Candida albicans
KEKLANMESDEEREAYCKEIGAQSALPKIIVAMRQKLDLISFFTGGPDEVREWTIRKWYTAPQAAGTIHTDLERTFILAQVIKYDDLIELGDENSVRAAGKLMQKGKDYFVEDGDIIYVKAADGKAR

SEQ ID NO: 16869 - protein, 425 aa, Candida albicans
SKKKMSNPIVPFGKQFRAKYFTNMDDEVFPVNHGSYGLTPTPVLEKYLDLIVKNASYTDKFMKYGIKDSYVESLKAVGRVLNCDYHNLAFVDNATSGVNTILRSYPLKKGDKLVIQSTVYGACGNTVKFLHDRYGVEFIVVDLNYPITDEEILSKFERVFVEEKPKLCMFDTISSMPGVVFPYEKMTKLCKKYLVLSLIDGAHGIGCIPQDLGNLKPDFYVTNLHKWFYIPFGCAVLYIDPKHHNVVHTLPISHLYLEDHVKLSDGDQKNRLIDRFFLYGTKNFASIQVIPEAIKFRSEVCDGETKIYDYCHGLAKQVGELVSRKWGTSYLDQKGSTLISTMVTVEVPTQDYPEIVKNWSVIDHHVYNKMFDRKAYTPCIAHNGKLFARFSCQVYNELSDYDYASDVVLETLKEVASEQYKKHKL

SEQ ID NO: 16870 - protein, 582 aa, Candida albicans
LTSLLLSQFMLKTSIRTLKRMTNSKLIELPKSSSCTQRIKPDKRVPSVEVALENEGNITNTPRNITHGGFSWVLPTPRDDYEFMIANPLTMKDLGLSLDEMEDPVFQLIVSGEFYKDKVTFVKENFPMPYAQAYAGWQFGQFAGQLGDGRVVNLFEVPKAVPDGENRDKYEIQLKGAGKTPFSRFADGKAVLRSSIREYIISEHLHAIGVPTTRALALTYLPSTLAQRHGAERCAIVARFAESWVRMGTFDLYRWRGDREGIRDLSDYVINELFTINGVKFQNFERIVKTGPNFFKLNDKLLGELTDYDKMYYETVVRNAETTAICQCYGFLNGVLNTDNTSILGLTIDFGPFSIMDKYNPNYTPNSEDHEGRYGYRNVPTAIWWNLTRLGEDLAELVGAGNELLNDPLFQQGIKEEWEDSIIKRATKIIEIGGEIYQHAFTKKYVETFFNRLGLSHELIDAQNPEIQRTDVIVPMLDVLYKIQTDFNLFFLKLQDLDLDSGDYALIAEKEFLPNYDFNTYRQHKDDLIKQISEWLILYHELRNKTKKYKSTPDPAKYNPKFLPRKLDFRSSDSASRKLTWG

SEQ ID NO: 16871 - protein, 232 aa, Candida albicans
KQTITMKKTALIVVDLQEDFLPPNGSLAIKNGRSVIPKINQLLPSQDNHSKFDWSLIVATQDWHPPNHTSFASQHENVAPFTEIEFIHPEKKLDPKTNQPIVMNQIVWPDHCVQGTKGAQLEPLFANQFEKLTKQDDNNTAPCKIVKKGYLPDREYYSCFQDCWGLHHTELIDLLHEYDIENVVFVGLAYDFCVLSSAIDSAKNGFKTFVLKNYCESVYPEKINDTDKLFID

SEQ ID NO: 16872 - protein, 242 aa, Candida albicans
TINMAPPTLTQAAPAAPQLDTPKMLVGEHTLPASWWTSESIFELEKRAIFHKSWMFCTHSSRFAKAGDYYAFNLAGINFFVIKSKIDGQLKAFHNVCRHRAYPIVRKDQGSSTVLGCKYHGWSYNSDGILRRAPHFDNVEGFVKEENSLFPINTHVTPQGLVFVNFSSDPIPFDDWFLGLTPEMNEFDFSDYEYHMSYELDGKFNWKTLMDGYQECMLLLELALSAPFTNLLSKTEINTNNF

SEQ ID NO: 16873 - protein, 226 aa, Candida albicans
HIFINRHCPTTHPGLNTAFKMETYKVVPKNRYCRHFAKIVRQEKPVEKQDSSSWFGFKKETKEVKETKPNPGGEFDGLWVYLFPSNGINCYSPAWYSIRMLPINAKRTILQYDIYTKKVLDDEEKKEFVDFLQQVELEDFDLCELTQRNLNERIYSTGYLHPEKERGVLYYQGVVRDMVKEHFALEQAAGQSIDPAAVGTNPKNGEVEELEGICKSLECGKETVDW

SEQ ID NO: 16874 - protein, 186 aa, Candida albicans
NTLSMIKSLITRNSTRIRGANTNLTLVRFAGHSKWQNIRHDKAKNDARKSKEATLISGRIESCVRVGGKESNARLEQLLEKAKTLNVLKAVVEKAIKRGCGELTDTAQLQNVQYEFMGPGGVAIIVNALTDNKARTVLMVKNAMTYFQATLSPCLYMFDKMGEVIFMSSPRGWKEPRKAQKRQEKG

SEQ ID NO: 16875 - protein, 199 aa, Candida albicans
KHTYPFFFSIMSVDPITCHILDTTLGTPASGVIVQLFHISNDPLLSSISEDTTTTNGKHFAMAKTDNDGRIKQWIINPNGDFQNLGITKNSSKNNHQSWNNLKPGIYKAKFLTGKYFLLLAQNQQGSTSGGDGGRTFFPFVEISFIIDNPPDNHYHIPLLLSNYSYTTYRGSQYIYTYICRKFTILQHRINNVFINKTK

SEQ ID NO: 16876 - protein, 199 aa, Candida albicans
  UNSURE (26): Identity of amino acid sequences at the above locations are unknown.
FPWSLGPSVKNLVKVMGNISFNWAIXSTGKILNLSTLPSYLTERKVIIIDSVKSGTGRTPGKDIYLDILDPLFKELSIEHEYHATKSATSISELALSLKDHKVTIIFISGDTSINEFINSLNDSEKGEIAIFPIPGGTGNSLSLSLNITNPLDAIIRLFSAGTTLPLNLYEVDFPQGSHYLIANELGSPVPSHLKFLVV

SEQ ID NO: 16877 - protein, 317 aa, Candida albicans
LFFRWSSLSTMKRSLLRISQEVRQALFEKRPVVSLESTIISHGLPYPQNIEMAKSVEQVLRDNGVVPATCAFIDGVPHVGLDNFEQLRNAVKVSRRDIGYVMANKLNGGTTIALTMILSHLAGIKVFATGGLGGVHRDGQYTMDVSADLTELGRTPVSVVCAGPKSILDIGLTMEYLETQGVFVGTYNPEKVDNLQVPGFYCRESGVPSPYGFESFAEAARVSYYQGMVGSGSVFCIPPPQETAMDSEYIRSVIEKANEKAKEVGVTGKKLTPFLLKEIAVATQGQSVESNIALVKNNARAAAEIAKELSQLVCKEK

SEQ ID NO: 16878 - protein, 355 aa, Candida albicans
ERDASVLVVGSVALDTMAKLGPSTKMGDSNIGTVTNSIGGVGYNIARASGYVCDSTKFVSRVGNDAAGKTIQESVPGLGVGSGGTAQYVSMHDSSGELVVACADMSVIEEEFEVDHKASVAVYDCNLSPKTVSKALDNNEYNIIEPTSHVKARRIGEMELAVFPNNKVKLITPTVEELASIYDSMKDKFDDEWFGVLDAMKVDQIRERLDKKWYDKGVYQQCFQLLPFFQNILVKLGKDGVLLVSLCSTVEDYKSIPTTSPYRPKSIIYSKGNQVGAVVEYFPVPKDVEVVNVTGAGDTLVGYLAAKISELNWLHHEIGSAEQVWGKWESIYKAQLAAGLTLGCADSVIQEIANI

SEQ ID NO: 16879 - protein, 185 aa, Candida albicans
RTTKNELKSDWFVKLNPNGRIPTIVDPNFKDGEITISQTGAILQYLADNYDKEHKYSYAFGTEEYYKTLEYLIFQVSENGPIQGQLNHFKLFAKEKIEYGITRYENDTKRIYGVYEDILKRNSANDSKYLVGDRYTVADYALFGWAYSLHKVGIDIHDWPLLGKWFDALNKDPAVIKGVNVPEKK

SEQ ID NO: 16880 - protein, 240 aa, Candida albicans
KDPKDRLEFEKLLKDADVVIDGYRKGAIEKLGYGPTKLTQLGIERGKGYIYGAENCFGFVGEWSGRPGWQQIADCASGVAWVQGLSMGKNEPMVPPFPMSDYGTGCLGAIAIMLGIYKRHKYGGSYLCTSSLVQYDLLLLKQGQYPEELWKSQILLNDKYKEFTKIRYYDSVDKISKTALDAMIAQRPGLLNNAQYFVKQESKGFGATISTLKPVCQFDTIETGYRCSSRPNGYDAPEWW

SEQ ID NO: 16881 - protein, 354 aa, Candida albicans
LSLLHHSPSMFVILSLIIDLIYWLNKQFRYISDLIIGNVFDPRFDIVLVTGGVTGLGRELVLQIISKGAQVVVLDILEPLEEDLNTVGLTHYKCDVSDPQDVLRTQKLVRKEIGVVTVLINNAGIATGKPVLDLSFQEIEKTIQINLLSSFYTIKAFLPDMMLRGRGYIVTIASVLGYMSPARLSAYGASKSGLIALHESLTYELGSPSLNPQGIKTLLVCPGQLKTGMFQGVATPSTIFAPELDPAFVASSVVNAIELGRRGEIKLPLYGKVIPMFRALPWPIVEVTRRITGIDQSMIDFKSKISKVASSVSSLRNISLLGSKNVSTEVTPTFAVAESTPQENKAALSQTEIS

SEQ ID NO: 16882 - protein, 187 aa, Candida albicans
  UNSURE (87),(141): Identity of amino acid sequences at the above locations are unknown.
APTWIFQPRGQDLTVMGALILYEQGKLQLDIPVSTYFPEIANIGVLEPGAVDKYSGKLSKPLTTPQTPITAKHLITHTAGFSYGFIXPDYFALITKGERIYAINPPMEFFHKKTPLIHEPGTDWAYGHNIDWLGCVLERIXGQKLGEFLATHVYEPIGMTSCTFHKKDPSDLVRIHFRKPDETLVLL

SEQ ID NO: 16883 - protein, 207 aa, Candida albicans
IDSIIVIIMSTQSGFGYIKGQSDIQKFTDIPIPTPKSNEVVLKVEAAGLCLSDPHILHVGPVESKPPLETPSKFVMGHEIAGSISAVGDQLANDPYYKKGARFALQIVQACGTCDSCRRGLDSVCDLSHQAYGLNEDGGFQQYLLVKNLRTLLPIPDGVSFEQAAVATDSVLTPFHAIQKVRKFLSPTSTVLVQGFLTDRLAGPYGL

SEQ ID NO: 16884 - protein, 182 aa, Candida albicans
  UNSURE (3): Identity of amino acid sequences at the above locations are unknown.
VVXILSVMTLCKDLKAGGNRAACVDATIIYCKSPTVAGLVARELIRLGHGTPTENPHVDWVSEDFDADWDYTVALRNGIGLHFGALPRALQQYTADQFNAGKLRFLLCTSTIIEGVNTIAKNVVIYDNRDGTRSIDKFTHGNIKGRAGRMGVHFVGKIFCLEEIPGRQSQSRGGYSARYSWH

SEQ ID NO: 16885 - protein, 133 aa, Candida albicans
STTTAMELAALTNSPMGTSKVAPGAWAFTSSAKSFAWRKSPEDNLNQEVDIPLGIHGIDTPINLLASVQPDHLSESSQDRFDEVFINDRVSTDLVKKHSYFPCPAISKCRKACSEMKDRYQFPPLSVFTGTPP

SEQ ID NO: 16886 - protein, 212 aa, Candida albicans
AFFQNNILKSQLLQFMFRQLNRLRHFHTSAVLQSDFSHVVIGGGVVGTAIAAELQEQPGNEVLLIDKNEQLGMETTSRNSEVIHAGIYYPPNSLKSKLCIAGKNKIYDAWAKGNFQVALKQCGKWVVAQTDKEAEYLEKINNIAKEVSVPVNFISPTKAKAKYPLIRAETAILESPTTGIISPHDYPLFHPARFESNNRTMGLYTELTELGV

SEQ ID NO: 16887 - protein, 175 aa, Candida albicans
LTMCLCLSDLFLIVLSVLFPPLPVWIRRGCCSCDSLINIALCMLGYFPGLIHSWYIIAKYPPYYYQQQQQQQQRKDTIYYVYRSDLENQTPRRDGRDGRDECHHDHHHHHHHHHNQAESQSAGLIVSNNHNNNNNNYGSVVEGSSSSNLTPVAPIPVENGAPPPAYTEIDNKTQH

SEQ ID NO: 16888 - protein, 105 aa, Candida albicans
NKLDNNNNYNEYLNQFNSPQVVSFFLVLSFLFYNHFFFYFFQVHFTIKMPFTCSDIIKIIVAIILPPLGVFLERGCSSSLFINILLTILGYIPGIIHALYVILKY

SEQ ID NO: 16889 - protein, 314 aa, Candida albicans
PTLEINFNTLVGVNEQGTIDFIHKDYDASLYNNKSPIQFFIDQEEHPHSQPHQENHGQQRYQHFEFVDYSHDLTKFFIPGFIDTHIHASQYPNIGIGLGTPLLDWLKKYTFPLENHFCQSGQEQQQEQEQETKLQFANEIYNQVIQRTLENGTTCASYFTTIDPETTNLFAELLLINGQRGFVGKVCMDHNEPYQEYQESIEDCEKSMHKIINHIEKLNTNTNTNKNLVTPIITPRFAPVCSDKILKFLGELSHEKNLPIQTHISENKQEIELVDKLFPDCENYASVYNKFNLLTNKTILAHAIHLTPKECQLI

SEQ ID NO: 16890 - protein, 248 aa, Candida albicans
FQFSVHPFFFPSLQRHVVELNIMVHQITYTSNEIPQLCDRVHKDYLSKRKSDSQPRYLISLAGVPGSGKTTFANAIAKRLSTFAKVVVLSQDGFHLYRSELTLMADPKEAFRRRGAPFTFNAQAFVNLISKLKDRSQTIKAPSFDHKLKDPIEDDIVIHGNVDIIIIEGNYVSLRDKYWDEIENFVDDTWFIKTPENLVRERIIKRHLNAGIAANEKEAAERADGSDMQNAHYIDGNSKPTKVLILSE

SEQ ID NO: 16891 - protein, 140 aa, Candida albicans
KIEILKFAGEDGAYKRRPSSFREFISSKPGARFPPEAGRYHLYVSFACPWAHRTLITRRLKGLTSIIGLSVVHWHMDDKGWRFPTKEELKTLKTEDDISLGTPDHNYDFSRLRELYFKAEPEYEGRFTVPVLWDKKEVQS

SEQ ID NO: 16892 - protein, 211 aa, Candida albicans
  UNSURE (39): Identity of amino acid sequences at the above locations are unknown.
TRIRGKIHSSSIVGQKRSTIVNNESAEIIRMLNTEFNSXLPSEYAEIDLVPKDLESQIDELNSWIYDNINNGVYKAGFASKQEVYAKECQNVFDHLDKVEAILEKNHNGSKKGEFLLGNQLTEADIRLYTTIIRFDPVYVQHFKCNIGTIRTHYPYIHNWLRLLYWKIPGFQETTNFEHIKYHYTKSHIKINPYGITPLGPVPNILPLEEK

SEQ ID NO: 16893 - protein, 176 aa, Candida albicans
SSTMSELNKSQAVSSDVYLSAFGTTRAKAGSAENFKKIDYGINYLSAKAAKENGSKVCVLVSSMGANASSPFLYMKTKGELEDDIIKLGFDHTVILRPGALLGERKESHGLGNSIAQTIGNWTKGTWLQGLLKPIDASDVGKVAIDFAQKGINGELKDKVIIVGGDDLVKLANSLN

SEQ ID NO: 16894 - protein, 120 aa, Candida albicans
LKILEYLSFSLLIFYYLFSNQQHNNIQHLTVMSSSALTADSLRDIITTRLNANLVQVEDMSGGCGQAFAVIIVSSLFQGKNKLARHRLVNNELKDEIASIHAFTQKGFTPDEWIAQGGHL

SEQ ID NO: 16895 - protein, 410 aa, Candida albicans
QPVPLKKKSYREIQIISDFAIYRIINNSDLFFLCVSPLLVSKMIRVVVKTVTRLNSQCKFYSTVSGGVQGVEGRVPRVNQRSENTNSLSITDPYLIYLGYIQQGILEKDESQLRVMKEFQKLYHRVLDYTPPEELQIQLSLILRQIEVSQAKETNRDNKFNPMKLFQKDPEHKRKQLVRYMTDEEELQNFASPQGLLINGEVGCGKSMLMDIFAASLPHKSKMRWHYNNFILWVFSEMHNIQQQRQLQVGLQKYTMENEFLLYEVAQKMVQKNSILMLDEFVLPDIASANIIKILFTFYFKLGGVLVATSNKLPEELYSTDFSKRKFKDFVGILNMRCQSIDMKSEKDYRTYFANESSKILYMVTKKDNPENEKDWLKLLKVEALGIPSGSHWLDERVSLGRIRRWAILR

SEQ ID NO: 16896 - protein, 171 aa, Candida albicans
  UNSURE (11): Identity of amino acid sequences at the above locations are unknown.
RSVITKIFRSXLGKTSIKNNSPSSLLVDEQTLLTVSNEVRGIYLYGDVGCGKTMLMDLFYDTIPENLPKKRLHFHQFMQNLHKRSHQLKMQHNNNNNNNNNNNNNTTKSGGGGRQHNDIDVIPLLASEIAQTSTILCFDEFQVTDVADAMLLRRLMMLLLLPQFGVILFAT

SEQ ID NO: 16897 - protein, 219 aa, Candida albicans
YHNSLIMSFNHPLIAKLRNYKLILGSSSPGRQEILKTNLGIHDFGILGSNFAEDLSKDDKSPLEYVQLTSKHKAEAIVASLGIKENGGLATLILTCDTIISCNNKVFEKPITKEVQRQFFNYFKQFPELQVISALTLIIIDKDNATTEFSDYTITKLRFKTDDDDEIINAYIESEEGLEVAGGFKYQELGGLLFESIDGDYLNVVGLPLKTFDLLHRSI

SEQ ID NO: 16898 - protein, 203 aa, Candida albicans
LSHCGWPRPVVKTPVVLPFLAVYIVLMMECIGDVTATSDVSRLPVSGEMYESRIQGGVLGDGICGILSTLMTMTPMSVFAQNNGVISITKCANRKVGYWCAFFLIVMGVFAKFAGAITSIPKPVLGGMTSFLFCLVAISGIKIISTTEFTIRDRFVLTAAVLPGLGATMLPNWFEHVFTYQGGNKSLKGFFNAIIVVVESGFC

SEQ ID NO: 16899 - protein, 109 aa, Candida albicans
  UNSURE (97),(99): Identity of amino acid sequences at the above locations are unknown.
MANERTFLAWVRTSLAFLTFGVGFLQYYRVESKASVLESNSKTSAIERLNRPIGSICMVLSGLTLIFGAVRYFQVQDLLQNDYYPATRFTIPNNSFXQXRALGRSAMCI

SEQ ID NO: 16900 - protein, 154 aa, Candida albicans
SQLSLTMSWDQTKFTLSPKSKGCYLITDDVIRSVPQIKDYEMGILNLFLQHTSAALSINENWDPDVRTDLDKSLDRIAPEGDFYLHDAEGPDDSVLHIKSSTIGVSLSIPITNGKLSLGQWQGIYLCESRRYRHSRTIVATIKGKRNRNICTLT

SEQ ID NO: 16901 - protein, 353 aa, Candida albicans
KTLTKQKPRYLPLIDVFLKIYTPMTKLPIPIWLDCDPGNDDAFAILLSLFDSRFQLLGISTVHGNAPISMTTHNTLGLLDLLRVYNKVKVYKGAEFPLKVPSKFALEVHGKNGLADIEFSENTINEISQDMDCIEAMKQTIDLNSENINLVCTGTLTNVAKLITKYPDVTSQIKWVSIMGGSFGFGNITPYAEFNLHTDPHAAKLVIQELSNKVIVSPLNFTHKVIATSEIRKHMYDDNNEKRSSPIRNVFFRILTFYYKVYAANGFLEGPPIHDPLAVYSLLPFFNSFEQYGYTCAQKNIDIITEGVRMGESVIVEGGNTDKGVYIGEAIDNKKFWDSILLALQNADLQTKN

SEQ ID NO: 16902 - protein, 236 aa, Candida albicans
TNFIIMSFGRKAAERLANRSILITGASSGIGEACAKVFAEASNGQIKLILGARRKERLIKLSDTLIKQYPNIKIHHDFLDVTIKDSISKFIAGIPTDFEPDVLINNSGKALGKEQVGELKDEDITEMLDTNVVGVIRMTQAVLPLLKKKNYADVVFIGSIAGRVAYKNGGGYCASKAAVRSFVDTFRKETIDTGIRVIEVDPGAVLTEFSVVRYKGDTEAADAVVVHHRGWKVQRS

SEQ ID NO: 16903 - protein, 209 aa, Candida albicans
TNFIIMSFGRKAAERLANRSILITGASSGIGEACAKVFAEASNGQIKLILGARRKERLIKLSDTLIKQYPNIKIHHDFLDVTIKDSISKFIAGIPTDFEPDVLINNSGKALGKEQVGELKDEDITEMLDTNVVGVIRMTQAVLPLLKKKNYADVVFIGSIAGRVAYKNGGGYCASKAAVRNFVDTFRKDTIDTGIRIIEVDPSGFPTEI

SEQ ID NO: 16904 - protein, 180 aa, Candida albicans
RLISETSNSERKTIVAYFKQGKFPVLCNVTVFTEGTDIPNIDSIILARPTKLKPLMIQMIGKGLRLHKEKSHCHVVDLVGIMDENLELKAILEGKQLQMKKAKDGTTSKIESRDQVNYFENDRISKTIECALQIHSKNIVELRSVDGLELFREYMLDVGVGGTYNTLFLIKKITGYGQTD

SEQ ID NO: 16905 - protein, 364 aa, Candida albicans
HYNSMNLFFIPIIASIIYYYYFTNPNLNTKETQIANDMASQLSKKFIQNPTPFPTYFFSHGGPTFMYELDDFGNKGAWNTVKKIGNNIKKNWKPDYIIVISAHWQSKGDNLIEIDCPRNNEENPLIYDFYGFPDHMYKEEFHSKNNLFIANEIKKELEKNGFNSSLTNRGIDHGVWVPFKVAFSDYNTQSRPQPEVKGLDLPDTSVIQVSLTSRDGDFAKHFKLGEVLSKFRNELIWDESRQKYLSGLIICSGMSVHNLRDLGASFRQPKQIMPYVKPFNQLLTKTVEENHGESLLQAFLELKKNPLLRQAHPTLEHFLPIVVAGGVASKSDDNIKEVYNDSMLSLGWGVYQVGQYNNNNSSKV

SEQ ID NO: 16906 - protein, 118 aa, Candida albicans
FSIAEVNIGIAADIGSLQRLPSVVNNKSLLMQHALLGDKFGAEEALKLGFVSCVVDSIDEGVEFAKTLGEKICDAPAWAIKGTKKYIQHILNGGTVEEGLKSIAEYNAVNITDSKMKL

SEQ ID NO: 16907 - protein, 232 aa, Candida albicans
RPLVLFFGIGNSKRGSIPYIRLTSMNMNIGSHRDESVSTNPNSLHMQFFQDDPDQIAPVHLDPTSMIVNRVTINTLEEQLTNPKIFEDNQDNDESDKYSEDKLDPIAFSIRNRKFKAELTPDERGYIIGRSVSTSVQELAKELKLSRSTIQHTLKMCRQRKHNKTLNQNRGRKLAISPEEMERVLKLIEQRPGISKQEIISSLDLKVSSRTLARALQRNGTKRLTLRNHGKQ

SEQ ID NO: 16908 - protein, 111 aa, Candida albicans
YPLKIVMAKRKKSRSKLQQNVDSNESTKSPSTQNPHQPTYVEQESTQWSTTHQEVEPNTFIQAPYAAEVTQPPNVNQPTYPGIQPELLNPVIENSPISTLSSVHHALIVRN

SEQ ID NO: 16909 - protein, 295 aa, Candida albicans
QTQPSNLQTMSPTSTTQQPVTSRGYEIGTRGSHNIAKGGKHPYQLPKFTDKKEERKWMLQHMAAAFRVFARKGYTEGTAGHISIRDPIDPNTFWINPLGKHFGLLKASDMVHVDHEGNILPDGAQVAINAAGFSIHIALHHARPDVHAACHTHSVYGKAWSAMGKPLAMINQDVCTFYKSHAVYEDFGGVALEAEEGIHISKALGDGKGVILQNHGLLTVGNTVDEAAYLFTLLEKSCQVQLAAQAALLPGEKLKIIGDEEAAYCERNDGDPETLYTEFQPDFEMEVYLNDDFLK

SEQ ID NO: 16910 - protein, 227 aa, Candida albicans
TNIYKKDMTPAPTSTLATTEKPNTKTSSKGYQIDENSFHKLAIGGSLPNQYPKFTDKLQERKFILEHTAATFRIFARNGFNEGVAGHCSVRDPLEPNTFWINPLGLHFALIRAEDLVHVDEDGNILPDGNQDPINAAGFAIHSSLHKARPDVNAACHTHSLYGRAYSAFGKPLEMINQDSCTFFNNQAVYNSFGGVAIEKDEGKAIAEAAGDARAVILQNHGFIDYG

SEQ ID NO: 16911 - protein, 355 aa, Candida albicans
ALMFSKLGVNRVRQLILKRYTHQTSQTSQTNVLTPTFSVDQIRDLPYVDHVDLVWKQLLPYKVKINKRKTPILFLHGLFGSILSFNSIGRLLSAVVKHPVYAVDLRNHGDSPRALPHTYTIMARDIHNFIKQRKWDECILVGHSMGAKVAMMVSLLYPSLVSKLVVVDNTPHSRPLNHQFYKDLLGMCEVEVNGHQYKTANKKTVGKISQINRFLTQYEEDHKMRQILTGNLMTCLKHFKNRKDINHEKEVFKMPVMNFYKYDILRTLGGWPQLPQVQKFDKPVYVMYGNQSEFVAPQFHKEFYRYFTNVKFQDFDSGHWVAMEQPRQFLKKLAKFIDYDEYCKFKPNKVRYVKW

SEQ ID NO: 16912 - protein, 236 aa, Candida albicans
VCFLILTMFKGKTALVTGGSRGIGLAISKKLAIEGAAVSLLSRNETILQQSLLELATDHGQTHTYHSLDLTSLLLRNPQDLNFGSPTILVNCAGVTNHSLLLRMTQEEIVNTINLNLTVPILLSQMVVKNMLRQKGSDPTILNISSVLSMTEHFIPGTSVYAASKAGLLGFTKSLSKELRGKIRINALMPGLVKETDMGNKVMADINLVLVESVANEAIRILQDTKLNGECIVLDK

SEQ ID NO: 16913 - protein, 302 aa, Candida albicans
YLHIMTDLTTVHQLPYVDIASVFDVKQIETYRYRGIKPLQKQSSQHRGVFGGNFVAQSLLVAIRSAPHGFQPHTIHSYFVRAGDDKTPIEWEVDEITNGRTFANRAIRGFQNGKVVFTANVSLTSKNSVKDIVKKTGTMPVIFQKEVDTEYQDLKNNISKCPLFVENSNAHFTVRTFPINLSSDIYAFLLKFGAESKETVVGLTTEYQYVALATISDFVRLEEVFKIMGVEVDVSFNVSLDHSIYFHDNDLDATKWSTYLVEVTRWSHDRVMIVGKIYNDKGIHVASISQERLFVIKNKPKF

SEQ ID NO: 16914 - protein, 621 aa, Candida albicans
PFLCLSFFSFFLKFFLILTPSHPSKNTLPVFFLPPMSNQDISNSDFDVNILHDPLIDPNVDLKFPLPIDKETYINVDGNVKTLHQSFNLLNLAFRLITGGSKYDKIYSVPEYRYFTNKHSDEFRTKFKNYMNNKLEKDDTKLDEIIYDLINQELSLKLIKANQFKERFQKVKQYMVEYYKKQNEKNLPTFPSHNFIRSAYVTVMTIMQKLFPKGIWVSNQDMSDLYQKYLDDPMSIIFLPSHQSHLDYIIVHLVCVRFQMATPSVIAGENLNVAVIGGLLKNLGAIFIPRSFNNEAYTERNLNNVIEFILVNKIPFEVFIEGTRSRDGKLLLPKYGILKSLCSIYLKQRNEEKNTDFNLLFQPISVTYERVYENDAFLKELKGDDKTQESLFGTISVATSAFFVKKEDKVIYNKNGWNDNSERTLTGKIFVKLGESFKISEFVDDQNEIDRALNDDVNLKKLGFKILHEINKNSYIPEISIVGTTLQAYQYFSGKDTFAISELIPVLRIVVRTLLNENQDSSATNSKILEDMAICNDAELTELVKHQILSFFRYIKVNRKTDQIKIESPIELLYYKNLTIHLIIKRCLVMFILNLLNGCTNCNHRVIGKLFYILIGFLKNE

SEQ ID NO: 16915 - protein, 89 aa, Candida albicans
NKINIPLIGMVQNMSHFICPNCKHESHIFKNKGAERVALENNLKVLSSIPLNEEICVQSDVGKPIVISDPNSEIAKPYFDIAKAIVDFK

SEQ ID NO: 16916 - protein, 148 aa, Candida albicans
VKMVKKVLLINGPNLNLLGTREPEKYGTTSLSDIEQAAIEQAKLKNNDSEVLAFQSNTEGFIIDRIHEAKRQGVGFVVINAGAYTHTSVGIRDALLGTAIPFIEVHITNVHQREPFRHQSYLSDKAVAVICGLGVYGYTAAIEYALNY

SEQ ID NO: 16917 - protein, 444 aa, Candida albicans
IHFFAPRTTECLYIYCHGCPHHLLCCSFSLSMSFTRFTNCHLIDNGELYEFTDLYVNNATKRICHPPANPELVSEVIDLKQQILAPGFIDIQNNGIYGLNFSNLGEESTAEDVAEFKRFYRDAMAKYLSTGVTATCPTVTSSFPEVYAKVLPMYKRSVLASQTDSLGAHVEGPFINVQKKGCHPVETFVDAKEGESKLLEVYGDLFDNVCIVTAAPEIAGVLDLIPVVKSKNCVFSIGHTMSDYDTAVKAVEKGATMITHLYNAMPQPHHRNAGVVGLINSPIVDTPYFGLICDGVHVDPSMVNLAYRSNPSKCVLVTDAMHLIGLPDGHYKWDSQVIVKTGDRLYLENTDTLAGAATTLPQCVRNLVKWSQISLPQAVMTVTNNAAKSIGVDHERGFLNVGCLADFVVLDKSGFVRKVYKLGREVQSSDIPLDRATDKLTAVL

SEQ ID NO: 16918 - protein, 290 aa, Candida albicans
MEKQPRSGPIQECLLSGGNCVFNTYMVNADSEVDFRGIFIFVHGWSEHILMYLDLAYFVASLGYDFFAFDLRESGKTRGPYTDVDCPIRDLDFVIEKSTTKYKSFNLIGHSMGGAIILDYLCKGKYRDMIDSVILSGPCVKLHDSIQPSPLKRMFVNIILYWFPGIRYWESKSISAYALVTTNEKKQLEMFNDKLCCPNGPLKIISDMYYRGKRLVETIPDISNKARILIFQSENDSIVDPSAVKSFFNDLSSTTKKIVCIENSGHALFLEKESTVELINKEIESFLKTQ

SEQ ID NO: 16919 - protein, 213 aa, Candida albicans
KLVETLKQTHVKQLVVLDACTGTGCIPLLIGHELNNIAPKIYGLDVSGKAFDLANENLSLYKQRYPNNPIDLKFYLGDVFDAEIMDKLGLPKINLLTSNPPYIPYHDYIKSIDRDGVAKSVKLYEPSLALLGDGEFYRSLVQNILRPSQAEAFVFEIGYKNQADYVNFLLEDDSAWSIGVMKDSSNHIRCVLGWLNGSDFDGLKTLCGDVYVR

SEQ ID NO: 16920 - protein, 145 aa, Candida albicans
SAYFHKLSINLKIAFINSTNNRTSIRSKILKQFSNQEVNILITTDLIARGIDVASITDVINYDLPNSSREYVHRVGRTARANQVGYAYSFCFGKGENSWFKKLAHEVSRSKEVENVDLNVKELISDRDEEIYQQALHELQQQAKK

SEQ ID NO: 16921 - protein, 406 aa, Candida albicans
RCLGLESPQTGVGRLALSDLDKKVRDWFVQETEKLGCQVKIDEMGNIFAIYPGKNQGPPIGIGSHLDTQPNGGRYDGILGVLLGLEILRTLKDNNYTPNYPIAVIDWTNEEGARFPTSMISSGVWAGKIPLETAWSLKSLDVNPVSMKHELERIGYNGDVKASYLENPLACHFELHIEQGPVLENEKKKIGVVTGVQAFEWNLVTVTGKSSHAGTTPMNTRSDAIMMASKIILMAIEVASREGGLATVGTLDLEPRSVNVIPNIVKFSLDVRHVKDDKLEKIMNEIKTKAAEIAQTNINSSFAKPLTVEFQNLITSPAINFNQTNIDTVRKSALQLFKENEIRDIVSGAGHDSCFTSSRVPTSMIFIPSKDGVSHTPEEYSSPEEVENGFQVLLRSVLLYDEMRGE

SEQ ID NO: 16922 - protein, 135 aa, Candida albicans
SYTLHPFQSLLHSIMLRLFIRRMSSAKPPQISHSETPGPIESSIISKITNEFKPLYFKIDNDSHKHAHHAGIRGAKNKTESHFRLEIVSDVFEGKSLSARHRLVYSLLANELKNDGVHALQMKTKTPEEINKTQN

SEQ ID NO: 16923 - protein, 69 aa, Candida albicans
LMITIVCRHTYYLNEQSAHFALLLDLDLNMKVNHLTLFGGQQQRISIARAYLKNSPVLIMDESFSALDN

SEQ ID NO: 16924 - protein, 322 aa, Candida albicans
YPLNPLMLSLLQKRIAVTINSNPAISKAHYATASQEPIDHHKRFQLHEWPKSAKPSAYEIFGLTSKDMGMSTLELNKVLKRKYLALVKIYHPDTSLSIQYKGGEMTAEMKRKRFDMIQEAYDILKNPRRRTAYNRYQTTSWDQQGHYSGNGGQWSKENFEAYRRAHAHRTRYNFKNDEQFWLASTWQDYYQMKYNRPPPTKEELEKNKYKILFGVIAVGVLGFGLQIMNAIDKTNQYLLETHRLNMKSMKDLNESYDNYGEGYSDADKLRRFLINRRSTMKLKREEEGVEKEPEPSDHELLTKFARKRVDIWDREEGNNGKH

SEQ ID NO: 16925 - protein, 232 aa, Candida albicans
APSFNSIGKDWWSWLTYGKNSKTNKSFFFDKNLTSDDIHNTEDTFKSIYPYKDKKYFNTFVTPQVTRKMKIQRGLSQIERADVFSINDSKFEIDTIDNELSQTTDVNNRNELLEKKSLLTWRVLRDQRSSDWLKATQALRAKAVSDQERNADNETKEDHSEDIAKSQKRTLAESVDDDSPEEKKIRLDEQINSENSDDVSEKDPQNHVISEANDASADSDGENHDAVDVDIK

SEQ ID NO: 16926 - protein, 123 aa, Candida albicans
MCVYMGTKKLSKIFFFREFCQCIIFSIILSITYNRLTTHHINMISITKVISQQFKLSNITKNLFNATPRIINPITTGSLYQPIRGFKVRTSVKCMCKDCYLVKRKGRVYVYCKSNGKHKQRQG

SEQ ID NO: 16927 - protein, 202 aa, Candida albicans
LVAIFFYGRENQPIDSSIMFSFTRAVPKSQLRFTVRNSFRTYVSIGDKVPATPVFEGSPGNDINLAEETASGKTILIGVPGAFSPACSASHVPGYIKNIRAFNDKGYQRFFVVAVNDPFVTKAWGEQLLESVAGQQIRFFADSTGAFTKELDLLFDARKAFGNERSKRYALIIEDGKVVKSFVEPDNTSVDVSAAQKVLEEA

SEQ ID NO: 16928 - protein, 509 aa, Candida albicans
VFFIRSFVILPLSDPITFIECLKIAGVFIVGMIILILVDVNLIKGLKFVFNKFGHNKDDKIHSDEEVVVEEEEIELQNLQSKSKSKGITSMRDDITTIDLDSLRPTENKEVTPPPPPLPRLPINENPFEDTSDLIEPEPIYHKPHHVDMFPRTSSQNISIPTTPTTLPPPPETKRSFEQQELVVEVDDDDSELSQITIFITNYIDWILYSLLFIISLPLYYIPSIHTCLPYHLSITIMSYYIALLFHQRYPITKNLLHPIIVSTGLILFICFIGSLIYHHNSPKGFLDDLKFYKTGKNYLNLFTGITLNNNSKSTLVPSDNPTSTPQWPGCGDFLSSLMDVSIVALSLPMFTHRKDFIKNASILMPTIFISIALTFFIYPVICHAIGIQPERSIGFIGRSVTLALGTPLISALGGSISLMAVCTILSGILGVLINEPLFKFLKVDKQDYVTRGVTLGINCGAIATAHLLNVDPRAASMSSLSFSVFGTIMVIMASVGAVRDLVRTWVGL

SEQ ID NO: 16929 - protein, 304 aa, Candida albicans
NITTGIIFPFLPFTTIIITITNYEMEYEEQTKIKTKTNIKLLSKLTSLSLSEAIRPTTFEQYVGQDHLINPIDGAIRNFIKLGYLPSMIFTGPSGIGKTTLASVISYECGLPFLELSATTMTTMDLKTTIMLKNQKNQKNQNVGEQKIVLFIDELHRLTKIQQDWLLPYLENGEIVLIGATTIQPNTRIRQAILSRCQVFKLEKLTRKEIKKVLCQAITFQNLKRKHLYQLGAIVYDDDDEEQGDGVDECFDLILDRAQGDCRIAINLIELISDNFLNNVNDIKLLKNQLQKIFHSLNYNNNNN

SEQ ID NO: 16930 - protein, 127 aa, Candida albicans
VIEFSAKVLIVGSIYQINDCLSCATAGVLRGQGRQMIGGIVNLIGYYLIALPFAYTLAFIFQFGLLGLWFGMIIALIFVSFTQTFFVISSNWQKIIDDCIEEAIIEDGNLNIDAHSILPSMSNSIVV

SEQ ID NO: 16931 - protein, 257 aa, Candida albicans
RISIFIQIKSNQQQQTSRQLIRINNQLPPSVVLHNIIMKSILITTGATITFKSLIQIILSPQFLNNLIRLKINKLIIQYGHEIKNSINLSESFFNETINKYDLINLFNLEIEETPIGDDDDDEGIRLFKNSDIEILAFSYSSNINKYIENVDLIISHAGTGSIIDCLHLNKPLIVIVNDKLMDNHQLEIAQQFTKLNYCIYYSIKELEQYVNNNDNNKDSRFWNQLNQLINGELQLNKLPQTDGSIIETIICEELEK

SEQ ID NO: 16932 - protein, 205 aa, Candida albicans
SNKFKLHTQQIIHIYIYIPIIMYSLSKRTLFQQLNKRISSTTTSSTIIPLSSLSSSSHISTRRYVSTKELTPQTLPTDFPLMSEKKATNAADYVLTSLDMIANWARKSSFWPVTFGLACCAVEMMHVSAPRYDQDRLGIIFRASPRQSDIMIVAGTLTNKMAPALRQVYDQMPDPKWVISMGSCANGGGYYHYSYSVVRGCDRVI

SEQ ID NO: 16933 - protein, 150 aa, Candida albicans
KKRIMLRSASRISRHRLYQSLSSQINKQSARCYAAAASSGPENRPLVTPLGRHPQKYSTPAPGFGPTTFTEVLDDVNITWDKNDDPDRLEKQNTKIRHFTINFGPQHPAAHGVLRLILELHGEEIVRSDPHVGLLHKGTEKLIESKTYMQ

SEQ ID NO: 16934 - protein, 123 aa, Candida albicans
NNIRSLLYFELILNLGVILLINFMCQDMLSFYVYFEISLAPLFILIGLYGANNRDKAADYILIYTLFSSLFMLLAIGTYEVLIGNTDYQAVSLVVLSTDLQCILFLCISAGIMVKTPLVPVHT

SEQ ID NO: 16935 - protein, 96 aa, Candida albicans
IALLMLVNLIGLILFPMVNDLIPLYVIIELQSYSLYLLTGVYNKSYNATRAAILYFVTGGIASVLILLSSAEVYEATGLTNLSEISTYYSISGINT

SEQ ID NO: 16936 - protein, 126 aa, Candida albicans
SPIVNVNQLVVPNKALCIALIVCLFSLIGIPPLPGFYGKYYIIVGLMSNGLNLEALTIIVFSVIATYYYAYIIKQLASNLYNNNTNVIATPINSTLGFIISILMVILITFYMYLPTLLDGLTLLHS

SEQ ID NO: 16937 - protein, 519 aa, Candida albicans
  UNSURE (509): Identity of amino acid sequences at the above locations are unknown.
ISIFVTMLDDVAFIKTPAAKKQPPASNECGVWTTDSPAIHNAPLPADGPGSTSFSNTILFSILALVPGYITYKLGLGFKTWVFFFLILAIPILMAYWSIMSTFSPRINEKVKYPNRPISYYLEFHTPELKAKYETSNGGKGSKIPIETFQELYFDGKVSFKGDCLDVLEYKHDWASFRFTLGLFRFFLLGMIPEVIFHSQSQDEEQVRDHYDRGDDFYTWFLGPRMIYTSGVISDITREETLEELQDNKLTVMADKIDLKKGDHVLDIGCGWGTWTTFASSKYGANVTGITLGRNQTKWGNTLLKEYGIPSDQSRIVCCDYRDAPKSSKPSGKYDKITSVEMAEHVGIRRLTAYLEQCRDALEDDGLLFLQYSGLRKNWQYEDLEWGLFMNKYIFPGADASTPLSFFASCMESVGFEIVSVDNIGVHYSATLWRWYRNWIGNKDKVVNKYGVKWYRIWEFFLGSSVVASKNGTATCYQFICRKNINSYIRIDYVPQQKGLQGPVQERTXWAKEFTNFYD

SEQ ID NO: 16938 - protein, 178 aa, Candida albicans
PLSTFINMSSRINLFRSLFTSNSLKYGIPKKNKLPPRPKHLIKEEDIEEKFLHGGRGPGGQKINKTNSKVQLTHIPTGMVVSCQATRSQEQNRAIAREKLALKLDDFYNPGTSRNAVLMERAQKVKQSKSKKSNRKYKKVEDENIQKQMELSKLEESLNIKDIDDEFDDFIKNAKVDL

SEQ ID NO: 16939 - protein, 238 aa, Candida albicans
CIEKNTTDVITHFPKLLDLILVSATIPKVFEKKLSKLFPDQRSLIRVATPLLHKVPRNIKVMTIDADVAPYNGSKPRCLAQALYAISKDGTEPGYVKRIIVFVNEKSEVDGIVESMITKYKVRPEDIVGVSGSVNIRDRKDMLQPFLQPAELIENDDFGSTVKILVTTDLLARGLNFQGVKNVILLGLPRNSVDLVHRLGRTGRMNQNGRVFVIVDKKSKKSWVKGLGNAIIRGLRIG

SEQ ID NO: 16940 - protein, 241 aa, Candida albicans
IMSNQQGTQTQDTDYSSDFDEFAATFNNFKPKEFKSTTETSTLILSAARLELESITLKQTMSDTIKSFLKLPVKKLTETHSQVKQLYKDILDLKQTINETNQIVKEELLEIKNSFLNNQEQFNLQIQDLVSNQSMVLESRFLEQTNYVLEIIGKERQLFETSQQQCQYNLQEKINQQSIEYNKLTTQIEGQNKDIQEIKQFLKLLVPRIVGIEASYKVLSTENPIMESQQKPRPIKRKKQS

SEQ ID NO: 16941 - protein, 371 aa, Candida albicans
QFCFPTKNNFFDKHNFNYYIITMEELLHSKIFWGRILNLEMFLWCSMAVMELVFVHNLQYVKEMICDNIIVKFLRLACDWDILFTQSKDSLDSLLKTLWYRQTTILQTDVITSNRLVHVITLLLGMVLTTGPESTTANVEIPFNFLRTCYLMRQDEFPLILEKMNCDKSLMEEFFNNLVTKNDNETLLRLQKFPPFVKSILKEFQMLKEQHNKTDYLKVSNMISVTLHNGGKLGQMNSIYIKSFEKDCELIKSQTMNAELAKFNRLVQDKEESIKHLISTYHGLKTEISRLFEDHSTKSYVLDYIENTNRMRKRLVVEDQLPESERLTYNIDVPLKKIDSFTNASAIHQYDAAITATVFTYGAGRIRAKVS

SEQ ID NO: 16942 - protein, 341 aa, Candida albicans
LIIQLFITTITSYYLCQYIYQKSNNSSYTQDTHTPPPSIMSNPISQYLALVSLNSVQSTLKYETDAVTNLFNQYQQDEFAINNIIQSITIMYNTIVANNGKIVITGVGKSYKLGLKLVATLNSLSIQSSSLHPTEALHGDLGLIDQNRDCLIMVTSSGNTPELIQLLPHLSSNLPILLLTCSKNSKLSQYNQINSLILAELLSCHKEEIIHGIPAPTVSFTLSMMLADAVILALLELIETDSLKRKKLFGLKHPGGSIGANLAQEFNQNNTNRSGDNTITTTTTTNTNTNNSSSITVQAPIIPPSNLMSATTSTTTTRLSSNSSSMLSLKEMELESYSSVG

SEQ ID NO: 16943 - protein, 251 aa, Candida albicans
KINKDLSNHIHIKGTTPFIMLRSQIIQTRSFTSLTRNLSWFGDIFGKNKTSIESKQKRQDIITKQDELTESDSIKIHHLTFKNSDKYQSFTIEQNMPNFHKLKNWKFQKSLTPNDYESFYSDKSILQNIINQELKNLIQKDIIVSRDNYKDIKLDDLSFRFQIVKSLQSKLGIDINDYIISKSHDLETLYEEIENLVNKRWKFERNPNAIVLRSEDFDAENIYLNQERNDFEKNLELQKLTQKLKISQSQQ

SEQ ID NO: 16944 - protein, 635 aa, Candida albicans
  UNSURE (28),(34),(42): Identity of amino acid sequences at the above locations are unknown.
RIPTFHWPIPKNLATLDNSMWTKNQGKXLENFFXWLSPLLVXLRINLNSKNLFFNDLALKQQQRRNRVKIFWVFKILLKCFNLKFGFKPSLNTTVINPVTIDRYFQLTPEKLSSLLDDNDDLFNTLLKPSIEFLNLMNIIIPSSFSPNYYQYLKQDRKKKDKDKDKDKDKDHHHHHHHHTTPHRLDLILNEDDGEGNDGNLNYNYHQFLIIDKNLSAWRKSLQNKKTQLTLLMELGLPNLINIVENDLYFDMNCDALSREGLINYYLTGLPDIHTASHLIKLQLNFHYILIRSTNYLNFIVDRELTFEYYREISLLSMEVLQFFLLIFEHVSKAEEKINEPKVPSNSIVMESLGLDVDEDGFVINDFSVKRRKLDSNNKATNQLKKLVKEIPISPFNTMLNGLSLCIINLKKSIILQMLYLLICQMKFIKRPQGWERMDESFDLLNKTVDLFIRLFINYKPGTSKKVHEDKLYKKLVNDELKDDILRHHQYGSDDEEEEEDDDDDQFNGAKKRLPGYYKSIDWDDEDLDEDLKYLKILKFVKYKSNDSLQKFRKKQKPDNNTNTNGNGSGNGNGIPQPTSVTHHHHLHHHSQPQTETDIAVPQLPIQHSSSVSPATATTTTTSASYNGGCNKFIK

SEQ ID NO: 16945 - protein, 366 aa, Candida albicans
IKCSSGWLGRKRYNGVAVDNLLGFDQVITATVEIFKLKSKYESEALKLSNQLNTLINQLSLDISDLKNDFTMDILSCLKLLEDSILDSTKLTHFQNSFNHLNVKLTSLVNILQRFQNFRFEIKSELVYQSYPQIIQILGSIKSMLQSFGDIDYIPASKTLNIDPISTKLEQLITLDSLILAEISEVILNTNSEELFIKLSKLKDVKTKHKLVKTECETTIEYFLGFFRKLEMFESSLQSSPPLKYFEARDPPDFDITPDIFNQFKTVILRHNNCHHDKLFRVLQEQFVPSDFSNTTLEFFTRLIPIKASPISSNDSSFDLTSSTSVDDDDIFDELQQKLDFHLLLTNNKIYDIQEFIRRFENGFKL

SEQ ID NO: 16946 - protein, 282 aa, Candida albicans
MISMNPIMIRNNLSRSSSPAAPPTTNHSSTVDYFSIKPKLSLDTNSQSDSNSTQSNNNEDTHSEQSDYNSYTHNQYYDSDDDEDDFDIRDQLLDPFDKITLSNCNEEYYSPLTPFDGQTTSPQDSIISSKSSNKSTTVVPSPQFQLTLPKLTTYSFLIVDDNIINLKILNRILLKLFPKCHIVQIQDSKLVKDLLHKQLFDSIFIDIEMPDVNGIDIAQFVRQDTKFDNMGMVAVTTRNSTQDLELFKQCGIDFTFHKPLNYSLDFMANSIDDIIITRKNKI

SEQ ID NO: 16947 - protein, 213 aa, Candida albicans
RPGMTEDNRVNKSQRKELRSQLDESYQNNSELKNEKEIGIPNDQILTSSCLDSNEEPNHDSKKTLKNSISENYTSPATNNSSVSLQNLHNSTPKTIAVNVKQNTNGKRTKENVKKSVKCDNEHVSKDITKLSNNSKSVPTKSSATETATSNLSHSKTASNKENIDAVRMNRKIIRKRIASKPLSEICNQHLRSRVGLSKRVKIDPLHQKLKNK

SEQ ID NO: 16948 - protein, 143 aa, Candida albicans
CLSQIDRSLISAMLSKIKLLGSRKCFSTWSILAHENPLGIPRLAGKPNSIPKASKGLPIRQKIPNVSNIILISSAKGGVGKSTVSVNTALALNSLGKKVGILDADIFGPSIPKLMNLKGEPRLSSLGKLLPLSNYGVQSTFMG

SEQ ID NO: 16949 - protein, 374 aa, Candida albicans
DNGSLPELESFICWDCSIHNAGDFDKSLSIFPPNLKTLELETCKFVNADFSNWELPNTLESLYVSDLPFKDGFLGEYLKDVDVSGNELTLDSNFRIFHMVEKFILHPQYLTFESLDFMYHLPNSLIKLHLISRKQGRLSPLIQMVKWPPSLCDITLENFNIDQSMLEFLNFKESRLEKIKIIKGDVKRFIADLFPVTVRNLSLKYMGIQQLSDSFENLENLRKLSLKGNQLRKVNPVKLPMSTLETLNLYQCNLRLISPFLVSMLEEKNKNAELKVYAWGNTNISVIDIRTALKSIKGLSLELNDFDKTLTEISKHSSRLQCKYFVYDPYSKESKSSATEEVALDYDPDDLYDGSDVSLDEEDVGGGDTNRRKM

SEQ ID NO: 16950 - protein, 523 aa, Candida albicans
  UNSURE (61): Identity of amino acid sequences at the above locations are unknown.
EYNYIPTINKTFKQFVDKLKSIEFINDLINWINEIYIKLGTSKHALKLQQKSNFLQNEIKXLVTFDDFNPKEIKNNVLQIVKDMLGEKSIDEKSIEQTLTDEPTGDEIPLELTPNEQTISSETANNNVSGDDEVHVEEVSAEETPDEEVPVEETPIEEAPIEEIPTEEEPIEETFKEETTIEETPTEEIFIEETHIEDTPIEKYKAEVEEEEEVVIEEEVVVEEDEIEIEPEIPSSNDDEDEDDSELEPETIHLTSTIVVTQSESEVTGVNDAVSTDDPVWGPILHEINYWETKVNKTMILALNNLKIEMKPKIDEIINDIKPEISDILQDLQKTNYEQYQLIHRKISQINKDYEEIKLTNNSLIETITRQEIRDDISNCTKTSEDASLKIQEILNNNHEKLLTIFYEVLQDTIDILETSSESVINEFKNQLNYFIYQSDLKDDDEINWTIWKKYHKIKESLFEFRDNLIKDADDYQVDNKKNSVDKLTNDSLNEWDNYLKNIEFHLNFLISDNIEFLQFLHH

SEQ ID NO: 16951 - protein, 326 aa, Candida albicans
GVIRTLSSRILVQDQFFFDFHTQEPLLLPKEVIIRLIPKLIKPLKIYKDWERDFKEHLIENDVVQYNELLGKMSRVNLAINKAAAIYEKLSTSVTLPNFLISRKTLEKFNDESLIEVAKKSNKDGNDQLPRNVQLKQLFSLEASSTLPLPEFKVINQLINIEYRLRLEKRIQLELLTLIKQKLNSENREWAKNLDSLDRFITQSIPEAISQVERIKAQELDARSKKIEQESDSLDDEESEIQDVERDDDDMEHRREEVDVEDNEMGKESDVESDVQHSPIDTTSLPLPSDHHEDEEDLELHIHQEITAPDDSNTDNDEDEDMLLDH

SEQ ID NO: 16952 - protein, 138 aa, Candida albicans
MTLLKQTPPQQQQLLHNELLQQAKLNQINDLKNSQLYSKQLIQTLQSLIKSNSNTLLPSSGLIDKITTIHQLNNEIDKQLNHDIAQNYYELIQYKQKLEKVIKDCHYVINEIDNLQFKSELIDQNLRILEHTLKLIKK

SEQ ID NO: 16953 - protein, 199 aa, Candida albicans
  UNSURE (3),(5): Identity of amino acid sequences at the above locations are unknown.
MIXHXIILLLWSLLLLASTNNDEHYTQAVIGLEQLARNFTRPNVYNIDNIEGNLYIPQFDQLTNDYKSKQEKPQPPLELTRRIIPLLKKSASESRNVNALVTLGDLYLFGNYSLTPDYYMAKEYYQEAVSLAPNGHAYFMLGYIYSTGLFGTFPVDQERGVLYYQFAVENGDRNAQMVMAYKNFKGLGVPKNCELALEY

SEQ ID NO: 16954 - protein, 396 aa, Candida albicans
MRMNGGDPHTSEHHKEIYTYMKDAVYHRDTEALYYMGSFLQSGLSKIADSKNDISCPNIVMYYRVFLERLSSFYAPHLKFAFEELIAGNYQNALIGYLIAAEHGFEEAQISAAYLLYQLQPLYSKQPPKTFVPERVEMAVDYLERASKQSNVDATILLGDLYSGQAGASHITPDFDRAFNYYRTAAERESSHGAYKLAEMYEYGIGPANNSVDYFMAKRYYDFSLKYNEMLNHAKLESPSQFVSGKTHIDWALLRLRLKYLFNRLASKQSGNSDGGWLSAFKKVGNRVPNEVPQDSNSISRANAHHEGGTYNDDLIEEYDIGDYLVIAMTFIFFFVFFVQNILRQFRRMRNGQRRDEANNNNNNGDDNDDNQGQNGWNGNQFHFKRGNFEFHFFAI

SEQ ID NO: 16955 - protein, 197 aa, Candida albicans
QNNEIKTEKLLLQYLLMIEPILKSTHQSDLNQSEQRILNMLNELYNYDENDTGLVFQKIANSKKQNDLQSGNYNLIKNVVKPILDGLGELNKTLMTLNKEYVSKKQAQVENDPEEGAKRKQYYELVRKWRELENMVTEIPVLISDLPINWYDDPTLLQIMQEVDEIQIKLNTYQLIINEDTISAYSTTELLALEFPC

SEQ ID NO: 16956 - protein, 268 aa, Candida albicans
LKETYLTMFRSVIAQQRFVLPRLAIHPRILRSILFCPSNSFHSSSQCLAKRKNKKSSNKNDEELDSSEKADENAEVTIDFQKVTSNFDNVLSKFNKAATDIKLGKLNPKIFDNLEVNIGNHGHEELVPFTSVAQTSVKGRNFIINLFDAGYGKHVINSIIGSGLNMSGTIDPTNKFQIKVPIPNITTETKQENIKQLKEIFENLKNNHKSNSLNYVRSEARNKFQSSLKHNKISDSQHQLLKKLETLHKTYVDKLTDAFKQAEKSILK

SEQ ID NO: 16957 - protein, 301 aa, Candida albicans
RVSVQPRGEDSSSAKDDDEISDIETSSVSQGNGNGIIEQPEVLSSRSSNGTLVRKREHPEESLAPSKRSKVCESTNSAEDGLKVTKTQLNANEKSLPLDDEIALENKQGELKMSKVDVDFNGQQGENIQVDSCNFSSINNNSLDPKTFAESIVSTDGEEKSENGEIPPAKELDIECTTSPDLKNSDNSAILETNNDINKKDTEEEKEKMKEEQYSMVQEAPSYFLPLKEFEEIKSKKEIDDDFENSVGYRSNGISKSYSPMDLVDLLSTKSDAELACITSDEKYEMETKLLNLMVRLRNLK

SEQ ID NO: 16958 - protein, 311 aa, Candida albicans
IKTSHLLMHHLKYSPLSIFITKHSMINSIRLLSTQASNNLTHYQILDIPATASIKEIKLQFKKLLKKYHPDLNQHLSDDERDAIKEKYMQMISSYEVLKDLKRKKAYDQSINLNHKREWNNKYYGEAKYHSKTNKSYNYTSLGLNTKRHKVRFHNGYTPDNTNANAKFTGEHVNYGDRYDVPHFDYEKHLNRNLKFEQRLIDKYLDQSTQTKILNQITRSNHDDILQELKTKHLLRHVNMIRNTNTSYSGSTSSPKYGESTTFNGSSASTAFHQNIYQKPRSTDEDSSMFKAFAILGGAGSSLYLLYQVVF

SEQ ID NO: 16959 - protein, 199 aa, Candida albicans
NMGIPFPDIDPYETLGVSKDCSPLEIKKTYKKLCLKYHPDKLRQNNNDNDKDKQQDMFTKIQFAFSILNDPVKRKRYDNTGSLADYDLEDEGFDWKDYFESINEKITVEMVEEDRLKYQGSEEEKYDILNNFIYYDGDFLKLFELIPHLEFTESEEQRVYKIIDKELNNLQVNDSVRKSWEKYTKSRKTSSPRRGRTKS

SEQ ID NO: 16960 - protein, 327 aa, Candida albicans
IFNLFYNLILIDAPIPSDLPFMIATQQNIIDKLIDICWKRVRGTSDFIFLSQIRPIINEIQDILQKDSLFNERENEIIKQFIQSDPMKKLQKQELKKFIDRSVEFGNYEIFLFNRHKLTSYEIKRRIEQNSLLNDSMANTKIPRLLPNREYKYKVWDELRQKDDYIKEKTQALESKDLKYSLLLSQIDEQLLAVKTLKGENLTLKKQILELKSQLSRQPPVNKSNAVYHLQLKERDLTIKKLDQVGKEYKKRIHQLEQQQLETSKAMNKLKQSILEHDKLVGRLKEKSITPTNDDTSNLKKFVTTLPIIKQWYILLIYKMDNNSIKM

SEQ ID NO: 16961 - protein, 286 aa, Candida albicans
  UNSURE (32),(34): Identity of amino acid sequences at the above locations are unknown.
EQILIKKSVQLHNDIDSLISKLESLVEAVDIXSXDKQRLIQITTTKINLIINEFETNPKLLDSHLQNYITRLCDLYLNQLSVRSHCGEIVYNLAKIRQMKNIILYFPSDLYLINKILSIVTTTTKANEFITFFALLWICNLSLLPFPLNSIDKNLSITIYKLGIENLHKYHNGSKNQIASLILLSKLLTRNDCSHLLQQFFQNIDINNWVILDANSKLSYYLTVNKLLKSQNIVGEDELLKINQCINNDLLQLKSLNPSNLNVLYLVKIFSKLALNYISRGISPKI

SEQ ID NO: 16962 - protein, 204 aa, Candida albicans
KRRNMIHLNSDEEPNSNLTARTPATSTPTPSTSTATTTATTATTSNNHIPVITSPVPSSSSRPIPNTAANQTVVETFYTNQLHQTITDQLISFRQELTSNNEILVERNHQGAALGDLLDQRIKKLETTLIKTNNQFKKKFEKLTTDHFNKINSITNEFLLEQKDLTRQIKQLFNQDPQNNENLQLRITKIEELYESLLNKRKSL

SEQ ID NO: 16963 - protein, 324 aa, Candida albicans
YLQSHIGERDQYNFLHIYTTKCTTYHLFILKKLEIRYFGDAWFQTRDITINMGASTSKQGGRKLAKSVSESAAKTINRTSNVNQLPLQNLRDKFEQQHKDNLVSQGDEKSHQDEISQHSFRPDSTTKFDPKFLRKKLNNETTSAFEGKDGGDPHEQGTSTYDKSFIDSVSKLGTQIKTIEFDPYKDKNALPLRQLRSRKKLYDLGEQELKDLMEPTSLRNEVEKTMVHPQTLSAILRDLDDPRVDNKEIHKDYQLEPDFLKKLGTSIRLPKTTVVIEEVVKKDEVGHKKVVPRKRHEEAEIIEDDHGLEKDQYDKLKKRLSLDD

SEQ ID NO: 16964 - protein, 224 aa, Candida albicans
HYGVSTLFKLANLHKHVIKHQMSSNPAKHIGIKQQKLIEESIKNYVVYYDKTFSLYLKLRSDILELHNTVRLLSTHKEKRNTSNPDDNETKEEVSTAEENSISKDEIEPDNIKIDEADAESFKNKLAEAAVRLEQLKFEADKVQITYESYLNELRNILAIESRKHAEGYQPEVLTDAKNKLSSLVNQETELNAKIDDIKTVQKPLLDKVTNLVSNFNSNITISS

SEQ ID NO: 16965 - protein, 208 aa, Candida albicans
NNFNMVKQEDFAVEQFMDKYETKIEWNMAETCTASLSFNELFELIPDKSVSQSLQQKVFDTRLTYGRIKGSPELKQVIAQLYNDEGGSITADDIVITNGAIGANFLTLYAIVDQGDKVIVVNPTYQQLASVSRVFSGASENIIPWNLNFEDNYLPNLDELQNLVDTHNPKLVIINNPNNPTGVVWGHTIMEKIVGICSAKGIYILCDE

SEQ ID NO: 16966 - protein, 288 aa, Candida albicans
HSFSSDYSMSSSSLPPPTTTTSTTHIAILVLQSYIPNVTEKHGDFGDNIIDLLNRAQINYPMIKYQLCTDDESQLCETYQQLNRNLSANLITGIVLSGSKNDAFDNSKLWINKLDEFIVDTLFKLSTKLPIVGICFGHQILAKNLGCKIGRNELGWEAGTHTIELNQEIFKIENTPFLPALVSPKDTSNSNGDNDNDNNPENQVILDHLNLVESHQDIIHGLPTITGFEDMVSIGSTVKCNIQGMMTTKTCPIRLLTFQGHPEFTTSIELDILKNSYEHGVCNEQEYE

SEQ ID NO: 16967 - protein, 204 aa, Candida albicans
HHHIMQVKNKAKLKDKNVAITLVPEDSEDLWYLYNLLKKGDTVQLVTHRNVKKGNQAQITKGKSKMEKIVVRLKLLVEDIDYIASDQTMRINGKSLVQQEYIPLNSIHTAEVELNKELTILKDNWDEYDMTLLNELCSIENKADIGAVVFQEGVAHIRYVADSMTVLKAKVEKSIPRKNNEYGTTDLGKRHEFFFQYGSISKHE

SEQ ID NO: 16968 - protein, 700 aa, Candida albicans
GRSSDRGSAWGLWQLFSFSKRYWLIKMLFKISFPYRQLCGFLLGDRVELVKFMNQPQYASDISISGVEETVTEDVRLALLDIGLVYPGLQINVDNKRITIVDVNDSLDASMDKLSIKDSDSLLSVHTVSPPYLFSPTTSINVATLSFPARSKYPNLPQQITYDQVGGLSKQIELLKSTIELPLNNPTLFSDFGISPPRGILLHGPPGTGKTMLLRCVANSITEAHVLTINGPSIVSKYLGETENAIRDIFNEAKKFQPSIIFMDEIDSIAPSRTSDDSGETESRVVAQLLTVMDGMGDNGRIVVIGATNRPNSIDSALRRPGRFDQEVEIGIPDVEAREEILTKQFAKMNSEKCQITKEEIASIASKTHGYVGADLTALCRESVMKAINRGLTVGIPQTAIKVTVDDVYHALPEIRPSAMREIFLEMPKVHWSDIGGQEELKRKLIEVVQLPLEASDSFKNLGVSSPKGVLLYGPPGCSKTLTAKALATESGLNFLAVKGPEIFNKYVGESERAIREIFRKARAASPSIIFFDEIDAIAGDRDGDSSTTAALNVLTSLLNEIDGVEELKGVVIVGATNKPTEIDPALLRPGRLDRHIYVAPPDYDARLQILQKCSRKFNLQSGDESVDLQKLAELTDGCYGAEVTLLCQEAGLAAIMENKEATTVTNKHFEHALKGISRGITPEMLEYYEKFSKKSGLNI

SEQ ID NO: 16969 - protein, 294 aa, Candida albicans
IHISFGRLVQIHGCGPVSLNANKEDMIKKFEQKSEAEKLSTIKKFLNMHPDPLNQEQLAPLAITYQDFVNALPSVQPSAKREGFATIPDVTWQNVGALFKIRMELHMCIVQPIKKPELYLKVGIAAPAGVLMWGPPGCGKTLLAKAVANESRANFISIKGPELLNKYVGESEKAVRQVFQRARASTPCIIFFDELDALVPRRDTSMSESSSRVVNTLLTELDGLNDRKGVFVIGATNRPDMIDPAMLRPGRLDKTLYIELPTPEERLEILKTLVRTNNSPLHRNVDLNAISRDP

SEQ ID NO: 16970 - protein, 182 aa, Candida albicans
KIQQDLIITNPNLMIDMSSIITNEMEENSIQLVNIVESIAKENFKFTKFMSSIKEYFTKVNMSLSDFKYRDLETEKLPTPTDLIDLKEITADPETIKEYFTEIEPSEIIARTILNECYKLYHNIETLLNYISQNDPLDKDNESAIAKLQQDLEVMKSNWQDALKTSENWKKLAEQQQKHLST

SEQ ID NO: 16971 - protein, 391 aa, Candida albicans
WEKSPQYWTTFSGYYREIRNICHQVSLPFAKDQILQVYGNITEFYRTLMDEMTNSNKYTENIQNELKAKFDKLIGVIDLILADREKNREDLKSSFNMFKNNFEKSLNNALVVMKHSYEDANSNVKELESHLNYFINDMLQVYILINEKALEVKSQQDRIKEHNADILNQIEEIKKNLDNAYEEALEVQISNNQLVHDIQSSLDYSLFTVSNLNSHLQLSINDFIEKNEDIRSRAPIIFEEIFGLFLNHLNESGQLAMDSFEAALDLSLNMLHQKLNQTERSIDNLNSKVSDLAHFADSLKKYASSIFNVPNYVRTSMNHKIQQWREFGNIMVVGGVFFFVVLTLLVLSFIRTQVMKVFRFAFIGIPMITGIALAIFILRLLSMPMKVVDID

SEQ ID NO: 16972 - protein, 273 aa, Candida albicans
FMLSKVPVAGQMCTTSQQKKKDVFIFIRAVEKKKKTTIIEAEKLVSFTHTFPHGYECLQTSNQFFKRTTMDNSYDDLLAISTLVLSLSQNVSDSEEYITKLQSLSKNLVSKDQYEQLSKEADVLTESNNNANDNDEMSIIRKLEEERLSLIMDIQREDFVSSKLIELIDQNQEIIESVKEYLEARESIQEEEAAYTKKQLDIFVNDIVLPILAQLNENLTGLLARMKNVARKLLRIQLRAKENPDLAMSENYRKEFTELVQCFCSLCKEYKTT

SEQ ID NO: 16973 - protein, 1008 aa, Candida albicans
HPPSIDHSSNNINQQQFAMPNLPSILIPPETPRAKAKDSNTSNLGSVNRNILTPSFSFGLNFLPSFNFNSPSVQAISPGNFLHISNSFNKAINRTPITSTSLALVPPSTGKKHNRFLEALTRSSQQDGDNNKEGSSVSDTDNNDEIWSTVNTSQAQHNSTNQTSMYEDENDHEKDNSFLPPNKLVLEKIEENNKSPSLDKAADISPKTAGDDYIVKKRKLSTDQSLTDSPNNSVASKIDSTMQSPINYRKQSVAYSTKSNSSSSAIADEKVWWPELDDVLIKSLYKYKKFKEDQDSFNASSILKKTSQNKIISRMLLNKTGILRTTKQISSRIFRLSKSEKLVKETKTLQTGSFANNNLDDILLTPLRSLVNARGSIDSSKLNTIIDEELDMLLGTSPLNEEFDDTLYKLEIRDFRLSFRSVHDHHIFTNLVSIDVNKSLSVPIEEAIRIKLELKKVPAWIINHDLNLNCHHIASSTPCSAVSASHQFQQLHLSLTGGNFESHMTIDVSCGEKSHKILSWRSHIVVYKKGNKLLEVVDVINGYFSESSKSYTLQIPFLKNFFLGYITYLANGAAITPDENLKIVQIIYSNPKSGTMEFDLGESTIRAYIIHELNIAGTSGSSKINIIDVHSKYQSASKQDHCDIDDNETVLADSSPLKLSPNSSRQWDTPSKSRLRIDTNKANIDGGAIAGPMTAPIYNAELLNKKMLDEQEKMKSNLQKEQLRPPLMHSQSVCNVNLSTQRIHSSPEMANNSTLAFSTPMTNRLGPVQNNPPSDSNFTPYQIAQKLFIARTQLELHLQLQANMQEQQQHLQLHTQSFLHQQLEGMINPQIHFVQTQMPQQASAGAAIAISPQIQNQLPQQIIQHVPLQNLGQMRNVPQQSFSLATNNNVITPDNNFMRQQWQQQMYFQQVAQQQLHNNGHQTGTVSGNGQSGRHNLKMIKHPTNLSSSQQNVHNNKENIKPRQITFGPILGHDPSPDLKTIQKQNTKNNGIVQCFPANTQIMYKPKK

SEQ ID NO: 16974 - protein, 316 aa, Candida albicans
LNIWKRLLTNFLNNCLEIKQIRSLEFFAKFLDPNANWGDEIALIQSQLPKSIYLLNPENGLKTDPIYSNLPNPSNKNTISFFKDNKKKLTKKTNKLLSNGSENHDIGVGGGGGTIGNGGNGVNGNGTNSQSQYIANTSMLDDINKRIMENYIGLSNDYSKLGSTFNSFSLILAETTTTTTTGVLSATKKSNDNELNLIFDKIGQVFDRSYITINSLIGELETKFSEPLGEIVQYTSIIHYVAKYQSKKIKQKSMLDNEIKDKRKTLEDLLKIERESNRIENAINSQVKPKNGKYNLEQQQLSTVSPAPPPGPPPSS

SEQ ID NO: 16975 - protein, 433 aa, Candida albicans
VIIGWVLGCSGFLYHRYYNMHVLRKMNDAFETGDPSAQLKMHTRTHDDSLEDEINAHWVDRPQQKLLNDIIAGDIIGRYFLIIGEKGTGKTSLILESMKRVNGFNVCIFDAHADPEIFRIRLGKALNFTFNEDYIGSLFSIRGPRDTTALLDIERAFSKLEELAIKRVNKVHKPLIMIINNAHLIKENEEGVKLLELLQQKAESLSGSGLLTMIFNSDDYWVYEKLKQLGTRLELINVRDFNRMETINALKFVRHRYFPKLEKLDDELCNAVYDLIGGRPQHITQVARHRDIMKACHQIIDREKTWFLNQCGLLGDDMDDDVMESGISSTSAMLLMREFVEMDRQKSNPLLINLSSSDGTHSSQLMNHRLPELPLWRARQIMTRPDYIQRFDNLNIVTIDSESRVRADSVPMMRAFHEIASQPHFRSIIRRHI

SEQ ID NO: 16976 - protein, 149 aa, Candida albicans
YYSFSIHSQLYIMDDAELNAIRQARLAELQRNAAGGGSSTNPSSSSSGGAQDLAQENMTITILNRVLTNEARERLSRVKIVRPDRAQAVENYIIKLYSMGQIHQKLGEKDIVQILDGLSRDSQQKQQTKITFNRKNIAGDDEDDDDFFD

SEQ ID NO: 16977 - protein, 696 aa, Candida albicans
  UNSURE (4): Identity of amino acid sequences at the above locations are unknown.
AVVXTPSSVLAVNTSKATFENTQSHFSNLHIEYQPQPTLKPSLKDSDVVVFDKASSYNNSPNSESKDGQNRQSDGLDDSFQAISKAIRKSIAGRVGDTIFKQDLSGLDLLPNRSSSKSQYSKLDTTMQSLKSDEKSLAPKTPKSRSSMFIALPTREPIVIKSVSRRKLGVSKRRTMENTKSLNSDQNSVTLNTNIKSELNNTPVSTKGEKQKFEQMSPVKLPVDKRVFREKVPMLSTGEKDDNGEKKVDKLVERTMRKEEEHVEHVFTLPEVEHEKPIVSVTRKVENEESVVQSTDPKDVTNDTVLPSGIWSAIGKYRSLSPVRKPLFNSKTDDSPRSILASTSRSRSRSRSRSPLRKEVLVHRKNSRSPRHELFRGNSPTSPSKLTANGGESDLINRLTAPTSSSAAKSKSQNRKTDCRKPERNKFLTTTLIPTTGGNNKAKEVSPIKLKSEPYRFPKLETSSIPTLKMSMMEKRSETTLSKTRQKYIIKPTNTFKRKSELGKEKHEHSIIPQHTHLSEDQKLETNPQTTLGSTTQDRKSEQRIKRIKTANGVALPEAARGLLNKDNANKKSIASVAITPARDEIRVGNNVLPVTPTRISPRNLPEIDSDEEGDFSKKKILQPWADSPILRRSIAASRSIDPATVITNNPKIDLHETFQSVVSAKRGQESPAATPNMRQLEKDMKRYFQQLGYIQ

SEQ ID NO: 16978 - protein, 80 aa, Candida albicans
YSAGTTKGEGKESEINSVRDPEGEQKEIKIHRKGRTSFKTVKNNRDYLKNKQTSNWMYLSPFRRLPRSTSLCFRQAPKSI

SEQ ID NO: 16979 - protein, 97 aa, Candida albicans
  UNSURE (6),(14): Identity of amino acid sequences at the above locations are unknown.
SPNNCXAIRLVEDXFASHPTSIVRELHVYGSVVPLHSRDPRKFQHQGFGTLLMEEAARIAKEEHGSEKISVISGVGVRNYYAKLGYELDGPYMSKML

SEQ ID NO: 16980 - protein, 239 aa, Candida albicans
  UNSURE (44): Identity of amino acid sequences at the above locations are unknown.
RSCRTVIPVAKSVNLIFWLLNFHNLLQHKKFIEHELEGMGIRIXQDPPNIVITKTDKGVFHITNTVPLTHLDNDEIRAVMSEYKINSANIAFRCDATVDDLIDAIEAKASKYIPAIYVLNKIDSFYIEELNLLAKIPDAIPISSANGWNLDDLLQMMWDKLKLVRVYTKPKGKLPDFNEPVVLRSDRCTVEDFCNSIHKSLVEDFRNALVYGTSVKHQPQIVGLNHQLEDEDVITILKK

SEQ ID NO: 16981 - protein, 253 aa, Candida albicans
PKNYTGLLIIMGREIVIGLVGKPSSGKSTTLNALTDANAKCGAFPFTTIDPNKATGYLEIDCACARFNKQDKCKPNYGYCRNGKRGVPIMLLDVAGLVPNAHLGRGLGNKFLSDLTEADCLIHIVDASGTTDAEGKATRGYDPLQDIEWLQDEIFQWILGNLKERWGSVVRRHIGTKSSTLETMRQQLGGYVANKKLIGDALHLIPDLPPLQDWDDEMLGKVVRAFMEVKFPTVLSLNKMDHPDADKNVSKII

SEQ ID NO: 16982 - protein, 156 aa, Candida albicans
SRSVEDPTNGGIDITEDAIDRHLYTKDVPPLDLLVRTSGTFRLSDFLLWQTVSPECAVVFVDKLWPAFKPWDMLKILLNWGFNKYMYGNPNGYGVSSNLVVKTPVDGELINTPKSTTGLDRYLEDEETEVSSNNLGTEEDTVTSEEEDSEGIVKKQ

SEQ ID NO: 16983 - protein, 234 aa, Candida albicans
VLEVCYKVGIEQVTIYAFSLENFNRSKEAIDTLFALLPDKLKVMSEHEDLYARYNKFRIRIIGNRSFIPEDILKDLENVEETTKDLRSKKTLNVCFPYTARDEITYAIKTIASKRVSGELNDRNKITTKTIEKNFYFGDDVPPLDILIRTSVHTRLSDFLLWQCTTECTIEFPDVLWPDFGFISIMSILFKWSYYRTIQIEEEAIRGKEPRVQEVIPPVLLKELPNPPPATSVI

SEQ ID NO: 16984 - protein, 65 aa, Candida albicans
TSPCAKLPEQNLEQDTIVTVYAEGKENALAIGKLLMSTDEIKSKNKGIGIELLHYLGDGLWNYQE

SEQ ID NO: 16985 - protein, 326 aa, Candida albicans
  UNSURE (322): Identity of amino acid sequences at the above locations are unknown.
KKFILPLSTIHLFLVSTIKEMLKSSRILLNRSSSSSSLYLNRRLSTLLTTKPIEKLTIEDLSHPSINQQDEIGRLKLIESIQNTSTLSTQNRNELLEFLIPNFSIYFKLPQHTIKQEVLHRLIQLNPGRVHSTFDLYNNHRNEIQDYMIQDVLKRLIHGEKNATIAREDGDDESESIDLNNIIQIVNDYQHLQFDQLLIELFYKLIDNNSNELIVELINSGVLNGEMILKEMVGQVNIKTSSITTKFAFITIFNRLFNNNPQSMDHQVYTIALNLLNFDDSHKELAVSLTSNEILQYVTESKLDEIPEAINLSSSQQPAKDXCKSG

SEQ ID NO: 16986 - protein, 431 aa, Candida albicans
  UNSURE (65): Identity of amino acid sequences at the above locations are unknown.
FLLRDNLLLANPIIPADQNGLYSLLPIVNGFDFNSHIDHLSNLKKINEDLYKLNDQVKLYELKGXEQDLEFSIPEELIQFEIKFHQTIKILTDLNKLNSKTTKNYKSMVDTLIDLGGNLNNFSLQVYQQKSGSNNELLEAIEKFGSTMDQSFLNFESFILNQLVPQWQEPVDQLILYLQNSLGLIKFYKYKIVQFKILYKLKFNKFQQLINLTNIGGVSSSGSGGGGLLASRISTDNDSNNSNNSGNNNNDGDLDTENFDHLKELNSPTINNALKNLSAKKISKKSSWYGLFGGNNQTKKFNFQLPIEEPTTATGSTEQQSQQQLAPNSPQREQQQSQSHHLHQTSIRFKLNHIEKELNKLNQLIELCNQDMHKLTEALVNTFEEFLLKIERKWLQLMITYIQNCKNMSETNLTNWRQFKESLFNETREVN

SEQ ID NO: 16987 - protein, 187 aa, Candida albicans
NIISISSSSISKTKVTISENENNSKRKRIDDDDDNDDDSLAPDTTTTIINTKNQQFIDEQFKIWELQEQINDYIHKIELKNNEKQFAFKEYENCLKSIDDSNKQIENLIDQYNNNKRKFDELIEKNPLNNNNNNNNQFEIEKQKLITKIKDQEIINESLKFKLNNAFTFLNDTKYLKKRKNRGITPK

SEQ ID NO: 16988 - protein, 317 aa, Candida albicans
PKMGLLTKIKESKHRRSQTRSSIFLANESEASHTSSDTFNYEPPQPIKNVPTALLPMRKQRQPRPKSDYVYEKSLPQEPIHNRSRSEDFNELPILSIGDETLQVPLNETKQNTDQHSQLDPALSKQSNAKLHKKSPSNDYDIRNGSQYKSNSKANESDYSKQTGIGDQAQLTEQDIQHEPTKSTFDYPNSQVTQPQAENLQPMHEQIEKLESKPLYEPVDQHNDSLDQQSLYVNQLFNHSQSQAVDQQQQQQHLYMQGMNSQRMSPRFSSNNNLFANENQTSEEFNVSQPNQFFQPVPDVSSKLILPTRTGPYSIIC

SEQ ID NO: 16989 - protein, 426 aa, Candida albicans
AKVILFHFFEDLIYQYLTIMTPKVVIIGGSYAGLAALNTLKLLITKNSGAIAKSISITLIEPKSGFLNILGLPKSIVNKEFASQQYVPFCDFLKFDNVVSNSNDLKVQLKKNTNSDNNNLMLNYIQGKVTKLTSSRVTYTTNDTDESSIDYDYAILATGRNRNWPVNPKGITFESYLNEMEITNKKIQKSSIISIIGGGAVGIELAAEIKLHYPNKVVNLIHPHGTLPPEPILDAFKNKTLQSLKQANINVFLNTRIDTSKTSLNNGETSNLKTTDGKTIESNLNIWATSFKNNLDYLSLDLQRSIHITANHNIKTNDYLQVSNMSNIYAVGDLIELSTIKSAGWAFHTGIQAGTNVYNSIFDKPLQLSRISFKQIDSHKLTIVGGEGSIIHEVKGNLEINPESMVQEYQDYRLGTCKKFIGATVN

SEQ ID NO: 16990 - protein, 312 aa, Candida albicans
NINRGSWQPLSKEVRTSKKTSLKCKQIFSFILGEHLVIMFNKDPFKVYHDNVNKNIERMKKEKKLLVSSQHIPGDRQHHAHHHKRQPLSNITSARINKPTSTTKTNLLSTRKLLSKFEKPKREIFSNKSYEFEVLNNRGSNNKYTKIENEFDSKNINSKDLTINSFLKKFKEMVNWYKLNKFQFEITNTTSKEGVNNNGYFEQVNKNVITGQIMQNIVKRNYIRPEYSKAKITATHKVNQIGKLSEFMYAVKVSGETSNDDNQTQTEKTVLLMNVGNCEIKVNDRLNLNDLCYLMDYQGGKLGVYLRWHVVK

SEQ ID NO: 16991 - protein, 215 aa, Candida albicans
PYPPVETEIQHDPVLVPGVDSTLDVPGVVAELEPGVVAELEPDVDSIVDEPGVVAELEPGVDSTLDVPGVVAELEPGVVAELDPGVVAELEPDVDSIVDEPGVVAELEPGVDSTLDVPGVVAELEPGVVAELEPGVVAELDPGVVAELEPGVDSTLDKPGVVAELEPGVVAELDPGVVAELDPGVVAELDPGVDSTLDEPGVVAEVVLLVTIVSC

SEQ ID NO: 16992 - protein, 286 aa, Candida albicans
EELGFETSPKILFLQDLNRLVCEAYSLTGSSKKAKQFCDSFDDSDNLFLPKHITEIDKYLLKKKYPQAEELLNKFNNNVKQTKLFTDRWTKVEEYHMKLNQQRQQQYFQQQQQQQQQRQRQQQYRGAQPHQQRKKPANDYYKVLDVPRDADEKTIKKGYRTQTLKYHPDKYKGDDLTPEQIEKKMQAINQAYEVLSDPELRERYDRGDDPNDPMGQSHPQWQPQGGGGQPNFNFNFGGGGGGGNQFFQQFFGGQGFKFNGQGNPFGNSHQKVKITKNKKKNRSRKQ

SEQ ID NO: 16993 - protein, 89 aa, Candida albicans
LTTTMSQDKKEFGQLGDIKKQIDEKYSHLSAAEKEKLVIGKVEGKLGKVERKLCKTEGNLGKVEGKLGKTEGNLGKTEGNLGKFEGDSN

SEQ ID NO: 16994 - protein, 373 aa, Candida albicans
VKVCKEQLNFFRCVFSLSYVDITDRNILWGEKKKKHKHKLYYTQTTSQLDLKGMTVSFDKRIVVSGGAGFIGIHFLCYMVKKYPNFHFTCIDKLNYASNATEIENLKSFSNFEFVHLDLSDNLEYLLKITKNTTDIINFAAESSVDRSFKDPVYFTKNNILATQNLLECHRLNPSIGYFLHISTDEVYGDVYEGDNKENAVMNPTNPYSASKAAIDLIIKSYQYSYKLPITILRPNNVYGPLQYPEKIIPLTIQCINEKKPIPVHGKGTNKRKYLYVLDIVLAIETVWIKNPMTTVNQIYNIGGTDELDNLSLIKLIMEIFGRGEIQFIKDRNYNDTNYSIDTTKIHNLGWSPRISLVQGLQWCKQLLDSPIE

SEQ ID NO: 16995 - protein, 194 aa, Candida albicans
INNYFLTQGFKNIFFYLHHYIVYHTKFTLFAMSIAQEFEKANTHYSSNFTKGDLPLPPARKVAVVICMDARIDPAASLGLTEGDAHVIRNAGGRASDALRSVIISQRLLGTREIVVVHHTDCGMLTFSDNDLRGIVAKETGHNVDHFAFLPFGDLEKSVKDDVEFFKRNPLVLDVPVTGYIYDVKSGAINKVDS

SEQ ID NO: 16996 - protein, 117 aa, Candida albicans
SLLTHFISLSLSPLSGHCYLFHQQTNSIMSNQVLKSPLSKSIKIALIQLKAGADKAANLTKVTKFIDDAVTKSTGVNLVMLPECFNSPYAVYQFRNYAEDIPQGTNYSIVVKFGTKI

SEQ ID NO: 16997 - protein, 195 aa, Candida albicans
NYNTSLTFNPQGEIIAKHRKAHLFDIDIPNGITFQESLTLSGGDKATVFKLGEYGNVGLGICYDIRFPELASIASRYPYNSFAMFYPGAFNTTTGPLHWHLLARARAVDNETFVVLCSPARDVEGGGYQAYGHSLVADPFGNIIAEAGEGEEILYAELDPALLPKARDGIPVHYQRRFDIYGDFVGEGKAKVSDK

SEQ ID NO: 16998 - protein, 191 aa, Candida albicans
VKSLNGSTYLSIGIHLPAKKRVRNVHVLIDPKGAIVSEYQKVHLFDVDVPNGPILKELNSVEPGNKIEDPIPIDDFKLGLGICYDIRFPELALRLRRLGSDIITFPSAFTTRTGEAHWELLSKARAIDSQCFVINAAQCGQHQVGTDPNDLSKVIKRISYGDSIIVDPWGEVLARGEKYTGALTHDVLNTA

SEQ ID NO: 16999 - protein, 405 aa, Candida albicans
SFQPPWVKTISKAKWSSDGKRIILFASKMVSRQSLNLADRITSANKLKEEIGSGLIFMGLVGIEDPPRKNIDHVIGILRDAGIKIVMITGDFELTGVSIAKQCGIVTSGKIAKVNTLGDSDKNSISVTGPELNLLDESQWEQLVAHNELVFTRTTPEQKLLIVEKFQKYGQVVGMTGDGINDAPALKQSDIGISILDASDIAKEAADLILMNSDADQLFLSIVEALKFGRLVFENLKKTICYLLPAGSYSELWPVVMNVFFGMPQMLSSFLMIIICCLTDCAGSIVLAYEGAESNLLKKKPRVVTGERLVNFKLLFHAYFCLGTFYTFTSFLVAFLNLTRRGLKFDQFSLSFGSYQDIPNVTNWLNMSSSIYFVNLIILQMFNLLSLRTGHLVFFFTTAGASDMV

SEQ ID NO: 17000 - protein, 625 aa, Candida albicans
DLLYFLLFLSYQPIMTKDSVNSDLNENLPLLNKTLKSPKTAIGSDSSKSNTQPINTNSISANPLRHAQYSNPALTNSTNRRPLSGIAAPVTPLEYTEFDEYLTSMRHHSFSANEFYQNKAAERPLFHRLLSSHHSVTNPNSPFDNYVSGNISGTQINAPLFPQNTGGDRSSMESLGEFGELRRLSVVDFVSSLRPARLIGTVLPLCTWKDYFKSNINKIKGGDVRKYYEEQNHLIEKFTEIDNFLDAGKIHYNMLRNYGSDVNESLGDIAEGLHESSRAASPDNLNGDELQATDLERGDSTSKYSTRFNDVPGNVTNDGSRYLGYNEEETNSQVLTAILVNFLINILLLVGKIVVTLLTSSMSVIASLVDSILDFLSTFIIYIVNRLATQNDWKIQHAYPVGRSRLEPLGVLIFSIIIIISFFQVGQESFKRLFFPTPNQKIPVPIGLDAISIMMITIIAKLGCWIWCSSSQSSSVQALAQDAMTDIVFNTVSLLMPTIGHYFNIWWFDPLGAFALSIYIVVNWGHTAFEHINNLTGAAADPLDYKVILYLAYRFAEPIKHITALKVYHVGYNLNVEIDLVFANDKYKLSFKDCHYIAEALQYSIESLPMVEIAFVHIYYMEGNY

SEQ ID NO: 17001 - protein, 105 aa, Candida albicans
RTMEKKFFLFFFCFVLFPFLIFEVEIFHNNSLLNFFKPKRFFYNYYPRHPHTMSSPKEALEWKDKGNNLLKQHKYDEAIEAYTKAIDIDVFIHEAQGPRLCYWGG

SEQ ID NO: 17002 - protein, 215 aa, Candida albicans
LGVLMGTLRRFPPRKIFLCVPLKLIIWEVIWLLQYNKAILVDHLTYRDAKIKLLKGDIENNNYQGNLITTPNSDDDYNLELGKQHQLTIYDYITNYLQDSLMSVNQFITYYKYYSYLQNKGYFINPGIKFGGDLVIYPGDPLRYHSYSIVRFEFFDVHDVVVGGRLATSVKKNLVLMGYDQEADKTHQEVNEDVISDLFDESVPLTFYIEWAGFG

SEQ ID NO: 17003 - protein, 195 aa, Candida albicans
TFTNSPLDSIMVSTISPTILKTSTSKLINLSAGCFWGVENVFRKQFTNKGLVDIKVGYANGKPSISNVTYEKVCTGTTDYAETVQISYEPSQLKLAEILDIFFKMHDPTTVNSQGPDVGTQYRSAIFTFDDEDKSLALKIRDQFQKEWYPNHKIATTIETIYNWYDAEDYHQNYLTKNSGGYECPTHFIRTKPKI

SEQ ID NO: 17004 - protein, 461 aa, Candida albicans
  UNSURE (37),(53): Identity of amino acid sequences at the above locations are unknown.
NLVRLVTNYIYKPLDTHIYIFFSYGYSRIMGLFKLSXGKRISLDELVDQSIKXRQRPPRVAIDAYLFIFQADHSSIIVEEKDGVLMQNVMAKILALVGLNISVIVVFDGILKPLKLKSKENEGLIYEDELQRLALISNYSENNPFVEQLKIELSNNKIEYVQAPGEGEAQCAYLQKLGIVDYVISQDVDALVFGARRVLRNFSRFAEDIGKSPPKSSDITARSSYYVTPVDMDKVEQETGLATSRLVFLASLRGGDYSVGAKKMGIVNAKNLALSGTSKSMYYTENKSKIQLKELQKSPQKCKGPPPDFANELIDCVQSKDRSIKLHPWDLRLYPEARRSNFDSLLKKMNFYLKEQNRDIFGRKVTFQEEFEFDEYYTMLYLFPLVSDQVPIFIPDTLGSGELKSDLHINLPEKTKVSRISNAIKRNYTQIVGEPIDELPEKQTHLFVPQILYLVNKTHYM

SEQ ID NO: 17005 - protein, 158 aa, Candida albicans
QFLGQMVTLADDWGVNVESILIKDLTLPDKVQASLSMATEAKRIGEAKIISAKAELESSKIIRKASDILASKAAMQIRYLDTMQAVSKNAGTKVIFMPSADQVERIAMSNMQDQPPSGKGKPLDLEEDKDWVGTPQSIGINNNRHISETVALQEAMRV

SEQ ID NO: 17006 - protein, 284 aa, Candida albicans
  UNSURE (99): Identity of amino acid sequences at the above locations are unknown.
LSGDPLCSQLQAKRTIGNLMPEGPLFLPFIVASLPVGINQIDTTDLTGSLMRPIVVVHLILAAALTPILWRVERAAPDPVVQVNLLASREVRIATAISXGNGLSQAAIVFIPSYAFLALSLSESMASFSLLPFVTTMALSAPIVGVLLDRVGSRVVMISGSLILMVGCTIMALLSSTTPLFILAEVLMALGLITVIGAPLRYIMLSETPPEHRASGQALINILSSAGQLVGGALIGGIVASMGSGVMGYRFSFLFLVAVAFTLFLLSTGLKGRKQQLETMKSPA

SEQ ID NO: 17007 - protein, 296 aa, Candida albicans
NYRTMSDFKVKAGLAQMLKGGVIMDVVNADQAKIAEAAGACAVMALERIPAEMRKSNQVCRMSDPKMIKDIMETVKIPVMAKCRIGHFTESQILEALGVDYIDESEVLTPADTVYHIDKTKFKVPFVCGARNLGEALRRINEGAAMIRCKGEAGTGDVSSAVDHIRTIKKDIEEASKLKTETEIVELARELRVPTELLIQVIEEKKLPVVLFCAGGVSTPADAALLMQLGCDGVFVGSGIFKSKNPEKLAKAIVNATTHYNDPVKLLQYSTDLGELMGGIAIDSIKEKEKLEKRSW

SEQ ID NO: 17008 - protein, 380 aa, Candida albicans
MIAPNLLQIIVVGAGLIGPRHALHVSNNPQTDLFAIIDPNPATADVAETFNTLYFPSIESCMKYCDENSIPYPDGAIVCTPNHTHVSVGAELASYGIHLLVEKPIGSTPEDAKALKHYCEIKNVKVLVGHHRRFNPYILATKKNLFKVGQIIAIQGSWMLSKPQEYFDISPWRKNTSTGGGVLLINLVHDLDLLQYMFGRIQRIYAELLLQQRTHEADEGAALTIKFESGVTGTFICSDNVVSPFNFESGTGENPTIPQNQGVSGIYRIFGSKGTSSMPDMKLYHQDKGVTSSWTNPINETVIELDLDKLPFDSQLEHFIDLIRGNVKEPWCSIDDGISALLCIDAVMRSIESDMPVKVQDIKSVSADYKKLGIDQGVFM

SEQ ID NO: 17009 - protein, 253 aa, Candida albicans
KKNFGNLIRNLTDRISIMSSEEILQGVEDIHLNTSSDSDSEYELEEETTTKSLPLSSRTITEKEDIVTKYADKIKTDPIKKGPKITKDRANRATVEQVLDPRTLRFLAKIINKGIISRINGCISTGKEANVYHGTSDDPDNDREYAVKIYKTSILVFKDRERYVDGEFRFRNTKNQSNPRKMVKVWVEKEFRNLKRIYQNGIPCPEPIELKSHVLVMEYLTKGDGQPSPKLKDYLFKDVQDIVNYYQQDVVLI

SEQ ID NO: 17010 - protein, 248 aa, Candida albicans
  UNSURE (94): Identity of amino acid sequences at the above locations are unknown.
KQQTGNFVTKPWKIIQETRGWNGIATESLRKKENALDYRYAPDSELPLIRLDKNIQAQLQNTLDELPDSVLDRLTKEPYNLQLAHARNLLFQPXILDYYENIFGRIRDANKWFFHELLAAFAKSDVEFQVDIVLPDMLVDIVLSVEKNEISLTGARIILKHIIRNKSTKTLPQLIKELDIGKPEASAELEEAINEICQQIINTNADVVEKIARGHTNALQVLIGQAMKATKGKVHAKEFRSKFMELLK

SEQ ID NO: 17011 - protein, 394 aa, Candida albicans
ANTNTLSQHQQHLLIQTMGILEKIAQIQEELSRTQKNKATEYHIGLLKGKLARYRRELLEPQPGQGSSGGGGQGFEVAKAGDARVSLIGFPSVGKSSFLSKVTNTKSEAANYEFTTLTSVGGILDYNGAEVQIVDLPGIIKAASQGKGRGRQVIAVSRTSDLILMVLDATKGGDQREILENELQSMGIRLNKQRPNISIKVKKTGGVKMNSITPPKYLDEKIVTALLKDYKIHNADVLIRDENVTIDDFIDVINDQHITYIKCLYVYNKIDAVSLEECDRLAREPNTVVMSCELDLGIEDLKEEIWRQLDLLRLYTKRRGVQPKFDDPMVVRNNSTILEVCDSIHRDMKNQFKYALVWGSSAKHSPQKCGLTHPIHDEDVVQIVTKSMSLGGGY

SEQ ID NO: 17012 - protein, 159 aa, Candida albicans
YIAVDTFSSHIMSDWVSTFPGYKQVLLTCKKMLGTIIMTGPVPQHVGIIMDGNRRYDKTHKIEIKEGHSLGFDTMASILELLYELGVKCATVYAFSIENFKRLQYEVKWLMELAKSKFTQINQHGLLCEEYGVKIRILGNTKLLPRDLVFTARSGNTGG

SEQ ID NO: 17013 - protein, 131 aa, Candida albicans
RSSRTTRSKEWKMVCERIWVITDSSSRRIMVESGNKIFFFVETKKKPFSFLSTIMSDETVPQTVLPLEVIDRSVGKRVRVLMTGDKEFNGKLIGFDDYVNMVLEDVTEVDGGAPIKKMLLNGGHIAMIVPE

SEQ ID NO: 17014 - protein, 99 aa, Candida albicans
KHLMSTIQAEQQQDQQPLDLIRFQLDEYVLVKLRGARELKGKLQGYDSHCNMVLSDAEETIYTSNEDDDSENTSEEPIVKKTAMVFVRGDSVILISPIQ

SEQ ID NO: 17015 - protein, 349 aa, Candida albicans
LYLYIYIYTSKLNNGGGTMSKELSLNQKNYLIQALKSNIRLSTSTNTGGSRKFNQFRPIDIKLSNTRYGSVELSLGKTKVMVNITSRITEPYQDRPFEGIMTINCEIPNHIKLQSNDTTNNNNDNEDEFINLINRALDRAIRRSNAVDLENLCIIAGEKVWELIIDLQVLNYDGNLIDSGCLAIITALLDFKKPDVTINNNNNSNSSYTSGGGGNIIVHDDEMKRPFIELSILHIPICLTFVLFNLGSKETNLKTNDIDQEIWLLRGDAMEESCRDGYLIMTMNQNHELIQLSKIGGGGNNGGVSIDGQQLINLCHESIDEINRLTNLVKSTVKNHQLNKYNNENYKLL

SEQ ID NO: 17016 - protein, 313 aa, Candida albicans
NNRAGPLLRAVLTTKYTFDVHEDDILFTAGDIGWITGHTYCVYGPLLAGATSVVFESTPPYPNYSRYWEIVDKYKVNQFYVAPTALRLLKRAGTKYVEKYDLSSLRVLGSVGEPIAAEVWHWYNDNIGRGQAHIVDTYWQTESGSHLLTPLAGITPTKPGSASLPFFGVDPKILDPTTGEELPDNDVEGVLAIKSAWPSITRGIYNDYNRFIDTYLAPYANYYFSGDGAARDRDGFYWILGRVDDVVNVSGHRLSTAEIEAALIEHPIVGESAVVGYADESTGQAVAAYVSLKKDKAVGEDVENIKKEMILTV

SEQ ID NO: 17017 - protein, 69 aa, Candida albicans
LCRKEIGPFAAPKMILLVDDLPKTRSGKIMRRILRKVLAGEEDQLGDISTLSNPGVVQQIIDVVHHAKK

SEQ ID NO: 17018 - protein, 265 aa, Candida albicans
  UNSURE (16): Identity of amino acid sequences at the above locations are unknown.
KLGKSNLLSRYYFALXVKQVGFPPGVINIVWGFVDTAGAALASHKKVAKIAFTGSTATGKIIQKLAAENLKAVTLECGGKSPLIIRSDADIDQAVKWGAIGIMSNQGQICTSTSRIYVHESIYDKFIEEFAAHVKLDYKQGDVFDDEAVVGPQVFKMQHDKILNYIDIGKKEGARCVLGGEKNIEGELSKGYFVKPTIFADVKPEMRIVNEEIFGPVVVVGKFSTDEEAITYANQTDYGLGAAIFTNDITVFKSQCRSMLCKPSE

SEQ ID NO: 17019 - protein, 382 aa, Candida albicans
NYLVLARRSEDYCTSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 17020 - protein, 66 aa, Candida albicans
LPYYFNYFLLFSFTQLHIHTFKLTKSMTIPLSVDVTLPDGKKFTQPTGLFINNEFIKSKSVESQQP

SEQ ID NO: 17021 - protein, 222 aa, Candida albicans
  UNSURE (20): Identity of amino acid sequences at the above locations are unknown.
ENSPSQNCSHYVEPVQSEGXDNHATSFFFQVLRDITKKHGILFIVDEVQTGVGASGKMWAHEHWNLTTPPDMVTFSKKFQAAGFYFSNPDLQPKLPYRQFNTWCGDPSKAILAKAIYQEIVKSNLVERTAEVGDYLFEKLLSILSRFPDKVFNLRGKNYGTFIAWDCSSTDLRNKILAASREQGLNMGGCGDQSIRLRPTLLFEKEHADIFLGILESVLNKL

SEQ ID NO: 17022 - protein, 436 aa, Candida albicans
YFIRSPYHKMSSKSVSSLYFPEEPKEPVVVDSHAKSKEIADRLGKVFDNRGVYFVADYEKSVGNYIADVDGNVYLDVYAQIASIPLGYNNPALIETAKSDKMIRAIVDRPAIGNFPGKDTDEIVSEILKVAPKGQDKVWSGLSGADANELAFKAAFFYYQAKKRGYTTQFSEEEMKSVMQNEAPGSPELAILSFERGFHGRLFASGSTTCSKPIHKLDMPSFKWPKAQFPSYKYPLDKYAEENKKEDERCLKIVDDIIQNNKIPVAAVLVEPIQSEGGDNHASAEFFQGLRDITLKHGSLLIMDEVQTGVGATGVMWAHERFNLQPPPDLVTFSKKFQSAGYFFHDPEIIPNFAYRQFNTWCGDPARMILAGAIGQEILKHDLVKRAAEVGDYLFKKLEQLQEKYPKYIKDLRRKDRATFHWPVFGKVVKPENNSL

SEQ ID NO: 17023 - protein, 336 aa, Candida albicans
LCESTHLQVGFFFVFIFFISPYSIVSFFLRFSLAPSSLTTSFSFKMQRTLINTSLRQVQKRFNSTSVTASYFPEEPKNPIFQTETIPGPKSIALNKELGEVYDNHATYFVTDYFNSLGNYISDADGNKLLDVYCQISSIALGYNNPELIKAAKSDEMVNAIVNRPALACFPSTNYKQILEEGLLAAAPPGMDKIWTSLSGSDANETAYKAAFMYQHAKLRGDKAFTEEELATCMENKTPGASDMSILSFDKGFHGRLFGSLSTTRSKAIHKLDIPAFPWPRAPFPRLKYPLEDFETENRDEEQGCLYQLESIIENSRKSNCSHYRCSPRECRSAGN

SEQ ID NO: 17024 - protein, 90 aa, Candida albicans
KSFELICSDPKFTGIFVKFFGGIVRCDYVAKGLIAATKNFNLDIPVVVRLQGTNMAEAKELIDNSGLKLYAFEDLDPAAEKIVQLAPKNN

SEQ ID NO: 17025 - protein, 242 aa, Candida albicans
EKPLKNFLKRQPNKGHIHDVNQYKQMYEQSIKDPQGFFGPLAKELLSWDHDFHTVKSGTLKNGDAAWFLGGELNASYNCVDRHAFANPDKPALICEVDDEKDSHILTYGDLLREVSKVAGVLQSWGIKKGDTVAVYLPMNAQAIIAMLAIARLGAAHSVIFAGFSAGSIKDRVNDASCKALITCDEGKRGGRTTNIKKLCDEALVDCPTVEKVLVYKRTNNPEIHLTEGRDYYWDVETASCT

SEQ ID NO: 17026 - protein, 681 aa, Candida albicans
NETKIMPESTQQSHLSLDHEKMQQPPKGFTERFKTKPNLDDFETYQKLYKQSIENPNEFFTQQAKENLDWFKPFDLARFPVDPKDDYKNDDLPAWFINGQLNACYNAVDRWAIKNRDKPAIIYEGDEPDQGRIITYGELLKQVSKLAQALTKLGVKKGDSVAVYLPMIPEAIVTLLAIVRIGAMHSVVFAGFSSASLRDRILDADSRIVITADESKRGGKTIETKKIVDDALKECPKVRNVIVFKRTGNSHVPFSPGRDLWWHDEMAKYGPYFPPVPVNSEDPLFLLYTSGSTGKPKGVQHYTAGYLLGAALSTKYIFDIHPEDILFTAGDVGWITGHTYALYGPLLLGVPTIIFEGTPAYPDYGRFWQIVEKHKATHFYVAPTALRLLRKAGEQEIAKYDLSSLRTLGSVGEPISPDIWEWYNEFVGKNQCHISDTYWQTESGSHLIAPLAGVVPNKPGSASYPFFGIDAALIDPVTGVEIEGNDAEGVLAIKDHWPSMARTVYKNHTKYMDTYMNPYPGYYFTGDGAARDHDGYYWIRGRVDDVVNVSGHRLSTAEIEAALIEDKKVSEAAVVGIHDDITGQAVIAYVALKEGNSDEDSEGLRKELVLQVRKTIGPFAAPKSVIIVQDLPKTRSGKIMRRILRKVSSNEADQLGDISTLSNPQSVEGIISAFGAQFGKK

SEQ ID NO: 17027 - protein, 442 aa, Candida albicans
INKLGPAGPVGEDGTNNNNYANVDLIVEIAESTNAHAVWAGWGHASENPLLPEKLAASPKKIIFIGPPGSAMRSLGDKISSTIVAQHAQVPCIPWSGTGVDEVKIDPQTNLVSVADDIYAKGCCTSPEDGLEKAKKIGFPVMIKASEGGGGKGIRKVDDEKNFITLYNQAANEIPGSPIFIMKLAGDARHLEVQLLADQYGTNISLFGRDCSVQRRHQKIIEEAPVTIARKETFHEMENAAVRLGKLVGYVSAGTVEYLYSHAEDKFYFLELNPRLQVEHPTTEMVTGVNLPAAQLQIAMGIPMHRIRDIRTLYGADPHTTTDIDFEFKSETSLVSQRRPTPKGHCTACRITSEDPGEGFKPSGGSLHELNFRSSSNVWGYFSVGNQSSIHSFSDSQFGHIFAFGENRQASRKHMVVALKELSIRGDFRTTVDLHQAMEGHR

SEQ ID NO: 17028 - protein, 177 aa, Candida albicans
TLKNYSQQQHLFSLALFLRFFMRCKLSLIKNTNSLVHRSRFLITKPQLYIPHRHYIPFKNIFKSLLMSDQSPSPSPSDSLSYTTLHENLPSHFLGGNSVLNAEPSKVRDFVRAHQGHTVISKILIANNGIAAVKEIRSVRKWAYETFGDEKAIQFTVMATPEAVQANSSIAGCRNSI

SEQ ID NO: 17029 - protein, 1023 aa, Candida albicans
IGERPDPIVAVVCGAVTKVHIQAEEEKKEYIQSLEKGQVPHRNLLKTIFPVEFIYEGERYKFTATKSSEDKYTLFLNGSRCVVGARSLSDGGLLCALDGKSHSVYWKEEASATRLSVDGKTCLLEVENDPTQLRTPSPGKLVKYLVDSGEHVDAGQPYAEVEVMKMCMPLIAQENGVVQLIKQPGSTVNAGDILAILALDDPFKVKHAKPLERTLPSMGEPNVTGTKPAHKFNHCAGILKNILAGYDNQVILNSTLKSLGEVLKDNELPYSEWQQQISALHSRLPPKLDDGLTALVERTQSRGAEFPARQILKLITKSIAENGNDMLEDVVAPLVSIATSYQNGLVEHEYDYFASLINEYYDVESLFSGENVREDNVILKLRDENKSDLKKVIGIGLSHSRVSAKNNLILAILDIYEPLLQSNSSVAASIREALKKLVQLDSRACAKVALKAREILIQCSLPSIKERSDQLEHILRSSVVQTSYGEIFAKHREPNLEIIREVVDSKHIVFDVLAQFLINPDPWVAIAAAEVYVRRSYRAYDLGKIEYHVNDRLPIVEWKFKLANMGAAGVNDAQQAAAAGGDDSTSMKHAASVSDLTFVVDSKTEHSTRTGVLAPARHLDDVDETLTAALEQFQPADAISFKAKGETPELLNVLNIVITSIDGYSDENEYLSRINEILCEYKEELISAGVRRVTFVFAHQIGQYPKYYTFTGPDYEENKVIRHIEPALAFQLELGRLANFDIKPIFTNNRNIHVYDAIGKNAPSDKRFFTRGIIRTGVLKEDISISEYLIAESNRLMNDILDTLEVIDTSNSDLNHIFINFSNAFNVQASDVEAAFGSFLERFGIILWRLRVTGAEIRIVCTDPQGTSFPLRAIINNVSGYVVKSELYLEVKNPKGEWVFKSIGHPGSMHLRPISTPYPVKESLQPKRYKAHNMGTTYVYDFPELFRQATISQWKKYGKKVPKDVFVSLELITDETDSLIAVERDPGANKIGMVGFKVTAKTPEYPHGRQLIIVANDITHKNG

SEQ ID NO: 17030 - protein, 610 aa, Candida albicans
LVAQGRILPAPVVEDLYQVAWNEEGSPDKGFRYLYLSTAAKESLEKDGKSDSVVTERIVEKGEERHVIKAIIGAEDGLGVECLKGSGLIAGATSRAYKDIFTITLVTCRSVGIGAYLVRLGQRAIQIDGQPIILTGAPAINKLLGREVYSSNLQLGGTQIMYNNGVSHLTANDDLAGVEKIMEWLSYVPAKRGLPVPILESEDSWDRDVDYYPPKQEAFDVRWMIQGREVDGEYESGLFDKDSFQETLSGWAKGVVVGRARLGGIPIGVIGVETRTVENLIPADPANPDSTESLIQEAGQVWYPNSAFKTAQAINDFNNGEQLPLMILANWRGFSGGQRDMYNEVLKYGSFIVDALVDFKQPIFTYIPPNGELRGGSWVVVDPTINSDMMEMYADVDSRAGVLEPEGMVGIKYRRDKLLATMERLDPTYGEMKAKLNDSSLSPEEHSKISAKLFAREKALLPIYAQISVQFADLHDRSGRMLAKGVIRKEIKWTDARRFFFWRLRRRLNEEYVLRLISEQIKDSSKLERVARLKSWMPTVEYDDDQAVSNWIEENHAKLQKRVNELKQEVSRTKIMRLLKEDPNSAISAMKDYVERLSKEDKEKFLKALK

SEQ ID NO: 17031 - protein, 427 aa, Candida albicans
EHTLGGDTYTLTHKKKGTTLIKYEEKAVKTNNNKNKKFNHIKPKQSKKKRAFFFISNVSTICFTLFFFFFFLFLSSYLVFSYSILFENNYSILTNHLPLISFLTMYRQFTRGFSSSLPARNYASTIKNLKVTKDTKVIYQGFTGKQATFHAEQAIAYGTDVVGGINPRKAGTTHLDRPVFGTVAEAMKEAGASATGIFVPPPLAAAAIEEAIAAEIPLAVAITEGIPQKDMVRISQILKTQEKTRLVGPNCPGLIAPDQCKIGIMPSSIHQRGKVGVISKSGTLTYEAVAQTTAVGLGQSLVIGMGGDPFPGTNFIDALTLYLNDPETEGIIMIGEIGGSAEEEASEFLKQHNLTRPEGPKPVVGFIAGVSAPPGRRMGHAGAIVAGGKGDAKSKIDALESAGVVVEKSPARLGNSLLAEFKNKNLL

SEQ ID NO: 17032 - protein, 142 aa, Candida albicans
MFVSEAKLKELGLKPLAKINGWGEAARNPIDFTIAPALAVPKAVKHAGLTLDQVDFFELNEAFSVVGLANAEICQIPLEKLNAYGGAVALGHPLGCSGARIVVTLLSVLIQEGGKIGCAGVCNGGGGASSIVIEKVDSDFKL

SEQ ID NO: 17033 - protein, 126 aa, Candida albicans
  UNSURE (117): Identity of amino acid sequences at the above locations are unknown.
FNSCNNFLFPLLIANYSPNNIIMVPPVYIVSTARTPIGSFQGTLSSLTYSDLGAHAVKAALNKVPQIKPEDVDEIVFGGVLQANVGQAPARQVALKAGLTDKIVASTVNNVCASRLXNAPGISAMG

SEQ ID NO: 17034 - protein, 354 aa, Candida albicans
RLVMRTGWTVVRMNFSHGSYEYHQSVIDNARKSEEVYKGRPLAIALDTKGPEIRTGTTIGDKDYPIPPNHEMIFTTDDAYKTKCDDKVMYIDYKNITKVIAPGKIIYVDDGVLSFEVISVDDEQTLKVRSLNAGKISSHKGVNLPGTDVDLPALSEKDIADIKFGVKNKVHMIFASFIRTANDVLEIRKVLGEEGKDIQIISKIENQQGVNNFDEILEVTDGVMVARGDLGIEIPAPQVFVVQKQLIAKCNLAAKPVICATQMLESMTYNPRPTRAEVSDVGNAILDGADCVMLSGETAKGNYPVEAVSMMHNTCLTAEKAIAYPQLFNELRSLAKKPTATTETCAVAAVSAAY

SEQ ID NO: 17035 - protein, 75 aa, Candida albicans
FYQFSTYTTHNNKNLNMSNEYILVTGGAGYIGSHTVIELISNGYKVIIVDNLSNSSYEAFARIEFLVKQHVPFYE

SEQ ID NO: 17036 - protein, 610 aa, Candida albicans
DGETLGRYRHIPMVNTQFAALKAVGESTKIPLAYYDNNVSGTVNLLEVCKANDVKTIVFSSSATVYGDVTRFGDNSMIPIPEHCPMDPTNPYGRTKFIIESILKDIYNSDDAWKVAILRYFNPIGAHPSGLLGEDPLGIPNNLLPYLAQVAIGRREKLSIFGNDYNSRDGTPIRDYIHVVDLAKGHIAALAYLKNLQSKGLYREWNLGTGKGSTVFEVYHAFSKVVGRELPHEVVGRRAGDVLDLTAKPDRANKELQWKTELAIDDACKDLWKWTTENPFGFNIENYSWKEFDGFNNRLHSFVAGDLKVNLANRGALIQAITLKDSNMVKAYNNAEDFKSETNPFFGTTVGRYANRISNGEFKLNGKVYKLTKNEGANNLHGGANGFDKQDFFGPVVKSRDGKFFVDFLLVDKDGNDGFPGELEAIVHYTIDDSSVEIEYECQLLSGEATIVNMTNHSYFNVSNSDTIEGTEVKLITDKMLEVDSQLLPTGKFIENEKAASPIVLNENDVFDNCFIVDEECGIDTRDKPLKQVFEATSFVTNNKLKISTTEPAFQFYTGDGVNTKGFGKRCGFCVEPSRFINAINHKEWSNQVILKKGDVYGSKIKYEFQ

SEQ ID NO: 17037 - protein, 544 aa, Candida albicans
  UNSURE (3),(32): Identity of amino acid sequences at the above locations are unknown.
LPXYQNGKNWKKLTNPVGEKFSVRDAFAKDPXRFEEFSWIYKNYDDSKILFDFSKNLVNKEILDQLVTLAKEAGVEKLRDAMFAGDHINTTEDRAVYHVALRNRALRKMPVDGKDTAQEVDDVLKHMKEFSDSIRDGSWTGYTGKSITDVVNIGIGGSDLGPVMVTEALKAYSKPGLNVHFISNIDGTHTAETLKNLNPETSLFLIASKTFTTAETITNVTSAKNWFLATAKDSKHIAKHFAALSTNEKEVVAFGIDAKNMFGFESWVGGRYSVWSAIGLSVAIYIGFENFNDFLKGAEAMDQHFLTTPLENNIPVIGGLLSVWYNNFFGAQTHLVVPFDQYLHRFPAYLQQLSMESNGKSVTRANVFTNYQTGTILFGEPATNAQHSFFQLVHQGTKLIPADFILAAQSHNPIEKNLHQRMLASNFFAQSEALMVGKDEAKVKAEGATGGLVPHKEFSGNRPTTSILAQKITPATLGSLIAYYEHLTFTEGAIWNINSFDQWGVELGKVLAKVIGKELDDKKAVATHDASTNGLINQFKEWEE

SEQ ID NO: 17038 - protein, 387 aa, Candida albicans
PKEFTHLQMSSLSSVTRSAKLATQSLKYNTRPSLSKIGQFQTSKITYRANSTQSTPVKEITVRDALNQALSEELDRDEDVFLMGEEVAQYNGAYKVSRGLLDKFGEKRVIDTPITEMGFTGLAVGAALHGLKPVLEFMTWNFAMQGIDHILNSAAKTLYMSGGKQPCNITFRGPNGAAAGVAALHSQCYAAWYGSIPGLKVLSPYSAEDYKGLLKAAIRDPNPVVFLENEIAYGETFKVSEEFSSPDFILPIGKAKIEKEGTDLTIVGHSRALKFAVEAAEILEKDFGIKAEVLNLRSIKPLDVPAIVDSVKKTNHLVTVENGFPGFGVGSEICAQIMESEAFDYLDAPVERVTGCEVPTPYAKELEDFAFPDTEVILRACKKVLSL

SEQ ID NO: 17039 - protein, 230 aa, Candida albicans
ARILPAPVGEDGMVINTEWGSFDNGLKILPSTEFDEIVDSETANPGYHLFEKRISGMFLGEILRVALIHLFKKGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIYLKIAKDGSGVGAALCASTA

SEQ ID NO: 17040 - protein, 479 aa, Candida albicans
YLYFSIIMSLSPKLEEIVSSIEKSFEIKDDFLVKATEYFIESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLFENHSEACTAKNTEPLKLGFTFSFPVNQTALNRGTLIRWTKGFDIPDTVDRDVVELLQANLTILEVNVKVVAIANDTVGTLLTAAYSNDSAKTNRNTIIGCIFGTGTNGAYFESKIPKLSSSTSKSQGMVINTEWGSFDNGLKILPSTEFDEIVDSETANPGYHLFEKRISGMFLGEILRVALIHLFKKGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIHLKIAKDGSGVGAALCASTA

SEQ ID NO: 17041 - protein, 479 aa, Candida albicans
YLYFSIIMSLSPKLEEIVSSIEKSFEIKDDFLVKATEYFIESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLLENHSEACTAKNTEPLKLGFTFSFPVNQTALNRGTLIRWTKGFDIPDTVDRDVVELLQANWTILEVNVKVVAIANDTVGTLLTAAYSNDSAKTNRNTIIGCIFGTGTNGVYFESKIPKLSSLTGKSQGMVINTEWGSFDNGLKILPSTEFDEIVDSETANPGYHLFEKRISGMFLGEILRVALIHLFKNGLIFQELYKARGGSLPHRIEEPWLLDAEVLSYLQIDDSTDLKTSGLILQNVLRLETNKEEREVIQRLTRAISQRAAHLSAIPIAAIAKKVKDQYKDDDRDFEVGCDGSVIEFYPGFRQAVLESIEKINPLKGTNKKIHLKIAKDGSGVGAALCASTA

SEQ ID NO: 17042 - protein, 477 aa, Candida albicans
IFFLFTFYEIYKSSFNSNSIHSSFHSIEFFFLSSFFFYFLYFLIQFFNQAIINCRRITIKMSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 17043 - protein, 206 aa, Candida albicans
GCGIYYWLRLRPTITANVQEGDNVAVFGGGCVGLSVIQGCKERKVNKIILVDINDKKEEWGKQFGATDFVNSTKLPEGTTIVDKLIEMTDGGCDYTFDCTGNVNVMRNALEACHKGWGTSIIIGVAAAGKEISTRPFQLVTGRVWKGAAFGGVKGRSQLPGIVEDYLDGKLKVEEFITHREPLDKINTAFDEMHGGDCIRAVVSLW

SEQ ID NO: 17044 - protein, 136 aa, Candida albicans
YIYTILETMARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILMYC

SEQ ID NO: 17045 - protein, 76 aa, Candida albicans
GLAATPEDAEDTHKGIRAHLAKSIGAEQAEKTRILYGGSVNGKNAKDFKDKANVDGFLVGGASLKPEFVDIIKSRL

SEQ ID NO: 17046 - protein, 419 aa, Candida albicans
ALSFLLVYLPTSIQPLLPMYRATATSRQLVGTTANILVAKRSMAKAASDLVTIELPASSYEGYNLEVPALSFETEKETLLKMYKDMIIIRRMEMAADALYKSKKIRGFCHLSVGQEAIAVGIENAITPTDTVITSYRCHGFAFMRGASVKSVLAELMGRRSGIANGKGGSMHMFTNGFYGGNGIVGAQVPLGAGLAFSHKYKNDKAVTFDLYGDGASNQGQVFEAYNMAKLWNLPVIFACENNKYGMGTSAARSSAMTEYYKRGQYIPGLKINGMDVLATYQASKFAKDWASQGNGPLVLEYETYRYGGHSMSDPGTTYRTREEVQHMRSRNDPIAGLKAVLLEKEIASEDEIKSYDKAARKYVDEQVAAAEADAPPEAKMDILFEDVYVPGSEIPVLRGRISDDSWDFKNKTFLNKVY

SEQ ID NO: 17047 - protein, 505 aa, Candida albicans
IFFLSVHIIYSSQQMLRSFKSIPANGKLAQFVRYASTKKYDVVVIGGGPGGYVAAIKAAQLGLNTACIEKRGALGGTCLNVGCIPSKSLLNNSHLLHQIQHEAKERGISIQGEVGVDFPKLMAAKEKAVKQLTGGIEMLFKKNNVDYLKGAGSFVNEKTVKVTPIDGSEAQEVEADHIIVATGSEPTPFPGIEIDEERIVTSTGILSLKEVPERLAIIGGGIIGLEMASVYARLGSKVTVIEFQNAIGAGMDAEVAKQSQKLLAKQGLDFKLGTKVVKGERDGEVVKIEVEDVKSGKKSDLEADVLLVAIGRRPFTEGLNFEAIGLEKDNKGRLIIDDQFKTKHDHIRVIGDVTFGPMLAHKAEEEGIAAAEYIKKGHGHVNYANIPSVMYTHPEVAWVGLNEEQLKEQGIKYKVGKFPFIANSRAKTNMDTDGFVKFIADAETQRVLGVHIIGPNAGEMIAEAGLALEYGASTEDISRTCHAHPTLSEAFKEAALATFDKPINF

SEQ ID NO: 17048 - protein, 456 aa, Candida albicans
RGSCQPRGEDGGTSEEVLCDIKLSLKENSPITMLPNYNVSPTGNEHGQYLVIDLGGSTLRIAVVDISKPHPNLSRSERITIVVEKSWIIGNDFKRIDGEFFKYIGSKINEILVGQNVIDVKSVINTGITWSFPLETTDYNRGKIKHVSKGYTVGEDIYDKDLKMVLEDTLRQEYGLTLDVQSILNDSLAVYSAGCFIDSKMKLAMVLGTGINMCCSLKRSSDIHPSKMLADATLFNCELSLFGQNLCKDFATKYDIIIDKRFAGFLHHFKTFMEPDPITKTLFQPHELMTSGRYLPELTRLVVVDLIEAGEIFQNVDHQQMYQEYGGFSGELMCFVHENDDYDDIHDKLCKAYGWTTVGLSDIVCLKEVVSCIIKRAAFIVANAIIAFFKLLGSDELGGDVTIGYVGSVLNYFHKYRRLIVEYVNSAEEAKGIKVDLKLIENSSIIGAAIGAAYHK

SEQ ID NO: 17049 - protein, 491 aa, Candida albicans
FNFILLTMVHLGPKPAQKRKGTFTDVSPQLLEALKPIQEQFTISADKLRAIVKHFISELDRGLSKAGGNIPMIPGWVMDFPTGKETGSYLAIDLGGTNLRVVLVKLGGNRDFDTTQSKFALPAHMRTATLDELWDFIAKCLKEFVDEIYPDGCSEPLPLGFTFSYPASQNRINEGILQRWTKGWSIDGIEGKDVVPMLQKAIKKVGVPIDVVALINDTTGTLVASMYTDPEAKMGLIFGTGVNGAYFDVVKDIPKLEGKCPSDIPPESPMAINCEYGSFDNEKYILPRTKYDVQIDEESPRPGQQTFEKMISGYYLGEVLRLILLEFAEEKKLIFKGQNLDKLKVPYVMDASYPSKIEEDPFENLSDVADLFREKLGIETTEPERKIIRCLAELIGERSARFSVCGIAAICQKRGYKTAHCAADGSVYNKYPGFKERTAQALRDIYEWPADVKDPIIIVPAEDGSGVGAAVIAALTEKRLKEGKSVGLLGA

SEQ ID NO: 17050 - protein, 317 aa, Candida albicans
ELLWAEKTLKLSPSTIHSLLQTMLLTCSNTILLTVDTRVKSLLLVTTWSLMVTRLKFSKKETPANIPWGKSGVDYVIESTGVFTKLESAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRVPTTDVSVVDLTVRLKKAASYEEIAQAIKKASEGPLKGVLGYTEDAVVSTDFLGSSYSSIFDEKAGILLSPTFVKLISWYDNEYGYSTRVVDLLEHVAKASA

SEQ ID NO: 17051 - protein, 341 aa, Candida albicans
RIRNMPSSSDAINRISYISLVTSDNDKFNQTFQFYSQLGFRLTKSFSKVSSYGSGLGANHPEFQLGVSHDSLKEVWLESYPLQNVDSNGNLRPWQEMEVYDGDNCERLNESTVIKVRLLGETPLKSISQKQFVFFTTQLNKIEKILTDANVKYGKVVDNVILAEDPLSNIISFSNTQNELCKTRFQSPEEYVEKTTAEILAKRKKSQLGSKFGSFEEISPSEVGGGNGLRKKKIGVMTSGGDAPGMNPAVRAVVRAGIYYGCDVYAVYEGYEGLVKGGDLLKKMEWSDVRSYMSLGGTSIGTARCKEFRERAGRLQGAYNMIKNGIDALVVCGGDGSFLHH

SEQ ID NO: 17052 - protein, 236 aa, Candida albicans
ILPSTIPLVKLHTIYKNSISKGLLIVGGFEAFIQLHELCEQKANYPIFEIPMVVVPATVSDNVNGTEYSLGDDTCLNQLVSYCDAVQQSASSTRRRVFVVEVQGGHSGYVASYCGLITGALATYTPESNINLRELQGDIDLLQKVFATDRGEDHNGTLIVRNEQASAVYSTQLIADILKENANKRFETRTAIPGHVQQGFTPSANDRVMAVKLSLKAMEFIETRNGCYGKHDRKLS

SEQ ID NO: 17053 - protein, 301 aa, Candida albicans
FRNITTMSYATKIHARYVYDSRGNPTVEVDFTTDKGLFRSIVPSGASTGVHEALELRDGDKSKWLGKGVLKAVANVNDIIAPALIKAKIDVVDQAKIDEFLLSLDGTPNKSKLGANAILGVSLAAANAAAAAQGIPLYKHIANISNAKKGKFVLPVPFQNVLNGGSHAGGALAFQEFMIAPTGVSTFSEALRIGSEVYHNLKSLTKKKYGQSAGNVGDEGGVAPDIKTPKEALDLIMDAIDKAGYKGKAGIAMDVASSEFHQDGKYDLDFKNPNPNHLNWCPGPQLGEFISTIEFPNTPLV

SEQ ID NO: 17054 - protein, 148 aa, Candida albicans
IVSIEDPFAEDDWDAWVHFFERVGDKIQIVGDDLTVTNPTRIKTAIEKKAANALLLKVNQIGTLTESIQAANDSYAAGWGVMVSHRSGETEDTFIADLSVGLRSGQIKTGAPARSERLAKLNQILRIEEELGSEAIYAGKDFQKASQL

SEQ ID NO: 17055 - protein, 84 aa, Candida albicans
LTMAIKIGINGFGRIGRLVLRVALGRKDIEVVAVNDPFIAPDYAAYMFKYDSTHGRYKGEVTASGDDLVIDGHKIKVFQERDPS

SEQ ID NO: 17056 - protein, 137 aa, Candida albicans
YHTMPKLVLVRHGQSEWNEKNLFTGWVDVRLSETGQKEAKRAGELLKEAGINVDVLHTSKLSRAIQTANIALDAADQLYVPVKRSWRLNERHYGALQGKDKAQTLEAYGQEKFQIWRRSFDVPPPKIDPKDEYSPSW

SEQ ID NO: 17057 - protein, 123 aa, Candida albicans
FLTLSGPLATPVVKNVDPAVVPLTESLALVIDRLLPYWQDEIAGDLLAGKVVLIAAHGNSLRALVKHLDNISDEDIAGLNIPTGIPLVYELDENLKPTKPSYYLDPEAAAAGAAAVAAQGQKK

SEQ ID NO: 17058 - protein, 268 aa, Candida albicans
IFYQLIIMGVHKLIILRHGESQWNHENKFCGWIDIPLSQKGKQEAIYAGELIKKNHLDPDILYTSKLMRSIETGLTILEVLHKPWIDHIKTWRLNERHYGQYQGRDKHEVFVELGKDKEKFQYIRRDYHGLPPLIEYGQDKSIDEKYKDVLNKDILPRGESLLMVMDRLIPFFKYEILDNQMIQLNKTVLIVTHGSIVRSLIKYLNHVSDDDISKINVPTGIPLVFELNDRGELIKPYYYLDQEKAEKGIAKVKMEGLERKGQTDEKL

SEQ ID NO: 17059 - protein, 366 aa, Candida albicans
SINIKLTMAPPAVLSKSGVIYGKDVKDLFDYAQEKGFAIPAINVTSSSTVVAALEAARDNKAPIILQTSQGGAAYFAGKGVDNKDQAASIAGSIAAAHYIRAIAPTYGIPVVLHTDHCAKKLLPWFDGMLKADEEFFAKTGTPLFSSHMLDLSEETDDENIATCAKYFERMAKMGQWLEMEIGITGGEEDGVNNEHVEKDALYTSPETVFAVYVSLHQISPNFSIAAAFGNVHGVYKPGNVQLRPEILGDHQVYAKKQIGTDAKHPLYLVFHGGSGSTQEEFNTAIKNGVVKVNLDTDCQYAYLTGIRDYVTNKIEYLKAPVGNPEGADKPNKKYFDPRVWVREGEKTMSKRIAEALDIFHTKGQL

SEQ ID NO: 17060 - protein, 440 aa, Candida albicans
NTGSARRCEDPVYIALPSNMVDMKVPQAMLEKSIDLSLEPNNIQSQNEVIDRILGMVSKASNPIVLVDACASRHDCKKEVKQLVETTQFPVYVTPMGKGMIDEGGIGGEDLADASAFKNLASNLSSGTSVASRYGGVYIGSLSKPEVKEGIENSDLIFSCGALLSDFNTGSFSYSIGTKNVIEFHSDHAKIKLAIYSGIKMKELMQALNKKISSVLTNYVPKSVPKVKLVNAPTELSAPLTQAWFWTRVSSWFKEEDIIITESGTAAHGILEARFPNNVVGISQILWGSIGYSVGATLGASVAAKEVDPKKRVILFVGDGSLQLTMQEVSTMIKNGVHPYIFVVNNAGYTIEKLIHGLNAKYNNIQPWNHSQILLLFNAKDSQSAKISTVGEADDLFRNKYFGVNSKIRLIELMFSSLDAPKALVQQAKAAADVNRGTTD

SEQ ID NO: 17061 - protein, 320 aa, Candida albicans
LKKLNSQSSLLPMGKSSVDESHPRFGGVNVGSLSKPEVKESVESADLILSMGALLSDFNTGSFSYGYKTRNIVEFHSDYTKIRQATFPGVQMKEALQKLLTTVKKSINPNYTPVPVPETKLINTPAAPSTPLTQEYLWTKVSSWFREGDIIITETGTSAFGIVQSRFPKNSIGISQVLWGSIGYTVGATCGAAMAAQELDPKRRVILFVGDGSLQLTVQEISTMCKWECNNTYLFVLNNDGYTIERLIHGEKAQYNDIQPWNNLQLLPLFNAKDYETKRISTVGELNDLFADKAFAVPDKIRMVEVMLPTMDAPANLSSR

SEQ ID NO: 17062 - protein, 258 aa, Candida albicans
NSQIIKFTMSEITLGRFFFERLHQLKVDTVFGLPGDFNLALLDKIYEVEGMRWAGNANELNAGYAADGYARVNPNGLSALVSTFGVGELSLTNAIAGSYSEHVGVINLVGVPSSSAQAKQLLLHHTLGNGDFTVFHRMFKNISQTSAFIADINSAPAEIDRCIRDAYVYPRPVYIGLPSNLVDMRVPKSLLDKKIDLSLHPNDPESQTEVIETVEKLISEASNPVILVDACAIRHNCKPEVAKLIEETQFPVFITPNG

SEQ ID NO: 17063 - protein, 78 aa, Candida albicans
LTLSHKQLQTSITYIMREISLGRYIFERLYQLNVHTVFGVPGDFNLSLLDKIYETENEHGGGSFIWAGNCNELNATYS

SEQ ID NO: 17064 - protein, 236 aa, Candida albicans
DLPTTSKVLVSEEQEDLIVFPGGGTYAVCTDPIDGSSNIDAGVSLGTIFGVYKLQEGSTGGISDVLRLGKEMVAAGYTMYGASAHLALTTGHGVNLFTLDTQLGEFILTHPNLKLPDTKNIYSLNEGYSNKFPEYVQDYLKDIKKEGYSLRYIGLMVADVHRTLLYGGIFAYPTLKLRVLYECFPMALLMEQAGGSAVTIKGERILDILPKGIHDKSSIVLGSKGEVEKYLKHVPK

SEQ ID NO: 17065 - protein, 313 aa, Candida albicans
FTSNTLVSVNIDIHAWKGDWPLATKLPLVGGHEGAGVVVRMGEHVKGWKIGDFAGIKWLNGSCMSCEFCQQGAEPHCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 17066 - protein, 352 aa, Candida albicans
LNYTMSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 17067 - protein, 435 aa, Candida albicans
LLLLVPMSELSIKTIETKPFQDQKPGTSGLRKKVTVFQQPHYTENFIQSILDAIPEGSQGSTLVIGGDGRFYNDVVIQLIIKIAAANGVKKLILGQNGILSTPATSHVIRIKQATGGIILTASHNPGGPQNDLGIKYNLGNGGPAPKSVTNKIYEISKQINQYKLIELPNVDLSKIGTIVEGPIEIEIIDSTKDYVDMLKSIFDFPLIKSFIDKATKEQDFKVLFDALNGVTGPYGYEIFVNELGLPESSIQNYKPLPDFGGLHPDPNLTYAHTLVERVDKENIAFGAASDGDGDRNMIYGAGTFVSPGDSVAIISEYADSIPYFQKQGVYGLARSMPTSGAIDLVAANKNLQCYEVPTGWKFFCSLFDAKKLSICGEESFGTGSNHIREKDGLWAIVAWLNVLAGYNKQNPQSKTSIEIVQNSFWGKIWSNFFH

SEQ ID NO: 17068 - protein, 148 aa, Candida albicans
NCSKFILGKNMVELFSLEMILKMFLVKELPKLIDLLQSIVNEKSVGDELAPGYIIKQADNFSYTDLDGSVSSNQGLFIRFDNGLRFIVRLSGTGSSGATVRLYLEKHCDDKSKYHLKVDEYLTNEIQFVLELLKFKQFLNKEEPDVRT

SEQ ID NO: 17069 - protein, 98 aa, Candida albicans
PHTHWLTYSTMNVTVTLTLRQLFRDTSKQGGLPSPIDRSRGDRFAIRAVQFIEDHCDVLAPYRYELDFPIDDKKILKHSGCIRYQVFTFEIHFYQTFV

SEQ ID NO: 17070 - protein, 543 aa, Candida albicans
KIKVKSPMNNLKDTNTCTFVVWWVPIDNDMAMTDATIGGYSALERICRAIDYIDATANSHSRAFVVEVMGRHCGWLALMAGIATSADYIFIPEKPASSKDWQDQMCDIVGKHRAQGKRKTIVIVAEGAITSDLKPITSDEVKDVLVDRLGLDTRITVLGHVQRGGTAVAFDRTLATLQGVEAVKAILELTPDVPSPLIAIDENKICRRPLVEAVRITKSVASAIEAKDFEKAMSLRDHEFKEHLANFMAMNTANHEKPTLPREKRKKIAIINIGAPAGGMNSAVYAMATYCMSRGHTPYAIHNGFAGLSRHESVKLIEWIDIEGWNSIGGSEIGTNRQTPEETDIGMIAHYFEKYQFDGLIIVGGFEAFVSLEQLERSRAMYPSFRIPMVLIPATISNNVPGTEYSLGADTCLNSLMEYCDIVKQSASATRGTAFIIDVQGGNSGYIATFASLISGAQASYVPEEGISLQQLEMDINSLREAFAVEQGMTKSGKLIIKSSNASKVLTPHTLADIFNDECHGDFDTKTAIPGHVQTRWITFTNR

SEQ ID NO: 17071 - protein, 99 aa, Candida albicans
GNEMARRQSFLSEGGTNIGTARCMEFKERWGKMKGCKNLIDAGIDGLIVCGGDGSLTGADLFRHEWPSLIQELKDKSEITNEQFERHKHLYICGMVGSH

SEQ ID NO: 17072 - protein, 271 aa, Candida albicans
RKTTTMISIVNGTSTLSLVAGSVETLNQAIKLYTNILGLSVHSEQNDWTYLSNDDNKMIVKIQLDTKSGLSLDQINDRRTEIIAKLNITDWRSLDTTSVLKVQNLVALIETLTTFNYTLQITPNELYPNEVYCVDPLGYIIGFTACDEPLTLVPPLQKSHPKPGLVSNLMSKSGSQSRNIEETKAVRRNIAVMTSGGDSQGMNAAVRAVVRATIFHGSKAFAVQEGYAGLVKGGPEYIKEMKWQDVRVFFQKGVPILVLPDAWSLRNVGVR

SEQ ID NO: 17073 - protein, 131 aa, Candida albicans
ALEYGANEFHTDIGKSKHEPMSFDVIFDFVGIQPTFNNSDKFIKRRGKIVMVGLGRSKLLIPNYKLGIREVEIIFNFGGHSAEQVECMEWVAKGLIKPNVHVADFNSLPQYLEDLANGKLTGRVVFRPNKL

SEQ ID NO: 17074 - protein, 175 aa, Candida albicans
IIMSALFAVSRSAIALRSIAPRSSTATTSSFLALARLYSSGKFPPHTVINMPALSPTMTQGNIQSWAKKVGDELTPGEAIAEIETDKASMDFEFQEEGYLAKILLDAGAKDVPVGQPIAVYVEDAGEVAAFENFTAADAGEAPKPAPAAEEKHKERRTKGFYLHFSSSFYSIPIF

SEQ ID NO: 17075 - protein, 404 aa, Candida albicans
HLVKQSPKLKPIKHQWILNFKKKVIWPRFYWMLVLKTFQLDNQLLFMLKMPVKLQHLKISLLLMPEKHQNQRLLLKKNTKKEEPKASTSTSAPASTPSPSSKKAPTDRIIASPFAKTIALEKGISLKGIKGSGPNGRIVAKDLEGVEPQAAAAAAPAAAAATAGAAPSATASYEDIPITSMRKTIASRLLQSTQQSPSYIIQSQISVSKLLKLRASLNATAEERYKLSINDLLIKAIAKTCVRIPEVNAAWLGEQGVIRQYKNVDVSVAVATPTGLITPIVTNAESKGLAEISNQVKDLGKRAKVGKLLPEEFQGGTICISNLGMNHAVTAFTSIINPPQSAILAIGTTEKKAVPSEVNEQGFVFDDVITITGTFDHRVIDGALGGEWMKELKRIVENPLEMLI

SEQ ID NO: 17076 - protein, 223 aa, Candida albicans
FDILTIFLSNYGNVSTIGHVVPVTTTKKNINKDALLTKIVSTLIFIYSKFFVFLNCFYLFIIINMLRAAFTRRTVNQIRAFHGSSIYYAASVFKMPAMSPTMSEGGIVSWKVKPGDTFSAGDPILEVETDKATIDVEAADDGKLWEILVNEGTSGVPVGKPIAFLAEQDDDLSTLEKPSIEDVKQETQAPAPQEKNPEEKTTKKEVKQSAPREFLHQGWKIRV

SEQ ID NO: 17077 - protein, 380 aa, Candida albicans
LTNGHLILLRRTETNIYKIMTHTERQKVTFEFFDNTSHQMQRNKLKQLPPLSTDIESSSSPHSPSGADLRFISSSSSINSLFDSVPLYSRTASTTTITPILSRHDSNPGFKNNYHNLLHHPTIQELDFTQTIDLKLRQHQSCTTSAQPKEKLILLLVGLPASGKSTICKQFQEFINENSEYNAQIYNAGDVRRRRSASEFNDAQFFDPNNEQGKKDRELYATITVNNLINDLQSNVIDVGFLDATNTTLERRQRMINLINEQVPNGRIVIFDVQCNNQKLLEYNISGKSENNDYKNKDYTTAINDFKQRAMNYKKIYKPITEEELASYGDKVDMYMKCVNGGQQFEFSHIHHADTWYYKILSDFKSNYKLSEVYRELLGQ

SEQ ID NO: 17078 - protein, 454 aa, Candida albicans
PVLYLESVCNDPSIIESNIRLKLSGPDYKDMDPKLAFNDFVGRLHNYEKAYETIDEEEEKIPGFQYVKMIDVGKKVVSFNIKGFLASQTIYFLLNFNLCERQIWITRHGESQDNLNGRIGGDANLTKRGLKFAQALTQFMNFQRQEFRKQQLERFSSRLELKYNSLFNEDDVALLDSIHSEPNFCVSTSMLTRAVETGQYFNDQLYSIKQLRMLNELGGGKFEGMTYEEIQSKYPKEFASRLKNKLSYRYPGVGGESYLDVLTRLRPLIAEVERTTDHLLIISHRVVSRILLAYFLNLDKSAIGELDVPLHTLYCLELHPYGTDYTMYEYDENLDWFVKAEPEHQKNVKEVGVVFKERKYSVVPTAPPTSKSRAVSFAVTNNYNNNNNTDHTNNKATDDVRDEIRRRLSMGTSNKPTLLVRDGDDKSITAKHLRDLKNLRKPMGQRKTAADQLC

SEQ ID NO: 17079 - protein, 60 aa, Candida albicans
  UNSURE (24): Identity of amino acid sequences at the above locations are unknown.
EKKWAMDTLDQLLDYVISGSGSVXIFDATNSTKLRRKRVLKRIQQRFKWGITSIIFRKCL

SEQ ID NO: 17080 - protein, 661 aa, Candida albicans
MPPTSTDSTNNSTPSPNTSANSLDQFPHHSQESIRILIAANFKQPKPQPQQQPHPQQHSLELSHPTSNLHQVSSNSAHSSDISPTDSGISLRPNRVKSYSISNGVLSHSRTANKRVSFSNLHSTNSSQLSLTSSESSENEIYSDEDDEEEEDYEAGKDNDNSEDIKHPNHNEPSELLLREPNFKQVKKDDTITTTTQEELSSHNSSGSINRSTIGKKIAKFTAGSMTPSPNELSPTSSSASLKSKKNKSSYPYPYSSRHNFLNHYGGEKLALSKSLDSQLLEPYDSNSSVNSFLPEFNKRPLTDTPIVSTIGSPITREQSYDDYDEDEEEDEDRGNINSIQEEEGGDSSGTTTNKHKPTSLHKTKNISHLNLSELSHKDTTTNKEGSPDAESLKNSREHAALIAAKQLVGNKALEKEDDLPTGTIAAQLLRKSAGISDNSGQLLYSVPSRSPPHVLIDESTGVSTPVGSVVTVSSGEDGKEKGKGLVMAKNVKDNLLKDLPPYMKEQFEKTPSLEKLKNLLMHKPPPSARKAYTLNIPGQTSSKTSPDGKIASVDVGSKLVIVMVGLPARGKSYITNKLTRYLNWLQHDCRVFNVGNTRRKDKLNAGPENQPLPDKATTPTESRSPRQHDADFFNPENKDSTALREKMGYGYFRSIIRLCY

SEQ ID NO: 17081 - protein, 92 aa, Candida albicans
IFTLTTHIHTQLNINTMLKVARLQIRFNSSTAASAAAVAAKTAEVRTRTVKTPVGIKAAIESLKPKATRLSMDGPVECALSGFSLLNSPQFN

SEQ ID NO: 17082 - protein, 284 aa, Candida albicans
GSAYSKEERESFDLTGLLLSQVNSLDEQVERAYRQFSYLKTPLAKNDFCTSMRLQNKVLYYELVRRHIREMLPIIYTPTEGDAIASYSDRFRKPEGCFLDINDPDGIDKRLSAYGEDKDIDYIVVSDGEGILGIGDQGVGAIRIAIAKLGLMTLCGGIHPARVLPIALDVGTNNDRLLNDELYMGNKFPRVRDEKYWDFVDKVIQAIKKRFPSSVLHYEDFGVSTGRDLLYKYREELPSFNDDIQGTGAVVMASITAALKFSKRDLKDIQVLVYGAGSAGLGIG

SEQ ID NO: 17083 - protein, 266 aa, Candida albicans
PIHLVSRGATEEQARARIHCMDRYGLITNESTNASPAQLKYADPASEWDGIDTKSLLACVNKIKPTVLVGCSTQPGAFTEEIVKEMYKHNPQPIIFPLSNPTRLHEAVPSDLMKWTDNNALIATGSPFEPVDGYYISENNNCFTFPGIGLGAVLSRCTTISDTMISAAVDRLASMSPKMENPKNGLLPRLEEIDEVSAHVATAVILQSLKEGTARVESEEKPDGGFVEVPTDYEGCLKWVQSQMWKPVYRPYVKVEYVSEIHTYQY

SEQ ID NO: 17084 - protein, 94 aa, Candida albicans
ALARSWPLRARRRECHRRAIAKREPCDILVVAHGHILRCLGARWVQRELNVNPQLILDAGGVRTLSYEHHNIDEPSIFLSGAFTVPVAEQCADL

SEQ ID NO: 17085 - protein, 158 aa, Candida albicans
YSTIIHHFSFSFWNSPFFLLQLITLLNPKPYKMSKIPYPRLIFVRHGQTEWSKSGQHTSTTDIDLTPFGVEQMRNTGRALIGPSNLQMIKPENLTRIFVSPMQRAQQTLQLLLEDVDPEFKDKIPVEIDEDVREWDYGDYEGITSAEINELRIKIRLY

SEQ ID NO: 17086 - protein, 276 aa, Candida albicans
SSSTCAPITGGFIFFRFFFFFSFIFHFLAKPERNNIMTKSPCPRLIFVRHGQTEWSKSGQYTSRTDLDLTPFGVKQMRNTGKGLIGPGNLQMIKPENLTHIFVSPRKRAQRTSQLLLEEVDPEIKDKIPIEIDEDVREWEYGEYEGLKTNEIIELRKQKGLDKDLEWTIWGKGCEGGEQHYEVAARLDRFIEKIQKIHREALAKGVASDIIVVAHGHILRCLVARWVKRELSTNPQLILDAGGVGVLSYQHHNVDEPAIYLAGAFTVPVEEEGADI

SEQ ID NO: 17087 - protein, 245 aa, Candida albicans
ILGERIELHNSNYGYLINKVVFYLMNGKIKPGSLYLARCYKNSVDYNQDPPLDEEGIKYAKNLTYTLFDHLEKSGNLQEKQQQQQQQEATPKDNNSLAIWTSVKRRTIETTQFFAAKNIPIRHRVQLSQKNPGITGTLTDDEIREKFPIEYAQYDHSPYHYRYPRAESYHDLAIKIEPLILEMERMSGDLLIIADETVLQVFYGYLMSCSCDEIPNLNFKPNEIVEVKFNAYSNSAKRIPIKDYS

SEQ ID NO: 17088 - protein, 286 aa, Candida albicans
  UNSURE (194): Identity of amino acid sequences at the above locations are unknown.
MSESTTTTSSSSASTTSASFIPDTETEILNGFGSAPISSDTNQLRTTKRWSFTSKTRPNMGDSVKNGPPANYVPKRRMSDITGIDAVHNQRNPLDSLGGAQLYLTESGRLFHAGEIIIILAGIPGRGKTHLSVSLTRYLRWLGVNTHSFHLGNYRRANAEDDITHDLFVPSPQSAKAHALREKMVNDCLGDILXFFRNDGGQVANYDATNAIPEYRLELHKKFRDLNIQVIFIESLVTDDSIVMHNIEQAAKSSPDYHKWDYDKAYKDYTERIKAITPHYIENGGI

SEQ ID NO: 17089 - protein, 817 aa, Candida albicans
GKTEGMEFSNKRSRDDFEQDEGQFHDGPSHDSFDHKRHHIDPAQELINNICKDIRRLGEAGDIENLIADTNYISNPIVAEFEKIDNLRNSILSTVYALITEQPHKISAIANLILICNAKNFVIAKYVVEYLHSKMQTMLDSQEGSVFNDIKNILKFLSTLTPIIEDNGIIQIFKQFLNFAIELQEQTEVRNGLAQEIYYNVLIAIPYVLSNDNSDDLKKSINELIELARNFKIVAESATVLLPFDTRMGNFELPYIPKQMVDLILPALIKLQNDDWNFRLFLDFKTHLDPVIQSALENNSISSELVKHKLPQLSFPSVENASFKSTSIDKLWNDNPRYLFQVYNNTTEYETVPPIETYLGLFFKDIAFDILTNLSFNKNETAIELSILDMFFDNKLFAPPGTSIDQLNAIYEDNKLGTNDPSLSTWKIEDVAVESILTMIFQLPNPLEVEIYYYTVLISCCRESPESIAPVFGRAIRYFYNHLETLDYELKIRFLDWMSIQLSNFEFSWKWEEWVSDSKKLKDLKYHPKKNFIKNLIAKEIRLSNKKRIKDSFIDIVDGEVVNLDEFYQYLDISMVPDVKSYIISYDTELYGESLRDTLIQLYEQKQEQLNSKSNIGAQNEIFFNFTNSELPFHETASKVYDFILTHWKSNTDFNELYKSVLESITAPNNERFAINLIIQTYAYIGSRSIYSVVSILSRDINKLKFLSGAPIDYVGDKARVEDLHFTEEEKLNTQNWIIEAVFRIWIHQPQVVSVISEYLIEFGIIDPEYILVKALESNLIIDNVSCMESINRILSSAELKELIILSFTAIIDKLIK

SEQ ID NO: 17090 - protein, 224 aa, Candida albicans
YQMTFEINENPDPEIIRVFIVRHGQTDHNVQKILQGHLDTDINETGKEQAEIVGKYLSKIPFDYFVSSDLSRCQQTLIPILSHQQTKTVKYTPNLRERDMGKVEGMYLKDALEKYGPGFRNLGEKEDALCKRVEKEWNEIIEQNYHNVLICTHGGVITRFINYLHKDLGYKLNNKLTPDNLKVPFNTSVSVIDVEKNTKRGVIQAFGNTLHLGGNFEVKDQLLR

SEQ ID NO: 17091 - protein, 222 aa, Candida albicans
RLMNPGKKYNLQYYLKVVDEIVKMGTHFLGIKDMAGTLKPAAAILLVGEIRSRYPDLPIHVHTHDSAGTGVASMTACAIAGADVVDAALNSMSGLTSQPSISAILASLEGSIETGLSESMVRELDNYWAQMRLLYSCFDADLKGPDPEVYQHEIPGGQLTNLLFQAQQLGLGTKWVQTKETYKVANQILGDLVKVTPTSKVVGDLAQFMVSNTLTEEDVYRL

SEQ ID NO: 17092 - protein, 166 aa, Candida albicans
RLMRGTAFAPYADLIWMESALPDYAQAKEFADGVKAAVPDQWLAYNLSPSFNWNKAMPADEQETYIKRLGKLGYVWQFITLAGLHTTALAVDDFSNQYSQIGMKAYGQTVQQPEIEKGVEVVKHQKWSGATYIDGLLKMVSGGVTSTAAMGQGVTEDQFKESKAKA

SEQ ID NO: 17093 - protein, 357 aa, Candida albicans
KTKRIYSAEDIAKKRGTLKINHPSSQQADKLFKLLEKHDADKTVSFTFGALDPIHVAQMAKYLDSIYVSGWQCSSTASTSNEPSPDLADYPMDTVPNKVEHLWFAQLFHDRKQREERLTLSKEERAKTPYIDFLRPIIADADTGHGGITAIIKLTKMFIERGAAGIHIEDQAPGTKKCGHMAGKVLVPVQEHINRLVAIRASADIFGSNLLAVARTDSEAATLITSTIDHRDHYFIIGATNPEAGDLAALMAEAESKGIYGNELAAIESEWTKKAGLKLFHEAVIDEIKNGNYSNKDALIKKFTDKVNPLSHTSHKEAKILAKGIDWYRYLLQLGMLPEAEKSYYRYPRWVSMCRHE

SEQ ID NO: 17094 - protein, 475 aa, Candida albicans
  UNSURE (14),(15),(27),(29),(40),(41),(42),(65): Identity of amino acid sequences at the above locations are unknown.
PKHIEVQLLADNYXXVIHLFERDCSVXRXHQKVVEMPPAXXXPKLVRDAILTDAVKLAKSANYRXAGTAEFLVDEQNRHYFIEINPRIQVEHTITEEITGVDIVAAQIQIAAGASLQQLGLLQDKITTRGFAIQCRITTEDPTKNFQPDTGKIEVYRSAGGNGVRLDGGNGFVGSIISPHYDSMLVKCSCSGSTYEIARRKMLRALIEFRIRGVKTNIPFLLALLTNEVFITGDCWTTFIDDTPSLFQMISSQNRATKMLSYLADLVVNGSSIKGQVGYPKLDTDAIIPEIHEPKTGITIDVDHTPPPRGWRQVLLEEGPEVFAKKVRQFNGTLITDTTWRDAHQSLLATRVRTIDLLNIAPTTAHALKGAFSLECWGGATFDVCMRFLYEDPWARLRKLRSLVPNIPFQMLLRGANGVAYSSLPDNAIDQFVKEAKENGVDIFRVFDALNDLEQLKVGIDAVKKAGGVVEPTVC

SEQ ID NO: 17095 - protein, 116 aa, Candida albicans
YRLARIVRPLCGRRPTEQSLKYYKDQSLVKSQVELIDDIDSLRACVAFEKCFGKVVEPACGAAMAVVYNKIDLLYKNFKHLQPEDIVVIVVCGGSCTTGSDLKGFEKMIQKSEIKL

SEQ ID NO: 17096 - protein, 556 aa, Candida albicans
LSIMAPPTAVESSINFGGHPTIKSTQDPLVQKLSLNTDTVIRHNAPPPTLYEDGLLEKGTTISSTGALMAYSGNKTGRSPKDKRIVDESTSSHNIWWGPVNKQVDELTWKISRSRALDYLRTREKLFVVDAYAGWDPRYRIKVRIICARAYHALFMTNMLIRPTEEELKNFGEPDFTIYNAGQFPANIHTKGMTSATSVEINFKDMEMVILGTEYAGEMKKGIFTVMFYLMPIKHKVLTLHSSCNQGVEKGDVTLFFGLSGTGKTTLSADPQRKLIGDDEHCWSDNGVFNIEGGCYAKCLDLSAEKEPEIFNSIKFGAILENVVYDPITKVVDYEDSSITENTRCAYPIDFIPSAKIPCLADTHPTNIILLTCDASGVLPPVSKLTNAQVMYHFISGYTSKMAGTEEGVTEPQATFSACFGQPFLVLHPMKYAQQLSDKISEHNANAWLLNTGWVGSSVAQGGKRCPLKYTRAILDAIHSGELSKVEYEKVPVFNLNVPTSCPGVPSEILNPTKAWTQGTDSFNKEIKSLATKFAENFKTYADQATAEVKAAGPEA

SEQ ID NO: 17097 - protein, 245 aa, Candida albicans
NRGSFQPGGEDSNLSLLDIQNSLHLHLPNENGENCPCGCSNPHAVHERPVSIAGSIYGAVAANERVPISIAGSIKLSDEEDEEDNASLLSIEDYNSRHRDQHFHFASNSTNREQSPAPGAFAAATAIAQMQKNKLFLQQQQQLENENNKQQMLTSLVAMSIPRSTEETLCVPTLLARICQTYGYDSKQAILAANSLASLKENITSNTGTLLDEERKNALNSMIMNRYETTKLSEEEAIVFTKGFD

SEQ ID NO: 17098 - protein, 458 aa, Candida albicans
SPHFAAPSAPCGRKRDYDDVNQEDNVNILIVNNTKLSIVGKVSKMALSVMLYSKVLANILDSIYSRFDNTNIHKKALQRDRMLDCWRRELPLDLKFEIDINGLSLKDSSNNFIEGNIWRNYNKQQLTLIFLYYHAKILIYLPILSRFGNHHNVGLSQKEQLLKGEGDVATIVSSISLIQQSSIQILEVLKYLTSTSSSNILPIPIHIVREQSLLALMVAKGALDYIKGGPLFSNLKQLLLDTMGNLSRDANFDIPGALNRKSFKLFEITILGILGLNINKSMTSGVNMKRKGSSALQPITKTAVERSPTVNLTNNFAASKLKTPTSNTDMVNNNQILKIEQQDPVLSQQQKQTRNISTREISNNGDIELDNSNNYADDIESLEELLNFDPFKVNVNRQMLVNEFVTDGSLGLVPFLEMNNEQLNDSSMLFDKSYNAINERKTTNHDDYISHNDSHFWK

SEQ ID NO: 17099 - protein, 335 aa, Candida albicans
RQPIFTCQFFLVFICFLSIDKNTTIRGSHSMLESEDPNKKRKRIRRACDFCRSKKAKCDGKSPVCSNCFANKEECIYSQPVKRRGLPTGYTHDLEKKVRLFQGLIARLCEDKYVQSRLQTILNDESLVDDLVELEKSWNSNSISELFDQVASQSNSKNNIAKLATHKPTPVQSDSTPVSTLDGNPPLTTLQCQVCQKSQDRKFRKAHTPDPLQTISASPSTSQTATAATAATAAATVAADNAINPVIGSDRPTSIYPSTPSPFVSDLAFFLNYDVFQFISDEIEGVENPENWEPVALQYHGLSSIISGFTNKVVQQYNSKLNNVFTNPFRVGQLS

SEQ ID NO: 17100 - protein, 325 aa, Candida albicans
  UNSURE (261): Identity of amino acid sequences at the above locations are unknown.
AISLPIMKAIVYHDRGDIRYDPNFPDPQIIRLDDVKIKVHYCGICGTDLKEYSDGPIFFPPKGELNEISQMESIQVMGHEISGEVIAIGDDVTNVKVGDKVVVEVTGTCLDRHRYQDSKNGDLPKPNCPSCVSGNYNACDYLALIGCGFANGGCAEYLVVANLKVIAFDQDKIPMDIAALIQPIAVSWHAVKVSNFKPGSNALILGGGPIGLTTIFALKGNQVSQIVLSEPALARRQLAEKLGVITYDPTGKSIEQCVEDXKKLSPGGYGYEYSYDCSGVKATFETGLKTLKIRGCATNVAIWAHKSIPLYPMEITLSEKMLTGS

SEQ ID NO: 17101 - protein, 282 aa, Candida albicans
ANGSCLDKKYLQQLQEEQNDVCSACAHGRYNACKRLGFYGLGYDNGGFAEYIVASENKVIPYDANIIPDEVAALVEPLAVSWHGVRQSKIEECKSPQALILGGGPIGLCTIFALKGHKVTDIVVSEPAEGRRELAQSFGVKTFNPFDYKDAEIQIKELLKMTKTNSGFTHVYDCSGNKATFNTMLKVLATGGVGTNVAIWPKVPIDFYPMDLTLNELYLTASMDYTKIDFELVVKAFETGLIDPKEAAKLVSKKVPLRDGIEHGILDLINNKEKYIKILLHP

SEQ ID NO: 17102 - protein, 703 aa, Candida albicans
YKRKTTIIMSISVEPNETEALLRKQNDLSTTASIEEKYPHQQGEAAEDDDDTLKRTQYDEAKETAESLKQVESILAPIVFTALSFFVRFYRISVNDHVVWDEAHFGKFGSYYLRHEFYHDVHPPLGKMLVGLSGYLAGYNGSWDFPSGEKYPDYIDYTKMRLFNATFSALCVPLAYFTGKEVGFSMFTTWLFTLMVALESSYVTLGKFILLDSMLLFFTVATVFCFSRFNNFNNKSQEFSRKWWKWILLTGVSIGCTCSVKMVGLFVTTLVGIYTVVDLWNKLSDKSISWTKYIQHWFARIVALILVPIFIFMLSFKVHFDLLYKSGTGDANMSSLFQANLAGSDVGGGPREVSMFHSVITLKNQGLSGGLLHSHVQTFPEGSKQQQVTTYGHKDSNNNWIFQRARGQPYYDTSGNTTDIEYIFDGMHVRLMHPQTGRNLHTHDIPAPVSKSEYEVACYGNLTIGDPKDNWTVEIMEQASDEDKMRLHPLTSSFRLKNEVMNCYLGVTGTTLPQWGFRQGEVVCYKNPFKKDKRTWWNIENNRNAVLPPAPEDFKLPKTKFIRDFIQLNLAMMATNNALVPDTEKQDDLASSFWQWPTLNVGIRMCGWGPENPKYYMIGSPATTWTSTVGVILFAFIVLYYLIRWQRQYVDFPSTNPHKLKLFLMGGIYPMFGWGLHFLPFAIMGRVTYVHHYVSSPRGWKVR

SEQ ID NO: 17103 - protein, 280 aa, Candida albicans
LLNIFLMPIVQESPKEVDTVLKNQSTNASTNTNTNKQQFRESPEFTLSNVLDDIKQGIIAFLINPKVTIIVYPIIICLSSILTKIVINKISYTEIDFITYMQQIKLINQGIIKYSEIEGDSGPIVYPGGFVQIYQFIQWLISSSSSSSSSTGEEILSYDVREAQYIFSYLFTTSIIFNCLIYINLINIPPWTIYLFLLSKRLVSIYVLRLFNDCWTTLAILGVILILQQASTNITEDWLVYLLVILASDLYSNGKSIKMKALLNFPAFNKHGLIPNWKKI

SEQ ID NO: 17104 - protein, 256 aa, Candida albicans
  UNSURE (12): Identity of amino acid sequences at the above locations are unknown.
FNQPVFLLVMIXIQILLGGHFLLPLELFNNDVDVRRMASIIRWDYINQAFNFKRKFLYEWTVNWKFLSIETFTSDGFAKLLLLLHVFTLLVFIITRFLNSRITGKSITSLIYQIVLPFSSSSSSSKSSSSSNGNNSNLIKNPQSGPQLIFIIMSITNLIGILFARSLHYQFLSWYAWSLPGLLYLNFPIYFALPIWFVHEWCWNVFRSNSISSITLVSILSLIIGATWWNFDHWFPPSVNLSYTSNENKNNKKKQE

SEQ ID NO: 17105 - protein, 97 aa, Candida albicans
IGTNSSSVSDEITAITKLARDSPLETTLHSAGTTIAGPWDQVMDLIGQMHQLLHEKHGVVRIQSDIRVGTRVDKPNQLPQDKINVVQRKLAQQEKQF

SEQ ID NO: 17106 - protein, 179 aa, Candida albicans
EGYPTGMEGELEKCWEFLKKYFYILGDYVELELQEKKRIVAENDSFIVVVPYWALWPFETLLISKTHLKSIQEFNDKQKLDLAAILKILTTKYDNLFNTSFPYSMGIHQAPFKCTHEQNECSWFHMHFYPPLLRSATVKKFCVGFEMLGEPQRDLTSEQAAARLQELNGDVHYMNKPQA

SEQ ID NO: 17107 - protein, 164 aa, Candida albicans
DQVSPPTNVIIIMSLDHLLNPLTSTPTYIKMTQEFDFTNHSHRRLNLLTNKFVLCSPHRAKRPWQGAKEEIKKSALPEYDPKCYLCPGNIRATGDMNPKYDATYIFPNDYPAVRLDQPEYKEDEQDKQNTLKSRLLQTQGVRGKCFVICFSPKHNLTLPLMKDE

SEQ ID NO: 17108 - protein, 1093 aa, Candida albicans
  UNSURE (416): Identity of amino acid sequences at the above locations are unknown.
KVEREVYGLNDEINDYGSSPKKNQVISFSRPMNNEKPAKPKHDIYFWKVYCYAITFWAPAPLLKLFGLPTKDRQFAWREKIGLISCILYVGAFVAYLTFGFTKTVCSSQVVRTQINHVNGGYLIINGRAYDLTSSQHPKAAGIQAGSNVLYPPMNAGGKDASFLFQNVNGNCKGLIKPRENCSIPYDGDELAWYMPCRLFNQDGSTKPNNTFAYYKGWACHTSETARDAYYKLKVNGDVYFTWDDVKNSSRNLVVYSGNVLDLDLINWIETDDVTYPELFDKLRDDETYRGLDISLVLTNSEERQAARCLTEIIKVGSIDTDTIGCIASKVVLYMSLVFILSVVVVKFIMACWFKWVTSRKQGATMYDSKAWAKRNREIEDWVDHDHGIGAEVEPVPVKARANYKAAKTNRQSVSXRAQKLSLRPNADLSQYYDNPNALSKTFKYTTMSTQAALLGRNGYGKRGNNANKSVSGGFNGRQSNLYLTDQGSSTDLLNRPVSSYNPFDSMGDDSIVINGLSPDIIHPDVVPQPPVEYQPFGYPLAHTINLVTCYSEDEEGIRITLDSIATTDYPNSHKLILVICDGIIKGSGNDETTPDIVLDMMSDLTVPRDEVEAYSYVAVAQVIKRHNMAKVYAGFYKYNDETVPPEKQQRIPMITIVKCGTPEEASAPKPGNRGKRDSQIILMSFLQKVVFDERMTSLEYEMLQSIWRITGLMAEFYEIVLMVDADTKVFPDSLTHMVAEMVKDPTIMGLCGETKISNKAQTWVTAIQVFEYYISHHQAKAFESIFGGVTCLPGCFCMYRIKAPKGSDGYWVPILANPDIVERYSDNVVDTLHRKNLLLLGEDRYLSSLMLRTFPTRKQVFVPKAACKTVVPDKFKVLLSQRRRWINSTVHNLFELVLVKDLCGTFCFSMQFVIFIELIGTLVLPAAITFTIYVIIVAIVSKPTPVMSLVLLAVIFGLPGCLIVITVSSLSYLVYFVIYLFALPIWNFVLPSYAYWKFDDFSWGETRTVAGGDKGDHSAVEGKFDSSKIAMKRWREWERERRSTENRKQQQQQQLTNNSSNNLAVPGAAWDPSNTGGNLIDDLSQGSSSGSS

SEQ ID NO: 17109 - protein, 746 aa, Candida albicans
WISISPQQQSPRQSPNIFSRSTARAATSKLNMSIYDNTPNLQFNKSGAATPRAQFTSKESPKRQKTTEVTIDFDNDDDNNHTLEFENGSPRRSFRSSAISSERFLPPPQPIFSRETFAEANSREEEKSADQETLDEKYDYDSYQKGYEEVETLHSEGTAYSGSSYLSDDASPETTDYFGASIDGNIMHNINNGYVPNREKTITKRKVRLVGGKAGNLVLENPVPTELRKVLTRTESPFGEFTNMTYTACTSQPDTFSAEGFTLRAAKYGRETEIVICITMYNEDEVAFARTMHGVMKNIAHLCSRHKSKIWGKDSWKKVQVIIVADGRNKVQQSVLELLTATGCYQENLARPYVNNSKVNAHLFEYTTQISIDENLKFKGDEKNLAPVQVLFCLKELNQKKINSHRWLFNAFCPVLDPNVIVLLDVGTKPDNHAIYNLWKAFDRDSNVAGAAGEIKAMKGKGWINLTNPLVASQNFEYKLSNILDKPLESLFGYISVLPGALSAYRYIALKNHDDGTGPLASYFKGEDLLCSHDKDKENTKANFFEANMYLAEDRILCGELVSKRNDNWVLKFVKLATGETDVPETIAEFLSQRRRWINGAFYAALYSLYHFRKIWTTDHSYARKFWLHVEFIYQLVSLLFSFFSLSNFYLTFYFLTGSLVSYKSLGKKGGFWIFTLFNYLCIGVLTSLFIVSIGNRPHASKNIFKTLIILLTICALYALVVGFVFVIHTIPTFGVSQHGESRTNV

SEQ ID NO: 17110 - protein, 503 aa, Candida albicans
TMQAAFSKLKLKSKASDIPQADSASTSGKPPSTKQIYQSRQNFGVNFGACFVLEKWIYHELFSETNGDAELDAVLSLFKKLGEDDTRSRFENHWKGYVNDDDWKWLSEHHVNSIRLPIGYWEVDGGAYTSGTNFDKYKGVYKNAWKIIKDDFIKKALDHKISVLVDIHGLPGGANNSGHSGESGAGGKFWKDEKKQIAIAKMMGWIANDLKSFDNIAGIQVVNEAEFSDPAKKQSTYYSACITEIRKSDKLVPIVISDGWWADQWVKWVQEKQGSDGYIGVVLDEHVYRCFSDDDKKKKPQQIIDDLQGDVLTNLNDNGKGVDFIVGEYSCVLDQQSWDNDKNADRDDLVKKFGQRQSEEFAQKTSGSYFWTFKFQSGNGGEWDFKTMTDKGALVPPPIPSNQPLDDKFEEALNNAYNGHVDFWKNEHPDGKFEHDNFKEGFTIAWKDADAFAQFDGSRIGRKEAWKRSRLQEFASSKGKLDFLWEWEQGFDQGLEGFYSAST

SEQ ID NO: 17111 - protein, 177 aa, Candida albicans
NAAHSFRGEHVKPHLSIIQVGDRPDSNTYVKMKLKAAEEASIGCELIKLPEDISQFELLSKIEKLNNSLDVDGILVQLPLPEHIDETKITDAVLANKDVDGFGPFNVGELAKKGGEPLFLPCTPKGIMHLFEKSKIDLEGKDVVVLGRSDIVGKPIARLLTKANANVTVVHFKNTIK

SEQ ID NO: 17112 - protein, 92 aa, Candida albicans
EDPILLVNQLLVYLLKPMPMSLLFISKTPLNKLKNYLGDADIVVAAIGQPQFVKGEWLKHGVEVIDVGTNFIPDASKKSGQRMVGDVDFESS

SEQ ID NO: 17113 - protein, 80 aa, Candida albicans
NMVLKLSMLVPISFLMPVKNLVNVWLVMLILNHLKTKASFITPVPSGVGPMTVACLLDNVLIGAKKHYKANNETPNSPTL

SEQ ID NO: 17114 - protein, 512 aa, Candida albicans
NPKFTNPLKLHLQKPVPSDFEISRAQQPKRITQVAEEAGILDAELEPFGFYKAKVSLDILKRLNNKVNGKYVLVTGITPTPLGEGKSTTTVGLAQALGAHLKKNVFANVRQPSMGPTFGIKGGAAGGGYSQVIPMDEFNMHVTGDIHAITMANNLLAAAIDTRMFHESTQKDGPLYRRLVPEKKGVRKFTPSMLRRLEKLGINKTDPNELTPEEITQFARLDIDPESITWRRVVDCNDRFLRGITVGQAPTEKGFTRATGFDITVASECMAILALANSLEDMRERLGKMVIGSSKAGIPITCEDIGCAGALTALLKDAIKPNIMQTLEGTPVFVHAGPFANISIGASSILADKMALKLAGTSSELSEEERKEQEGYVVTEAGFDFTMGGERFINIKCRSSGLVPDVIVIVATVRALKVHGGGPEVKAGAPLAPEYTQENVELLRKGCSNLAKHIANAKSYGLPVVVAINKMSSDSDKEHEVIREEALKAGAVDAIVSNHWVFTTGLAGSAIE

SEQ ID NO: 17115 - protein, 1020 aa, Candida albicans
MTHRKNYTDTAYTRLKNFVMLFLKKEQLFVFFLFSFFSLSIPPAMLRLRPTIRSLSRNFHRSCINLDAVVVSGTKLANTIRANVAEKVINYNKEHFGDNNKSFENFRFQPSLTILQVGSRPDSSAYVQFQLKAAASSNIKSKLIKLDESISQEDLVEVIERLNKDPKVHGILVQLPLPKHIDESVITNSVATDKDVDGFDHYNVGQLSKRGGTPYFKPCTPNGIMELIKTTGIPLRGKTAVVIGRSDIVGTPVATMLRNEDCTVTVCHRYTQNLPEIVRQADIVVAAVGIAEYVKADWVKDGAIVIDVGINYKDDPTAKRRRRLVGDVDYEEVAKKASFITPVPGGVGPMTVAMLCSNVYDAALIHAKKAHEHGFKPLELNIKDPVPSDIEISRNQKPKKITRVAQELGILDAELEPYGHFKAKVDPKSVIERLDEQAEGSAQDKGNYVLVAGITPTPLGEGKSTTTMGLTQALGAHLGYNAIANVRQPSMGPTFGVKGGAAGGGYAQVIPMDEFNMHLTGDIHAISAAQNLLCAAVDTRMFHESTSKTTSGFYKRLVPIKKGKRSFTPSMLKRLEKLGITKTNPDDLTAEEIEKFAVLNIDPDSITIKRVVDCNDRFVREITIGEGKNEASKYPPRKTGMDITVASELMAILALSNSLKDLRQRVGKLVVGTQRKTGEAITAEDIGCAGAITALLKDAIKPNLMQSLEGTPVFVHAGPFANISIGASSVIADKLALKLTSPSNPINNGETGFVVTEAGFDFTMGGERFFNIKCRASGLKPDAVVLVATSRALKLHGGATDVKPGQPLPAEYVNENLEYLEKGCANLAKQIANIKQYNVPVVVAINQFETDTDAEIKLIQSLALKAGADFAVPSNHWAKGGAGAVELASSVVKAVELAPLEQQKYLYDVNDTVENKLLAITTKMYGASGIELSPLAKKQIETYTKQGYDKLPICIAKTQYSLSHDSSLKGVPTGFTVPIREVRCSAGAGYLYALAAEIMTIPGLPTHAGFIKPLSSTHEL

SEQ ID NO: 17116 - protein, 88 aa, Candida albicans
KLLIFLGCGVPVVSVDFPAIDELVKNKVNGLITNSKSDQTKEVARLVTEVFTDDALLRSIKEGALEESNSRWDENWMQTFSSIFENKS

SEQ ID NO: 17117 - protein, 397 aa, Candida albicans
SNTSLYSGMGEIIKYKGFDHVWQYSGPWLYCLIGIYISLPVLAYHILPWIFHKNRSNKRKTISIFVLGDLGHSPRMCYHASSFSKLDYYVNLCGYVETEPSHQIVDDVNIDIIPIEAIKNTSNLPFIMFAILKVVRQCGKIWSILWDTRGSDYIMIQNPPSIPILLIVILFKTVFSRETKLIIDWHNLNYTILNLRYNNLNHPFVKLVKLYEKFLGQFANLNITVTKSMKKYLVKEFGFQKSKIVTLYDRPGVQFQPLSNKREFMSEHKLFEDIDIEKYNVLISSTSFTPDKDFNILLDALKNYENTPNTPPILLIVTGKGPLKGKFLETVDKLEFTNKVCVKSAWLSSGDYPKVLACADLGISLHTSSSGIDLPMKIVDFFGLWRTCCISRFPSHR

SEQ ID NO: 17118 - protein, 481 aa, Candida albicans
KASMVQGKVLVVSNRIPVTIKRLDNGSYDYSMSSGGLVTALQGLKKTTEFQWYGWPGLEIPEDEQTKVNDELKSKFNCTAIFLSDTIADLHYNGFSNSILWPLFHYHPGEMNFDENAWAAYIEANKKFALEIVKQVNDDDMIWVHDYHLMLLPEMLRQEIGNKKKNIKIGFFLHTPFPSSEIYRILPVRKEILESVLNCDLIGFHTYDYARHFISSVSRIVPNVSTLPNGIKYQGRSISIGAFPIGIDVDNFIDGLKKDSVVERIKQLKSKFKDVNVIVGVDRLDYIKGVPLKLHAFEVFLNENPEWIGKVVLVQVAVPSRGDVEEYQSLRSTVSELVGRINGEFGTVEFVPIHYLHKSIPFDELISLYNISDVCLVSSTRDGMNLVSYEYIACQQDRKGVLILSEFAGAAQSLNGALIVNPWNTEDLSEAIKESLTLPEEKREFNFKKLFTYISKYTSGFWGESFVKELYKCNPQKSLRD

SEQ ID NO: 17119 - protein, 208 aa, Candida albicans
TSFSSTPIMKLATEIDFKLNNGKTIPALGLGTVASKDPKDVKDQVITAVKAGYRHIDTAWFYGTEKYIGEALQELFAEGIIKREDLFITTKFWPSYWANPEKSLDESLKDLQLDYVDLFLQHWPICLHGDENGLPKIPKDENGELIYDDDPTPNGTKYIDVYHKLEDILETTTKVRSIGVSNYSIPKLRQLLPKVKNLHHAARRSAAY

SEQ ID NO: 17120 - protein, 448 aa, Candida albicans
KVHHQILKMVENYTPDDFQNSITALTNKFDFSYLPGFKGIITKNNSTSFESLDDLDINGFSLIPGNVQFKFLNKGNKKGTPEQILEQNMKDYKELLGSKTIGQPKDAKLVPPPPPEELPNYKRANATILSLVRNGELGAIGISIKRLQKKFNSKYNYPYTFLNDEPFTDRFKQRILKYTGNAPVEFVQIKPEYWQKPSFIDTVKEAKEMEIMFKHDVAYAKKQSYHNMCRFYLSQFYKIPELQKYKYYWRVEPKVNFFTDINYDVFKYMEDTQKIYGFTINLYDNEETVKTLWPETIKYLNQGDNYKYINPKGSFQWLLEDLQNPKKTKFAGGYSTCHFWSNFEIGDFDFFRNEAYDNWVKYLDSTGKFYYERWGDAPVHSIGVSLFADKDKIHFFKDIGYDHDPYTNCPNTETTQMCEIGKFSRWEHLYDQNCLMNWLHHDQPKDVY

SEQ ID NO: 17121 - protein, 729 aa, Candida albicans
GDHEVLIQYHPIMFVFKYAGKEQLRINDKQFLNIEHRRTRDENDNNMLPQESDFNMFSDSFQDSKFDTLPLGPESIGLDFTLLGFSNLYGIPEHADSLLLRDTSSGEPYRLYNVDIFEYEPNSRLPMYGSIPLVVAAKPDVSIGIFWLNSADTYVDIHKSKSSTVHWMSENGILDFIVIIEKSPAMVNLQYGKVTGNTQLPPLFSLGYHQCRWNYNDEKDVLDVHAKFDEYEIPYDTIWLDIEYTDEKKYFTWHKENFATPEKMLRELDRTGRNLVAIIDPHIKTGYDVSDEIIKKGLTMKDSNNNTYYGHCWPGESVWIDTLNPNSQSFWDKKHKQFMTPAPNIHLWNDMNEPSVFNGPETSAPKDNLHFGQWEHRSIHNVFGLSYHETTFNSLLNRSPEKRPFILTRSYFAGSQRTAAMWTGDNMSKWEYLKISIPMVLTSNVVGMPFAGADVGGFFGNPSSELLTRWYQAGIWYPFFRAHAHIDSRRREPWLAGEPYTQYIRDAIRLRYALLPLFYTSFYEASKTGTPVIKPVFYENTHNADSYAIDDEFFIGNSGLLVKPVTDEGAKEIEFYLPDDKVYYDFTNGVLQGVYKGGKKPVQLSDIPMLLKGGSIIPMKTRYRRSSKLMKSDPYTLVIALDEEGSASGKLYVDDGETFAQGTEVAFTVDNNIINAKKIGPTASIPIEKIIIASKDQTTTLNNPKLDINLDWSLPFSFDSHRKIEHDEL

SEQ ID NO: 17122 - protein, 497 aa, Candida albicans
LSSMLARLLKLAIVVAAIAAITPNNPIRTLISFGCIGYVATLLVIPKVSPSFVKIGLKGKDLSKPPPVSEIPETMGLVASTTYMFLMFGLIPFIFFKYLVSFGSMSNDEVITKNYLSQYQSLADNRLFPHNKLAEYLSALLCLQSTTLLGLLDDLFDIRWRHKFFLPAVASLPLLIVYYVDFSVTSVVIPKFVTEFPGGYVLINTINFFIKYSNHLVTSITGLSFRTLQTDYVVPDSSPKLIDLGIFYYVYMSAISIFSPNSINILAGVNGLEVGQSLVLAAIFLINDFCYLFSPGISQAAHDSHMFSVVFIIPFVGVSLALLQYNWFPARVFVGDTYCYFSGMVFAIVGIIGHFSKTLLIFLLPQIINFVYSVPQLFHILPCPRHRLPRFSIEDGLMHPSFAELKKASRLNLAILETLSFFKLIKVERGSKLNQIVRFSNMTIINLTLVWVGPLREDQLCISILVVQFVIGVTMIVVRHTIGPWLFGYDNLSWGVK

SEQ ID NO: 17123 - protein, 203 aa, Candida albicans
LHYIILIISPNLLNLSIRFSLVVKQKKLTFLHTYHHGATALLCYTQLVGTTSISWVPISLNLAVHVLMYWYYFLAARGIRVWWKEWVTRFQIIQFIIDLVFVYFGTYQKVVITHFSKVLSYCGDCAGTMIAAYSGCAILSSYLVLFIAFYIDVYRRKDSTKSKIVKSVKGGVAAQVNEYVHASGVQIPSNTNSTAKTVRSRKA

SEQ ID NO: 17124 - protein, 127 aa, Candida albicans
IFFFFNYLKEEFLGLHIRLINYHIFYSGFTIIMSSLSSSFPIPTWDTPFGIQLWPIFDKVISQATNNKFIPSQFQFISGHLPLSTLPEALMAITIYYFVIFGGDYIFKKSNIKPFVLNGLFQIHNLF

SEQ ID NO: 17125 - protein, 295 aa, Candida albicans
PLNMSLPIPTWETPFGIQLWPIFDFVASKLSQGKFVPSEFLFINGITPLSTFPEAAVIIVIYYIVIFGGRFVISTLNLPVIKLNGLFQIHNLFLTSLSLTLLVLILEQIIPIFHSGGSYHSICSPNAYTSKLVVLYYLNYITKFIELIDTVFLVLRQKKLTFLHTYHHGATAWLCYTQLTGYTSVQWVPITLNLAVHVVMYWYYFLAARGIRVWWKEWVTRFQIIQFIIDLGVVYYSTFTHFVYKYSGKMRDCSGTETAAVVGCLILTSYLILFISFYITVYKKSGNASKKVKKA

SEQ ID NO: 17126 - protein, 142 aa, Candida albicans
PLNMSLPIPTWETPFGIQLWPIFDFVASKLSQGKFVPSEFLFINGVTPLSTFPEAAVIIVIYYIVIFGGRFVISTLNLPVIKLNGLFQIHNLFLTSLSLTLLVLILEQIIPIFHSGGSYHSICSPNAYTSQLIVLYYLNLHY

SEQ ID NO: 17127 - protein, 229 aa, Candida albicans
  UNSURE (5): Identity of amino acid sequences at the above locations are unknown.
PPICXYIDRVSSQLRSEHLRSHDKKYESIFPKTTGSITTTTTTTTTKEGEGGYLSFVILQNEYPDTVKSINWIKSNRPQLNIAYNPSPFKSELITKELLSKIDLLIVNEGEALDVANHLLKNSHQQDLIDKINQINKSNVTNSTGDNHTVLVEVFLKLAIELQKLINPDNIQIIVITMGSKGSIYIAKNSGGGSGGGGSQTTPQFIKSRKVEKVIDTIFTTGREGSAPP

SEQ ID NO: 17128 - protein, 103 aa, Candida albicans
  UNSURE (79): Identity of amino acid sequences at the above locations are unknown.
KIIVMSSSNPSITIIGSLNYDLVTYTNKVPQGGETYQANSFETHVGGKGLNESIAVAKLTPKNSVLLSSTTTTTTTSGXGDGAIRMVGKIGLHTRLEGTALAH

SEQ ID NO: 17129 - protein, 177 aa, Candida albicans
IHLAIPPPIHSFFISPTMTNPSLVLNKIDDISFEDYESPEITSPRDVIVEVKKTGICGSDIHYYAHGLIGPFVLRKPMVLGHESAGVVVAVGDDVTNLKVGDKVAIEPGVPSRYSDEYKSGNYHLVSTHGHLLLRHQSTPTNRTHQVLCANTTKLQLISCSNSQTTFLWSWALWSSH

SEQ ID NO: 17130 - protein, 271 aa, Candida albicans
TRCPVKIQRRVQVRKLPLGVHTWAFAATPPVNPDEPNPPGTLCKYYKAPADFLFKLPDHVSLELGAMVEPLTVGVHACKLANLKFGENVVVFGAGPVGLLTAAVAKTIGAKNIMVVDIFDNKLQMAKDMGAATHTFNSKTGDDLVKAFDGIEPSVVLECSGAKQCIYTGVKILKAGGRFVHVGNAGGDVNFPIADFSTRELTLYGSFRYGYGDYQTSIDILDKNYINGKENAPINFELLITHRFKFKDAIKAYDLVRGGNGAVKCLIDGPE

SEQ ID NO: 17131 - protein, 241 aa, Candida albicans
NETMMSFVNETSDGDKQNLETPTLFFKLGGPTLESTEEQANLVDEIAKKNNVMKLQRSTNDEENAELWAARRNGLWYTFQYGSKVLKDKDDVQVWTTDVAVPISKLSIVISEINDYLIEKGFKDRFSVMGHIGDGNCHFIILYNSPDYDKVHHVVDHMVERALSHDGTCTGEHGVGVGKRKYLPLELGVEAIDTMRQIKLALDPRRILNPDKIFKIDPEENLDEQLDQGSVKVKPNCMHNH

SEQ ID NO: 17132 - protein, 379 aa, Candida albicans
RIFSNPSTMWKRLLSSTSSRLVTGVVTVASTSFFAYRYGQAASNGQSLLPLGSTAKLSSLKPPQYCPELEIPNIMSKIQQLGISVVNSKPEIDHHTGNDFTTHKPLPNEVPQFIIYPDSTEQVSQALKILNEYKVPVVPFSGGTSLEGHFHSTRRGVVIDTSKLNKILAINDNDLDVVVQAGVNWQDLNQVLEPYGLMFGTDCGHNGLISGMIGTNASGINASRYGAMSANVISVTAVLPDGTIIKTRNRPRKSSAGYNLTNLFVGSEGTLGIVTEAVCKVYPIPKLETVVVVQFPLILDSTNAVAQVFRSGIQPTAIELLDKDMMHCLNYSGYTTRDWLECPTIFFKIGGINETVVKENVNILQQIMQANHADSSPRK

SEQ ID NO: 17133 - protein, 189 aa, Candida albicans
FHLFFCFKSKIWREKLNLQVMFSKLGKNGGRLSKRFVRYNSSINRNNSKNPLLAYTFAAIGFLGAGYFIGKALLKEPLPTSSDRSTSPLSTLLSPQYANEKDFEAGLSKIVEIVGHENASFDKDVLLAQNDSFYSTHHPPNPDVQKPSAVIYPTSTEQVSEIMKVAHQYRIPIVANSGLTSLEGQNIHT

SEQ ID NO: 17134 - protein, 143 aa, Candida albicans
  UNSURE (138): Identity of amino acid sequences at the above locations are unknown.
VQLQHTMFTKFQPPARQLSRIFRSYSVKSNVRLPSKTSRYLIIGIVFLGGGIAIGSHNSRGRNEDDLSTTPLSTLDSPIYATKYEFETGLAKIVDIVGADNISRDKKTLQSHNDSFFSTHHPPNPEVQVPGAIVFTHXGWKVP

SEQ ID NO: 17135 - protein, 363 aa, Candida albicans
ILSARIRLVPDVILGSSASGTNAFKYGTMKENVVNLTVVLADGTVIKTRQRPRKSSAGYDLTRLFIGSEGTLGLVTEATVKLHVRPKYELVSVACFSTIKEAAEMALDVIAQGVLPNAMEILDETMIEFVNESTSKKQLQTPTLFFKLGGSSKNSILEQSRLIQNIGSKHRMLDFKTSSSEEENDELWSARRNGFWSTFEYGKKILPDTNDVQGWGTDIAVPVSQLAKVISQTNDDLINSGFNKKFSIMGHIGDGNCHFLILYNSPDYHKVKVLVDRMVNRAIEASGTCSGEHGIGVGKRRYLATELGQATVDLERTIKLSLDPNRILNPDKIFMIDPKDDLDNQLDEGSLLNNTSSSCNHQH

SEQ ID NO: 17136 - protein, 133 aa, Candida albicans
EDVRIWVTDIAVPLSKLSKVLNEINSLIKASPFQSIILAHAGDGNFHADIFYKHEQRAEVEQLVNKMIELGLQNEGTCTGEHGVGNAKRNFLQLELGSDTIDLMRKIKLAVDPNRILNPDKIFKIDPTDPGEY

SEQ ID NO: 17137 - protein, 243 aa, Candida albicans
GVNRVGIADTVGCANPRQVYELVKTLKSVVSCDIECHFHNDTGCAIANAYTALEAGAKLIDVSVLGIGERNGITPLGALMARMITADRDYVLSKYKLHKLRDLENLVADAVQINIPFNNPITGFCAFTHKAGIHAKAILANPSTYEILNPNDFGLTRYIHFANRLTGWNAIKSRVDQLNLHLTDDQVKEVTNKIKKLGDVRQLNIDDVDSIIKDFHAEQSTTNTPLLKPVEDDEGPEIKKQKV

SEQ ID NO: 17138 - protein, 481 aa, Candida albicans
  UNSURE (435),(461),(468),(469),(474): Identity of amino acid sequences at the above locations are unknown.
FLIISILVKTMVDGYKEVSESFDRSKIQHNPYGPNPGDFLSNVGNFQLIESTLREGEQFANAFFSTETKIEIAKALDDFGVDYIELTSPVASEQSRKDCEAICKLGLKAKILTHIRCHMDDARVAVETGVDGVDVVIGTSQFLRQYSHGKDMNYIAQSAIEVIEFVKSKGIEIRFSSEDSFRSDLVDLLNIYRTVDKIGVNRVGIADTVGCANPRQVYELVRTLKSVVKCDIECHFHNDTGCAIANAYTALEGGARLIDVSVLGIGERNGITPLGGLMARMIAADREYVLSKYKVHKLRDIENLVAEAVQVNIPFNNPITGFCAFTHKAGIHAKAILANPSTYEILSPSDFGLTRYIHFANRLTGWNAIKSRVDQLNLHLTDEQCKEVTNKIKKLGDVRQLNIDDVDSIIKDFHADMSTPLFEIKWSGRKKQMFXNKKFKSQRVIVNTYTLQKDLYFENIXGLVWSFXXMFFNXNIYSKPR

SEQ ID NO: 17139 - protein, 173 aa, Candida albicans
IQRWIGISLPFFHLSLCYKKSLTMTSHTHPVKLSRTFKTKSGDELSIGTGTGTKWKKDSKLDEINQELVDQILLAIKLGYRHIDTAEVYNTQAEVGEAIKQSGIPREQLWITTKYNPGWNDIKASSASPQESIDKALKQLGTDYIDLYLIHQPFFTEENTHGYSLIDTWESIN

SEQ ID NO: 17140 - protein, 143 aa, Candida albicans
AIKHLEALKEVSEPEFYPVVNQIESHPFLQDQSKNITKYSQENNILVEAFSPLTPASRLDANPLTEYLEELLKKYNKSLGQLLLRYTLQRGILPITTSAKENRIKESLDVFDFELTKEEFDKITEIGNANPHRVFFHEAFKDL

SEQ ID NO: 17141 - protein, 295 aa, Candida albicans
RKDLLPKKKRLSKVYRVCSYKFLATTKKKVHTCYHTMTLTTVSGDPITIGIGTGTSIKDLKRGQPTAENKARIVDILRYALLIGYNHIDTAEVYTTQPEVGTAIAGFQREKLWITTKYSVTSSMIKKKSFTPTDFVEQALDEMNTNYIDLLLIHFPPKPNDPYTIQSLWQEFVSIKATGKVRYIGVSNFDIPQLNTLLEIGTPTINQIQYYLGSDNLEVVEFCKNHGILVEAYGPLTPLRNPNPKTDALIEKLQNANHLTKSQALFRYLLDNNILPITTSFKKERLKEALHSYTY

SEQ ID NO: 17142 - protein, 310 aa, Candida albicans
  UNSURE (301): Identity of amino acid sequences at the above locations are unknown.
VPSITLIGQVFVICHLSFVICSCGCVGTWLRSSSVKNWIFFRGRSKFFNPRQQQQPITTNYNHSPISLLSRLSYYTKLIVMTKELPSGYFQGPFRPYKTFQPSLTERPLSKFEQFAVFSILLISLIRLYKLYIPDRVVFDEIHLIKYIKNYYDGSIFVDIHPPLGKLIYFYITKLFLFDKDFQIDIIGDLYPEDFPYLWLRLFSGICGIGHVLLTFFTLRITCNLVISIVITILICLENSMVTVSRLILLEGPSLFVQSLVIYNYKAFTTRIPFTGCWYFNLFVTGNTLGLNISLKISRLXTFAWVGILT

SEQ ID NO: 17143 - protein, 277 aa, Candida albicans
LLLPVGQPFVQLSIFGTYVLVMFFRCILGTLLSTNTHVFNVNVQIFSYVLGWALHYLPFFIMGRQLFLHHYLPALYFGILALGHFFEIFTGYLTSRSKYFQQVAFVLVGLFSILSLVFYVNYSSLIYGTPWTKASCELTKPFSGWDYNCGTFFDTLGEYDIQEKSLASESEIPTETVVVEAKQTPKAEPKLAKQDDHIESPAAAEPVEEKEVKEEVEQLAPPLAVDFEEETPKVEDPQVADVDASSNDEKSVEEKQQQEQQQEQEQVEDESVHQVQQ

SEQ ID NO: 17144 - protein, 460 aa, Candida albicans
FQNIKYSIWKPFPKGGTLIEDFLTPHFRSTLDDYQQQPLQVLYGSTITIKHNALEKYLHSHDLTYPRGSNLQQVTLYDFPDVNNEWVIETKQKYNEEKLMTDQREVKDGDVVRLYHKATGHYLHVNDIRPPISEHEYSYEVNGNETRGLLGNEDYEFKIRMLVKKPHAENDLPLIKLRTTETIFQLIHQATRCNLMSHEQKLPDWGEYQNEVLCVKEPTIPNTLWYVELSSHPLLKDTKKLKTFPKFSFWSKLIETHKVMFNLNKGFTNPHPYASKPLDWPLLSRGIAFFSNYNLKSIDEESSLIYYLGNVAIYYLVFFVGLIAIFKCAIYSFIKLNPYASPPSSSKSSPYANFYNNSWPYLVGWFINYIPYCLMSRNLYLHHYLLALNFGILLLSQYLNYRVAKNKIIGGIITATIFVSAIYCFYEFIPITYGLPWTLYQCNSHKWFPNWDIDCMTYTG

SEQ ID NO: 17145 - protein, 591 aa, Candida albicans
NKFLYFYFYFYFYFSFPFNMAKKPVTPASKVAAKQAAVRSRHQEDVFTLDPLIDPIFQKGELRSYLVTEPSPSVLKKRLIHTKEYWMLSSLLLIAFYVRMYNLSNPNSVVFDEVHFGGFARKYILGTFFMDVHPPLAKMLFGAVGAIGGFKGDFEFKSIGDKFPDSTPYIFMRQFPALLGVGTVILCYLTLRQSGVRPIIAYITTFLLIIENSNVTISRYILLDSPLIFFIAAAIYAWKKFEIQIPFTFGWYRSLLATGIALGLALSSKWVGLFTVAWVGFLCIYQLWFLIGDLSVSTKKIWGHFFARGIILLGVPIALYLGFFAIHFQLLNKEGDGGAFMSSAFRAGLQGNKIPRDITEQVGLGSVVTIRHVDTQGGYLHSHEHFYQTGSKQQQITLYPHLDSNNKWLIEPYNGTIHNETFVPLINGMKIRLKHINTGRRLHSHDEKPPVSERDWQKECSCYGYDGFAGDANDDWVVEIVNYRSQKGEAQTFVKAINTIFRLRHAMTGHYLFSSEVKLPEWGFGQQEVTSASQGKRALTHWYIETNENSILPPSEAKIINYPKLSLWQKVVESHKRMWKINQGLTSHHHW

SEQ ID NO: 17146 - protein, 440 aa, Candida albicans
TFKEPNTMIRTTTTRAINRTAMLQNHIRGFSSTASILDKIKVKNPIVELDGDEMTRIIWQKIKDQLILPYLDVNLKYYDLGIESRDATNDQITIDAANAIKEHGVGVKCATITPDEARVKEFNLKKMWLSPNGTIRNILGGTVFRESIIIPCIPRLIPGWKEPIVIGRHAFGDQYKATDLVISEPGKLELRFTPENGGETQTHKVYDYTGPGVGLAMYNTDESISGFARASFNMALSKNLPLYMSTKNTILKKYDGRFKDIFQDIYENEYASEFEKKGLWYEHRLIDDMVAQMIKSKGGFVMALKNYDGDVQSDIVAQGFGSLGLMTSALMTPDGKAYEAEAAHGTVTRHYRQHQQGKETSTNSIASIFAWTRGLAQRGRLDETPEVVDFADKLEKATIDTVEVDRIMTKDLALAMGKTDRSAYVTTTEFLDAVADRLKK

SEQ ID NO: 17147 - protein, 72 aa, Candida albicans
FFSRVLFLVQHIICHTPKKKKEKNFQHIFLSSSHTSHIMKGLILVGGYGTRLRPLTLTLPKPLVEFGNRPMI

SEQ ID NO: 17148 - protein, 327 aa, Candida albicans
HQIETLAAAGVTDIVLAVNYRPEVMVSTLKKYEEEYGVSITFSVEEEPLGTAGPLKLAEEVLKKDDSPFFVLNSDVICDYPFKELADFHKAHGAAGTIVATKVDEPSKYGVIVHDRDTPNLIDRFVEKPVEFVGNRINAGLYILNPSVIDLIEMRPTSIEKETFPILVEQKQLYSFDLEGYWMDVGQPKDFLSGTCLYLTSLSKKHPEKLCKEKYVHGGNVLIDPTAKIHPSALIGPNVTIGPNVVVGEGARIQRSVLLANSQVKDHAWVKSTIVGWNSRIGKWARTEGVTVLGDDVEVKNEIYVNGAKVLPHKSISSNVEKESIIM

SEQ ID NO: 17149 - protein, 462 aa, Candida albicans
TILVMTLKVLILVGGETTGTRFRPLSMECPKLLFPLCGKPLVSHIIDNLTDQFPIDDLEILLMGFFKGQHKTMFQDYIQNVNKSNPDLRIKYLSEPFPLGTAGGLYHFKDEIFTDSNCKLLMIHGDVICNYPFKDMLEFFEQTKSNITLYGVDPVSLLKRSQAQILVVNGTENGDEAHDDDIVTKFGAIVAERKNSKVVHYVEKPSSSISEFRQDSTFEILLNGGIYIFDRSILDLLTLAEIKKKNSIQFDDGLDDNDSNDNDNSDNVLSLELDVFKTLPQLDNTNFNVFKSNGFWYQLKLPLSALLANNFFLAQSGGTKLSAGVELVQPVQILTESIAQAKSCKIGPNVSIGKNVTIGNGVRMVNCIVCDDVTIGDNTIIKNAIIANGTKIGKWCRIEGTITASILASNVISSSSAAYMKLLNDIVILCQNTVVHNQVFVYNSVVLPHKELKKDVKYEIIM

SEQ ID NO: 17150 - protein, 443 aa, Candida albicans
ARYRPPRGEHYHSCILFKQITSYHLLIKTNITITTTTSHTMYTTANNRLTQLTQILLPIVNDADSSFAQYLLQNPTFAPNPESSLNPEKPFKIAVVGSGNWGTTIAKIVAENALARPHLFSHYVNMWVFEEKINGENLTQIINQRHENIKYLPGVKLPNNLIAQPDIVTAVKGADLIIFNLPHQFLPKILKQLKGNVPKTTRAISCLKGLEVSKDGCKLLSTYITEELGIVCGALLGANLAPEIARGKWSETTVAYKLPNDYRGAGKDIDKLVLKACFHRPYFHVNVIEDVAGVSVAGALKNIVALAVGFVEGLGWGDNAKAAIMRVGLLETIKFSETFFPQSQADTFTAESAGVADLITTCAGGRNVKVGRYMAETGVSAEEAEKKLLNGQSSQGIVTAKEVHELLTYVNKLEEFPLFEATYQIAFGSESIENLPNLLNTTA

SEQ ID NO: 17151 - protein, 380 aa, Candida albicans
IQQIKNNFIMTTSPYPIETPFKVCIVGSGNWGTAVAKLVAENCAEKPNIFQRDVKMWVFEEEIEGRKLTEIINTEHENVKYLPEIKLPTNLVANPDIVDTVQDADLIVFNIPHQFLGRIVKQIEGKVKPTARAISCLKGLDVSPEGCKLLSTSITDTLKIYCGVLSGANIANEVAKGNWSETSIAYTVPEDFRGAGKDIDPFILKEAFHRPYFHVRVIEDVVGASIAGAIKNVIASSAGFVEGAGWGDNAKAAIMRIGIKETIRYASYWELFKIKALSPPNPKTFTEESAGVADLITTCSGGRNVKVARYMIKNNVDAFEAEKIVLKGQSSQGILTAKEVHELLTNFNLQDEFPLLEATYKVIYENGSVDDFPQLLERDQ

SEQ ID NO: 17152 - protein, 92 aa, Candida albicans
FMMTKSFVDYNGVIVEKYNVTKGAVPHRVDAEYGNQGLDFKGVATEGFGWVNASYVFGLTFLNLYAQRALGSLTPPEIFLRNMHPEQRKQYK

SEQ ID NO: 17153 - protein, 319 aa, Candida albicans
SIQTLVMAPQQVNAFSANGSIPSPKEFEGKGKLKLSGRILNVMTSLPLQIISDYDNKTGQYYWDVETVRGNSALYSSQHFLAENKEWETHLIAWTGELINKKKDTSSLTADTLQDDPLYLDEEDKLKIEKKLCDASGTPNIHPVWLLRRDQGRWRKYAENVLWPVFHYIQGQPSDGKAETDAWHDYVKFNEAYLNKIKSVYKPGDIIWIHDYYLLLLPQLLRMEFPNAYIGFFLHVPFPSSEYFRCLSKRSQLLDGMLGADKIGFQSDSFQRHFISCCARVLGCEVNRDSVSAYGTTISVETLPIGIDTEKIEHDAFSQ

SEQ ID NO: 17154 - protein, 90 aa, Candida albicans
VRGVIPKLEGFEIFLDMYPEWRETVVLIQVSSPRYSHSANVETRITEIISRINSQYGNLNHTSRFCFTRLRFAPQIIFNHGYRFTQLGFE

SEQ ID NO: 17155 - protein, 465 aa, Candida albicans
GKLAKDKFCKRWYGNNFFESLLIVQKYHKSPLIWWECTGTATVLKDAIMVNPWDSVGVAKTINDALMLSTKEKVSLESKLYEKVLSNTVQNWTSTFICDILSHSIVTHSNSYTPALNRPLLLNNYKESQRRLFLFDYDGTLTPIVQDPAAAIPSDKLNRILDVLSSDPKNQIWIISGRDQAFLEKWMGNKNVGLSAEHGCFMKDIGSKEWVNLAASFDMSWQEKVDDIFKYYTEKTPGSNIERKKVALTWHYRRADPDLGNFQAEKCMKELNDTVAKEYDVEVMAGKANIEVRPKFVNKGEIVKRLVLHPHGAKQEKHPTGHCTKDIPIEELPDFMLCLGDDLTDEDMFNSLNEINKKWKGDNRPTNKFGSYGVYPVAVGPASKKTVAIAHLNEPRQVLETLGLLAGLVSIFESAGTVDLDDRGHLANSVSSERSKHAVSKAVSLRKKASQEKEIVKEDPTNGAK

SEQ ID NO: 17156 - protein, 324 aa, Candida albicans
FITMLSRSIKSSLKRTTALARPTAAKSALKIANASSVRSLHIKNTSSYRPTPFLTFQRYASVSVKVPDMAESITEGTLAAFNKEVGDFVSQDETIATIETDKIDVEVNAPVSGTITEFLVDVDATVEVGQEIIKMEEGDAPAGGASASEAPAKKEEAPEKAKEESAPAAAPKKEETKKEEPKKESKPAPKKEESKKATQSTTSAPTFTNFSRNEERVKMNRMRLRIAERLKESQNTAASLTTFNEVDMSNLMDFRKKYKDEFIEKTGIKLGFMGAFSKASALALKEIPAVNAAIENNDTLFFKDYADISIAVAVFDHGGWKIRE

SEQ ID NO: 17157 - protein, 87 aa, Candida albicans
PWPSVAKGGVLGSVYGTPIINMPQTAVLGLHGVKERPVTVNGQIVSRPMMYLALTYDHRVVDGREAVIFLRTIKELIEDPRKMLLLE

SEQ ID NO: 17158 - protein, 199 aa, Candida albicans
TAELLGTSINVDLEKKKKILKKKFYNTQAPLRQYQMFKIKTFTPTSIPLAKPGLNSVRRLRLIPDWSKFKTIPQPPGYVVGTVNDAYKPPSPEHYEGSYHWTYERAISITMIPLVMTPFVAGVEFPMIDSIFSTLLLFHCHAGMKSCIIDYIPKRVYGFWYGAACKLLTLGTFVAMYGIYVLETTSNGLFNLVSSLWAA

SEQ ID NO: 17159 - protein, 144 aa, Candida albicans
PVVTDWPILLERIKTIPQPPGYIVGTVNDAYVPPPPHKLEGSLHWTSERIVAIGMLPLVLAPFITGGGASTLIDSTMSALLLFHCHTGFQSCIIDYIPKRVYGSYHNYAMYLLTFGTGIAGYGIYQIETKEGGVSNIISKLWKA

SEQ ID NO: 17160 - protein, 276 aa, Candida albicans
KNSLRDSHQKLEFFVEIPRSSLKKKQKTEKYKNQHFHPLLIRVKNRKVMSELPTDLEDTYTKTFKPNKKNAFEFSAVTDFITKYKKIVLFIVTFVCLSLFTNVPYIPHFRQAPPKVVIILAANEGGGVLKWKSPQEWSVERSSIANKKNYAKVHGYGLTIKDMTIKKRYSHEWRESWEKVDILKQTMRQFPDTEWFWWLDLHTYIMEPQISLEKHFLNNLYNATYRNLGHIQSIETYQQNLLTLDTTSLYKWLLIQIVGESIGVLFNSTSNGSRCS

SEQ ID NO: 17161 - protein, 119 aa, Candida albicans
RLIRRSEWSEMLLDIWWDPAMYEQMHMQWEHKEQDALETLYSTQAWIRERIAFLPLRQINAFPPGACSDQADDPQYFFQNHDFVVNMAGCEWGRDCWGEMEHYKALSKKLHKRWWKFWE

SEQ ID NO: 17162 - protein, 193 aa, Candida albicans
TTMTTTTTNTTVIVVGGPAGTGKTTQGELISKHFQCPFIEGDALHPQENVDKMSQGIPLTDEDRWGWLKQLSQVSSSKAHESENTTKIAVVSCSILKKKYRDFIKENSVDPLIKFRFVFLYTTFEELMSRVENRKGHYMKSDMVKSQYDIMEIPHNGELLQNGGDAITVDTSGKSPEEIFKEIIVTDNILSKN

SEQ ID NO: 17163 - protein, 234 aa, Candida albicans
  UNSURE (5),(12),(14),(48): Identity of amino acid sequences at the above locations are unknown.
GREHXPLTRPLXEXSKRVLGILDGKIKPNMSTIRIRCCNRCSRNMVLXKYASDYKNTIIGIEVLNEPLNPNMDKLKEFYIESYNDGREIQVINNTIFFQEAFQPIGYWDSFLEKGEIKVTETSNGTNHTTTKKADFKNIIIDHHHYEVFTESQVALNVSTHLENIKNYASAIGKEKAKAIVGEWSAALTDCAPWLNGIGLGSRYEGTAPYTNDRVRSCAEFNKSPDKWSKKLKK

SEQ ID NO: 17164 - protein, 112 aa, Candida albicans
  UNSURE (109): Identity of amino acid sequences at the above locations are unknown.
FSNENHFSYSLFIMCHKMMNKFQQRFLHTTSTPLFKTCVYFSNCSVYQKKHFPQDIPIEYYTHIFYAFILIDEQTGKLKFSDEWCDLQMPQPSPNQSITVNMCLTTPKXVHV

SEQ ID NO: 17165 - protein, 188 aa, Candida albicans
TSIFSLSFYACSLVFQFTYLLLLLTTFIMTPIQQTPSVHNTIDDSSNGFPNQISLGEYLFYRISQANPKLKSIFGIPGDFNLNLLEHVYSPIIAEREIKFINTCNELNCAYAADGYSTVIGGMSAMITTFGVGELSAINGIAGAFAEQCPVLHNPGENFHEKIHCVLPHEMNYIPPFGYQTHDSFKPP

SEQ ID NO: 17166 - protein, 516 aa, Candida albicans
ASQMRMAQARGEDVGTTSMKDRLRAPNEMINIHHLVPNHDPLKPPNHDVYKSMVENISVVQESLDYDTKKNLINIDNVLKKIIQEARPGYLCIPCDVPDLPVPSKMLFLDPFTAATRYTNLILSKQVLNDVTNAILEKMYDAKNPSIFSDCLTTRFGFQNDLNRFIDQIPETVKLFTANLARNLDESRNNFVGVYNGNGSSDDKTKQEFESSDFILTLGFFPNEMNTGGHTSNFSMIKDVVIVHADYIKVNHQIYHIKQNDGERLFTLGEFLCTLTEKFDPSKLSVAAAEPKKIYQYQPSQQYSPSNLDYIPQGKLIDHFNSTLKPNDLFILETLSFVFGLPDMKFPTNVQLLTSPYYGSIGYAVPATFGATLAVNDLKSDRRIIVVQGDGSAQMTVQELSSFVRYKEILPNMPHIYLINNDGYTIERKIKGPNRSYNDINGKWKWRNLLNVFGGVEGEMYDSCVLKNSSELDQFFNGDKTKPILSHKLQFYEIIAGKFDVPQRVDNMMCISKNKN

SEQ ID NO: 17167 - protein, 480 aa, Candida albicans
QLLHITCLVTMRFWFAFRDSDRYVYYIIIDKLILFFFFRPLCFFLLLLIVCLLLLYVSFLTSNRLHSLWTITIPPRSPTMTSYSIAFISGVILSIYYYFVLNYFSELKFSEPPYQRYNPLAKDQPKLASNQYLDKIYPPENRKQIGKENATMVMLVRNIELEGALESMRSLEDRFNRDYKYPWVFLNDEPFTEEFMEKTTLMASGETFYELIPVEDWQPPIFINETKLQENLDNSKTNVIYGGVRSYRNMCHFNSGFFYKQKKLLNYDWYFRVEPNVEYMCDFQYDPFEFLRINNKIYGFIIAITEYENTIPNLWPTVESFMKKHPELLHPNNAIEFLTSKEISLNHYMDLIPSATDYNLCHFWSNFEIANLNFWRGEAYRKYFDYLDQTGGFFYERWGDAPIHSIAAALFLPKDKIHYFDDVGYKHSVYTQCPLNPQFRYEHKCHCNPDNDFTFRGYSCGKKYFEKMGLQKPKEWEKYQ

SEQ ID NO: 17168 - protein, 99 aa, Candida albicans
KHCPKLSTSDWDNEYTDLPNKLVKVIVPDRSIFKTTNAERTLVEPKGMQDEIDKLVAQYPNGRSFVRASGTEDAVRVYAEADTQNNVEELSKAVSELVK

SEQ ID NO: 17169 - protein, 334 aa, Candida albicans
TMSIEQTLSQYLPSHPKPQGVTFTYGTAGFRMKADKLDYVTFTVGIIASLRSKYLQGKTVGVMITASHNPPEDNGVKVVDPLGSMLESSWEKYATDLANASPSPSNDSEGEKNLLVEVIKNLVSDLKIDLSIPANVVIARDSRESSPALSMATIDGFQSVPNTKYQDFGLFTTPELHYVTRTLNDPDFGKPTEDGYYSKLAKSFQEIYTICESNNEKIDITIDAANGVGAPKIQELLEKYLHKEISFTVVNGDYKQPNLLNFDCGADYVKTNQKLPKNVKPVNNKLYASFDGDADRLICYYQNNDNKFKLLDGDKLSTLFALFLQQLFKPIEPH

SEQ ID NO: 17170 - protein, 212 aa, Candida albicans
KRLAHKTLAFWLMDKEMYTNMSVLSPLTPIIDRGIALHKLIRLVTFALGGDGYLNFEGNEFGHPEWLDFPRQGNGESYHYARRQFNLINDDLLRYKYLYQFDKKMLQLEITNTGEYVSLKHECDKVLVFEKGKSVYIFNFNPTQSFVDYRIGVELPGTYKLVLDSDSEDLGGHGRLDHNTKYFTFNEPWNNRSNSLLVYIPTRTAIVLEKVE

SEQ ID NO: 17171 - protein, 175 aa, Candida albicans
LIDTAHGMGIQVLLDVVHSHSSKNVDDGLNMFNGTDHYLFHGGSRGNHDLWDSRLFNYTNYETLRFLLSNLKYYIDVFQFDGFRFDGVTSMLYKHHGLSVGFSGGYHEYFGDGVDNEAIVYLMLAHQLMNEISTTQNFNLTSIAEDVSGMPTLCRPISDGGIGFNYRLSMAIPDM

SEQ ID NO: 17172 - protein, 260 aa, Candida albicans
SIELLSQIIMLKQLYFFLVCLLWTTVNASRFDVEHALVLYDPELLRSNDTSSLTPKVAQFIEYLSDKFDMKISDYNSEDMNLFFDDYPRYEHLVLFPSSKKTITSTEALSLHSLLRFINENSNIFVVGGSQNVLPDGLKGFLDDLGVFPSPKNYKYIDHFNSKNGVVQLNRDNVVDGNRLVQELSVTKYDGNAALISNNELIFPIVRSSPPGYTNKVGEPIDAEQAWNFGEQSYLAVGFQPLINATLIGVGSNSLLGDPP

SEQ ID NO: 17173 - protein, 243 aa, Candida albicans
VKRIIQEQQKLVTKVNSAANGQLKLELKLKLKLKLTENEKMVLELVEDYVTLGKRVYPWISQRFPFYERWNGDSYYYPPNYEEIFKDKNEPLKSERSTVRDLTSSPLIFLNQFKDASNGKGIVLSITEKHIDDTINLIRLLRALNNKLPIQIIYFNDISQSSKTKIIKAAREEINNFPKSYEKVYHGKQPSVPPSPPPPQEVWFVNIYESINPQHRNLFAKFDFKLLASLFNSFVPQRRRRSM

SEQ ID NO: 17174 - protein, 492 aa, Candida albicans
IYPWLSFEYPVYERWTGKVQYQPPKMANYVKDGNQKTTKKTKYNNDKYLSSFLLNRLKQKCNGRGLVLSISDLHVDVTVRLIHLLRALNNRYPIQIVYYDNLSKETKEKIVTAAREVMSHVPKSFERVAKYFPDDYLDNDQGGLPKQEIWFINTYNVIHADYKLQFRGFANKFLATLFNSFDEFILLDADTVLTQSPSYFFNLPQYLETGTFFYKDRTTYETRPKSDSIFFEKLGPSVIDSVMFNIPIMTSYTLNRSFFKGLFHYMESGLVVLNRDMHYSSFLTMVQMNFFEPVNSRIHGDKEIFWLAMAINGKQNYYFDENYAAPVGVMTPDIERTKPDKTLHESKELCSPHPGHISHDDNSLVWLNSGFFYCGQNDKVKFVEEFKHKSRLKHLNTLEAFKTFYYSPLRIENAIIPPMDLDIWAANNEDEPAKGWFGDPRYCSGYMWCAYDKIGGKTKSGKNTRLEGKIINFDEQAQDLFNYYGDVWVGME

SEQ ID NO: 17175 - protein, 354 aa, Candida albicans
MPIIPFIKIIVGNFPDSVINYWLFCSILLLSLCWIDVDTVLMRPPEYFFQLKNYQTTGTYFFKDRSVLQRRTVEDGKFFERMGPSTVDQMMFDIPIMTNYTTTRELFRGLQHYMESGLVMINKDKHLNSILMITQINLIGPITGKVWGDKELFWLGFAINGDEEYYFDDNFAAAIGELTPPQDRARKDGTWHHSKEICSPHPGHVSGDDNHSLLWINSGFRFCHQADEVNFEKEAKKKTRLKHLHTADQFRTFYYNPLRITHAVVPPLDQDLQDRKNAMDEPTSGWLWESGYCKRYMWCAYSSVGGPQKRPDEKDDTVDNNETKDNTLDGILVEYNQDEIALFNYLGDIWVGTE

SEQ ID NO: 17176 - protein, 217 aa, Candida albicans
KQTLYNFTFVMSSEKLFRIQCGYQNYDWGKIGSSSAVAQFVHNSDPSITIDETKPYAELWMGTHPSVPSKAIDLNNQTLRDLVTAKPQEYLGESIITKFGSSKELPFLFKVLSIEKVLSIQAHPDKKLGAQLHAADPKNYPDDNHKPEMAIVVTDFEGFCGFKTLEQLAKILATVPELNEIIGQELVDEFISGIKLPAEVGSQDDVNNQKIVAKSVW

SEQ ID NO: 17177 - protein, 210 aa, Candida albicans
LTNLSVVLNYQQKLEVKMMLTIRKLLQKVFGKLMNTDDDVIKQQTAKLLERTDREPQVFKDIDSRLPELIQRLNKQFPNDIGLFCGCLLLNHVGLNKGEAMFLQAKDPHAYISGDIIECMAASDNVVRAGFTPKFKDVKNLVEMLTYSYESVEKQKMPLQEFPRSKGDAVKSVLYDPPIAEFSVLQTIFDKSKGGKRHFHHVVTNPPLRY

SEQ ID NO: 17178 - protein, 603 aa, Candida albicans
RIKQFTQIMTLAKHWKYGKDEDIVVTQLRGLVASNPYVNLIPSEKVVFNPHSDTSKKITIISGGGAGHEPMHGGFVGENLLDAAVSGSVFASPSTKQIMAAIKTKSNKEKGTIIVIKNYTGDILHFGLVAERAKSEGYKVELVIVSDDVAVGREQNKMVGRRGLAGTAFIHKILGSASATSPDVDLKSLSDLGHAINKNLVTLGASLDRTSVPGKLEEEIEFTGNDEMELGLGIHNEPGTKIKPIPNIDELIQKMYHQLLSPEDKDRHYVDFDFENDEYVLLINNIGGTSSFELYAIAEHALANLPLKRKPKRVYVSDFVTSFNSPGFSITLLNLSNLKKEDISFTSEDVLKFLDTPTNAPGWKPKIYNSEIWNLQNKEIESPMKNETLTSSDLKIDGQKFESQLVNALKVLLDEEPKITRYDTVVGDGDCGQTLADGANSILKALKEDDDFKSNLNDPVYTLGKITEYVEDSMGGTSGGLYSIFLTALVKQLKQTKEISVQSVGDALYHALYDGLFKYTRARVGGRTLIDTLQPFVDALHKTGDLTKAVEAANKGCEETKNLHASFGRASYVNEEEFKAEGGIPDPGAVGVLALIKGFTEKL

SEQ ID NO: 17179 - protein, 122 aa, Candida albicans
  UNSURE (13): Identity of amino acid sequences at the above locations are unknown.
LMFHQLVEMLLLXERNDYEKFDKQHHIRETMVEALKKEFPDFGLTYSIGGQISFDVFPTGWDKTYCLQHVEDEHFENIHFFGDKSYKGGNDYEIYNDPRTIGHAVNSPDDTIRILNETFKLQ

SEQ ID NO: 17180 - protein, 149 aa, Candida albicans
TMSFANKQDPKTLVLFDVDGTLTPARLTISEEMKKTLEKLREKVVIGFVGGSDLSKQVEQLGPNVLNDFDYCFSENGLTAYKLGKELASQSFINWIGNEKYNKLVKFILRYLSDIDLPIRRGTFIEFRNGMINVSPIVFTTGLDGPALE

SEQ ID NO: 17181 - protein, 181 aa, Candida albicans
INCPAVDSVYLRGMATFAPLSKNNINRVNFSSRGKFFESCFFSTNTINPIENCKMSDAGRKNISTKINEAITPESEKSTLEKGKEQVTSTLDKAVGSNVPDNQKSFTQTVADNVQQGSDNAKADLKKQSEQAEGEAKTLAETAQEYVEVAKTEIGKAAEYVSGVVTGATEGAKTGADSTKK

SEQ ID NO: 17182 - protein, 665 aa, Candida albicans
FRRTMARDIDNHLLFEVATEVAHKVGGIYSVLKSKAPVTVAEYRERYTLLGPLHYDSAQIEVEELPVTDPHIKQTLDSMSSKGIRWLYGRWLIEGAPRVLLFDIWSAGHYLNEWKADLWNVAGIPTPDHDLETNDAILLGYLVAWFLGELVYNDRDRAVICQCHEWLAGIALPLCRKRRIDVTTIFTTHATLLGRYLCAGSTDFYNNLDKFDVDAEAGKRGIYHRYCIERSATHSADVFTTVSDITAYEAEHLLKRKPDGVLPNGLNVVKFQAVHEFQNLHAIKKAKINEFVKGHFYGNYDFDLDNTLYFFIAGRYEFRNKGCDFFIESLARLNHKLKEAGSKTTVVAFIIMPGKTQSYTVETLKGQAVVKQLESTIGEVQKKVGERLFEYCARYPNTDHHGNDEVPTIDELIKPADRVLLKRRIFALKRDGLPPIVTHNMVDDSTDPVLNHIRRVQLFNKPEDRVKIIFHPEFLNANNPILSLDYDEFVRGCHLGVFPSYYEPWGYTPAECTVMGIPSITTNLSGFGCYMNDLVENPTDYGIYIVDRRMKSVDESINQLTDYMFDFCAKSRRQRINQRNRTERLSVLLDWRSVHSEYSKARLLALKRAYPDYVGEKVVESKMKITRPMSVPGSPRSLLLTPGDLGSLQDANQDISYFELGEEET

SEQ ID NO: 17183 - protein, 255 aa, Candida albicans
NNEFMWIDADTILMKSPEFFFNHQSYQQTGAFFFKDRSPLLKRPITDGEFLIKMGPSSIDSIMFDIPMMTQYTTHRELFKGLRLYMESGLVMIDKQRRRHFNSILMMNQLKFIHPISNSMWGDKELFWLGFAINGDENYKFNNHFAAAIGQLTSNQYNKDRITPLKSKEICSSHPGHISDEDDRSLLWFNSGFRFCHEANNIDYQEETKNNVILKFLNGRHPLEFKKYYSDPLRITHAIVPPLNKNFQKMYNYDE

SEQ ID NO: 17184 - protein, 77 aa, Candida albicans
SLLHKKEFRSLTHSFEKVAHLFGDKYINSQCKGMQPQKIWFVNAYNSIHKNYRGKFSRFGNKLLAILFNSFIESMLD

SEQ ID NO: 17185 - protein, 206 aa, Candida albicans
ETIISLAGVNKYSSISSDDSDNNFIKFSSTVNWHETYKFLKVQFPTTITTALQANYETQFGITNRSTHWNTTWDIAKFEVAHHKFMDLSEFNYGVSILNNSKYGGAIHGNLIRLSLLRSAKAPDNKADMGIHKFEYAIYPHKGPLGINTVKAGYNFNYKLIQNPYSKQTVASSYLSSAIKLKNENHKDGSLILSHIKRGENDMSSP

SEQ ID NO: 17186 - protein, 568 aa, Candida albicans
LASTISIMGYDNINLQPNFKPIDHLYDDRLRQFTDTGGQFHNLNLPKFYDIHRQEIHDLKSWKVPDDSNGKTQRPLFKDINFDEITWDNIGLGYNFGPSWKTFWVKFTLKIPEEWLKYEALEIDWDLNSEALIYNDKGLPLQAFTGGGQRNLFRIPKEYLTSDEQLFYIEVACNGMFGNGADGEPDPNRYFRLSRAHLVVPNLEARRLFWDFWILGDATREFPGGYWQKYQAADICTQIMNTFNPNDVESIGKCRKLAEQLLGDKINSDEVFHEYPNERNKRIDVYGIGNCHIDTAWEWPFAETKRKIVRSWTTQLKLADEYPEYVFVASQMQQFKWLKQYHPEILSKIHEKFATNQFIPLGGTWVENDTNLPNGESLLRQFVLGQRFLLDEFGFQSDIFWLPDTFGYSSQIPQICQLAGIYRFLTQKLSWNNINTFPLSTFNWKGIDGSQLLVHMPPANTYTAAANFGDVVRSLRQHKNLRDVPAGMLLYGHGDGGGGPTEEMIEKLRRCRGLDNNSGLIPSVQLGVTVDDLYEHLLEKSDQGRKLPTWSGEIYLAYHRCTYTTQAN

SEQ ID NO: 17187 - protein, 238 aa, Candida albicans
  UNSURE (183): Identity of amino acid sequences at the above locations are unknown.
RLPGAEIQSLWEDLCLCQFHDVLPGSCIGMVYYDEAYPMLRKLLKQADKLILEALKVDVNSNTTSGGGVVNTLPWNRYNEIVEVSRKQSPELFEQLIKDKVGIRTPKSSQYKHDDDDDDETVKVSVDSVDGVCKINKKVDYPASVSKIRGSNGNDDDDNDGGFILTNKLLTAKISSNGVITSXFDEVNQREIIDTTATNQTSNGKNSTNVGGNQFNLFDDETLNFPAWDTELYSLQKF

SEQ ID NO: 17188 - protein, 445 aa, Candida albicans
DQEYSVHPIPPQSVLPEMSKRQENKKIAFIHPDLGIGGAERLVVDAAVGLQDFGHDIIIYTSHCDLTHCFEEVSSGQLKVSVHGDSLPTNLFGKLHIFFAILRQFYLVCWLIFTGTIKNYDYFIVDQLSFCIPLLKMFCNSNCQVLFYCHFPDQLLVRRTSFLKKLYRVPFDAIEEYTTGSSDQIVVNSNFTKQIFHDTFKKLNHIDPQVVYPCVDTETIVDTNASSNSEVSKFFKDSPFFLSINRFERSKNIELAIKSFARMNKLMVTNKKPRLVIAGGYDSRVAENVEYLAELSTLCDELNLINFTIRGKLIMMPPSVDVLFLPSISTQLKNSLIQQTELLLYTPPREHFGIVPLEAMLAKTPVLAINFGGPLETVVNYNGNNLDEATGYTETGDFTKWSKIIMKHYNLDESTKIKLGENGRNRVINKFSRKKLAQSLDNILN

SEQ ID NO: 17189 - protein, 88 aa, Candida albicans
QCNLLIEQLYSQVPDVVKAYRIMPKSILKADLFRFLILFARGGVYTDVDTVGLKPVDEWMSNSEMILEKTNRSGLVFGIDADPDRPDW

SEQ ID NO: 17190 - protein, 164 aa, Candida albicans
YFCFHFLFQLLGINISKSNFRNPMLQLREPQMVHKHLKLAVLGIVVIFTTYFIISSLSSPTSTHKTEYNSPKLQLAKELELNSNWKELGLNFQPNKKYSLPDESTLRQQLSYQFPYDESKPFPKNIWQTWKVGIDEKSFPKRYLKYQQTWEDKNPDYKHYVVPD

SEQ ID NO: 17191 - protein, 664 aa, Candida albicans
  UNSURE (31),(36): Identity of amino acid sequences at the above locations are unknown.
LESEQKVIEENGDETTSRTGFLKLENPKNVXGYEGXVKFAGVSEELGAFELEINDGPKTNVHPAGRTDVDPELDPRKAHHYSLTVPDDNVWRARDIFMTMLQESIQKLVEKFGGVEAIPPENLFILRDLQDFEGNLHFVQKVYQGSCEFDVVYNNALTPITERITFDNLKFRIQNSLKAFDEKFNNHFELAPPFNSKKYKKFGKEVLSGLLGGLSYFYGDQLVDRETVFDEDSFESYKLEGTFEGPYELFTLVPSRPFFPRGFLWDEGFHLLPLLNYDSDLVLEITKSWFNLIDEDGWIAREQILGKELRSRVPAEFVVQSPQIVNPPTLTLVLTYLLDSVVGNYDTINEPKNVDESLSRENLGGFVLKNPEVLTNYTKQVYPKLKSHLDMFRRTQKGYVEEFDRGTNPEAYRWRGRTLTHCLASGLDDYPRALPADVAELNVDLISWIGIMTRSIRLMAEILNIDEDVETYKNLENDIIDNIEKLHWSPEDKTYCDVSVNDDDENIFVCFKGYISLFPFLTKLIPEANTDKLEHIINLISNPEELWTPYGIRSLSKADEFYKTGEDYWRSPIWIPINYLILDSIQDYYIGSKHHMSTDLQEKFAKTYHDLRINIVKNVFDQADKTGFVWEQYNDETGEAQRAKNFLGWSSLVLIMMTMPEHLQ

SEQ ID NO: 17192 - protein, 288 aa, Candida albicans
  UNSURE (9): Identity of amino acid sequences at the above locations are unknown.
LHDRARRGXKRYLSRVLVLLTFTFYLFYFVLHCTWVTSNAYSSPSVVLASRNPDGSQHIIDDYREAYYWLRMNTPEDAKVMAWWDYGYQIGGMADRTTLVDNNTWNNTHIATVGKAMSSPEDVSYEILRQHDVDYVLVIFGGLLGYSGDDINKFLWMVRIAEGIWPDEIKERDYFTDRGEYKVDKDASLAMKNSLMYKLSYHRFTELFGGRDGVDRVRNQQIPANEVPKLNVVEEAFTSENWIVRIYKVKDLDNVGRDLHQATAFEESSSGTSKRNRSIKRPKLEVRE

SEQ ID NO: 17193 - protein, 198 aa, Candida albicans
QEQYSAMASTISSKPQLKVLGIDVELIRVLLKVIIFISIAGAAISSRLFSVIRFESIIHEFDPWFNFRATKYLVTHSFYEFLNWFDDRTWYPLGRVTGGTLYPGLMVTSGAIWHILRDWFALPVDIINICVLLAPVFSGLTAICTYFLTKEMNDSSARLLAAIFMGIAPGYISRSVAGSYDNEAIAITLLMATFYFWI

SEQ ID NO: 17194 - protein, 411 aa, Candida albicans
  UNSURE (364): Identity of amino acid sequences at the above locations are unknown.
KGSQSTVLDYMGTQFSGDGKSDNQNHSLIFSRGEYIQLVDANLDNYLEECLKIRSILAEFEEATFPLDPYWTDLEGTELVYPVAIIGTREYIFSENIGILGDVVAGKEQTFGTLYARTLAHIGGKLHYGHPDFLNGIFMTTRGGVSKAQKGLHLNEDIYAGMNVVLRGGRIKHCEYMQCGKGRDLGFGSILNFTTKIGAGMGEQMLSREYFYMGTQLPLDRFLSFYYAHSGFHLNNLFIMLSIHLFLLVGANLAALTSESTICEYDRFRPITDPKRPHGCYNLIPVVHWLQRCIFSIFIVFVISFVPLAVQELTERGFYKAITRLGKQFASFSPLFEVFVCKIYAHSLSSDISIGGARYLATGXGFATIKVSFATLYSKFAVESLYYGSICGLLISYCSLSMWKSQLLYFW

SEQ ID NO: 17195 - protein, 268 aa, Candida albicans
GERSPSSRVVNTMLGLCCKKTGAVIAGVAHGVAVIVHIIFFIVMWVTEGFNFARLMLGIATMIYVQRLLFKFLTLCFLTREFKNDKANTAFWTGKWYNTGMGWMAFTQPSREFVAKIIEMSEFAGDFVLAHIILFCQLPFLFIPLVDRWHSMMLFWLKPSRLIRPPIYSLKQARLRKRMVRKYCVLYFAVWILFIVIIVAPAVASGQIPVDQFANIGGSGSIADGLFQPRNVSNNDTGNHRTKTYTWSYLSTRFTGTTTPYSTNPFRV

SEQ ID NO: 17196 - protein, 808 aa, Candida albicans
YAIAGPSSPVVKTKLLDSRTSRLGPTHALISIHADYIGGMNSNFRKWYFAAQLDIDDFVGFDNLAKNGKIKGSNDPVPTLEQAELQWSTNMLALSPTDSVIQLAIYLLIWGEANNIRFMPECICFIFKCCNDFYFSIDPDTPVTTVTPSFLDHIITPLYNFYRDQSYILVDGKYRRRDKDHESVIGYDDMNQLFWYSKGLERLVLADKKSRLMSLPPGERYEELNQVLWNRVFYKTFKENRGWSHVLVNFHRVWIIHSAVFWYYTAFNSPTLYTKNYQPALDNQPTTQARLSVLAFGGVVAIVIDIISLLFELRFIPRKWTGAQPVSKRLALLILALILNVGPSVYLFMFIPLNVQNTVGLVISAFQFSFSVIMVLYLSTVPLGRLFSKKPKANDRRFLPQRLFVTNFYSLAEGDRVASYGLWFAIFVSKFIESYFFLTLSLRDPVRELSIMKMSRCAGEVWLGNWFCTRQPTIVLGLIYLTDLVLFILDTYLWYIVWNTVFSVCRSFYIGVSIWTPWRNIFSRLPKRIFSKIISVSGDKNIKSKLLVSQVWNSIIISMYREHLISLEHVQKLIYKQIDNPGVEGDSVLKEPIFFVSQEDQTIKSSLFQDQAEAQRRITFFAQSLSTPMPEVGPVHLMPSFTVLIPHYSEKITLSLREIIREEEQYSHVTMLEYLKLLHPLEWSCFVKDTKLLAEEFETDSSSAEIKREKLDDLPYYSVGFKVATPEYILRTRIWASLRSQTLYRTISGFMNYSRAIKLLFDVENPDLTKFGTENDKLEQEAIMAYRKVSLITSCFSPRRGRSRNCVT

SEQ ID NO: 17197 - protein, 226 aa, Candida albicans
PARSNMIYQRGADENTIRPPLFFVYEDDNKFYDFIKIEKEWERRITFFAQSLSSPLPEPFPVVSTPTFTVLIPHYSEKILLSLQDLIKEQSFSKLTLLDYLKQLHSKEWDSFVQDSKMIQTIKEMDEDKFVRENMDDLPYYCIGFKDSSPENVLRTRIWAALRCQTLYRTVSGFMNYVTALKLLYRTEVIGFEQNEFPEEELEEFVSRKFNLPNCYAEFPEILPQT

SEQ ID NO: 17198 - protein, 155 aa, Candida albicans
RLKEGSWKAFQRFVRHFISMSPFFEVFVAQIYSSSVFTDLTVGGATYISTGTGFATSTIPFSILYSRIADSSIYMGARLMLILLFGTVSHWQAPLLWFWASLSALMFSPFIFNPHQFAWEDFFLDYRDFIRWLSRGNTKWHRNSWIGYVRLSRSR

SEQ ID NO: 17199 - protein, 352 aa, Candida albicans
  UNSURE (45),(46): Identity of amino acid sequences at the above locations are unknown.
FFKLPNQSSGPPPIDRSIYKSHHVIVIPISPHPNINILIRIPFSXXKRSFISTMQFKFLTTLATVLTSVAAMGDLAFNLGVKNDDGTCKDVSTFEGDLDFLKSHSKIIKTYAVSDCNTLQNLGPAAEAEGFQIQLGIWPNDDAHFEAEKEALQNYLPKISVSTIKIFLVGSEALYREDLTASELASKINEIKDLVKGIKDKNGKSYSSVPVGTVDSWNVLVDGASKPAIDAADVVYSNSFSYWQKNSQANASYSLFDDVMQALQTLQTAKGSTDIEFWVGETGWPTDGSSYGDSVPSVENAADQWQKCFCALRAWGINVAVYEAFHEAWNPDTSGTSSVEKPWGCLGLPTKT

SEQ ID NO: 17200 - protein, 317 aa, Candida albicans
PLEHIHKPNSIEGLSEELRQDSEVVSLMSIVTNALFFGVAYSPSNALEPQCGFTRRDAMLDLDRLYTITTKIRNYGMHCDQSEFILDAIEYMNLNMTLAMGVWIGSNDTVNEEQMNTMKRIVAKYPNPLELINSIHIGNEVLFREDKTRDELIEYIQDAKTFLQSKGIDDIPVGTSEIGSLVDLPLLQVCDIVGANIHPFFAGVPVEFATIWSLEFLNFQVQPYNEYNTKIVLSEIGWPSGGGTFGSSVASLSNLEYFANDFLCTFRDLPIEYYYFEAFDEPWKEIFWEGNRRWETQWGVFQDDRLPKFALQNIGCV

SEQ ID NO: 17201 - protein, 342 aa, Candida albicans
VTSTSFLYPLLPILIFNIFIRFPFSFLKRSSISTMQIKFLTTLATVLTSVAAMGDLAFNLGVKNDDGTCKDVSTFEGDLDFLKSHSKIIKTYAVSDCNTLQNLGPAAEAEGFQIQLGIWPNDDAHFEAEKEALQNYLPKISVSTIKIFLVGSEALYREDLTASELASKINDIKDLVKGIKDKNGKSYSSVPVGTVDSWNVLVDGASKPAIDAADVVYSNSFSYWQKNSQANASYSLFDDVMQALQTLQTAKGSTDIEFWVGETGWPTDGTSYGDSVPSVENAADQWQKGICALKAWGINVAVYEAFDEAWKPDTSGTSSVEKHWGVWQSDKTLKYSIDCKFN

SEQ ID NO: 17202 - protein, 510 aa, Candida albicans
QALISTRGEDMQNLIDGCHERRMKIICDLVVNHTSSEHEWFKQSRSLKSNPKRDWYIWKPPRIDAKTGEKLPPNNWGSFFSGSAWEYDELTDEYYLRLFAKGQPDLNWENEECRQAIYNSAMKSWFDKGVDGFRIDVAGLYSKDQSFKDAPIVFPDQIYQPSGELISNGPRIHEFHQEMYRQVTSKYDVMTVGEIGHCDRNEALKYVSAQRKELNMMFLFDLVEVGSNNQDRFRYNGWNLIDFKKAIQNQSDFIKGTDAWSTVFIENHDQPRCISRFGNTKSLDLINKTGKLLAMLQASLTGTLFIYQGQEIGMTNLPRSWSIDEYKDINTINYYKDFKEKYGNEPDFKQREEKLLDVINLVARDHARSPVQWNDDDTESYGGFSTHKPWTRINDNYKQINVANELKDPNSILKFYQLVLKLRKEYKDLFIYGSFDILDFNNEKLFTYVKSHKEGNELPKAYVTLNFSDELIPFKPLIEGEFKLMTTNVPQSDYDESVLSPYEGRIYIVD

SEQ ID NO: 17203 - protein, 427 aa, Candida albicans
  UNSURE (339): Identity of amino acid sequences at the above locations are unknown.
PLYTYLSAAKLRWLLDNDDVIREEYEKGDGNLMFGTVDTWLIYHLTKEKAFVSDITNASRTYFMDLETLDYDDDLLDFWGIDPTKIRMPKIVSSSEFYGEFAAPKLDNLGFHNKITKEAYDILKTITGVPICGCLGDQSASLVGQLAFSAGSAKCTYGTGAFLLYNTGPHKLISKRGALTTFGFWFPTLKGTDGKPHYAMEGSIAVAGSIIQWLRDNLKMIDNAKDIGPLASQVENSGGVVFIPAFSGLYAPYWDGGSRGTIFGMTQYTSAAHIAHAALEGVCYQVRAILKAMASDAGAVDDFLEDALSCQNTDKLLSTLATDGGMSKADEVLQIQADXLGPCVTVKRAQTAECTALGAAIAAGLSFKNEEDRIWKDLDDVVAKISGSSEDVAANSFTAKLSDENRRKAWKRWEKAVDRAKGWLEDE

SEQ ID NO: 17204 - protein, 77 aa, Candida albicans
SSRPLLLPNMRETTIVWSRKNGKLLSGGITGTDSRISEIIQHLEKMIDEDRKAEFKEKNGLTLIYLFICCQIKMVVG

SEQ ID NO: 17205 - protein, 259 aa, Candida albicans
RAFSVKDRASTSSSINKYQMTEIVTINTSVLLFDLDGTLVDSTAAVEKTWENQVNQHNQEFPDKFIDLPTLLNVSHGSRTVETFAAYFPELKTDRDSVYAWEMGIVQNYGHLGKAINGSVQTLITLNEKNIPWAIVTSANPKLTGFWLDKLFHGVKKPDVFITASDVSKGKPDPEGYCTAFERLKKVYNLNGSAKGVVFEDAPAGIKAGVNGGFTVVGIASTFPKEVLLQAGATYVVEDFTKVKIEQSGEAVKLVLEIL

SEQ ID NO: 17206 - protein, 258 aa, Candida albicans
DKMRLFVLLVYIIPFILCQLTPVLVASHKLVRGLKEEINPSNTLPHNVTSVTNMLKKLITECSSDAYLLINQPGLTYADLTTEKKDNWPFLRNYLYMSSTIVGLPRVENPIDLDFLEQYIISNCDAETINVWHDSEDEVVDYYDIRKRVIRIDLSPLSISNHDDRVKEIFEHDQLIRKILRKLPSPHYTIILTSLEPGIVHPVPRFLMEETPASFEIFDDIINDPFHNREIEKNDRFHKVEPNWNPIRDSNDRYYRNW

SEQ ID NO: 17207 - protein, 410 aa, Candida albicans
FFFNTSLPPPTNFFLVDFAQFSFSPSHHPSPSLSLHTFIMLIKSNYNCINIKRFLLNQTRVSVTASNSFSFYFYFKPYKFNCYKSYSTMSTTTPTIKLNSGYEMPIVGFGCWKVTNATAADQIYNAIKTGYRLFDGAEDYGNEKEVGEGINRAIKDGLVKREELSIVSKLWNNYHSPENVEKALNKTLTDLNLDYLDLFLIHFPIAFKFVPLEEKYPPGFYCGDGDKFHYENVPLLDTWKALEKLVNLGKIKSIGISNFNGGLIYDLIRGATIKPAVLQIEHHPYLQQPRLIEFVQNQGIAITAYSSFGPQSFLELQSKRALDTPTLFEHETIKSIADKHGKSPAQVLLRWATQRNIAVIPKSNNPDRLAQNLAVVDFDLTEKNLQAISKLDIGLRFNDPWDWDKIPIFV

SEQ ID NO: 17208 - protein, 150 aa, Candida albicans
KLNEAAKDYGWKLNNAGIALMWRGGCIIRSVFLAEITAAYRKKPYLENLLLYPFFNDAITKAQSGWRASVGKAIQYGIPTLAFSTALAFYDGLRSERLPTNLLQAPRDYFGAHTFKVLPGQENELLKKDEWIHINWTGTRGDVSSTTYDA

SEQ ID NO: 17209 - protein, 258 aa, Candida albicans
  UNSURE (92),(151),(256): Identity of amino acid sequences at the above locations are unknown.
SIKETQEEFCFLSKLLLQLMNSLNQLLPYLEEGDIIIDGGNSHFPDSNRRYEELAKKGILFVGSGVSGGEEGARTGPSLMPGGNEKAWPHIXDIFQDVAAKSDGEPCCDWVGDAGAGHYVKMVHNGIEYGDMQLICEAYDLMKRVDKKEDXEIGDVFATWNKGVLDSFLIEITRDILYYNDPTDGKPLVEKILDTAGQKGTGKWTAVNALDLGIPVTLIGEAVFSRCLSAMKAERVEAWQALKGPQVTGESTITVXIQ

SEQ ID NO: 17210 - protein, 843 aa, Candida albicans
SMFLGLFHNYIFLVILSLKIIPINAYSPYNSSFTSEHIRYLQNETQALFDHSWKSYMKYGFPFDEITPISCEPLGPDFDDYENTVRNDARGNISLMVLDNIDTLIIFERWDELEYILKYLLDNKQDFFNQDTVVQVFETCIRHLGGLLSAHLLLTDITNKPITLSTKYQPLREISNKYNGFLLDMAHDLGLRLIPSYQTSTTNIPLPRINLAYGLKKVPPKLQRDACTSGVMTPVLEFTLLSRLTGDRQFEYYSQLSFWKLWSLKLALNLLPMTIDPIANQWKDSITGIGASIDSFYEYAAKLAILFNDDYMWTVFKTSYRALLSHLAQGGKGTMIFPNVGIYDGVVFSPWIDLLGAFWSGLQVLTGQLQDAIKTHVVYLKIWDFFDLIPERWIYNHQHHHQGNKKVKRNKKKFKAEDSIDLEWYPLRPEFIESTYYLYRATKDPMYLQIGERVLNLLGDRYKAPCGLSGLQDVRTAERQDRMESFVVGETLKYLYLLFDTKDEIFLHNSTIMQNKNWIFSTEAHPLWLNKKIDLIGDSLTQSSNEISSVIMGEKPYHKNSLKPNKDLLKIPNSAFIRNITLPQPELVDIEGITEDVSHIAKKLPFAGRFDTCQLNPWNKSVDSFLESSYYKWPYLFNADYAFENSFRKPRYLSQTNLDGSYIELTKEFYNKFTMFNGANLICPRTSTTAVYEVFWGDIKQCEYIEVSEIYHTKFSNESLMAPGDIWIPSLNGLRVVLEELVPGKVDTFNNVVTEEQLLALQDSNNNEDYNNNNDDYRIRLVNSGLRIKRVNGVVIGEGVTLWTLPFEPLEQSNEEDGMIGITEDARVVIQGKVVENLFVWYG

SEQ ID NO: 17211 - protein, 207 aa, Candida albicans
RRIQDILNEMQKYLVFPIDRNDVLSAWSGIRPLVRDPSTIPKGQEASGKTEGLVRSHLLVQSPTGLVTISGGKWTTYREMAQETIDYVVKHFDFGDKKILPCQTNKLILVGGTDYSKNYSARLIHEYHIPLKLAKHLSHNYGSRAPLILDLYAESDYNKLPVTLAATEEFEPSEKKANEDNQLSYQRFVLHPREMDGSALDSIAPPA

SEQ ID NO: 17212 - protein, 100 aa, Candida albicans
HFSTMSTASIPSNPILIVGGGLAGLSAAHQAYLRGANVVLLDKESFLSGNSGKATSGINGALTRTQVNLKIPDSVEQIYQDTLASAKKSAHPKINQSFNL

SEQ ID NO: 17213 - protein, 129 aa, Candida albicans
FQFTTGGKSLISLLVVKCMIGLLVNKICVPPLFSSTEQAAAIAPMMDTSNLKATCVYHDGSFNDTRYNVTLALTAIENGATVLNYFEVEQLLKDTNGKLYGVHANYCEPMNSSKLKLKVLLMPLGPLAE

SEQ ID NO: 17214 - protein, 198 aa, Candida albicans
NYTMSRFLRSTLAKSVLAASAAVGGTVVYLDFIRPKNEPHLATSYKPFNKDIPPPPSRESLIGNLKKVPQFDVLVIGGGAVGTGTAVDAATRGLNVCLLEKTDFGAGTSSKSTKMAHGGVRYLEKAIFQLSRAQLDLVIEALNERGNMLRTAPHLCTVLPIMIPVYNWWQVPYFFAGCKMYDWFAGKQNLRSSTIFLH

SEQ ID NO: 17215 - protein, 770 aa, Candida albicans
KMLRAFRSAVPRTQLLKSRLTIPKTSVIGRRYLATDSFLQGSNSNYVDEMYEAWRQDPSSVHASWNAYFKNIENDNIPPSKAFQAPPTIVPTVSGGAAGFYPGQSPISEDVVTHLKVQLLVRAYQVRGHQKAKIDPLGISFGDNTTVPKELTLDYYGFTEQDLAKEITLGPGILPRFAQGGKKSMTLKEIINFCEKTYCSSYGVEYVHIPSKEQCDWLRDRIEVPQPFKYSPDQKRQILDRLIWATSFESFLSSKFPNDKRFGLEGAEAVVPGMKALIDTSVEYGVEDVVIGMPHRGRLNMLFNVVRKPNGSIFSEFTGSKEFDEGSGDVKYHLGMNYARPTTSGTHVNLSIVANPSHLEAEDGVVLGKTRAIQQYKQDIGSFKKAMAVLKHGDAAFAGQGVVYETMGFANLPAYSTGGTIHVIVNNQIGFTTDPRFARSTLYPSDIAKAIDAPIFHVNADDVEACTFVFNLAAEWRATYHTDCIIDVVGYRKHGHNETDQPSFTQPLMYQEIAKKNSVIDIYEKQLIDEGTFTAEDIKEHKQWVWNILEDNFKKAKEYKPTSREWLTTPWEDFKSPKELATEVLPHLPTAVDEATLKKIGNAISETPEGFEVHRNLKRILNARKKSVETGEGIDYATGEALAYGSLALEGYHVRVSGQDVERGTFSQRHAVLHDQNSESVWTPLSNLSEDQGAFNISNSSLSEYGVLGFEYGYSLTSPDALVEWEAQFGDFANTAQVVIDQFVAGAESKWKQRSGVVLSLPHGYDGQGP

SEQ ID NO: 17216 - protein, 226 aa, Candida albicans
HSSSRLERYLQLCNEDQRFFPSPEKLERQHQDCNMQVAYPTTPANVFHLLRRQMHRQFRKPLILVFSKSLLRHPLARSNLSEFTGDSHFQWIIEDVLGDKSEVKRVVLLTGQVYAALHKKRASLDDKSTAFIKIEQLHPFPYAQLRDALNEYPNLEDLVWTQEEPLNMGAYNFAAPRVEAVLGETQKYKDLKLRYAGRDPSASVAAGSKAMHVAEEEEFLEETFRQ

SEQ ID NO: 17217 - protein, 309 aa, Candida albicans
PNSTQFNSIQFLMSPKYALFTGASSGIGYNLAIELSKKGYKVIGCSPQLVLFGQKPLEQEYGVISLPLDVTDIDNIKTVLKKVEEITGGRLDVLYNNAGISISGPAIEIDETQLNKVFQVNVIGQINMTKYFAPLIINAKGTILFTSSVAARVPLSWVSAYNATKAAIDAYALTLHGEMAPFGVRVHSVITGGVDTAICDGNIKTSLGDSFYDVDGVYESIRSSAMMSRDLNISPEQYAKEVVRDIVSWRDPGFNLYHGARSYFLHWVSRFLPLWLVEFGVQIHFKQRRVLQTIAKLIKVKKSQEKKYV

SEQ ID NO: 17218 - protein, 325 aa, Candida albicans
SYKPLIIEKHIFFSSVSSSNNNNNIFATMSQQKYALITGASSGIGYALAKEFSLRGYKVIGCSPKLVLHLQKPLEDEYGLISIACDITNLEDIKRVKELVVKETGGYLDVLYNNAGIAIGQPAIEIPEDKLNWIFQVNVIGHINMTKHFAPLVIKSKGSIIFTSSVAARVPLSWISAYSATKAAIDAYAKTLHGEMEPFGVKVHSVITGGVQTQIGAEDNNIEEMKNQFADSPYNVDGIVESGIASQKMAADLGIPPQKYAKNMVGQITKKSSKFNLYGGSNSYLLHILGLFYPFWLVEYIMQFTFKQLKPFALIRKKYAGKKNR

SEQ ID NO: 17219 - protein, 303 aa, Candida albicans
LYQFREYILSMSERQKVALVTGASSGIGYATAIEFAKRGYKVFAGARRLEPMQKLKDDYGVIIFKLDVSDLESVKNAKKFIESETGADYLDFLYNNAGQSCTFPATDVTDAQMKQCFEVNVFGAIRTVRELVPLIINAQGVIGFTGSVSGIIPFPFSCIYSASKAAIHQYAATLRLEMKPFGVKVINIVTGGVKTDIEDKRDLPESSIYNVPGIQEAFNERRQMAARNKPMPAEVYAKKVVTDFESANLGGALNIYRGTMSTFLSFVLTFVPRFIVEAAVFSKFSSNSVSYSSCRGTKILAWD

SEQ ID NO: 17220 - protein, 125 aa, Candida albicans
NIYISPSSFFYYFSSLTKFNSTQFNSIQFLMSPKYALVTGASSGIGYNLAIELSKKGYKVIGCSPQLVLFGQKPLEQEYGVISLPLDVTDIDNIKTVLKKVEEITGGRLDVLYNNAGISIYRSSN

SEQ ID NO: 17221 - protein, 204 aa, Candida albicans
  UNSURE (19): Identity of amino acid sequences at the above locations are unknown.
DRDLAPWGRFGNLKDLIYXEDIKGIHFFTSLVQLKSLTMGLKFAQFYNDSFEFRLDIMNLIELLTKYIELESGFINNEDSDGDEDYEQQLLSKSYIISSPKLFYTKSRSGLDIASILAVLYTHNNNNANDDDDNDFPFDVDNGLVLTTLRYLIQDMTLRYPINFQDNFQGVALGRYPEDIYDGYGISERNPWFISTATASELIY

SEQ ID NO: 17222 - protein, 280 aa, Candida albicans
KNCNQIHFIRFQLINILIHTLITTTTMTKTQQPAVFYVHAALFDCDGTLVNSTGAISEFWRDFGKTRPHVDPEEIIRTSHGCRTFDVIAKWSPEDAIEEQVTAWEGAIPDTFGHHAKPIPGSVELVKSFDKLSKEATENGKQRWAVVTSGTLPLATKWLKLLSIERPDCFITAEKVTKGKPHPQGYQAARDTLGYHDAHYKVVVFEDAPAGITAGKGAGAMVVGICSTYDPEKVRKSGANIVVKDLSSFRIDSYNKETDEFKVVVDDYFYADEQFLQESA

SEQ ID NO: 17223 - protein, 227 aa, Candida albicans
RGFRQPPWLKTAFVDLSPTTTNQVKGSISDSSIITLSSIFTSFEEFIILNQHIIPLIELTKFFNNERYKLHGTYFFKSPSKLKYRTTKFNIGFHEIASFIKNQLIPNKFDKHYFNLYQKGSENGDEVTIDRFFNYQFNNLIDSSLIIFNKSKTLSGLLISGNFEFLYHDDLFNIRINNTPTKTKMDYLWLGQYISGINEQIIFNFNYAIMPGILTPSQNLPKDLIEC

SEQ ID NO: 17224 - protein, 134 aa, Candida albicans
SDEGYHTLLWFNSGFQFCNQLEKVNYEDEFSHKERYSQFDTIDKFKTFWQSSLVIESAIIPPENTNSNGGDGYEPSVSWKHMEPYCAGYTWCAYSSIGNGDQANDRGLVINYSPEEIEHFKKLGEIWMRGYNYL

SEQ ID NO: 17225 - protein, 389 aa, Candida albicans
SWQLPCEDNKVLAMLYSSFEEIILFDADVVPTVNPQEFFDSKYYKSSGTYFFQDRSLRDFNDFIETNFFSTLFPSNEKSIETIFDIPRVGEKTFNNKYMTGWRHYQEAGVVAYNKMQHFLGILMMFPLALWSEPVQSSIWGDKEMYWLGLSMAGDENYEFNKYAAASVGEKTTEQKYKYYPNSDSNEVCSTHPGHIDDNGRLLWINSGFSYCKKNGYFRDKGKFPFSTFELNDLVELYNSPIKIRAGLVPPDLPNQREPGSPPDTKPEMEFRKSWKSRKKDTDEINEKLPEGQEPYDFISEWGPQKGWVKNGICSGYYYCAYDKITSYSSEKEFDTGTLFEFDTKSCELYDYLSKIWHTGGSKMKPKVKLETEKLGTGSDKEQQKMQQQ

SEQ ID NO: 17226 - protein, 191 aa, Candida albicans
IWSSKFNELLNVKFKKAVAKAMSAMLPTIAPHFTVSSPSSVASANGTTNETVVILRPDLTDNTVTSAPSTVALSTSHLATNIMSQPQSSTFTLSDAPASKLVTIRKRLQDLDQKLAPKSVKLTDIARIHKHLAVIHDPNSKIKQLYGKYYDLLWSISASERSKEEKNALKQFEIGSLPSYRTIDSRISFRM

SEQ ID NO: 17227 - protein, 461 aa, Candida albicans
RISYTSSVKVSISSTMSSENGMSATHTFGISTNTIPSSTETSIKSATVTTPVSESTNTGMSIFMSTTTESKTTDITTETSVSGEVNLGSATVKVSSSEFISKGTVTRIMPTELTNSESTFTASPSFVLTSTESSVIETPATIEMSSRSSSYSVPLSKLRSEGETTRVIPTSSTATGSTVIGSPSSVSTSNESIITGSSSFVSTTAESIATKTIVSETPVTKVLSSKSLAANASPSEPTSKKETAETISTRSIVTESIVAGSPSLVLTTTVLDTTETTITETSIVGELSSRSLTFKASSLSKGEITGTVTPEMSVSTSKATTGTTSEVSIKESLTTKVPTFTSTTIKPETSETQHSESRTTQIPDSETKGSQLSTANSQVSQTGSSKSLIFESAISKDESSFVSPTVKSITTPAVAQYQTSLPNPASFSFLKHQARYWSSLDNPTGKFRNSTLLFTLKLLKH

SEQ ID NO: 17228 - protein, 554 aa, Candida albicans
HSLIRRLSDSCTEDPPILTSIQSSQTKDFRSSPNPKPNQTFISTNNQTSISKPTYTSTEQITDVIVIESDEEETSIVQKISGTSKIVASTRLPSSPVSIANQEPEKTMNDSIVDSSFSFMMDNLVTTIRNGGPKLSSSKPVSQPVSAGSGLSSGPNPVSSSFKMPPFVKWLSSDDDDDDEKEEDPIVPTSQPVPHETNFDAQPAKRSRTVQEPPQLAPKPVKRSKTVDQVIDLPRIDNFQYTSKDLKEANRATRKKEELLAEMELHMAESVYSRLEDLVKDFQLRVIKASYTLPVIFWKRNINAAYDKERDIFIPCHPRRVLEKTFVLYYHASVFFEKLRNHTLKVDVSAAKQQALAITPNEYNVILVVEGYDILLNKIKAYEQRLFKNQVLQGLNVEEQRRRRKDDTEMSKYPSSSEIEHLVNKAQIDLKANIFMVRAKQESIMWLNSFTHMIGQSLYDKFERNQGLANLGNVKSGADTKSTFLQSMKQFNLMTQAKADILYVLHQSLHLMYTKLRSHGTLGKDNLKRNIVPPSVDSSMKKFFTADDPDMVIN

SEQ ID NO: 17229 - protein, 322 aa, Candida albicans
  UNSURE (319): Identity of amino acid sequences at the above locations are unknown.
FFTNIDNSIFLSLLQKPLMSFWDNNKDSFKSAGKSTFKGITSGTKAVGQAGYRTYKKNEAKRKGVEYHDPIKNESKSGETNVPYNPSPLPSKDKLSSYQPPPKRNVGTFGVPQRGEASHYSAPAPTSGQSTYPANQQQYQHPNEIQTSSGYQEPPPEYLVDSNSDMQGFSAGSEYQRTAHPAPASTTFTPANQTSFIALPQPTSIATDNAIQNIQQQYNSVLKQPSPAPGLPPLQHQPGNLVNPPLPPQVPQKSNVPPSLPSRTSVASVASSTSQQSVGQGSFVNAQEQPKPKPALPDPGSFAPPPRRRDQHIPHEGRXSAC

SEQ ID NO: 17230 - protein, 599 aa, Candida albicans
SKVGNPPRDLDSFDFGMYGENNDGSDNETKGGTFDSPKSGTGITNDIIADLESDIDNFLKASSESGKEMPVVTRTNSSKHSSPFPSSSSDVADNSYINDLSISRSKPVMGLADIVNDQDQQNEDFIEPSLSTPYPLDSPLITPIISPVESPQIIQNEFMPISSNDSPNLKHEFSTSGQTSPPNPFSSPVASGTPSITSPRKLRNLDLSTTPASPVASLISSTEGNGGEISQFPVSSTSRNTSQNYTTSRTPSAASRMHSARLPGNPQPLTQTPLSRTLTENSSAPIALSKSYTQKTYASNRSNPSQHRMSSSVGSIYSSNSYRNVNLAALKKTLNLKPGEGERSNYVLAIRKAAGTSYNELTRMKWKLPVGILPVDKSATKENSNGKYMKLAGNLLAASRKKTSGVELKHGHLKPRLLAAEIDEGDDSTAISLAKTPLTQSSVNLKVTETNSNKTVSSENSLMRTTTDVSVVTGDTNSIVTTTTDTNASGRGESSGNGLKRNESIASSNSSGSLSDKNFTNFGYYQHRSYKDDDEDIFADGVNRQASNDGDVTDEESNQINGYPKVSYMDANSIEQEEEDNDRPRLVLANPDYDSDDSS

SEQ ID NO: 17231 - protein, 820 aa, Candida albicans
TADLPAAWARSIQIKQIPKPMNTSSITNESKPISAPATKESVSAKPTPTPTAPTTGVAPKSSPLITPLTASQSNLTKTTSISPQLSKAKSNQPSQPPCKQIKTNPKLLSNPQPNKAKSLTRPSVQPIATKYHKIQPAIAPKPMPASMSQTSKFNPIPTGKLSLLMNQLSFARPNDSSSLNTSRRWVLPPRPRPGRKPTHDSHGNITIDDKKISKNGIATNNNTTTPITTTANSNATVGNGNHNTPINASTSNGITKKKTKCKKDSTLEAKIALNSNTDLLNQIKSSENTTVISPEDINLKSSKPTPLKSLTPNNNKTSSPIVPISSSQQQPPQQQQEKQPIACTKSKAKAKSTTTTARKSKTASAKGTPLAEVPIPIPPIEVDPEKHLSNMQMSYLSKLKEQEVIRNYIEVLTNQIKELSLVQNGVITFDALKSNVKYNNKKILTSTTTSTGPGTTGAGGIPTSSTSSSTSSSKSMYDQLEAINNLNDLNKFLNYLTKSSNIIQSVKKNPGISSETLNKQVDHYVEVRKKFKAIKRNEQSGKTLNNLGLQPPPPSQYSLSIPSMTTGATITTTTAGSTTTPIPQAMKNHAMFNNDKLSGILSGSTFQDMDIDPNNNNSTNSCGGGRDSGGGGVVGDTLNESGMGQFVPDLLKPIKPVNLFSEFQDLQLQTETIEESSSQISQLSGIGESGEEYDIGTTVSNGNGSGTGSSSNTNSSGSNFAVPNNLDGGDLELFMDEHDFLNRLVLDDRQKLMNDEEEVFGKVQIHGNDMSGSSNVNNDTHSITNNDNNDENKNMNRVNNDLLLKKKCLHHAVEDPHLRY

SEQ ID NO: 17232 - protein, 148 aa, Candida albicans
  UNSURE (6),(9),(11),(12),(20),(136): Identity of amino acid sequences at the above locations are unknown.
NPNTPXNQXQXXGGRGRGEXLANNIYTPPLPQPSNFPLPLGIFFFEIQISFKTNLNLLIMTIEYTWWKDATIYQIWPASYKDSNGDGIGDIPGIISTLDYLKNLGIDIIWLSPMYKSPMEDMGYDISDYESSSPTXTSQEPGIVSPPF

SEQ ID NO: 17233 - protein, 314 aa, Candida albicans
NGFPSNHKFLKTPSQCLKGFKEHEDAEDTVALINSNVNPNEIPKHIEPLVISDSVDASDSTFVRINGSDQNIVINHVTSHLQSKIIYFALNLNKRKRAIWLSRHGESEFNLSGQIGGDANLSERGWAYARKLPLLVEKSCNGANLTVWTSTLRRTQQTASFLPFQKKLQWKALDELDAGECDGMTYEEIEQKFPDDFKARDDNKYEYRYRGGESYRDIVIRLEPIIMELERQENILIITHQAVLRCLYAYFMNVPQEESPWMSIPLHTLIKLEPGAFETIVTRIKADIPAVSTYKEKGILNWVNQPPTPRKVEI

SEQ ID NO: 17234 - protein, 525 aa, Candida albicans
LFYFTMSTPIEFKSSNSVTKDDHLYTKFTYENSVVEKDANGKFIVTPTASDYEFKVDLKVPKVGLLLVGIGGNNGTTLLGATLADKHNISFENKEGVVKPNYYGSVTQASTVKIGVDKETGEDVYVPFNSIVPMVNPNDLVVDGWDISGLPLDQAMKRAKVLDVTLQKQLYPYLENKKPLESIYYPDFIALNQSERANNVFNQVNGEVKTDNKWADVEKIRKDIRDFKAKNELDKVIILWTANTERYADVLPNVNDTADNLIKSIKESHEEIAPSTVFAVASILEKVPYINGSPQNTFVPGVIELAEKYDSFIGGDDFKSGQTKIKSVLAQFLVDAGIKPLSIASYNHLGNNDGYNLSSPKQFRSKEISKQSVVDDIIESNELLYNKESGDKVDHCIVIKYLPAVGDSKVAMDEYYSELMLGGHNKISIHNVCEDSLLATPLIIDLVVATEFATRVQVKGPGKSDYDELYPVASLLSYWLKAPLARPGFKPINGLNKQRQQLVNLLSVLVGLPIDNELRFERILK

SEQ ID NO: 17235 - protein, 389 aa, Candida albicans
RFLTQINKSIQQLHLHYFFFYLYIHYNQMSFAYATLLIGESYLPGVLTLGNRLKQLGTKHKLLILLDVSSISLQSKQLIESIYDELIPIDNQLILSPLQKLSEQLQRQELSISYSKILLWNQLDYDSIVYLDADVLPLQNLDRLFIDYDVDDNQIGAASDSGWPDIFNSGVFKLKPNKQTFEQLLEFSVDPNNTFDGGDQGLFNEYFKLENWIRLPYLYNVTPNYRQDYQYLPAFNRFFKDIKVLHFIGQVKPWHYENVLASDLANFHQYWWDEFNKLIGDDVALKYTLLNLPRGEATKLKFGKTVNAWDKKDIEQDTELVEEEEEEEEVVSHSPIFPWEHRQEKRQPTRVFQNIPTTSTVGNVSGKSGTKEEQELDRSTETLKRTHIS

SEQ ID NO: 17236 - protein, 210 aa, Candida albicans
EKLTYDLKRPELNKTFTKVELWSLIQYEKILYLDSDTLPIIPDAANGGTVLDLLALDFPKFKILAAPDSGFPDIFNSGVFALRPNLDDYTNLAALVQESVINPNVSFDGADQGLLNQYFNAQPDWVQALLTKHDATVDLETVSYTQDSNWIKIPFLYNVTPSAEYQYLPALKHFQNPPGQPLLLENPQAEAELVDQGAEQVFTTALEGSA

SEQ ID NO: 17237 - protein, 264 aa, Candida albicans
NLSRHLLSNHTAHQTAKKKKLVAVFPFFLFSNINMVKPIIVPSILAADFANLGCNCKRVVDTGDVEWLHLDVMDGHFVPNISLGPPIISSLRKQFPREGDKPIVFDCHMMVSEPDEWIEEIAKAGGDSYTFHFEATKDPARVIKKIKEHGLKAAMAIKPKTPVEEVFPYAEDLDMVLVMTVEPGFGGQKFMPDMMPKVETLREKYPNLDVQVDGGLGKDTIQPAADAGANVIVAGTSVFKPEDPKPVVQYLKQTVADAIQARNK

SEQ ID NO: 17238 - protein, 216 aa, Candida albicans
QVRFFHAWARSNPKNTNGELIASIRKMWNDSFLFNPLSRHPIVGQHFSQSPLVNSSAIEIASVDTILVKTCAPNSTKNAFASQSAGSSASSILNFTRKSTWGRTYDLLSFMVALVGWEHVISIKERLFKLNVETTTTENNNYIVNHGAKEKLVTCEAWLEQLFITIYEDLRTLMITIANNSNQERSALEWEMIRLLRWLVKHNLRDSISLLVTSIM

SEQ ID NO: 17239 - protein, 275 aa, Candida albicans
RIYFISPLGCPKGQEMQLHIDVNATEGTPDLKPRVDNQTLKYGPIAEDIQALTLLPMGLLYDHNRPVTKPVNLNRSIWLPASDVNKVSIEEYYELTHVGAALDSGFFRIDWMKGRYEGTRNHWALSHLELPLLDRDLDGYYYTDKVGVVSSHKVVKNHLLLLPRYPLFGGWNYNFTFGWSEDLSRFLHKLHDTSDEYIIKFPILNSLRDVTYGDVYLEFYLPENAEFQNVSSPIPFESITIDNESSYLDVSKGHTKVTVHYNNLFDDLHKLDVFV

SEQ ID NO: 17240 - protein, 243 aa, Candida albicans
GFDEKYREGERQWAYKNPGFVHELFNDDTAHTMIKYLYRQIPEVINAFEALPEVILRMDFFRYLILFAKGGVYADIDTFPIQPIPNWIPENVSPLDIGLIVGVESDSNSPNWRSESVRRLQLGQFVMQSKPGHPILREIIAQIVLYTKKLEVPELNGNPNAKAIAIMKWTGSGRFTDVVFQYLNDYILSSIYESINWQHLHNLEVPKLLGDVLVLPRVSFSADDEKNPLSFVKHYGDKIYKQV

SEQ ID NO: 17241 - protein, 258 aa, Candida albicans
PTMSNLTSSIQLTRQSTYKLNNGSHIPVIGFGTYLLDASQAADLTYQALKDGYRHIDTALAYHNEKEVSQGIKRFLKDHPEVQRSDIWFTTKIDTQSLGYEETKKAVERIKNDVKDNIEYVDLILIHSPLASKARRLSTYQYLQELVLNPNDAPLIVKSIGVSNYGVDHLEELFNWEGYLIKPVLNQLELHPWLPRLELREYLYKHEILAEAYSPLTQGYKLDDPELLAISKESGLTPAEILLKCHPSSSPRGGDPTC

SEQ ID NO: 17242 - protein, 157 aa, Candida albicans
KGWKVLQDAVEKGWIKNIGVSNYGKHHIEELLTNATIPPAVNQIEISPWCMRQDLATWCLSKGINVEAYAPLTHGNKLQVNNTEFQEIMQKYNKSAAQILIKWSLQKGYIPLPKTKTPSRLKENLSVDDFELTNEEIKAIDQPDAYEPTDWECTDAP

SEQ ID NO: 17243 - protein, 262 aa, Candida albicans
DTGIGGKLSTNMDHLVCFYGGLLALGATGGLTLNEAQSLKSWNEQREADFKLGEELIYTCYNMCHDVSPTGLSPEIVVFNEDTSKSKDFIIKPLDRHNLQRPETVESLFYLYRLTGDVKYREMGYEIFQNFIKYTKVVNSEGEVSFSSLSDVTSFDSNGLPKFKDNTESFWWAETLKYLYLLFDDTNKIPLTDYVFNTEAHPFPRFDTNDYFKTGWRRKIDENEKAQMRESKVIDKSNLPEAQPVDKSADQEAKEIIEEIAG

SEQ ID NO: 17244 - protein, 323 aa, Candida albicans
YKDKVPAFHPAHTSKNKKRILMLLKGFMLSLVLYAVYHLASNGGQFMFDFSGQSKWERAQLEVRQAMLDSWHTYEKYGWGYDVYHPIKQEGENMGPKPLGWMIVDSLDTLMIMDCPEEVSRARDWIKNDLDYTFDYNVNTFETTIRMLGGLLSAYHFSNDDVYLDKAVQLANALHGAYDSPSGIPYLSVNLKSGKGIKNHVDNGASSTAEAATVQLEMKYLSKLTGEILWWNLAEKVMQVLESNKPQDGLVPIYVNPDTGKYQGHLIRLGSRGDSYYEYLLKQYLQTNKQELVYWDMYRESVEGVKKHLVSDSYPSGLTYIGE

SEQ ID NO: 17245 - protein, 335 aa, Candida albicans
  UNSURE (315): Identity of amino acid sequences at the above locations are unknown.
AIGDSYIENNVPYIAYRSLLAIQGAAIVPIMFLTMKTLGFSVAACLFSSIIVCFDNAQVTDSRLILLDATLILSVALTIFSYSKFSTFRKQPFSSKWWTWLLATGVSLSCVISTKYVGVFTYLTIGIAVIHELWILLDYRKGLTLQEFAKHFFARLWALIIVPFCIYLYWFYLHFAILTRSGPGDAFMSSEFQETLLESPLAAHSKPVQYFDQITIKHKDTGAFLHSHQHEYPLRYEDGRISSNGQQVTCVVQENAANDPNNQWEIVPTLEGANKGTKVYTNDIVRFRHVGTGGYLLTHDVASPLKPTNEEFTVXYDDVAQQPYNETLFRLRLHV

SEQ ID NO: 17246 - protein, 279 aa, Candida albicans
  UNSURE (97): Identity of amino acid sequences at the above locations are unknown.
GFLHVDNVVAMGNPYGELLPRWLFNQPGVSGNKKIPVKDNIWNFDLITNLQSTDPRNQYVPKKVKTLPFLRKWWELQMLMFHHDNHFSSEHPFATQXGEWPLALSGVSFYNDNTEKTQIFFIGHIIGFWLEVCFLSIYIGILLADQITRRRNVHVLSDRARSRLYNTLGFLFVGWAAHYLPFFLMNRQKFLHHYLPAHLVAALFSGGLVEFICSNNSARPNGKPVGVNKYKIIAVVAACSTAIIWFFFYFRPLTYGDVYLTPEEVKARQWLDIKLHYGK

SEQ ID NO: 17247 - protein, 351 aa, Candida albicans
  UNSURE (31): Identity of amino acid sequences at the above locations are unknown.
WDIWIRLSYYRRKQEVKWIFYLFPRVRRFLXRYAPIAKDLACRDVFSRAITMELNEGRGVVSEKDHMYLQLSHLHAAVLKQRLPGISETAHIFAGVDVTKEPIRILPTVHYNMGGIPTNWQGEVLKKGTDGKDEVVPGLLACGEAACASVHGANRLGANSLLDLVVFGRAVSHTIRDNLTPGAPLHASPADLGKASIENLHRLRNAEGTKSTAEIRLDMQKTMQKGCAVFRTEETLEECVDNINEVDKSFANVKTTDRSMIWNSDLVETMELQNLLTCATQTAASALARKESRGSHSREDYPDRDDVNWWKHTLSYQNSVGSKVKLDYRDVIKTTLDTTDCQPVPPAVRKY

SEQ ID NO: 17248 - protein, 413 aa, Candida albicans
ISIMLTSLRNQVKSSAVTKRLLSSSSVRSQVIGSNVKGQDFNAAKYMSQKYHVVDHEYDCVVVGAGGAGLRAAFGLVSEGFKTACVSKLFPTRSHTVAAQGGINAALGNMHADDWHWHFYDTVKGSDWLGDQDAIHYMTKEAPASIYELEHYGVPFSRNDEGRIYQRAFGGQSKEFGKGGQAYRTCAVADRTGHALLHSLYGQSLRHDCHFFIEFFAMDLMMKDGACIGIIAYNEEDGTLHRFFANRTIMATGGYGRAYFSCTSAHTCTGDGYAMVSRAGLPLEDLEFVQFHPSGIYGSGCLITEGARGEGGFLVNSEGERFMERYAPSAKDLASRDVVSRAITMEINEGRGVGPEKDHMYLQLSHIPAPVLKERLPGISETAHIFAGVDVTKEPIPILPTVHYNMGGIPTNW

SEQ ID NO: 17249 - protein, 248 aa, Candida albicans
IMFTKCSRQAVNRLGRFFSNSSITFQTIGRIKGTEANSKKYLQQKYVVIDHEYDCVVVGAGGAGLRAAFGLAESGFKTACISKLFPTRSHTVAAQGGINAALGNMHKDDWHWHFYDTVKGSDWLGDQDAIHYMTKEAPDSIYELEHFGVPFSRNDEGRIYQRAFGGQTKEFGKGGQAYRTCAVADRTGHALLHSLYGQALRHDCHFFIEFFAMDLLMQDGECVGVIAYNQEDGTIHRFRSHKYLPQGS

SEQ ID NO: 17250 - protein, 487 aa, Candida albicans
  UNSURE (18),(61): Identity of amino acid sequences at the above locations are unknown.
NWRFNRKLGPTTTTISFXMGQISAVELGFNPSGSQVNKIKEFFIPELSFVKEIYLCQLNSXNVRIVHQWFNTPKKFYFLEDDDIAHIYDGELRIHRASTKSAGESTVRPIQTLEMELNEIMKGPYTHFMQKEIFEQPDSAFNTMRGRIDFENCVVTLGGLKSWLSTIRRCRRIIMIACGTSYHSCLATRSIFEELTEIPVSVELASDFLDRRSPVFRDDTCVFVSQSGETADSILALQYCLERGALTVGIVNSVGSSMSRQTHCGVHINAGPEIGVASTKAYTSQYIALVMFALSLSNDSISRKGRHEEIIKGLQKIPEQIKQVLKLENKIKDLCNSSLNDQKSLLLLGRGYQFATALEGALKIKEISYMHSEGVLAGELKHGILALVDEDLPIIAFATRDSLFPKVMSAIEQVTARDGRPIVICNEGDAIISNDKVHTTLEVPETVDCLQGLLNVIPLQLISYWLAVNRGIDVDFPRNLAKSVTVE

SEQ ID NO: 17251 - protein, 68 aa, Candida albicans
IMCGIFGYVNFLVDKSKGEIIDNLIEGLQRLEYRGYDSAGIAVDGKSTKDPSNGDEEYMDSIIIKTTG

SEQ ID NO: 17252 - protein, 343 aa, Candida albicans
KKMVKVTVAGAAGGIGQPLSLLLKLNPNVDELALFDIVNAKGVAADLSHINTPAVVTGHQPANKEDKTAITEALQGTDLVIIPAGVPRKPGMTRADLFNINASIIRDLVANIARVAPTAAILIISNPVNATVPIAAEVLKKLGVFNPRKLFGVTTLDSVRAETFLGELTNTDPTKLKGKISVIGGHSGDTIVPLINYDAGVGVLSDSDYKNFVHRVQFGGDEVVKANNGAGSATLSMAYAGYRFADYVISSLTGGATPAGRIPDSSYIYLPRVSSGKEFQQNMLMELNSFQFHSCCPKVRSDHLSTPFEESTVTTENINLVEIASKRLKRSITPWLPKYKKIF

SEQ ID NO: 17253 - protein, 358 aa, Candida albicans
FIYLFNLCTYFNQSIYINLTTMVKVAILGAAGGIGQPLSLLTKLNPNVDELALFDVVNVPGVGADLSHINSDSKTQSYLPKDKEDKTALAAALKGSDLVIIPAGVPRKPGMTRDDLFNINASIVQGLAEGIAANSPKAFVLVISNPVNSTVPIVAETLQAKGVYDPARLFGVTTLDIVRANTFISQLFLDQTKPSDFNINVVGGHSGETIVPLYSLGNSKQYYDILSEEQKKELIKRVQFGGDEVVQAKNGAGSATLSMAYAGYRLAESILAAVNGKTDIVECTFLNLDSSIKGASEARKLVKDLDFFSLPVQLGKNGITEVKYDILNQISDDEKKLLEVAIEQLQKNIEKGVSFAKK

SEQ ID NO: 17254 - protein, 333 aa, Candida albicans
KMFSKVATRSFSSSASNAYKVAVLGAGGGIGQPLSLLLKLNHKVTDLALYDIRGAPGVAADVSHVPTNSTVKGYNPDQIEEALTGSDVIVIPAGVPRKPGMTRDDLFNTNASIVRDLAKAAADYAPNAAVCIISNPVNSTVPIVAEVFKSKGNYNPNKLFGVTTLDVLRAARFVSEVAGTNPVNENVPVVGGHSGVTIVPLLSQTKHKDLSGETRDALVHRIQFGGDEVVQAKDGAGSATLSMAQAGARFAGAVLDGLAGEKDVIECTFVDSPLFKDEGVDFFSTKVTLGVDGVKTVHPIGEISDYEEAQVKEAKDTLIKNIKKGVDFVAQNP

SEQ ID NO: 17255 - protein, 169 aa, Candida albicans
SKLAVLKLNGGLGTSMGCVGPKSVIEVRDGNNFLDLAVRQIEHLNRKYDADVPLLLMNSFNTDADTEKIIKKYQSHRIRVKTFNQSRFPRIYKDSLLPVPESFDDSLEAWYPPGHGDLFEALVQSGELDALLAQGREILFVSNGDNLGATVDSKILDHMIETGAEYIMD

SEQ ID NO: 17256 - protein, 84 aa, Candida albicans
AFDNTATNVTASQMRNALNNLADTVENPEQTTRFENEMDNFFTLFRRYLTEKASGSTLDWDKIRSPSSDEVVEIRDLKSANNSG

SEQ ID NO: 17257 - protein, 169 aa, Candida albicans
DAYLHSRGEDIPNQKTISHGKSDINVLQLETAVGAAIRHFKGAHGVVVPRSRFLPVKTCSDLLLVKSDLFYLEHGALVLDPTRDGFSNPLIKLGSHFKKVSGFQSRIPYIPKILELDHLTITGNVTIGKGVQLKGTVIIVCNDGDKIDIPNGAILENVVVTGNLTILEH

SEQ ID NO: 17258 - protein, 205 aa, Candida albicans
TRNFQPFAEYKFGSDSDGYNFFTRELYAAGNSANSISSDPQQQQQYYQQQQQQQQQQQQQQQQQQQQQLQQQQQQQQQQQQQQQQQQQQQQQIQQIQQPSATNTIEKMNFWFNKGSLFAISNINHLIGFGDAKNPFAKLFQLPEALKERKDKKDRKRKSRSASQTEDANLATIGSAGGVDGQSITAADLTTNDWFYCLQFINKSV

SEQ ID NO: 17259 - protein, 158 aa, Candida albicans
CISRITSIRNSPEAIIADAATRSVIIIRELYLTREVVPLRFDGTVASDINETTEFENNSTWRSNVDETILHAVNEHDEMGKRLMKGLNLRLSSSTREDYKKRDPPVLNSRMAKTFKYCILITDDRNMRLRAKTIGLTSFQSKWLFGQLETVFSDRCID

SEQ ID NO: 17260 - protein, 431 aa, Candida albicans
FYFSNQSFSVPHSLPFLQRMNNTFDPTLHSFDNYSGTPQKRQNSLSSQMVHTSNKRTPNPLQTPLAMQSAQEYPFTVNNNNLNLNSPTTAPQVSSPRYNVRSRKNVIQHMKTPTPSAYEVPSSPNINHLSHLSNHNHSDLSDSNAVLENTQEAMDTKVASRSFSQQQQQQQSYSHLTHSQNYQQQQPTPQTSAPPPSLQQQQQRVMSEEEQQLATKLKETYKNIVNYEEIIQNNCVEISLKINQITSTNNPNLVYGSPMAAQNLSSSLNSNSSVASGVTRTSELLNDLWTVYHQNITLLDNYYDFLVTSLKPSSNQTQFKTGKNIVDLYKIPRRMWVYGVVGFLEVLKNIMSIFQDHEICLCFISYCFNIISNLTDPILEMEGWWLEKLGDLSRMAIALYASKFIDWKISAECWYSVAMKTLYGHGKIYYH

SEQ ID NO: 17261 - protein, 281 aa, Candida albicans
  UNSURE (15),(35): Identity of amino acid sequences at the above locations are unknown.
KLLISIGESFQKYLXSQPDDTLVNLKTFYPCESLXDHLNSLLSFVKNSPKLCAMYTQYLQVNYVQYFNQNEFLPEVWKCWGTLWFDLISEKHDYIDLETAGVKNNNLFDLPICGTYPVINNMSGDNFDLKSKNQMENDNDERIVRIILLSRTIADNYGFGLVRTRDEFKFDQNLYHREINDSFAQEFILDGRFLQNNFMQPISRENLTFETNHQLSSIQKDEIWFGGFDSHLYDDENLELGEDIIDCEDDLEEVYANEYGRASFRWWWWCYYSSPTGLEEP

SEQ ID NO: 17262 - protein, 197 aa, Candida albicans
HFLLQLIMGEIQKIKVKNPIVEMDGDEMTRIIWQFIKDKLITPYLDVDLKYYDLGIEYRDQTDDKVTTDAANAILKYGVGVKCATITPDEARVKEFNLKKMWLSPNGTLRNILGGTVFREPIVIDNIPRIVPSWEKPIIIGRHAFGDQYKATDIVVPGAGELKLVFRPKDGGEIQEYPVYNFESSPRSGLSAASSGG

SEQ ID NO: 17263 - protein, 306 aa, Candida albicans
FPPMLYLLTIFSLLLPALAINARSNSNVAVYWGQNSGGSQQRLSYYCDSDAVDIVILSFMHQFPSPIQLNFANACEGTYTANGILQCQTIAEDIKYCQNKGKTILLSLGGAAGSYGFSDDATAKQFAHTLWDLFGNSKNLATNDRPFYDAVLDGFDFDIENNWSTGYPALATELRTLFQKDTSKNYYLGAAPQCPYPDASVGPLLKQSEIDFVFIQFYNNYCNLGSSSFNWDTWLNYAETDSPNKNIKLFVGVPASSRAAGSGYNDPSAVSQYLTSDILNSKYFGGISMWDVSAGWSNTNSNGNFV

SEQ ID NO: 17264 - protein, 431 aa, Candida albicans
HHRYLYYCLNLLKPLVISNPFKPNGNLKFKRGGGHNVAWDYDNNVIRGVNLGGWFVLEPYMTPSLFEPFQNGNDQSGVPVDEYHWTQTLGKEAALRILQKHWSTWITEQDFKQISNLGLNFVRIPIGYWAFQLLDNDPYVQGQVQYLEKALGWARKNNIRVWIDLHGAPGSQNGFDNSGLRDSYNFQNGDNTQVTLNVLNTIFKKYGGNEYSDVVIGIELLNEPLGPVLNMDKLKQFFLDGYNSLRQTGSVTPVIIHDAFQVFGYWNNFLTVAEGQWNVVVDHHHYQVFSGGELSRNINDHISVACNWGWDAKKESHWNVAGEWSAALTDCAKWLNGVNRGARYEGAYDNAPYIGSCQPLLDISQWSDEHKTDTRRYIEAQLDAFEYTGGWVFWSWKTENAPEWSFQTLTYNGLFPQPVTDRQFPNQCGFH

SEQ ID NO: 17265 - protein, 388 aa, Candida albicans
  UNSURE (70): Identity of amino acid sequences at the above locations are unknown.
DRPRIPFLFKEVVVSGLKFQVLYMFSPGSEQVRVTFPREVQLRTFGDLVVCFMANACGPCIWSMDEQDIXKGDKNTIVSSFNRNFIARMTGNPATHALVASPEMATVYAISGDLGFNPITDTLVGADGKEFKLKEPQGVGLPPDGYDPGENTYQAPPEDRASVEVVISPTSDRLQKLSPFKPWDGKDAERLPILIKAVGKTTTDHISMAGPWLKYRGHLENIFNNYMIGAINAENGKANEVRNHYTGKYDGVPQTAAAYRDAGHKWVVIGDENFGEGSSREHAALEPRFLGGFAIITKSFARIHETNLKKQGLLPLNFKNPADYDKINFDDEVDLIGLTTLAPGKDVILRVHPKEGEAWEAVLTHTFNSEQLEWFKHGSALNFIKSKY

SEQ ID NO: 17266 - protein, 426 aa, Candida albicans
FLKHSNTMLSASRTALRAPRSVRGLATASLTKDSQVNQNLLESHSFINYKKHLENVEIVKSRLNRPLTYAEKLLYGHLDDPHNQEIERGVSYLKLRPDRVACQDATAQMAILQFMSAGIPQVATPSTVHCDHLIQAQVGGPKDLARAIDLNKEVYDFLSTACAKYNLGFWKPGSGIIHQIVLENYAFPGALLIGTDSHTPNAGGLGQLAIGVGGADAVDVMSGLPWELKAPKIIGVKLTGKMSGWTSPKDIILKLAGITTVKGGTGSIVEYFGSGVDTFSCTGMGTICNMGAEIGATTSVFPFNDSMVDYLNATGRSEIAQFAQVYKKDFLSADEGAEYDQVIEIDLNTLEPHINGPFTPDLATPVSKMKETAIANGWPLEVKVGLIGSCTNSSYEDMTRAASIIKDAGAHGLKSVFTQDDGRTIA

SEQ ID NO: 17267 - protein, 407 aa, Candida albicans
GSLQTKRYQLISHFYIPITTINTRLQLPQTFINKQTTHPSMITWLVFYLMLTIPMINGSDLSLRLQSKFMPTSFSPRNIFDTHVPATINSNKEDSSSSSGGGGGSGLPPSPMQFHPKLPFPKWLSDFTGLHEWPDLDPPYIPLDFIDFNKIVNIPIHKQGQCHDTGSNNNNNLTPLSILRTPKACSFDCFNCVEIDDVYTCPKLLQTFDDGPSTSTLKLLQSFNQTGLKTTLFTLGVNIVRFPEIYQQSHFMGHIMGSHTWLHKFLPSLTNQEIISQIEWSIWAMNATLNHLPKWFRPPYGGIDNRIRSILRQFGMQAVLWDFDTFDWKMLGGGGGATSNIRKEEDVFSEVEKFKLTKNNKGLILHHDAIQKTVDVGIMIHEKLLNHDQLTVPLCVGGIDYIKTFPK

SEQ ID NO: 17268 - protein, 563 aa, Candida albicans
SLSKIMYHQVPSEIEGKRTLRAPTIFVSQDDNNFETEFFPRNSEAERRISFFAQSLATPMPEPLPVDNMPTFTVFTPHYSEKILLSLREIIREDDQFSRVTLLEYLKQLHPVEWDCFVKDTKILAEETAAYENGDDSEKLSEDGLKSKIDDLPFYCIGFKSAAPEYTLRTRIWASLRSQTLYRTVSGFMNYARAIKLLYRVENPELVQYFGGDPEGLELALERMARRKFRFLVSMQRLSKFKDDEMENAEFLLRAYPDLQIAYLDEEPALNEDEEPRVYSALIDGHCEMLENGRRRPKFRVQLSGNPILGDGKSDNQNHAVIFHRGEYIQLIDANQDNYLEECLKIRSVLAEFEEMNVEHVNPYAPNLKSEDNNTKKDPVAFLGAREYIFSENSGVLGDVAAGKEQTFGTLFARTLAQIGGKLHYGHPDFLNATFMLTRGGVSKAQKGLHLNEDIYAGMNAMMRGGKIKHCEYYQCGKGRDLGFGSILNFTTKIGAGMGEQMLSREYFYLGTQLPLDRFLSFYYGHPGFHINNLFIQLSLQVFILVLANLNSLAHEAIMCSVH

SEQ ID NO: 17269 - protein, 395 aa, Candida albicans
LYSYSKENSTVFTERIEIIEKKMTDIPESLKPFVTKKVIHSTWAGTFLCKPQAIFQPRNVEEIQELIKQARLHGKTIMTVGSGHSPSDLTMTTEWLCNLDKFNHVLLEEPYYAPKSPTDDTPEIKFVDLTVEAGTRIFELNEYLKRNNLAIQNLGSISDQSIAGLISTGTHGSTQYHGLVSQQVVSVKFLNSAGELITCSSVDKPEYFRAILLSLGKIGIITHVTLRTCPKYTIKSKQEIINFETLLNNWDNLWLESEFIRIWWFPYTNKCVLWRANKSTDPLSDPRPSWYGTKLGRFFYESLLWVSVHLFPRLTPFVEKFVFGQQYGEVETLGKGDIAVQNSVEGLNMDCLFSQFVNEWSSPLNSGPEILTELKKIITDASHTGDFHRPPRSMN

SEQ ID NO: 17270 - protein, 116 aa, Candida albicans
REKGLADNFEVYIDGGVRRATDILKAVCLGAKGVGIGRPFLYAMSGYGDAGVNKAIQLLKDEMIMNMRLLGVNKLEELNELFVDTKYMQTRYVPDDVLFNRVYEPVPLPRFKDTKL

SEQ ID NO: 17271 - protein, 203 aa, Candida albicans
  UNSURE (11),(21): Identity of amino acid sequences at the above locations are unknown.
SPRYHWAVLSXSPDGEDRHQXVEELKRRQLVKNKPDISQIYNLYDFEFVARHTMDPIGWAYYLSLADGEATFRLNTGSYQRIFFKPRVMIDVTEIDTSTTMLGTKVSVPFYITATALGKLGHPDGEKVLTRGAQKHDLIQMIPTLASCSFDEIVDEAKPNQTQWFQLYVNSDREITKKIVQHAEARCMKGLFITVDAPQLGRR

SEQ ID NO: 17272 - protein, 746 aa, Candida albicans
SKMGWVLLPMPSDDVSLRVKSEISQKLSADYDCEAVFPDDVTFEGHYKSFCKQILWPTLHYQIPDDPKSKAFEDHSWGHYVLMNQLIADKIVETYNDVNDEETTVWIHDYHLLLVPKMVRDKLPNAKIGFFLHVSFPSSEVFRCFAQRNQLLEGMLGANSIGFQTNEYVRHFLQTCNRLLLADTSELGVNYQGNFTVTSTIPVGIDAYSVRENVHTEQVTEWRSLIKERWKDQHLIVSRDKLDKLRGIKQKLLAYEMFLTDNPEYIESTVLIQICIGSAQDPDYELEIMKIVSRINSMPENISVTQPVVLLQRDIGFDQYLALLCEADVFVVSSMREGLNLTCHEFITATEDKKSPLMLSEFTGSSNLLLCKGEGAILINPWDIKKFSETIKTLLTMPTSEKELRWHNCNQIVLTHDSKHWVTSCLNSIVNSWKIDHKKSGNLVPFTKNAFKDWCSVNGKRLIILALEISSAVSNSRGNSAGSTSGKVNVIDPSGLVRLLSDLVESQDTFVYLLSYLQRSDLDIMFKRYPQIGLIAENGNFVKLIGAKNWISLADKDELNSWMPEIVKLVESKVERLPGSFCEALDATVRFHAGKSFSEDRERSLDTMGETIQHINTLFEHNGVHATLVRNLVIVQKDQISLKAIRLVLSCHNSNLDQKYVVTHINEFQQPMKDDIPSNDHEVAAVLYSGGLTSIDEANYEYVNSLKKDIGNTLTVTLISSSNEETKTAATYGVRGINELLCILNS

SEQ ID NO: 17273 - protein, 546 aa, Candida albicans
CAPSFPRVVQVFIEKTPTSIVIGYDHRFNSQRFAEILASVALTQGVHVYYLGSVANLSEETMKLTKGDIENDSSTDRGYVHTPLVPFAIDYYGASGGVMITASHNPANDNGYKVYYLNGCQIIPPVDKEIADSIEENLTPWEGVWDVYDNIKKGVQKGLLSLAGDEVTKEYLKGVKEKLIQDNNLDFSFVYTPMHGVGYRIFKECLDLFHALTWNVVQEQADPDPTFRTVSFPNPEEKGALDLAIETARKLGYKLVLANDPDADRFSVAVETKGQWNQLTGNEIGFLFAMYVIEQQKEQDLDRVYLVNSTVSSQILKAMADKDGFHFQDTLTGFKWIGNKAIDLQKEGFKVPFGYEEAIGFMFDLVHDKDGISAATIFLQLYQKWFSGGKIDVTDKLEAGYAKYGWFKDYNGYYRLADMSTLDKIFTNIRGSFDSKSPENIGEFKVTSWRDLTIGYDSSTVDHTPVLPVDSSSQMITALLKLPGNDNAVVRFTCRGSGTEPKLKLYIEGKSTINEQSAKEIAVKCWETLKQEWFQPEKYNLTEVKP

SEQ ID NO: 17274 - protein, 204 aa, Candida albicans
KMYFSAQWYFEHEWSPKMKKRKAISSDYQLWLYHFQKYTEEDYVYQVALYLLIWGEANNVRFMPECLCFIFQCALDCNGPNLPKFNYLNRVITPLYEFIRDQLYCKVDNKWKRREIDHACTIGYDDINQLFWSPEGLYKLILYDGTRLYQLPQAERYHKLETINWSKSLSKTYRERRTWIHVLSNFSRIWIIQFFTNRAGRPAS

SEQ ID NO: 17275 - protein, 362 aa, Candida albicans
SSRLLKTSSNENTWNKPKLVSYDRKQINPHDVVLENEVCGLCYSDIHTLQSNWGEYNRDDLVVGHEIVGKVIAVGDKVTEFKIGQRVGIGAASSACRECNRCKSDNEQYCAKAASTYNAPDVRSNNYVTQGGYSSHSIADEQFVFPIPDDLPSAYAAPLMCAGITVFSPLLRNLGSDAKGKTVGIIGIGGLGHLALQLAKALGAKVVAFSRTSSKKDQALKLGADEFIATNEEKDWSSKYHDTFDFILNCASGVDGLNLQDYLSVLKVDKKFISVGLPPATEQFGVSPFTFLKHGASFGSSLLGSKVEVLEMLKLAAKHNVKPWIEEVPLSEENCSKALNRCHDGDVRYRFVFTEFDKAFAK

SEQ ID NO: 17276 - protein, 382 aa, Candida albicans
  UNSURE (287): Identity of amino acid sequences at the above locations are unknown.
DADFPALGEESAASESSVESSSASEFVVPSSATETSVSESASESSAEPSSASESVASESAVSETSASESAAPSSASETSVSESAASSSASELFASESSVESSAVPSSASEFSTSESVASETPASETPASETPASESASEQSSTSESSAEISSASESSAEPSSAKSAISESASEFSAAPSSASQSSASQSSTNESSSQQSSAESSSTGTSSVSASAATSEYTATWTTTNSDGSVSTESGIISQSGSSFTTITTFVPDATSEYTTTWTTTNSDGSVSTESGIVSQSGSXFTTITTFAPDATSEYTTTWTTTNSDGSVSTESGVVSQSGTSLTTITTFAPDVTSEYTTTWTTTNSDGSVFTESGIVSQSGSSFTTITTFEPPVVC

SEQ ID NO: 17277 - protein, 613 aa, Candida albicans
SSAPPSSTQSLFTAESSNSQLSSTTPSSSTEASSTVPSSSSQLSSSVPLTNSVSLSSVSSSDNGSSSASSPSSSQSSIASTAESSSTFPSSSDQQSSSIQSPSSQESSVSLTPTSSLQSSTNTISSSQDSSSFSPTTSDNSSTNSASSLSTLSSSDTSVSNPSTSNVSSTDNTQSSVASATPTDSAISATSSDITTEFTTTWEVTNSDGSVSTESGIVSESGTSFTTITTFPPPTTSSDITTEFTTTWEVTNSDGSVSTESGIVSESGTSFTTITTFPPPTTSSDITTEFTTTWEVTNSDGSVSTESGIVSESGTSFTTITTFPPPTTSSDITTEFTTTWEVTNSDGSVSTESGIVSESGTSFTTITTFPPPTSSSVAADVTTEFTTTWEVTNSDGSVSTESGIVSESGTSFTTITTFELPVVCKRDDISCGPATSATNSDTAAQDPTSDATAIESEFTTTWTTTNSDGSVETNSGVVSQSGSSLTTITTFAPDATSEYTTSWTTINSDGSVATNSGVVSQSGTSFTTITTFEPPVVCKRADISCGPATSAMNSDTAAQQLTSGMTATETEFACTWVVTKSDGSVFSESGIVGQSGTSSPRGWKKPRYKQERR

SEQ ID NO: 17278 - protein, 159 aa, Candida albicans
GRCEDQPATSLVVPPYSVIETEFTSTWTTTNSDSSVATESGVVSQSDTLLTTVTTFPPAPSAIVPEFTSPWKINTSIESNETLTVSASSYETVGESLAAATSSSFSSATVVVAPSESEINTSSSILNNEEIASASAPVSDTTSIAEHHDGSLSMTTTEF

SEQ ID NO: 17279 - protein, 145 aa, Candida albicans
TTFIKHQQKIIMLLIFLSLLLPVYADSWSKLGCYSSISVAESKGSYMYQSSGYCEQQCAGYRVAALKNGNECYCGDVDPTSQSNGCNIKCSGWPLDTCGGSSAYMVYINADADSQAQSSSTSSTSTSSTSSSKSTSSSSSSTSSS

SEQ ID NO: 17280 - protein, 394 aa, Candida albicans
  UNSURE (392): Identity of amino acid sequences at the above locations are unknown.
QFLNPVTSLAVPSYTVIETEFISTWTTTKSDGSIVTGSGIVSQSGTSLTTLTTFAPSSSSSSEITPEFTSTWEISSSNESNVVESSIVNQSNESLTNSVSSYEPATESAIVSPSDQVLTSSATSFVSASEFSAVTTTTTTVDSASASSSTDINNGVTVLVSPSESEINTSSSIWNNKNNASGAVSTSESTSTTDNHDGSLSMTKTELEINGFYSTESSTMFVTATITSCNESDCFENVVTYVSNDSYTTVTTGHSNDNTSVDNNNVPSTLIENVSNTETIPVVTNTEEVSTTVYNPLTSTSTSNIVESSNTSIVDNENNGVHINSDDMTAMVTAVETGNGITNGTNFVSPSTIPNEISETGSPATSIVGTLPYENGSNQLSIENSFQTAVEXHV

SEQ ID NO: 17281 - protein, 607 aa, Candida albicans
EVPQCLNKNNDKPKRKHCCIDNDGKVLYPKPCSVTSKGLTTKTGDDTIIPTSLITTDSSSTTATSTIDDVKKYPQCFNKKNDKPKRKHCCFDNNDRVLYPKPCTITSERTASTTAENTTESESSSATTLPDSTTESESVSSTFTSDDNIESESISSTTTSDASDSTETHDINRYPHCFFKYSNQPNKDRCCFNSRYQVLYPWPCDGSSQSTTTTVLISISGTESSSVTTTFDENLGTSSELTISSSSDLISTSQDIPQATTINNSTTSIESSANGSTLPLTQPILSVSEFESSVSDATNSNSNSNPTFTAEGGHSSDEMLTTTDKNNSLTSKSVATPTETSWLNSVAGTSSKEDMRTSTGTISSFSEVATTEMISSPSETGNPKKSSAIDYGTNSDITTLTGRYTSLRDKTVSTLQEDAGIESTTVEGITKTVHTTVYVTTSPDNSITTETAVVVVVTNDSTATTYTEIIQTTVVEGKTLTTAIPIPQDEINKIKVIEYSTILPTTLPNGQVTSVIEKVAVAVNGQGQKVTKTAPIELGAYTTKGFEIIQDSNDIGNSVAEGYNPSAGLGGSTLVAPIAVVSNENSASLPKVNLLLVKFLLLVLLIV

SEQ ID NO: 17282 - protein, 741 aa, Candida albicans
QVRDQLHMFISTSPSIIPSNRFDMLDPTDHNQLFNNTQFSIHEFEEQQDFESQQQQQPPQQQQQQQQQFQEQESIFKEDDDSLQQQMQQNFPLFQYQQPFMSTTNYLLDESVQENDDNYQLLSGGDLDSTSSFTTNSLANIKSNSLYGNSVNVNLGAVPTNLSNPDTIIAGQLSSSVSSSYYNTPFNQQHQQQALQINQSLQGFQPFQLPNDSSTSSSLYSYTSASASASAPQQQVHSRQEQMNTGSSFGFSNTPTQSTFTHTSSNTPLQQQNDLYPVSTSMNSFLDNSNLVYHQAKPEMSPSVINPIVQQQALNYNLSQSFPKPPLSSTSTTFDSINYNSSPTISQPQFTSQSLPNLSSGTAGKKKPSKRTKSRTPTTISRPVPLNIKKEETNTFKVNSHSIVKQENELSSTPGGNKRYRVIRGISAGGCNTRPPKESMEGKACYYSMNLNLNGASLKDICYPKWNQSEKQDRRRIIRIERIQQGPVITANFSIVGAANENPVVLPPSNPDIDVIEVSCLECDVKINNSHISEGTNFYDSQSSDDEMGGNNGDAAGMGGVGAKKSPNYIKNEFNDDYYQYYITSVEVVEIVELLIGNQFRDAAERRKERGRVRSNLVPFWSKKPISSRMSETSTSSSSPQNSSVTPGSSSSALGTTTTTATVGGAGSSLTNHDYRVELAKRIMGYEIRKPRGFDKEVRILRWDKLVPALQRALQSYYTEIPINDPYAQLYRTEAPETRNN

SEQ ID NO: 17283 - protein, 374 aa, Candida albicans
LNTDTYLYIIKSFLPIMVKLPFFTIVVSIFYTSSLLVSAADYTAPASNLGCYSSISGGDSKGDYTYQTSGYCVNNECPNSPYVAVKGKECICLNSLPQSSSKVSSSQCDQPCPGYQSDMCGGSNAYNIYKGLASASSSSSSNMGSASSSSPSSSGSPSSSQSSSITGSPNNSDDSDQSTATVVSTISNSNGNVIYKTITQEASATTSSGSSSHASTTSSSSSTSTSSSHSSDSPDGKSEKKSSSVGAIVGGVVGGIGGLILLVAGGFFYMRYRNNDEDEDEEEEFYDNKPLKRSNGSKIGSRRSPNALEMPMANPFQHPADDLVRNNSVQKNGFVDPRLNPIMMGRRRLSEGSLVDEADYSRKVLQVANPDDTK

SEQ ID NO: 17284 - protein, 352 aa, Candida albicans
PIEIYLIMTISNRPKVLRLGKIEFAQKKWDEVAQIAEVIDCESQNREELIKDLQTKYSDITNIARTYASVEQTGRFDAELAQHMPKTLVSLSHNGAGYDQIDVQPFTDKGIQVSNVTVPVEGPTAVTAVFLVLSCLRNYQEGHQILYDGGWDSKKCGGAKLGHSPEGKVVGILGMGGIGRAIRDRLKPFGFTKILYHNRKPLSSDLEGGAEYVSKEDLFKQADIICISVPLNAHTKHSINKEAISQMKDGVILINTARGAVIDEKELPELLKSGKIGAFGADVFEKEPEVSPELYRLPNVVSLPHMGTHTYEAIKDMEDWVAENVESCLKTGKVKTIVPEQYNLEIKQGPLV

SEQ ID NO: 17285 - protein, 166 aa, Candida albicans
IFIMSSIFKLSTRTIMTSTTTNSIKPKVLRLGITHYAQHKWDQLSKIAEIIDCESTNREEFIHDLQTKYNDITNISRTFASIKQTGRFDNELAKHMPTTLKAISHCGAGYDQIDVTPFTEIGVQISNVTVPVEGPTADTAIYLVLACMKNFQIVNNMLVNGGMAPY

SEQ ID NO: 17286 - protein, 163 aa, Candida albicans
VIGLKPFGFGKIVYHNRNRLSEELDAEAEYLSMDELLNQSDIIIVSVPLNAHTKHLVNKSLIEKMKDGVILINTARGAVIDEKVLPELIKSGKIGSFGADVFENEPEVSPELYELPQVVSLPHMGTYTVEAVRNMESWVVDNIESYIKTGKVKTIVPEQYNAF

SEQ ID NO: 17287 - protein, 364 aa, Candida albicans
LYHSAESSDNWENIAIFNLISTMTTGTSKPKVLLVGEFIYSKQKWSELEEIAEVIQSESTTREQFIQDLKTKYNDITCIARTFYSINETGRFDADLAQHMPQTLKSVSHCGAGYDQVDVEPFTRLEVQVSNVTEPVERPTADVAIFLVLACMRNFLQGRQILMNGEWPSNGDKEAAGAPLGHTPQGKVVGILGMGGIGRAIRDRLKPFGFDGIVYYNRKQLSPELEKGAEYVTMDELFKQSDVIIIGVPLNAKTRHLIDKEAIQKMKDGVVLVNIARGAIIDEKHLPELIKSGKIGAFGADVFEHEPEVSAELVNLPNVVALPHMGTHSVEALTNMEEWVVCNVETFIKTGKLKTIVPEQQGIF

SEQ ID NO: 17288 - protein, 248 aa, Candida albicans
PTVLTYTHTNIMSFDSFGDYATIVVFGASGDLAKKKTFPALFGLFREKQLPSTVQIIGYARSHLEDEEFKQRISAHFKGGDEKTKTEFLKLVSYISGPYDTDEGYKKLESRCQEYEKANKDKNDSYTPERLFYLALPPSVFTTVCEKVKKNVYPPEESKGKLRIIIEKPFGRDLDTYREMQKEISPLFTEDEIYRIDHYLGKEMVKNLLVLRFGNELFSGVWNNKHISSIQVSFKEAVFTTRLEDPRR

SEQ ID NO: 17289 - protein, 80 aa, Candida albicans
YLGNHSNFVRDDELDISWKLFTPLMNAVEDPAKKFELQYYPYGSKGPKDLRKYLNEHGYIFSDPGTYQWPLTSPNVKGEI

SEQ ID NO: 17290 - protein, 69 aa, Candida albicans
PVTKGMFKEIQRNELVIRVQPNEAIYLKINSEIPRIYTETSLTDLDLTYATRYSKDFWIPEAYEALIRD

SEQ ID NO: 17291 - protein, 110 aa, Candida albicans
TNVIDSITFIPKDMNNKNQFEKDKVIDLEHCHYYVDNSQLNSYPQLVYPNLSTTGKWEVITCNKMLDPNEKHSTIGKLLYVPTWLRGIIPYDVGYMEFCLLKKQDIEDTV

SEQ ID NO: 17292 - protein, 333 aa, Candida albicans
GGYPPVGAQFIQRRILHQMTTEGDSNDPDFDDERDVKEKNFQQAGIFTSNMYLAEDRILCFELVAKKNHNYILRYVNEAKAETDVPENIDEFVLQRRRWLNGSMFAAGYAVFHWTKIWRSNHSLFRKLFLQLEFYYQLVTILVSWFSLASFFLVFRILTANLGSSDMNFNVGKYLAIIFLWFYVGSVVCTFVLAFGNTPRGTRKFYLVIAVFFAILMAYMMFAAIFLAVHTVNSIVHNHKTDFTIALVFTNTKFRDLVVSMVSTYLLYFIGAFMYGEPNFMFTSFAQYVLLSPTYINVLNIYAFCNIHDVSWGIKRVEQAKDLGSAKSFGKEF

SEQ ID NO: 17293 - protein, 113 aa, Candida albicans
RQKKDDLAYYAFIRTITVLVWMLTNAILIAIVLEAGGVDILSGNKSGQTNADGSISGNSQVFLTIILWIVAGLALFRFIGAFLFLIFKSFRPLKWKLRAKRENKRNRNQNRNV

SEQ ID NO: 17294 - protein, 289 aa, Candida albicans
YPLFNNNRTKKYRTPTSSNSNSSYSTMVDNDEFQLLRKKTVAFTEPEYPPLTYSPGKKRDTATSTNVYDYDLEEMDDGSLVASGGSGGIHADFAGDDYIINPLQDADDDDSLDPFGDDESLFLDTGEEILRRGTTIKKRHSTRRGRRNGTLKRGKSRNTEYGGENEKLVNNDNGDEEDGDGDDDDDDFKPKLTYTKTIKKAKLINGNYVIDAPVPKTLLETYGKKINYHQDNVSREMSFVRYTAATCGPSNYVKFNYNLRQELYAPSRQTEIMICITMVSPGLEGPRTP

SEQ ID NO: 17295 - protein, 295 aa, Candida albicans
  UNSURE (95): Identity of amino acid sequences at the above locations are unknown.
LKPFPVFFQMDEIIYQLREHSAGLNCGRWDYIFSYIKCLRNHPDFILPDRSQVTMAAPFMSSYVKLLVHTTHKRKVHALGGMAAQIPIKDDEERXRAALANVTKDKLREVTLGCDSCWVAHPALVPVVLKVFNENMKGPNQISLPPKEPFKPITQRDLLSPFVPNAKITEQGIRANIIIGISYIEAWLRNVGCVPINYLMEDAATAEVSRTQIWQWVTHGAKTDTGKVIDKQYVKQLLDEEYAKLVKSAKPGNKFKRAFEYFAPEALGEKYSDFVTTLIYDDITTIGRSLPGERL

SEQ ID NO: 17296 - protein, 267 aa, Candida albicans
CLPPFPKTADKIKGVQILGPVPESAKHIFNQETLAFVATLHRGFEARRQELLNNRKEQQKLRDQGFLPDFLPETEYIRNDATWTGPPLAPGLVDRRCEITGPTDRKMVINALNSNVATYMADFEDSLTPAWKNLVEGQVNLYDGVRRNLTANINGKNYALNLDKGRHIPTLIVRPRGWHLDEKHVLVDGKPVSGGIFDFAVYFFNNAQETLARGFGPYFYLPKMEHHLEAKLWNDIFNYAQDYIGLRRGTIRASVLIETIPSVFPNG

SEQ ID NO: 17297 - protein, 280 aa, Candida albicans
MYIYPPCGTEFLIKQANLNQLRSNKLLYLAQFRPEKRHALLLKEYSNFLSNNFPNVTQITNKFPTLVFAGSCRTADDTATLKFLQEQVAKLDLSRFVEFRIDISYDEVVELLSSCKFGLNAMWNEHFGIGVVEYMARGCTPIVHASAGPLLDMIGRNDQQENCLNNWKTDGGFFFKSYDDPDLDPNLQKNTETGYIKFELFDQFIDYPTFETLLKELYVNDPTIIEDSKLLKMRQIDQNRVAEKFSNKAFNKKWIEYINDLNTLEKQYREEKRTKVEQVY

SEQ ID NO: 17298 - protein, 259 aa, Candida albicans
TMYLILLVVLAVYVTYKLITTVLPHHLLIPSQNWREKISYVVKYPKPIYLKVGTKRSSYRRRLILASENPAFYTNFINNKLKISPNDCENGDGFLNEMSRRDIDDPKRRIIYGFFHPYANNGGGGERVLWQAVKATLLADDKKIGVHYTTNIEAQPLDILNKANKKFQIEGLDHSRVVFIYLRKFNNLIDGNYWKHFTLIGQLIGGILLSLETIYELSPDVWIDTMGLPSSYLLVSLSLKIPILAYTPFPILQEDCVVN

SEQ ID NO: 17299 - protein, 125 aa, Candida albicans
VGIDLCLVRESTEDEYSVLENQFHPGAVEFLKIMTKSKSYIFVEYAFDFALKNNREFVTAIHKAKFLELGYGLVKTTLVLWIMLLYPLFPIRDNSLFWSYGFILSNSGAALIDVLDLVPVLAFGR

SEQ ID NO: 17300 - protein, 62 aa, Candida albicans
VGIDLCLVRESTQDEYSVLENQFCPGVVEFLKIMTKFRSYRFAEYAFDFALKNNKELVTAIH

SEQ ID NO: 17301 - protein, 193 aa, Candida albicans
NSIRSLATFASPEAVLPKKYGGRYTVTLIPGDGAGQEITDSVKQIFKSQNVPIDWEVVEVSGVESETGKSHGVDEAVESLKRNKVGLKGILYTSTGKSAKSLNVALRKELDIYASLVLIKNIPGVKGIYDGIDFALVRENTEGEYSGLEHQSYPGVVESLKIMTRFKSERIAKFAFDFALKKQQKIGYCYPQS

SEQ ID NO: 17302 - protein, 175 aa, Candida albicans
KNNRKLVTAIHKANIMKLGDGLFRQTVKDVGQDYPGIGVSDLIVDNAFMQAVAKPQQFDVLVTPNLYGSILSNIGAALIGGPGLVPGANFGREYAVFEPGCRHVGLDIKGKNSANPTAMILSSAMMLRHLGLNDHADKISKATYDVIAEGNVRTADIGGTATTTEFTEAIINKLD

SEQ ID NO: 17303 - protein, 102 aa, Candida albicans
AFDFALKNNRELVTAIHKAKFFKLGYGLVKTTLVLWIMLLYQLFSIHDNPLLWPYGFILSNFGAALIDVLGLVTGASFGRCCSGFDQIAVTLLWISKLKIQN

SEQ ID NO: 17304 - protein, 399 aa, Candida albicans
GGMRGIKGLVWEGSVLDPIEGIRFRGRTIPDIQKELPKAPGGEEPLPEALFWLLLTGEVPTDAQTKALSEEFAARSALPKHVEELIDRSPSHLHPMAQFSIAVTALESESQFAQAYAKGANKSEYWKYTYEDSIDLLAKLPTIAAKIYRNVFHDGKLPAAIDSKLDYGANLASLLGFGDNKEFVELMRLYLTIHSDHEGGNVSAHTTHLVGSALSSPFLSLAAGLNGLAGPLHGRANQEVLEWLFKLREELNGDYSKEAIEKYLWETLNSGRVVPGYGHAVLRKTDPRYTAQREFALKHMPDYELFKLVSNIYEVAPGVLTKHGKTKNPWPNVDSHSGVLLQYYGLTEQSFYTVLFGVSRAFGVLPQLILDRGIGMPIERPKSFSTEKYIELVKNINKA

SEQ ID NO: 17305 - protein, 389 aa, Candida albicans
MNSYYYNTVSHILSYSIYYVYDNLHEETESPPKSALSSSLLEPSTNQQTSDFKNHLLYKSLISSLFQNTTKQTKDLNSNIYDDIFSNHKLETVLGTLSFKERCDLYFKNVFAEDVNWHFNPDTRYDMHFDKNTKEFKDFIKVKELVIQEKFDKMKEKFKEEDYNRELSKLKKSMFTDFLNEKFEQEIVNRLSTFRIFNKCYITNDETPQINKINQFITNQQKLVQDIHRDESGNFYKSKIDKLKLTNKEALVDLMVTKSSTFEHRVYPWISKEYPVYERWTGKVYHEPPNYYEILNHDPMQKTPKKIQQSNNAAQPFLKQFKNKFNGRGIVLTIGNQHSDYAVSLIHLLRALDNKLPIQIVYYDDVNEESKRKIVTAPQERIPIFNTFI

SEQ ID NO: 17306 - protein, 388 aa, Candida albicans
DAISGIFRNENVQEIAQYPDLAVEKNKSGTESVGQGAKSLESPKHKDAISHGHSSKDHIKDRDTHSTGAAVTGGVAGTAAAAAAAAVTAHGKSRNEPTASTHGQSSSRAISDAGTGHQDEKNVANTPQHHYGNQNVGSNSYSPDTYGSAIGTLGVQEKTAPAVTGIHSKGIGAAAYPELTNAGNTGLAKGTAPASTSATYGESPSADYSKSGATGVVPATYLNTSGAPTGSLNTAGVVGGAGFGDNSNTSSYHQTGREREYEAPSLQSESGLHTTQANKGSPLGGLALGETNIRGTNFASKDSNYSLSGSGAQSQHGQAVGNSEIPKSIGTTNVGNTNRYSVNNKNLSGRSTTGAGAGNTIAGDADDADSSFFSVAETSTYSMPGSWN

SEQ ID NO: 17307 - protein, 827 aa, Candida albicans
LTIMLANVKLNLVTALYVLSYVSVVNAYQQENEITPADNIDKRAGAIGNFFRDFTNSIFGNDNLEVNQPSTNGATSTGHFFGPSIPSTSTHQQTPGETSNNVNTKSSSQNQSPSTSPTSTVAAAAATSSSPVASTRPASTSEQKQQEESTARQSTSPATTATTSNTPPSPSTSKETPTSNTAQTSSANNNQQSSNTAAPSTSVIQPSTSEVHVQSQQTSTTPNTPTSSPNTPTTSEAAPTTSAAPTTSEAPVTPSTSEVVPNTPTTSEAPNTPTTSEAPVTPSTSEVVPNTPTTSKAPNTPTTSEAPATPTTSEAPNTPTTSEAPVTPTTSEVVPTTSTQGDAVSTSSTSVTEQTTLTSSTLLPPTTALTTQTSTPEASDSPKPSSTSIETPSTSTFEQDPTTTSSVGTPSSEQPQPTTTSELAVTSNSPTQESTSLVEPTTSSLESSNTPTPNPSTSEAQPSTSASQAPPDTTSSAPAPELSSSNADFSNLVLHSSETTSLVNPTDSQIDSSSTTDAVSQATTEPTSENTPTAASSVTANDINSAQYSAPTSNADAETASSPVSEQSLATGSQTSLDTTAGASSTASEATAENLSTFGTDGSSDASQTIAETTSNSPDQSVVTPSASASPDVSTLPTGSESGTSLVSGSETSIDTNTVASGSTVIPESSNIPTQSPSQSVVSSDAAASNVSTGSATTDSLAGSETGVQPISSSATGTSEPVFSSEYNSSEGTTSLVVPTNSELSSTVTGSSETAATAINSESVLTGSSDTAATVTGSESILTGNTETSATAIASESTLTGSTTGATDSAATTIASESVLTGTSDAS

SEQ ID NO: 17308 - protein, 468 aa, Candida albicans
NLYNFNSNFDNNPKFFNNNLEQIHTSNHLKKEFVRFKKNSCTRPLPKDSTPVVYSLKTQLGQQQPHLRSTSIFKKSPVYDLFHYFEKAPDQWTARYILILTAIILRVAVGLGSHLGYHTPPMFGDFEAQRHWMELTINLPIYQWYFFDLQYWGLDYPVLTAYHSFICGKLGNFINLSWFALNTSRGLETDDIKTFMRITAIISELIIYIPSILKIANILGKKSNINRMDQIIIALIIINQPHLILIDHGHFQYNSIMLGFFIYSIIDLIKGNLIMASVWFISCINFKQMGLYYSLFIFFYILSQLNSSSKFFLVGVTVLLTQFIYLLPFIWFHPDSVLQIVYRVFPFNRGLFEDKVANFWCTSNILIKYCEILTDASQLSKLALIATLLTTIPINLLIFYKIKTNNNTTKKANTEITPLSSSSSSLPLNIVAMIYGFALNALSFYLFSYQVHEKSILIALIPISLLLL

SEQ ID NO: 17309 - protein, 266 aa, Candida albicans
FDGNKIMAKKKSTGPQPSLSSSPNGRAKVTAETITTTTTTTTDTTNSYSLLNIWVISLALKILLFIGYHSTDFDVHRNWLAITNKLPISQWYIENTSQWTLDYPPFFAYFEYLLSLLVPRFVANDGCLDIVEIGQYGLPTIYFQRLTVIISELVLFYALQTIVKTSPTLSAKRRMYVATASLALSPGLILIDHIHFQYNGMMYGILLLCINSARLQQYLLCGFWFSVLLCFKHIYLYLAPAVFIFPLRGYCLKFNWSSPRALEDPA

SEQ ID NO: 17310 - protein, 103 aa, Candida albicans
ARVRQSRGEYTVWSLVLGGLTNNELLKLVKNRKTKVLELNDENFENILNGQRDYHLIALLTSEAPNLNCVLCRELAPEYTIVANSWFQDHPNGVAEVELTEQE

SEQ ID NO: 17311 - protein, 242 aa, Candida albicans
LNKNKKMGKKQPKNIYFFKSEFKDSKKLFSVLQLQNIPKMFYFPPTKHLGPNNYLREKVEYQFFHGDHKELLKNWLIEVTDHRFNLYIPVNKTKIAINAIGTFIVVLLLRIFSKQVIQVITSRVIWCAASIISVILFTTGYMFNQIRGTPYVMEHRDGRTEYFAPGQQSQFGVETQIMSFLYGFLSILVIVLVKRAPEIKNQSANLFLVATISSLIFVLFSLLLSIFGVKGVGFPYRFINFL

SEQ ID NO: 17312 - protein, 241 aa, Candida albicans
LQLLILMYIVNYIIGLLLYIEVALCSSHSAIRLTELAKESQDYIIDVYNSDLSILEGPRDYFTVLLFTSSNADHNCKQCEGFKNVVTKVANSWFSDHTDSHLLTFITIDLNDPKNGKLFSLIGLQTVPHIWLVAPNPSRDYGDPNKILEDAHLEFKMPQVSQDKQTLEFAQFISEQLQKPILIRDTDALTKFIKTFVITFSVIIIIRKKGPSRITATKKKTIVSLVAIAIVLLFTYGVLTT

SEQ ID NO: 17313 - protein, 84 aa, Candida albicans
WGDAPVHSIAAALFLPREKIHFFEDVGYYHVPFTNCPVDKEVRKARNCNCDPNKDFTWRGYSCTTKYYTLNNFKRQKGWEKYTA

SEQ ID NO: 17314 - protein, 178 aa, Candida albicans
IINIHPNMAKSASNKKSIPTTSSSSTATSAASSSVVLKEVKSTLTTTINNYFDTISAQPRLKLIDLFLIFLVLLGILQFIYVLIIGNFPFNSFLGGFISCVGQFVLLVSLRLQINDSTTTTTNKESDDQLELDEDKIENGTTGGGNGRLFKEITPERSFGDFIFASLILHFIVIHFIN

SEQ ID NO: 17315 - protein, 276 aa, Candida albicans
  UNSURE (12): Identity of amino acid sequences at the above locations are unknown.
YICSGLPPRDEXAASHGNEEQVGKAIKDSGVPREELFVTTKLWNADHKNIEEALETSLKKLGLNYVDLYLIHWPASIDKSTNKPYTDFDYVDTYRGLQKVYKNSKKIRAIGVSNFTKKKLERLLSSEGVHVVPAVNQIEAHPLLTQPELYDYLKEKGIVLEAYSPLGSTNSPLFKNDTIVNIAEKNGVEPAQVLVSRAIQTKTVVLPKSVPESRVISNLKTFPLTSEEFETLNKLSEKDGVVRTCNPAFTQLLMIKLITILRFKNIIKSPLPLFSL

SEQ ID NO: 17316 - protein, 290 aa, Candida albicans
TMSAQLKTNNDRIALNNGNKIPVIGLGTWESNKDAFLTALKLGYRHIDTATIYKNEEQVGQAIKESGIPREELFITTKVWNNDHKNVEQALETSLKKLGLDYVDLYLVHWPVSIDKTTKEPYPDYDYVDTYKELQKIYKTTTKIKSIGVSNFTKSQLERLLSADGVDVVPAVNQVEAHPLLPQPELYEYLKEKGITLEAYSPLGTSSSPLIKNKTIVEIADKNGVDPAQVLISWAVQRKTVVLPKSVTESRLVSNLKTFELSAEDFDTLNKLSEKEGITRIINPFKNFQD

SEQ ID NO: 17317 - protein, 269 aa, Candida albicans
KMAWDKKKKKFSTIAIMEYGKFVLFGDSITQFSCTQYGFHPALQNVYIRKLDVINRGFSGYNSEHARQILPKILESETNIKLMTIFFGTNDAYDYINEIQTVELDRYKDNLSVMVQMVLDKNIKPIIIGPGLHDPKMAKAMLAERGRPIDKDPTTNQRLLKYSETAKKVAAQHNVAFIDTWNTLRQHQGWTKDQLFEVSATKDKWEIGESLAEIVSDGIHFTAKSYKILFEEIIRVIEEKYPELAPENLPSQLCDWKQINPNDLSSIFN

SEQ ID NO: 17318 - protein, 362 aa, Candida albicans
TAPVIRTTQRLFARSYIAGQFTGSKGSDGKYTVTLIEGDGIGPEISQAVKDIYAAADVPIHWEPVDVTPLLIDGKTTLPQPAVDSVNKNLVALKGPLATPVGKGHTSMNLTLRRTFNLFANVRPCKSIVGYETPYENVDTVLIRENTEGEYSGIEHTIVPGVVQSIKLITKPASEKVIRYAFEYAKSINKPHVLVVHKASIMKLSDGLFVNTAKEVAQEYPDVSLDFELLDNTSLRLTADPSQYKNVVMVMPNLYGDIMSDLSSGLIGGLGLTPSGNMGNKVSIFEAVHGSAPDIAGKGLANPTALLLSSCMMLRHMSLNSDADRIENAVLKTIASGPENRTGDLKGTATTTRFTEEVIKNL

SEQ ID NO: 17319 - protein, 368 aa, Candida albicans
LNDLNIQGPEKYLDIAMEWATKYNLFIQIGIHGLPGSQNGFDNSGLYTETPTWLENELNMNLTYRLVDYILNTYGNHTTIHSIQLVNEPLGFLLNKEKLSNFYIYCLEKIIQKNIKAKLVLHDAFFNIESWKNFPGEFILDHHLYEVFSQWQIDLNLQQHLQSIKHQGRSIVKSGHRSIVGEFSGALTDCAKYLNGVGKGSRWDGSGDFEIIDRKPNDDKNRTCEGHDDPNNIMFKLETMDFLKEQFYTFEEKGNGWIFWCWKTESTLDWDMKRLNEFKMLPDPLFQYNSMNGNGVEENDGFGLLNIDFQDTIPKEFSEQESSEQKFDYNSNSTTTMTTSSPKKNGCSIINVGESWLWIIFVYYLLIF

SEQ ID NO: 17320 - protein, 277 aa, Candida albicans
QNRRKKKKRGQQQQQRLTSNQPYNYNNFLVLSIPVMLPPTLSSIPEVKEEYPGACLIERTARLPQFIKLGPPDLCNIHKYSVNAKRENEIGTFLYLTGVDTSNTASIAAHLQNIANLMTSKLQYWFGEKKHWKVPQLTYCTFNAFSKIDLRVTVHIPGKFEMQIIGQDGKLINDNFNDEQLDKLWSETFLTSIVRAVLESEDGDDVNKIGGLVEVRKINPFNNGITSKELLNNFLLAFELLFFEGVKLGCNVEIPQPTLINNYLVDGFIKVIQLTQS

SEQ ID NO: 17321 - protein, 140 aa, Candida albicans
LAKQAVKSSPLDFKTWAILVQIYTKLRDFENALLTLNSCPMNSHKEKYFLKRVVPIKSNDDLHLPSPTDVTLDQVSNLQSNEISYEQRNLDPSLVNLPAGNLKSTFAKAYDLLTEIVVKTGWESLLKYRAKVFVMEEEYR

SEQ ID NO: 17322 - protein, 310 aa, Candida albicans
DRQGSATGVNGSHTRKNSTTSTSTSNANGNGNGNGTEAQTPTNNPSTASATTASTTTPSDSDAASTVAIKSPCPSNDTEDTTSSTNVSYDDEFRKKRLCERWLDNLFMLLYEDLRAYTMWQAESLHFQAQQMEYKKTTLEWEILGSIAFRLKHFKEGSIAFANALSGRFSAKSQRELLKYYVMERSKLLSKNSSNQSTTFIHSYTKMMNQLNEKILESIIKLLVWNHRWYSDFSSFLLLTLSDLVAWEGSVKINSSVTALYNETKTTTTSSSSSTNNNSTDHISNHGIIEMMTDLDNDYIKLYNLHNADE

SEQ ID NO: 17323 - protein, 377 aa, Candida albicans
PTYLSSPCGEDPLISTAISSFVRLYRIDVANSVVWDEAHFGKFGSQYLKRQFYFDVHPPLGKLLIGLSGYLADYDGNFDFESSNVYPDNVNYVFMRIFNCFFGILVTPLAYKTAVILGYNQFTCWLIAFMVIFEQLSLTLSKFILLDSMLLFFTVLTMYCLVKVHTLAIARVGSNSKTPLTKLEIKWYILTGISIGCVCSVKWVGLFVTALVGFYTIVDLWIKFYQTFAIDKKSPKKMSVVNYLIHWVVRIFTLIIIPMTIYVATFKVHFMVLNHTGPDDGTLSTLLQGSLIGNDLQSGPRSVSFGSLVTIRSQGLSPNLIHSHPHNYPQGSQEQQVTTYGFKDDNNEFLFEFGVDAGLRNQHPTLENENSTRDGGE

SEQ ID NO: 17324 - protein, 377 aa, Candida albicans
RWWGMMMIITNVIIHDGDTVRINHKNTGSYLRANAVGAPITSSSYEVSCFGDVESNDWADEWVIEIQSQDQSPDPMFQDEDPLEIHSVSTSFRLKHKQLGCYLATTGKSYPAWGYQQGEVVCKYSVFSRDKNTWWNIEKHVNDKLPLPATEYVPPKPKFWKEFILLNYAMMASNNALIPDPDRFDKLSSEWWEWPILNTGLRMNSWGDADIKYFLLGNPLITWMSTIALIVCPLYLLVVGIKYQRQWILLSATDTSNANPANSQSLSLLAARALLPLAGWVLHYVPFILMGRVKYLHHYVPALYFAIFVAGFIVDAILNLDFSYHNNKFQYIFKVVIYSTLYLVICISFWYFKDLSFGMEGSSVDYRHLRLLCSWMI

SEQ ID NO: 17325 - protein, 644 aa, Candida albicans
IRTKILRNTPLNREEAYVRVGSHKLKPNQIPLLKENIHDLIFALNFGNKNQLRVFFTLSKVILDSGIPQQVGVLPVIGDDPMDLLLAEKFYWIAEKSSTQEALAILYKYFESNSPDEVDDLLDKVEVPEDYKVDYNHVLNKFSISTASVIFNGVIYDLRAPNWQIAMSKQISQDISLIKTFLRQGPIEGRLKDVLYSNAKSERNLRIIPLEPSDIIYKKIDKELINNSIAFKKLDKAQGVSGTFWLVSDFTKSEIITQLIDLLLLLKKKAIQIRIINTGDTDVFGKLKTKFKLTALTNGQIDEIIEILKKSNASSANNDELKKMLETKQLPAHHSFLLFNSRYFRLDGNFGYEELDQIIEFEVSQRLNLIPDIMEAYPDEFRSKKVSDFNLVLSGLDNMDWFDLVTSIVTKSFHVDEKRFIVDVNRFDFSSLDFSNSIDVTTYEENSPVDVLIILNPMDEYSQKLISLVNSITDFLFLNIRILLQPRVDLKEEIKIHKFYRGVYPQPTPKFDSNGKWIQHYSAQFESIPSNVTYSTELDVPHKWIVVPQLSSMDLNTINFSESHSVDAKYSLKNILIEGYARDIHTGKAPDGLIFRAFNKNYSTDTLVMTSLDYFQIKGYPSIFNFSTTSNDTLLSASAKQISG

SEQ ID NO: 17326 - protein, 361 aa, Candida albicans
  UNSURE (330),(345): Identity of amino acid sequences at the above locations are unknown.
LDFINFDLTNKKHTPRIAAHYDHYSDVLTKFGDRLKSECAKDSFGNAVETKNGQIQTWLLYNDKIYCSANDLFALRTDLSSHSTLLFDRIIGKSKDAPLVILYGNPTEELTKDFLKILYPDAKAGKLKFVWRYIPLGIKKLNSISGYGVSLKMEKYDYSGAEGNTKYDLSRDFTRINDSQELVLVIGKHSYELGVKLTSFILSNRYKTTKYDLLDTILTNFPKFIPYIARLPKLLNHEKVKSKVLGNEDIGLSQDSYGIYINGSPINPLELDIYNLGTRIKEELQTVKEFMKLGFDNVQAKLLIPKFALLSTVKQTQFRNGITLMGNNDXRSKVYDNEFKKGIHXRVGSCSFNNIESEQKF

SEQ ID NO: 17327 - protein, 502 aa, Candida albicans
KTGALPTGLAMTLDNSIVYSRPLSVSENFFRCRTASGNYRNFVVTATYNQSLKKKLYVLVKALRKTILEYPILATTVKFDKTVNAFAYVPLKTINLSDILFFEGDEKWLTNGVINENYMKYCNETQFKLYEENVLFKLILVGDFHLSAIFEHTIGDGLVANYFHEVLLKNLAECESIEDAAFETQFGPLVFENIKAEDEIFNFSKDKLYIKNSLPPPIDPFLEDIDLDYSFGDPHFQDKIIPEGFPSKWKGRFDTVDTHDISFKLINFSKQETKIILSKCKEHKVGITSYIEVVHALTLQPIFGDNSFTTHRTAMTLRRHYTPDLAEPPYKKILSDSEYKIFGTLAHMGFVQNFPPIKVFSWDLVKKVNLDLSKAVKNKRALNQMKLWKDTGDLLDEKNMAFFDTQYNKPKADAVKISNLGFIELPEYATKNDKKWVISDMVFSQDMAPYASEFMLSVVSTPIGGMNFVLSYYDYSFEDGNWENFDEFVTKLHDNMLRYASF

SEQ ID NO: 17328 - protein, 106 aa, Candida albicans
CLVCGIRDVRDTQCGFKMFNFEAVKNIFPHMHTERWIFDVEVLLLGEIQKFNMKELPVNWQEIDGSKVDLARDSIAMAIDLVVTRLAYLLGVYKLDECGRINKKEQ

SEQ ID NO: 17329 - protein, 228 aa, Candida albicans
DIIPIMIYYILAFFIFISLSIYATVIFFSHKPRKPFPSELTYKTNDSTDKSHPLPPRINTNSKFQDDGIDISLVIPCYNETQRLGKMLNEAIEYLEKNHQSKYEIIVVDDGSSDGTDEYALQKANEFKLPSHIMRVVQLKQNRGKGGAVTHGLLHSRGKYVLFADADGATLFPDVAKLVNYLANANGQPSIAIGSRAHMVNTDAVVKRSFIRNFLMYGLHALVFSVWY

SEQ ID NO: 17330 - protein, 131 aa, Candida albicans
LPPERGSFQRPCVKTINKMESNEIDTSKFHDAVAKMYSWNDIARRTENVYNSLDLDKLNESLLHRLQRYYCCGIIAGKLYALCVIVDIFIFVILEWLYPADHIDKATKWPLAIKEEDELEEETFIFPNKVN

SEQ ID NO: 17331 - protein, 71 aa, Candida albicans
NMGYNIAMVTDFFYPQPGGVEFHVYHLSQKLIELGHSVVIITHNYSSRNGVRVLTNGLKVYYSSPRAEIPL

SEQ ID NO: 17332 - protein, 117 aa, Candida albicans
  UNSURE (16): Identity of amino acid sequences at the above locations are unknown.
RAGLYDMAVLAHRGEXVLSYRSSVFPTVFLCFPILRNLFIRKNIEIIHGHGSFSTLCHEAILHGRTMGLITVFTDHSLFGFAEIGSIMGNKALKFTFSDVGHVICVSHTCKENTVFL

SEQ ID NO: 17333 - protein, 152 aa, Candida albicans
SIDPIKVSVIPNAVILKDFKPKSHCVNKNYTKEITIVVITRLFPNKGADLLTAVIPKICQLKPKVKFLIAGDGPKFLDLEQMREKYFLQERVTLICAIKPHELRDVMVQGDLYFTPSLTEAFGTVFVGNCLLWVICRPHQSWTHSPKSYQSK

SEQ ID NO: 17334 - protein, 297 aa, Candida albicans
  UNSURE (296): Identity of amino acid sequences at the above locations are unknown.
NFSKFFLHFNNMTIKQKVLFLEKPNVDDLKQFEVKFDCIYYTLSTLEQLLIDFRISLKDIEGIYCGWNGFGVFGGFRGKLLVHAPRHLKIVATCSVGYDAFDIEGLSERNIILTNVPSPFAFEAVADLALYNAITSFRNFKLYAENLNNNQYAHSGISRTSMLHGEFDQSSGKAIVEPVVGHTYGYACCKRDNLSPRGHNAVIVGFGHIGELIGRRLACIGMNIHYVKRTRLSESQEKSLGYEVTYHESLEETKDIADLIIIACPGTPSTRHMINKQLISNMEKPFRIINIGKKVXY

SEQ ID NO: 17335 - protein, 389 aa, Candida albicans [sequence omitted]

SEQ ID NO: 17336 - protein, 380 aa, Candida albicans
LCFNFLLHQQLHKKILNQQTSNKKKKNMSIDKSKMVTRLGKSGLKVNTVAIGTMRLGSNWMGYNGDIDECLKILKFCYDNGFRTFDTADVYSNGKSEELLGLFIKKYNIPRERIVILTKCYFPVNDSDDKNWEDFDPVDSLNGKGLSRKHILAAVEDSVKRLGTYIDVLQIHRLDHEVTYEEIMHSLNDVVEKGLTRYIGASSMKAWEFVELQNVAKANGWHQFISMQSHYSLLYREDDRELNDYCKKNGVGLIPWSPNSGGVLCRPFDSEKTQKFFENKDWASVFGLGEPREADKTIVNRVEELSVKYNATMMQISLAWCIAKGVIPIAGVSKFEQAEELVGIFNVNLTEKDIKYLDEPYHAQRISQKNLIKKTFNIIF

SEQ ID NO: 17337 - protein, 69 aa, Candida albicans
RIECEIQCIYDASVIGHGVLLKGVIPIADVSKFEQAEELVGIFKVNLTEDDIKYLEEPYHAKDLARVAA

SEQ ID NO: 17338 - protein, 288 aa, Candida albicans
FLIPPDAYSNGKSEELLGLFIKKYDIPRERIVILTKCYFPVKDTTEEGMGEVDEVDFMNGKGLSRKHILAAAEASVKRLGTYIDVLQIHRLDRDVTYEEIMHSLNDVVEKGWARYIGASSMKAWEFIELQNVAKANGWHQFISMQSHYSLLYREDDRELNDYCKKHGIGLMPWSPNAGGVLCRPFDSDKNKKFFENKQWASIYGLDNVNDNDKAIVNRVEELSIKYNVSMMHVSLAWCIAKGVVPIAGVSKLAHAEDLVGIYKVNLTEEDIKYLDEPYHAKDLAPLIE

SEQ ID NO: 17339 - protein, 357 aa, Candida albicans
FTSDPWPGPVGEDMSIDKSKMVTRFGKSGLKVNTVAVGVMKLGSTWMGSNGDIDECLKILKFCYDNGFRTFDTADVYSNGKSEELLGLFIKKYNIPRERIVILTKCYFPVREAAEDGLGEVDVVDFMNDKGLSRKHILAAAEASTKRLGTYIDVLQIHRLDHGVTYEEIMQSLNDVVEKGWARYIGASSMKTWEFIELQNVAKANGWHQFISMQSHYSLLYREDDRELNDYCKKHGIGLMPWSPNAGGVLCRPFDSDKNKKFFENKQWASIYGLDNVNDNDKAIVNRVEELSIKYNVSMMHVSLAWCIAKGVVPIAGVSKFEQAEDLVGIYKVNLTEEDIKYLDEPYHAKDLAPLLD

SEQ ID NO: 17340 - protein, 222 aa, Candida albicans
IIITNNHKKIQTSNQNMSIDKSKLVTRLGKSGLKVNTSAIGTMRLGSSWMGFNGDIDECLKILKFCYDNGFRTFDTADAYSNGKSEELLGLFIKKYDIPRERIVILTKCYFPVKDTTEEGMGEVDEVDFMNGKGLSRKHILAAAEASVKRLGTYIDVLQIHRLDRDVTYEEIMHSLNDVVEKGWARYIGASSMKTWEFIELQNVAKANGRIIFTTSGRSAAM

SEQ ID NO: 17341 - protein, 366 aa, Candida albicans
FQISSLKTTTNNYNLTLTKKKNMSIDKSKMVTRLGKSGLKVNTVAVGTMRLGSSWRGFNGDIDECLKILKFCYDNGFRTFDTADTYSNGKSEELLGLFIKKYNIPRERIVILTKCYFSVKDDAEDSSLEIDPIDYMNGKGLSRKHILAAAEASVKRLGTYIDVLQIHRLDHEVTYEEVMRSLNDVVEQGLARYIGASSMKTWEFVELQNVAKANGWHQFISMQSHYSLLYREDERELNDYCKKNSIGLIPWSPNGGGVLCRPFDSEKTKQFLDNKQWSSLFGLENVRDADKIIVDRVKELSVKYNASMMQVSLAWCISKGVIPIAGVSKFEQAEELVGIFKVNLTEDDIKYLEEPYHAKDLARVAA

SEQ ID NO: 17342 - protein, 353 aa, Candida albicans
QTSNKRKKNMSIDKSKMVTRLGKSGLKVNTVAVGVMRLGSNWMGYNGDIDECLKILKFCYDNGFRTFDTADVYSNGKSEELLGLFIKKYNIPRERIVILTKCYFPVKDSTEEGWGDVDEVDFMNGKGLSRKHILAAAEASVKRLGTYIDVLQIHRLDHEVTYEEIMHSLNDVVEKGWARYIGASSMKAWEFVELQNVAKANGWHQFISMQSHYSLLYREDDRELNDYCKKHGIGLIPWSPNSSGVLCRPFDSEKTQKFLENKQWASVFGLDNAGKMENTIVDRVEELSVKYNATMMQISLAWCIAKGVIPIAGVSKFEQAEELVGIYNVNLTEEDIKYLDEPYHAKDLAKEVN

SEQ ID NO: 17343 - protein, 366 aa, Candida albicans
ITPFTSHYQSIQLSIAVMSIEIKYSNLGESGLKISPLIVGCLTFGSKQWAEWVIEDEDEVFTILKKCYDAGLRTFDTADSYSNGKSEELLGKFIKKFNIPRDRIVILSKVYYSVEPNTGRYSLADTSGFKEMDYANSKGLSRKHIFDAVEASVKRLGTYLDVFQIHRLDEETPKKEIMRTLNDVVDQGLARYIGASSMRAVDFAQLQFIAEQNGWHKFISMQNYYNLIYREEEREMIPFCQTNYLSKVGIIPWSPLAKGVLARSLGAVSKNSREKLDQERFKILGLDALSEADQEIIQRVEKVAKDHNVSMAVVATAWVIGKGFNPIVGLSSVKRVDDILQALKFKLTKEEEKFLEEPYVPKNVTA

SEQ ID NO: 17344 - protein, 98 aa, Candida albicans
SRIGKIYWCFIYEEFAQLQFIAQLQFIAEQNHWHKFISMQNYYNLIHREEEREMIPFCKDNFISKVGIIPWSPIARGVLTRPVDTSSENSRDKLDKTF

SEQ ID NO: 17345 - protein, 245 aa, Candida albicans
VLTIIQKYFIQSFVIGKVIHTTYHYHFTSISIMSIELKYNNLGESGLKIAPIIVGCMSYGDKRWAQWVLEDEEKIFQILKRCYDVGLRTFDTADVYSNGKSEELIGKFIKKFNIPRDRIVILSKVFFPVDPQTPGFSLATRDNFPVLDYYNSQGLSRKHVLQAVQNSVERLGTYIDVLQIHRLDKDTPKKEIMKTLNDVVDQGLARYIGASSMKNLLNYNLLLNYNLLLNKIIGINSLVCKIIII

SEQ ID NO: 17346 - protein, 266 aa, Candida albicans
NIYFSLPLSNDKCLKILKFCYDNGFRTFDTADTYSNGKSEELLGLFIKKYNIPRERIVILTKCYFSVKDDAEDSSLEIDPIDYMNGKGLSRKHILAAAEASVKRLGTYIDVLQIHRLDHEVTYEEVMRSLNDVVEQGLARYIGASSMKTWEFVELQNVAKANGWHQFISMQSHYSLLYREDERELNDYCKKNGIGLIPWSPNGGGVLCRPFDSEKTKQFLDNKQWSSVCGLENVRDADKIIVDRVEELSVKYNASMMQVSLGMVYC

SEQ ID NO: 17347 - protein, 1101 aa, Candida albicans
HHSTPLNLHGYSAKWVFELHAINMAANSSFFLADNCAPHNQSFIQFCIHAASKKKGRIALMCLANLFLLFSFHLLYARFCSGFPYVVPSTARSTNQIFHTNLEQLVNSPENKQIFSQLKFSDQAFYDPHDNVVGTTEFPVFNQYQRQPYVANGYIGSRIPNLGQGFTYDQLTNSLTANDDDLLNGWPLFNKRYSGAFVAGFYDLQKNTTGTNFAELLENGYESVIAAVPQWTALSLSVEILGKKYTLDPSLEHEAIGDITNYVQNMSLSDGIVTTQFTWLNTFDVKYEILAHRENINLGLVNMQVYNPGNESVQVIVSDVLDFNSSQRCQLNQISHDKNGIYVTFHPQGLSYIDGAIYSTLSANGQITREQTNETVFQNVELTIEPHSCVQVAKYVGIATTDLDPDSFKTADDVLKFARKVSQNKKHGDATQLVNSHRLAWSKIIQDAPLVTFPSDSLLNLGARASIFHLLANTRPNAEGVTGALGVSGLSSDSYGGMVFWDTDLWMLNGILPFAPDHIKSFINYRVHLHQQAIDNVPRGYQGAVYPWTSGRFGNCTGTGPCLDYEYHINMAVAMASWQLYISGAADDTFLESVAYPIINDAASFLAEYVVHYNDTLGKYTTKNLTDPDEFANHVDNGAYTNTGIVLVMRWAQIAGSILGKQVPKIYHDIETAMFLPTAENTQNITLEYSGMNSSVGIKQADVIMMTYPLENELIDQDQAYINMEFYSMKQVGYGPAMTFPIFSIVASNLAFTGCASQSYLHKAIQPFLRGPFAQFAEQNNDDYLTNGGTHPAFPFLTAHGGFLQAILQGLTGMRFDYTFENNKLQRLLKLDPIALPCLGEGVRFDSIKYDNHTLSMAINETHFTIKNKGKTTPNARNYVTILLAERNAMHGKYTINDEDEQSFPLFETSESFPDSISECNKAGFFNITEGAYGDVSILINDGDNTTSWQAKYNDTTGKVLVDLKSFRNISSGTFIWGDKPPKRVKVSKYSGSSFTAVTDFFAQVDFGNELFNEYKYANPEGKLHNQSDVFEEVYSGDVKISAPFDPEEYFQVWVPTRHNITEVAVNLQTRFLLIEVDEIHNTEAIDGDYGGAKLAEVVFY

SEQ ID NO: 17348 - protein, 681 aa, Candida albicans
LLSKMPSLDELTISTIRGLSVDAVSAANSGHPGAPLGLAPAAHVVWQKMKFNPKDPNWINRDRFVLSNGHACALLYSLLVLYKFELTVDDLKQFRQLGSKTPGHPEATDTAGVEVTTGPLGQGISNAVGIAIAQKQFAATYNKPDITLSDSYVYTFVGDGCLMEGVSSETSSLAGHLQLNNLIAFWDDNRISIDGDTAVSFTENVPDRYRAYGWNVLEVPDANTNIEAIAAAVDEAKKSTDKPTLIRLVTTIGYGSLKQGSHDVHGSPLKPDDIKQLKKSWGFKEDVDFFIPEEVSEYLAKHVSENQKVQKEWEAKLAEYKKKYPTEGAEIQRRLDGKLPEGWKEYLPKYTPADKPLATRKLSENVINALHGKIPEFIGGSADLTGSNLTRAEGSVDFQPPSTGLGNYDGVYIRYGVREHGMGAIMNGIAAFGANYKNYGGTFLNFVSYAAGALRLSALSHHPVIWVATHDSIGLGEDGPTHQPIETLAHFRAIPNLSVWRPADGNEVSAAYAAAIESTSHPSVIALTRQNLPQLEGSSIENALKGGYTLVKKDNPDVIIVSSGSEVSISVAASEELAKQGVKANVVSLPDFFTFDQQSDEYRLSVLPDGVPILSVEVMSTFGWSKYSHEQFGLNRFGASGKAADLYKYFEFTPEGIAERAQKTIKYYEGKQLLSPLDRAF

SEQ ID NO: 17349 - protein, 317 aa, Candida albicans
RLLDNEKDRSSCLLNSNINNIKVDVPYDYDRYPKIIGRVSSSNSLNNTSNTAPYQSETPSISSNSFNKNVNNTLNGSYNNIIDFSPFGGYPASSFPLNIDEKEPDDYLHNPDPVHDVIYEKNRFWNDLKTADRKSFGGILGFLFLIAAAVAVFVVVPALTYSGVTTHSPPQEYEILSHYSYPLLSAIRTSLIDPDTPQDALKMKAKDGSNWSLVFSDEFNIMGRTFYEGDDQFWTAPDLHYDATKDLEWYDPDAATTSNGTLNLQMDAFKNHDLFYRSGMVQSWNQLCFTQGKLVISARLANKGTVSIFTTRGGHPR

SEQ ID NO: 17350 - protein, 120 aa, Candida albicans
  UNSURE (104),(107),(111),(118): Identity of amino acid sequences at the above locations are unknown.
RQNWYELGGNGVHNFQTYGYEYLNDKDNGYLRWFVGDNPTLTVYPQALHPNGNVGWRPLSREPMSIVMNLGVSNNWAYIDWPSLSFPSTFRIDYVRLYQPPNHXFFXHALXGKFGFGXNP

SEQ ID NO: 17351 - protein, 96 aa, Candida albicans
VGWRKLPKEPLSLILNFGISNNWAYIDWPSLVFPSTMRVDYVRVYQPKDQINVGCDPTDFPTYDYIQQHLNVYQNVNLTKFEDGGYTFPKHKLIGC

SEQ ID NO: 17352 - protein, 625 aa, Candida albicans
CIIMSSDSSNISGLISSSSTSNDNDNDTTTTTTAPVINEESGSSTSGLQQNFTIKSHSRYFSPQRNITTKKFNYLDNPFYYMDKEFELHHHGQQDEDPSYVTSRNGQINNNNTTGDGNSSKKKKKSGGKWQWQWQWQWRFKRIDLKKSFRFIIAIVTILVIFVLAIIFAIMSSFIINNPIRNGDKIEKLTNINYAQLKSIRTNLIDPDTPTEFYNLNKTNETEVIGENGDWILVFSDEFELDGRTFHEGDDQFFTAVELYYGATHDLEYYLPQMITTNNSNLEILFDKFNYSSGLEYVSGMLQTWNKLCFNKHVKIEIKAKLPYEIKNGLWPAIWSLGNLARPGFLATTDGIWPYTYNECDLGILPNQSTLNEEMSYLPGQRLSKCVCQGGDHPNHGTGRGAPEIDIIEGLFQYDKFWGVQTLQVAPFDEWWRPDYDYVEIIDDNVTIIREDIGTVYQESISLGTLIDDEFPFQIFTMEYKSDSNTNNNSYIKFSINDITTFVINGSALHPNEFIGWREITKEPMSIILNMGLSYMWNPRVNIDELKLPAKFLIDYIRIYQPNNMIEMTCDPIDYPTDEYIRSHSIAYENPNLTSWYQAGFDFPKNSLSHQCKIPWSATNGRVTT

SEQ ID NO: 17353 - protein, 743 aa, Candida albicans
DLKMASQRDLTSNNPHFHISSSRNNTNDDFNSDHNPRNPFGDEPEEEEELDSASFSSSSQNNQPHHPFATSNQTLSTNNLHSTNSIRNEAEYGKPFQAYSGYYSNGGSSLYLNQEGVISDESRLLSSGNNNNNNNNNRDVSSVGGGGGSGDNRLNPTSPAEFDRYPSMAGSRVVSSTSLVSFNNPSNMMRNHHRHQPHLGSSSSPISSSMNNDSISDKSTSPFPNDFSPFGGYPASSFPLSIDEKEPDDYLHNPDPVQDAEYEKNRFMHDLKNMDKRSLGGLIGFIILFIAALAVFIILPALTYSGATNPYHPESYEVLTKYLYPMLSAIRMNLVDPDTPESAYKKKAKDGSEWVLVFSDEFDAEGRTFYEGDDQFFTAPDIHYDATKDLEWYDPDAVTTANGTLNLRMDAYKNHNLFYRSGMVQSWNQLCYTQGHLEILARLPNYGNVTGLWPGLWSMGNLGRPGYLGSTDGVWPYSYDSCDAGITPNQSSPDGISYLPGQRLNKCTCPGELHPNRGVGRGAPEIDVIEGEVMTDSSGKKENCGVASQSLQLAPMDIWYIPDYNWVEIYNFSVSTMNTYTGGPFQQALSATTMLNVTWYEFGDNAHNFQTYGYEYLNDPETGYLRWFVGDDPTLTVYSQALHPDGNIGWRPLSKEPMSLILNLGISNNWAYIDWPSISFPVTFRIDYVRVYQPPDQINVGCDPTDFPTYDYIQQHLNLYENANITSFEDGGYKFPKNSLIGC

SEQ ID NO: 17354 - protein, 368 aa, Candida albicans
GDFPKSWLRRANPKLAALIAEKLEDPNYDYLTNLGKLKKLEAFVDDYEFLKRWDAIKFDNKRRLATLIKETTDVDVDPTVLFDVQVKRIHEYKRQQLNIFAVIYRYLHIKELLSKGVSIEEIKTKHHIPKASIFGGKAAPGYYMAKTIIHLINKVGDVINNDPEIGNLLKVVFIPDYNVSKAEIICPGSDLSNHISTAGTEASGTSNMKFALNGGLIIGTVDGANVEITREIGEENIFLFGNLAESVEEIRHRHVYEGVKVPESLQKVFHAIESGDFGSPEEFKPLIESIRDHGDYYLVTDDFDLFLEAHKKLEKVYGHHGGDEHDKSHMNEWVKKSVLSVANMGFFSSDRCIDEYAENIWNVEPSNV

SEQ ID NO: 17355 - protein, 475 aa, Candida albicans
ETSLGRSMYNCDNLAAYQAASNTIRDALVIDWANTQQRQTIQDGKRVYYLSLEFLMGRAMDNALINLNSEQNTQKSLSDLGFNLEDVLDQEPDAALGNGGLGRLAACFVDSLSSKNYSGWGYGLNYQYGIFKQKIIDGYQIETPDYWLNYSNPWVIDRNEIQIPVDFYGYVYEEHDPNTGKVKKNWNGGERVLAVAADFPIPGFNTTNTNNLRLWNAKPTTEFDFSKFNAGDYQQSVAAQQRAESITSVLYPNDNFEKGKELRLKQQYFWVAASLHDIVRRFKKNHKSNWQKFPDQVAIQLNDTHPTLAVVELQRILVDLEGLDWDEAWSIVTKVFAYTNHTVMAEALEKWPVDLVGRLLPRHLEIIYDINYFFLKNVEHRYPNDRDLLRRVSIIEESPKSVRMAYLAIVGSHKVNGVAELHSELIKTTIFKDFVKVFGPDKFTNVTNGITPRRWLRQAHPELAFLICHKGRIPV

SEQ ID NO: 17356 - protein, 66 aa, Candida albicans
  UNSURE (41): Identity of amino acid sequences at the above locations are unknown.
RHISFDHIIWLLLWGIANEAARLREIRQMSDGIKVDTNFVXNLALTSVQMVGYMLYTSLVPDIQVP

SEQ ID NO: 17357 - protein, 420 aa, Candida albicans
TLKHGLIPNLLDAGRNPRYNARDAAWFFLQAIQEYVTYAPNGIDILDEKVTRRFPLDDTYIPVDDPQAFSYESSIREIIYEILSRHAKGIKYREANAGPNLDSQMRDEGFNVEVGVDWTNGLIYGGNQFNCGTWMDKMGESEKAHNKGIPGTPRDGSAIEIQGLLKSALRFVNKLHKQGKFEYTKVTKPDGSTISLEDWESLLAENFEKHYYVPKDPQQDDQYVIDPSIVNRRGIYKDLYNSGKPFEDYQLRPNFAIAMCVAPELFTPEKALGAIIIADKAIRGPIGMRTLDPSDWNYRPYYENSIDNDDFATSKGRNYHQGPEWVWNTGYFLRAFLLFHHLEEESSKASSSLPSIKILTLLNDRLPGHIKWITESPWNGLTELTNKDGSYCQESSPTQAWSGNCLLDLYYDLWNDKHFQ

SEQ ID NO: 17358 - protein, 319 aa, Candida albicans
GSYFWGELCQYEIGEAFEDSPETWKGMIEYIQLSAKTFNGFRIDNCHSTPLHVGERLLDEARKVNPNLYVIAELFSGSEEMDKIFVERLGINSLIREAMQAWSVGELSRLVHKHGGRPIGSLTWLPLDDFTYPAANEPVKDKFIDGYTELEIPKVLTCQAPHAIFMDCTHDNEMPAQKRTVEDTLPNAALVAFCSSAIGSVFGYDECYPKLLNVVSETRHYDLDSDNGIGKVKAKLNKIRDDLVQESEDVTRDHEMYIHHEGQYITIQRYNARTGNGWFLIARSKFSDHESAQGLSPSILGGTKVKHRLHPPGAGRSSA

SEQ ID NO: 17359 - protein, 256 aa, Candida albicans
IMALEFDSKHWIWMGHFLEFSHSLQELGLPTVVESEADLQKFMDGIQTHVLDKLKLWEYYVFNKRQTIVDLEKSFNDNKNNINKIQIPNDVDSQDLKQLSDYVLKVANINPTPIIGDRFANKLNVDKFLGVLFTVFDNNVEFETIANRAEEIIDEINSDLYAAFDDDTNSIKQQVADRIKYLRLADNGPKLGEITDKSPLTEPYFTRFTDVNGKKQALANNGWIWGGNPLVDFASNKSKAYNLEEVIFGVNCVNMR

SEQ ID NO: 17360 - protein, 298 aa, Candida albicans
YTPHHIHIFSFQFSKFTIILLKFILRIKFQHPLIKTGTILFFSFHCIFFFLLKYITISILHFVCISNSFVFSNKNSTKTMSEARTVLFRLSNLGEPVNNENIANGVLILPVVELPSNYKPGDALFQLRFQLNAASKVSRNVTLYTNVPSKYEQDFDRNTHYQYPIKSSFHEDITITVPIYKPGSYNYYIEYDDEEDNKKTTEKYYFNVPPNLTINGKFVPFNNINVETVVSKWIGPYENWDKFFKIVAQKGYNMIHFTPLQERGESDSPYSIYDQLKFDPKILPWPVIKMLYKKSIKC

SEQ ID NO: 17361 - protein, 177 aa, Candida albicans
WGICHPEVKTTKVKHQFSYSLIRQPGDYESQQDKLTGIPVQVEAIQSPSIEYTDDGDSIITIDEASFIPGSIAVFSTEIPGVDVKLDNFVKQGAIEASIGLDLYDLNALLYRASTEELDASNGKDDVYDIPGYGRLTYAGLEGWNTALKHVIWQNNLGHAICDHLRNGDWAFDYVVN

SEQ ID NO: 17362 - protein, 726 aa, Candida albicans
YVNHLNIYYSSISIFFPIFGCALVFHFLNFFFCLFSPSPHTALLLVSPICGIESHHFGINKHFNQFFFFNHQTMLEVDTDDTQELLATNAASGSSTTTGAPRFEVLSSLSQSHQEKSSTKYKKISEFVKINVLGHPNNFEEYVLRNEASDCSLIAKYCKTTTIDLSTQPTLSIDSISLNTIHIPHPLINFMKNEANQQLSPDDQVDVSNELQESPIVVFLHGLGGQMSQFEPLMGLLSQCLEILSLDLPGFGNSKLQFEEGFKFISEISDSDKSKISSSIQKMNWDDFSTDNIVRIVYEFISQNVPLSKKIVLIGHSMGTHISIKLAKKLPQSKVEGLILLSPPALTDYINTNEQNTKNTHNLLSLFTVFTYFPWLFNSFRTWDRLEGLDSASVVRQLSKTNNSIYNKLRQFRWNLDVNSDIVLKYASGFQRATYSDLISAISRFNDNPEDKQVYEKTVFICGNNDQMTPVSTIYKCDEFLTSNFGRKVSAAIEVKGVGHSLLLLKPEFISGIILNHIELKFPERLHLSPAWVLKIKAKVSGDKWGLKNEQKWLNIQSVSYNITRNRGKDIAPLLGMKTLRESDPIHSPSILEKQFYGDNSSNQIKGNLIAIIDISADIPPYSPKSFEKIKYYKCATVSKVVPDQSAIRRFIQLVNDILHENTVANPLIAVHCHYGFNRTGFLICCYLIEVLGWSVEEAVEGFKIAKQPGIKHPHFIDALYVRYEK

SEQ ID NO: 17363 - protein, 86 aa, Candida albicans
VHRGFHDYYTRTLSIIHPYIMEELNNCIEDDNYELIILGHSLGGSIAYLLGLHYLDLGFDKLTLVTMGQPLLGNENFISWGGGAKV

SEQ ID NO: 17364 - protein, 363 aa, Candida albicans
NKRKTIWFFFFLVAWLFVCLFVFNLFNLLLMLILIIIVLYCLSFAQEYKTDNEPAQDYKKIVQFSNLAAVAYCVGRGLSKGRLGDKGSGCHLSACKNDILKDVEIVKIFDFSTLNEVGTGYYALDKKRKTIILVFRGSVSKRDWATDIDFIPTKYRPIVQDDNFECEVFIQQECINCKVHRGFYNFLKDNSGAIISLGIKFKKIYPDYQFLIIGHSLGAAFTTLSGIEFQLLGYDPLVVTYGGPKVGNQEFADFTDRLFDTEEVANCITMKNDFSRGFIRVVHKHDIIPFLPPMFTHAGYEYFIDKKQLPHEECDIDRRGMEYSGLLWKRSSGIRPSTFWPDSLGKYEHTHYFRRITSCRDED

SEQ ID NO: 17365 - protein, 432 aa, Candida albicans
TTTTPNSIIMPVHEEISLISTLFNVSLLILKIIFLYISSLLGVDSFITTGDVPISKSSSNQPDNNHLKTRLVNAKDINEIVETHGYKIREHVVTTRDGYLLVIHKLEKIQNNSYSHHHRHISSTANLSKIAYFHHGLMTNSELFVLGTNKYKTLPYLLVDLGYEVWLGNNRGNKYSRKHLKLSASDPKFWDFSLDEYSYYDIPDSLTYIKNYYHHINNNTSNNNNNNHTGSPTVLSSSTSTLTNSDLQIIYIGFSQGCSQFFASLSLYPQLNSHIKMFIGLSPAIIPQNLNHPIFKLLVNQAANDNSFLFSLFGRRAIMPSVSFWYTIFGPSLYEKVVDKSLQLLFGWTGANISQSQKEIGYPHMFSNSSVKSLLHWFQIIKAGRFQMFEDTCCNGITKLSCLSHKLKQNGNKLSPFPISDHLNVPMVLFHG

SEQ ID NO: 17366 - protein, 551 aa, Candida albicans
IIQQTFKYYTTMTIPLIGRLSLLDWPLIIISFTLAWVEFIISLITTLLPSKFIDFCTFVTKQVYKFTPNPITLIIKQKKIDINDEENIKYLYIKSDIPKFTKKSYDLTIELLNSENIEQMVSLFGYEIESRIVRTQDDYLLTIHRIKGKNRPSNGKVIYLHHGLLMCSEIWVTMIDKYQNLPFILYDLGYDVWLGNNRGNKYSQKHLFYNLNSTKYWDFSIDEFALFDIPDTIDYILQTTKKSKLTYIGFSQGSAQAFASVSVNSDLTDKIDQLIAISPATTPHGLYSKFLDILLKSSPNVIYLLFSRRVLMPSCIFWERIMYPPLFDNMIDIANYLLFNWRATNITKLQKLSSYAHLYSTTSVKCVVHWFQVMSSKNFQMYHDSNSNLSGLKPISYPLKNIQVPIRLIYGTTDSLVDIDVMKSQLPKLTTKAYPVENHEHLDNLWGNDVYEVVFKKVLRFLGEDTDKVYARLFRQSEDTKFIEDIIQTDESFTVDDGETLNNSSGNVNQSYLKSAGNARSASNSGNIQVESDIVIDYERQQSIGGTSIFL

SEQ ID NO: 17367 - protein, 60 aa, Candida albicans
LVTKTFARLIYNDYVSNPSKFADLIDDTTRSTIERLIYDESLTDKILEKTFVGFAPVLTN

SEQ ID NO: 17368 - protein, 275 aa, Candida albicans
  UNSURE (220): Identity of amino acid sequences at the above locations are unknown.
EASLLICFPSKHIFQSDLKLHMVMTNSPQNIGIKGIEVYIPGQAVNQSDLEKFDGIPQGKYTIGLGQTNMAFVNDREDIYSISLTVLSRLIKNYSIDTNKIGRLEVGTETLLDKSKSVKSVLMQLFPGNNDIEGIDTVNACYGGTSSVINAINWIESSSWDGRDAIVVAGDIAIYDKGAARPTGGVGAIALLIGPDAPIVFDSIRGSFMEHAYDFYKPDXTSEYPVVDGHFSLSCYVKAVDNCYKNYSKKITGDANKTVGVYDHFDFSAFHVPTC

SEQ ID NO: 17369 - protein, 107 aa, Candida albicans
YYVGSDNLKNKRISIFSYGSGLASTLLSVTVKGDVSAITKVLDFDYKLGDGRKIQSPEDYLAAIELREKAHLQKSFKPQGSTDNLSQGTYYLTEIDDKFRRAYAIKE

SEQ ID NO: 17370 - protein, 413 aa, Candida albicans
NLMKHFEIVITGRPVPFLVDLPKDVTASILRESIPINSTLPSNALSQITKKAVSEFTSEAIKRAANILNKAKKPIIYAGAGILNNEQGPKLLKELADKANIPVTTTLQGLGAFDQRDPKSLDMLGMHGSAAANTAIQNADCIIALGARFDDRVTGNISKFAPEAKLAASEGRGGILHFEISPKNINKVVEATEAIEGDVTANLQSFIPLVDSIENRPEWFNKINEWKKKYPYSYQLETPGSLIKPQTLIKEISDQAQTYNKEVIVTTGVGQHQMWAAQHFTWTQPRTMITSGGLGTMGYGLPAAIGAQVAKPDAIVIDIDGDASFNMTLTELSSAVQAGAPIKVCVLNNEEQGMVTQWQSLFYEHRYSHTHQSNPDFMKLAESMNVKGIRITNQQELKSGVKEFLDATEPVLL

SEQ ID NO: 17371 - protein, 267 aa, Candida albicans
IISNSLFFFLFYFFFFFFLLYRFKLLIQTNMISRNLRTSSTKTFYGSILRSQIRSISKNNSQQATAQSTSRPQPSPAFNTADTSTQPIINDPTLNKHKSSAISRKKKEQLMDDSFIGLTGGEIFHEMMLRHKVDTVFGYAGGAILPVFDAIYNSDKFKFVLPRHEQGAGHMAEGYARASGKPGVVLVTSGPGATNVITPMADALMDGVPLVVFSGQVPTTAIGTDAFQEADIVGISRSCTKWNVMVKNVAELPRRINEAFEIATTGR

SEQ ID NO: 17372 - protein, 129 aa, Candida albicans
FQLAYYFELHVGGIKARTFHNNHNLKFNDLVNDKLMQVLSKTHNTVYIESFAVLEAYRGLGIGKKLLNYLIEETKKRFIHEIIIHVSVANHEAISWYKKQGFLQGELVPDYYKDQGLESPEAYIFTIAV

SEQ ID NO: 17373 - protein, 231 aa, Candida albicans
SRVLPAPWAETGWTHQETTYLNYRLIKFHLIVIISYQSIQNLVYNWRTFFFSQMSLITTINGLPYHQFDINNQDEFKQISNLISLHLSEPYSIYVYWYFLNNWPQYCYTVKEPETKKVIGVIISKIEPHRNVRMRGYIGMLVIDPKYRKQRLASNLVKLTIENMKSIDKVDEIMLETEVINQGALNLYESVGFLRTKRLYRYYLNTHDAYRLILPLGEKSRTRIAFLPPLE

SEQ ID NO: 17374 - protein, 530 aa, Candida albicans
LGLQHVREKFFFINFFLVLSPPCNHIYTNSYWTVQKVESFSHCLVFQFFFSFLFFTPIFFLFFNCFLIQFVSIYQTMLRARSVLSGSVSRRALATQAFNFSVPPEYQSRTPPYSKLINNLSTVKKILKNQPLTLAEKILYSHLCNPEESLTSSNVSDIRGQQYLKLHPDRVAMQDASAQMALLQFMTCGMSSTAVPASIHCDHLIVGKDGAEEDLVKSIATNKEVFDFLQSCGEKYGIQFWGPGSGIIHQIVLENFAAPGLMMLGTDSHTPNAGGLGAIAIGVGGANAVDALTGTPWELKAPKILGVKLTGKLSGWSSPKDVITTLAGILTVRGSTGYIVEYFGDGVKTLSCTGMATICNMGAEIGATTSTFPYQEAHKRYLIDTHRAPIAEAADSVNSEFKFLQADEGAEYDKVIEINLSELEPHVNGPFTPDLSTPISKFGETAQKECWPETVSAGLIGSCTNSSYQDMSRAVSIIKQAEAVGLKPKIPFFVTPGSEQIRAPIERDGLINTFESNGAIMLANACGTCI

SEQ ID NO: 17375 - protein, 112 aa, Candida albicans
NQKEKKKVYIKYSFSLFLSNPVYLTMLRLSRNFKAVAPLRTFITSTINFQNTRIESDAFGEIEVPTDKYYGAQTARSKLNFKIGGEAARMPVPVVRAFGILQKSAGFQTAGR

SEQ ID NO: 17376 - protein, 151 aa, Candida albicans
NEPGSLIMPGKVNPTQCEAMTMVCAQVMGNNTTITFSGALGQFELNVFKPVMAYNLLNSIRLLGDACQSFRLHCVESIKANKEKIDKVLNESLMLVTALNPKIGYDNASKAAKNAHKKGITLKESCLELELLTSEEFDEWVRPEKMIGPKD

SEQ ID NO: 17377 - protein, 291 aa, Candida albicans
NMSRIESDAFGEISVPADKYWGAQTQRSLGNFEIGDIKMPIPIIKAFGTLKKAAAIVNEKMGSLDPKLSSAIQEAASEVIEGKFNDNFPLVVYQTGSGTQSNMNANEVISNRAIEILGGEKGSKKPVHPNDHCNMSQSSNDTFPTVMHIAAVSEVEQQLLPKLTALRDAFEAKSKEFSDIIKIGRTHLQDATPLTLGQEFSGYVQQLTFGIERIKLTLPRLSNLAQGGTAVGTGLNTKKGFDVKIAEEISNLTGLQFHTAPNKFEALAAHDAIVETFFQPRVLEGPTLRCN

SEQ ID NO: 17378 - protein, 198 aa, Candida albicans
  UNSURE (9),(10): Identity of amino acid sequences at the above locations are unknown.
LGSGCSVVXXTAGALNTVAASLFKIANDIRYLGSGPRCGYGELSLPSNEPGSSIMPGKVNPTQNEALTMVATQVFGNNAAITFAGASGQFELNVFKPVMIANLLSSIRLIADGAASFRVHCVDGIEANTDKIDKLLHESLMLVTALNPKIGYDAASKVAKNAHKKGITLKESCLELGALSSEEFDQWVRPENMIGPKD

SEQ ID NO: 17379 - protein, 301 aa, Candida albicans
HIRRKKKTNKQKKNSPSLTFPFLSLFNHSIIRPFNPLIMFRSILHQQKAVQFSVRSLATAAAEKAPRLKKFQIYRWNPDTPEVQPKMQTYEVDLNKCGPMVLDALLKIKNEQDATLTLRRSCREGICGSCAMNIGGRNTLACLCRIDQDESKDLKVYPLPHMFVVRDLVPDLTHFYKQYKSIEPYLQRESNPADGREHLQSIVDRAKLDGLYECILCACCSISCPSYWWNQQQYLGPAVLMQAYRWLIDSRDQATANRKAMLQNSMSLYRCHTIMNCARTCPKGLNPGKAIAEIKKQLAFD

SEQ ID NO: 17380 - protein, 155 aa, Candida albicans
FTHSTHSPYTLTHSNNYINPKKKNLHYTNNKEPIVQSNKPSFPLACHNNMISRIGLLKRPTVSTLNNYVKLQSTLALKRYTSTVPATSNQEQEILVAQRKNRPTSPHLQIYEPQLTWIMSSFHRITGVAMAGAFYALTCGFAATSILNIPFDTTN

SEQ ID NO: 17381 - protein, 255 aa, Candida albicans
INDFLMELLMIINACRVATATRIIAVIPSFPYATLDFNDKSRAPITAKLVANLIQTAGCDHVITMDLHASQIQGFFRVPVDNLYAEPSVLRYIKENYKQSDIIMVSPDAGGAKRVASLADKLDIQFALIHKERQKANEVSKMVLVGDVTDKICLLIDDMADTCGTLCKAADVLLESKARKVVCMITHGIFSGNAIERLNNSKLEKVICTNSLPVQDKLKQCDKIEMLDISSTLAEAIRRLHNGESVSYLFNNVPE

SEQ ID NO: 17382 - protein, 332 aa, Candida albicans
ISHNFFPSSSPHMSTNSIKLLASDVHRGLAELVSKRLGLRLTPSELKRESTGEVQFSIGESVRDEDIFIICQIGSGEVNDRVFELMIMINACKTASARRITVILPNFPYARQDRKDKSRAPITAKLMADMLTTAGCDHVITMDLHASQIQGFFDVPVDNLYAEPSVVRYIKETIDYSEAIIISPDAGGAKRAAGLADRLDLNFALIHKERARANEVSRMVLVGDVTDKICVIVDDMADTCGTLAKAAEVLLDNNAKDVIAIVTHGILSGNAIKNINNSKLKKVVCTNTVPFEDKLKLCPKLDTIDISAVIAESIRRLHNGESISYLFKNAPL

SEQ ID NO: 17383 - protein, 382 aa, Candida albicans
SIFSLNPTVSTLSSLNMRKCKIFVGSSHPELGQLVCDRLGVEPAPCTLKKFSNGETSVQIGVSVRDEDVYIIQSGSPHINDHIMELLILISACRGGSANKITAVIPQFPYSKQSKMKKHRGAITARMLANLLVMAGADHVVSMDLHASQMQGFFSKPVDNLFGAPTLARWIRHHIPDWENAVVVSKNPGGTKRVTALADSLKINFAMIHTDRRRTQDEYAKKKELKQAQIIEEGEDNIVSELQTARVVQGHVVDDDYQANGTSEHLAKEGILDSDVLGGTYDATGSDDEDETTTSSEEKLITLVGDVKDKVAIILDDMIDKPNSFIAAAEHLRLNCGAKAVYVVGTHGVFNDKCLKDLTDSKCIDKIVVSLQPARLPGNTSK

SEQ ID NO: 17384 - protein, 300 aa, Candida albicans
CDKFPPNTRSDEQSRGIANHLIEFLEHEVKQGRLPANLHPLQSGIGNIANAVVEGLASSNFKNLTVWTEVLQDSFLDFFESGSLDYATATSIRLTNDGFKKFYDNWDTYSKKLCLRSQVVSNSPEIIRRLGVIAMNTPVEVDIYGHANSTNVMGSRMLNGLGGSADFLRNAKLSIMHTPSARPSKVDPTGLSCIVPMASHVDQTEHDLDVVVTEQGLADLRGLAPKARAKVIIDKCSHPDYKPQLQEYYDRSVFYATKKKTLHEPHILRDVFKMHLNFQENGTMKLDSWDQNLYGFFTSQ

SEQ ID NO: 17385 - protein, 167 aa, Candida albicans
  UNSURE (165): Identity of amino acid sequences at the above locations are unknown.
IMSAILKQRVRYAPYLKKLRTGEQCIDLFKHGQYLGWSGFTGVGAPKVIPTTLVDHVEKNNLQGKLGFHLFVGASAGPEESRWAENNMILTRAPHQVGKPIAAAINDGRTQFFDKHLSMFPQDLTYGFYTKDKPNGSNLDYTIIEATAITEDGSIVLGPAVRASXFS

SEQ ID NO: 17386 - protein, 331 aa, Candida albicans
  UNSURE (323): Identity of amino acid sequences at the above locations are unknown.
YLYKPKITGLKKKIVIMFKRFFSYTPRTFKMATFNNSFLMNHTCLRIKDPKVSIPFYTEKFGMKLIATFPFADFTLYMLNYETEANKHLNWSAREGVLELCHNHGVENDSNYKLNNGNGEKDRGFGHICMSVDNIEAFQDQLLKSEVKFQKKLSDGRQKNIAFALDPDGYWIELIENGINKVANKTEVSSYKLNHTMIRVKDPKKSLEFYRDVLGFKLLSTSEHEGAKFTLYFLGYDHDPNFKQDTLVRNEQAKREGVIELTHNWGTESDPEFKGYHNGNSTENGALQGFGHTCVSCEDPAKFCQELEQKSGDKLNCPLNGNXGRSLKLPP

SEQ ID NO: 17387 - protein, 440 aa, Candida albicans
STMPMLKDPSVKYKKFPNVNLPNRQWPSRSLDKPPRWLSTDLRDGNQSLPDPMSISEKKEYFKKLVDIGFKEIEVAFPSASQIDFDFTRFAVETAAEDVSIQVLSPCRPELIGRTVESLKGAKRATVHIYLATSDCFRNVVFGLSKEESKALAVKCTKLVRQLTKDDPSTAGTDWDFEFSPETFSDTDLDYAVEVCEAVKEAWGPTEDKPIIFNLPATVEMATPNIYADQIEYFATHITDRETVCISLHPHNDRGCSVAAAELGQLAGADRVEGCLFGNGERTGNVDLVTLALNLYTQGVSPKLDFSDLNSVIDIVEKCNKIPVHARAPYGGSLVVCAFSGSHQDAIKKGFLAHEKKKEKAGGKEVHWQLPYLPLDPEDIGRTYEAIIRVNSQSGKGGSAWVILKNLELDLPRGLQIAFSKVVQARAEVKGQELTNERIM

SEQ ID NO: 17388 - protein, 141 aa, Candida albicans
LTKELCELFKQEYFIDYDDEAPEQYFKLVDYSISTPSKGIKEIQADIEVDGKVISIKGEGNGQLSAFNNAIAKYLNIDIDVKHYHEHSLGEDSKARAATYIEVLVDKKVARWGVGIHTDVSQASFLSLISILNGLHKNKNI

SEQ ID NO: 17389 - protein, 592 aa, Candida albicans
FFTSTTLSFSTTTMQKVFQRWVSRIPPVKLQYKNMLRDPSKKYSPPKQINLPNRTWPTKVITKAPRWLSTDLRDGNQSLPDPMSVPEKKEYFHKLIDIGFKEIEVSFPSASQTDFDFTRYAVENAPDDVTIQVLTQSREPLIRRTVESVKGAKRATIHTYLATSDVFREVVFGMSKQDAIDKAIETTKLVRSLTKDDPNMQDTEWNLEFSPECFSDTPVEFAVEICEAVKKAWEPTVENPMIFNLPATVEVAGPNVYADQIEYFCQNITEREKIIVSTHTHNDRGCGVAATELGMLAGADRVEGCVFGNGERTGNVDLVTVALNLYTQGIAPNLDFSDIESIIEVSERCNKIPVPARSPYGGSLVVCAFSGSHQDAIKKGFAKQKGDKWAIPYLPLDPKDIGRTYEAVIRVNSQSGKGGAAWVILRSLGLDLPRHLQVAFSGLVQNTADLLGRELKVDEIVNLFNEQYLVSAPLSIQDFEITKNKNDEREIVAQLNDGITIKGQGNGPISAFIDAISNKFGVLFEVVNYQEHSLGGGSSSKAATYIELSYVNANGEKVTRWGCGINHDVSQASIEAILSVVNYLIKKNELTV

SEQ ID NO: 17390 - protein, 692 aa, Candida albicans
YKPMNHTFSLYVEEGFNCYCYLLNLDYRFIEDQSIMKTLKKKKKERKNNEWKKKKTQKKFKKIQTPIFPSINTNPRLTPIAPPLVSMILLIDSYDSFTNNLAHLLKESTGQEVITIHNDSFKPNEYETFYTQYLPLFQFIVIGPGPGHPAIESDIGIISWLIKKFQQQHQENDNNVVPILGICLGFQSLCYEFGNDVSRLQKVKHGQVYDIYPVSKSELFPDDESPFGSVRYHSLYVENTNDEIIPLAYCYEPLETDSQDKQKQKQTNKILMAMKHKKFPFYGVQYHPESICSSKGSDLIKNFNDIAQQYNEIYRPNVFKQNKVSNWLDNHAVHEDYLIKDGKFISNELHNIYFQKLQLDKEILPIDVCDYFYQQNSDHKCNFILLNSASIPGEWSIIGLPTIGESEIITHSVDDENHIYLSQFGSKTNEKQTLDGTDTVWNFIANKMQKAYISRETIKLKLNDYGKRELPFWGGYMGLISYEEGQHVIINKISNICQNGTTTTTTTTPDLKMVFITRFIAFDHVTKNWFIVAINDNDGTNWGQQMINDLHKVEKINLDNIPDSVNKLATKGDEDLIDFELPNRDIYKKQFNQCQEYLHSGDSYELCLTTQLKIHLPLYIQPRDIYKVLTLHKNPSPFSCFMDFDDCCLISSSPERFLSWKDDITLGNNNKIVQLRPIKGTVKYTNELFTTG

SEQ ID NO: 17391 - protein, 216 aa, Candida albicans
  UNSURE (212): Identity of amino acid sequences at the above locations are unknown.
LLPPRGEDGTDTVWNLIANKMQKAYISRETIKLKLNDYGKRELPFWGGYMGLISYEEGQHVIINKISNICQNGTTTTTTTTTTTTTTTTTTTPDLKMVFITRFIAFDHVTKNWFIVAINDNDGTNWGQQIINDLHKVEKINLDNIPDSVNKLATKGDEDLIDFELPNRDIYKKQFNQCQEYLHSGDSYELCLTTQLKIHLPLYIQPFLNTAXNGQV

SEQ ID NO: 17392 - protein, 146 aa, Candida albicans
EVSQLMTVEEYKTVFQLVSVIQGKLYKEGYHGIDLLHRSLPPGSMTGAPKKRSVELLQDIESMQKNFVGGRRGIYSGVVGYWSITDDSDWSVIIRSVFHYSNDKENNPKTKLWRIGAGGAITVLSDVDDEWDEMMLKLTSALQAFK

SEQ ID NO: 17393 - protein, 385 aa, Candida albicans
EIEIMSFTKKNVSLAEGPDPRSSIQTERANSKFNPEQMNYFLEGSKERSELFKGLAQQMERDPVLFTDGSYYDLTKDQQRELTALKINRLARYRETDSIDTFNKRLSLVGVFDPQVGTRIGVNLGLFLSCIRGNGTAEQLKYWAFDKETSNIKGIYGCFGMTELAHGSNVAGLETTATFDKETDEFVINTPHIGATKWWIGGAAHSATHCSVYARLIVDGEDYGVKTFVVPLRDSNHDLMPGVTVGDIGAKMGRDGIDNGWIQFSNVRIPRFFMLQKFCKVSADGDVVLPPLEQLSYSALLGGRVMMVLDSYRMLARMSTIALRYAIGRRQFKGDNVDQNDPNALETQLIDYPLHQKRLFPYLAAAYVTCPSFSHTDLTGSEWNS

SEQ ID NO: 17394 - protein, 193 aa, Candida albicans
LMTVTIPLTETNLFKPISIGDVKLNHRIVHAPTSRKRSTKDNYPTDFMIDYYKSRSQYPGSFIIFESCLVSERSGLVPHKIWLWDEKHCLALKQIVDQVHYNNCVISCQIMANGRTSNAKLMHSKNLPILAPSITYPNEAAEKLPTELNFPIKPLTVDDIHNIQDYFVNAAVNSLKIADFDFVESHATSWFFD

SEQ ID NO: 17395 - protein, 233 aa, Candida albicans
PFFFLSIMSNSNPLKDSLVFQPIKVGDNTLSNRIVYCPTTRFRAAKGNEEPTYRHVPLDLMLKYYSDRAQYPGTLLVTEATLISNRAGGYDGCPKISTQEETKAWKKIVDAVHSKGSFLSCQFWFLGRVGYPSLLKHRKLDYLAPSPIYENEKHQKQAEKAGLPLREVTEQEIHDIIYNDYTIAAKNAIAAGFDFIELHGAHGYFIDQFLHECSNQRNDKYGGSIENRCRFVL

SEQ ID NO: 17396 - protein, 419 aa, Candida albicans
LTTHINNMDRLNQLSGQLKPTSKQSLTQKNPDDVVIVAAYRTAIGKGFKGSFKSVQSEFILTEFLKEFIKKTGVDASLIEDVAIGNVLNQAAGATEHRGASLAAGIPYTAAFLAINRLCSSGLMAISDIANKIKTGEIECGLAGGIESMSKNYGSPKVIPKIDPHLADDEQMSKCLIPMGITNENVANEFNIPREKQDAFAAKSYSKAEKAISSGAFKDEILPIRSIIRSPDGSEKEIIVDTDEGPRKGVDAASLSKLKPAFGGTTTAGNASQISDGAAGVLLMKRSLAEAKGYPIVAKYIACSTVGVPPEIMGVGPAYAIPEVLKRTGLTVDDVDVFEINEAFAAQCLYSPGQRYVPEIKLNLNGGAIALCHPLGCPGARLYATILRLWKPGEIGWTSMCFGCGMGCASHMDLGIGVL

SEQ ID NO: 17397 - protein, 269 aa, Candida albicans
  UNSURE (5),(12),(239),(264): Identity of amino acid sequences at the above locations are unknown.
GDRKXVPCPLKXLDSQLRPRLDTVNRQCASSAQAITYQAGSLRSGENQFAIAAGVESMTHDYFPHRGIPTRISESFLADASDEAKNVLMPMGITSENVATKYGISRKQQDEFALNSHLKADKATKLGHFAKEIIPIQTTDENNQHVSITKDDGIRGSSTIEKLGGLKPVFKDDGTTTAGNSSQISDGGSAVISTTRQNAEKSGVKPIARFIGSSVAGVPSGLMGIGPSAAIPQLLSRLXVDTKDIDMFELNEAFASQLIYCIDXMGSRL

SEQ ID NO: 17398 - protein, 308 aa, Candida albicans
  UNSURE (283),(296),(297),(300): Identity of amino acid sequences at the above locations are unknown.
RKVKIPSGYSSNQKLFFFRFTLSFFFSSFFDSGGFISGFLIVIQHHTHTMTGKKSTLSMLLENSQQLDDNENVLYSMSDEDEDYQHHFHQDSDEDELPKSFNSAHFSVSEDRFMKDHDLKVKAFEALHNSGSNNNNHNQVQTFSPVSPKLTSVKRRSSIIDMPQRLNNFNPAIPQNKFGQNFATDPNALPDEYPSDELIEFYQNVKKCLDFRQKYLDLSLQTPELLNPKNQPDWNIYPPPPKPTYKSKNRFNQLPRESDNDEEEEFDFSKCEIPHISDNPYYXALDDEDVYQVHDXXNDXNLVRSQFT

SEQ ID NO: 17399 - protein, 610 aa, Candida albicans
  UNSURE (66),(80),(84): Identity of amino acid sequences at the above locations are unknown.
IYRYKHQNCLILKTNQIGISIHHLQNLHINPRIDSTNYLENPTMMKKRNLTLASVKFHILAIIPIXLPLMTKMYTKCMTXRTIXIWSDPNLHDYYSDLNTISKISSDGPSKSFAYKRLQYLEAKWNMYYLLNEFEETKQSKRNPHRDFYNVRKVDTHIHHSACMNQKHLLRFIKYKLKTEPDKQVIFRDGKILTLAEVFKSLNLTAYDLSIDTLDMHAHTDTFHRFDKFNLKYNPIGESRLREIFLKTDNFVDGKYLAEITQQVMEDLESSKYQMNELRISIYGRSIHEWDKLAAWVIDNKLFSHNVRWLIQVPRLYDIYKKNGNVRSFLDIMKNVFEPLFEVSLNPRSHPKLYVFLQRVIGFDSVDYESKSEKPIQSRKYPPASEWNSISNPPYSYYLYYLYANIASLNNLRLKNNMNTFVLRPHCGEAGDPEHLISAFLTSYGISHGILLRKVPFIQYLYYLDQIGLAMSPLSNNALFLTYDKNPFYNFFKKGLNVSLSTDDPLQFSYTKEPLIEEYSVAAQIYKLSGVDMCELARNSCLQSGWEANIKKHWLGKNYMKGGVEGNDIEKTNVPDIRVAFREDALQSEKNLVKYYNGLHRKLLDANSAT

SEQ ID NO: 17400 - protein, 62 aa, Candida albicans
  UNSURE (1),(4): Identity of amino acid sequences at the above locations are unknown.
XPSXGAGEDETGMVWINSSNDSDYHVPFGGVKMSGVGRELGEYGLNMYTQAKAVHVNLGTRL

SEQ ID NO: 17401 - protein, 292 aa, Candida albicans
MFIKMCTPRHHSNYSRHKIQLLITPNYVTTLNGKIVSYFHDIALNFNKETREANMVVEIPRWTNAKFEINTKTPGNPIVQDIKKGRVRFVKNLFPHHGYIHNYGAFLQTWEDPTTKHHGLFGDNDPLDVCEIGSKILSTGDVRRVKILGSIALIDDGELDWKVIVINVHDPLFKEVNDINDLDEKCPGLLDTTRQWFRDYKLADGKPQNDFAFNGEYKNANETIDIIEQCHKSWQQLINGETKTDKTPDITNTTVKGLPGFTDTISVLLNNPSRANAAIPVDVEANYFIKTS

SEQ ID NO: 17402 - protein, 139 aa, Candida albicans
FLDQKQERAISCNGITKNYLVEPRVQASWDIAKENQVGSNEFILKHWKGKVIRAGTYAHELNKINEDINNDRTLIAFSRFFISNPDLVKKLHDGISLTPYERATFYNHDNFGYNTWIKYGENKVFNEQEEKKKLGKPLA

SEQ ID NO: 17403 - protein, 92 aa, Candida albicans
TTMTISNSNLFKPINIGKKTISHRIAHLPTTRNRATKDHVPTDLMQKYYTDRAKTGGLLVTEATLISLNQGIYPNVPVSSHGPGRSAIAIGT

SEQ ID NO: 17404 - protein, 172 aa, Candida albicans
TAVEKCQYILKQLEVRKSQGNEIAYVSIVEPRVSGNSDVDSFGDKSNDEIIKSWSGKLIRAGGYATNFNVENPTLIKTNKQVTNEGGEIVHYANLINDVNNDDRTLIGFSRPFTSNPDLVYRLENNLKLEYYDRPTFYTQTGEGYLTFKNYDGSAVTKLPEKELMREGILLQ

SEQ ID NO: 17405 - protein, 398 aa, Candida albicans
LFKQLPMTISNSNLFKPIKVGNKTIKNRIAHLPTTRNRATDDHVPTDLMKKYYTDRAKSGSLLITEATLISLDQGVYPNFPGMWNKQQKDAWKEITDSVHSIGGTIAIQLWALGRVGNAKLLKDEGLPLTGVSPIYEHEKAEQDAIDAGNPIQELTQDQIKDIVYNQFANAVKLADEAGFDFIELHGANSYLFEQFIHPGTNKRTDKYGGSIENRARFLFEVVDHVSTIVDPAKLAIRLSPLNNFQVPFVNPEGQEDYSYIVEGLQKRADEGKGLAFIDVVEGRFTSDGGTEGCNVDFVGEIWKGPLLKGGNYTYDRKNEWKTIENDANADDRTLVGFGRYFIANPDLPARIQKGNELNDYDRSTFYNTDDYGYNTYPFYGEENKADPNIKVLGVALA

SEQ ID NO: 17406 - protein, 196 aa, Candida albicans
KRTDKYGGSIENRARFLFEVVDHLSTIVDPSKLAIRLSPLNNFQVPGINPTAKEDYSYIIAGLQKRADEGKGFGYINVVEGRFSPDGSTEACDVNFVGDIWKGALLKGGNYTYDKKNSWETIERDANADNRTLVGFGRYFIANPDLPTRIEKDLPLNDYDRSTFYANDDYGYNTYPFYGQEIKADPEHKVFGVALA

SEQ ID NO: 17407 - protein, 94 aa, Candida albicans
ILPKAQKKIDLYTKQGFGKLPICIAKTQYSLSHDANLKGVPTGFKFPIRDVRASIGAGYLYALAAEIQTIPGLPTHCGFMNVEVNEDGEIDGLF

SEQ ID NO: 17408 - protein, 327 aa, Candida albicans
FPSIMSKPAGRTILASTIAKPFQEEVTKAVKQLNFTPKLVGLVSNEDPAAKMYANWTGKTCESLGFKYELLEVNKNDLETALIKANKDDSVNGIMVYFPVFGDKQDQYLQQLISPEKDVEGLNFLYYHNLYHNVRFLDPPQNQQKSILPCTPLAMVKILEYLGVYNTILHYGNRLYGKKVLIVNRSEIVGRPLAALLANDGATVYSVDINNIQQFTRGDDLLEQRHKVVDLSPEEYTLEKLAPQCDVIIIGVPLENYKFPSDLVSHGTVVINFASSKNFNDDVKLRAGLYVPSIGKVTIAILLRNLLRLIHNKQIRQGEVSDATSSA

SEQ ID NO: 17409 - protein, 82 aa, Candida albicans
HSRWVIRTTHWGANNNPLIFAGVNGFLDNVALDRIGEFEEAFLGHLKSNETGILDAIKTKGELSKDELEKLRKVTEEFVASF

SEQ ID NO: 17410 - protein, 74 aa, Candida albicans
ARPTLLTAQRFASAKAAPTEVSSILEDRIRGVSEEANLNETGRVLSVGYVSIQLQINYCFPSSAHSVDGLFRPH

SEQ ID NO: 17411 - protein, 66 aa, Candida albicans
KAYILTLCYFFRDGIARIYSLNNIQAEKMVEFSPGAKCIALNLEADQVRVVLSGSDKLLIESETAR

SEQ ID NO: 17412 - protein, 217 aa, Candida albicans
RDLAGDVFYLHSRLLERAAKMSDAYGGGSLTALPVIETQGGDVSAYIPTNVISITDGQIFLEAELFYKGIRPAINVGLSVSRVGSAAQVKAMKQVAGSLKLFLAQYREVAAFAQFGSDLDASTKQTLNRGERLTQLLKQKQYNPLAAEEQVPLIFAGVNGFLDNVALDRIGEFEEAFLGHLKSNETGILDAIKTKGELSKDELEKLRKVTEEFVASF

SEQ ID NO: 17413 - protein, 487 aa, Candida albicans
FKLRSCQRRGEDNLGIKKKIIWVGKFGNLSNQQTFITPIQQQIICNNIMIRGSSALKSLTSRRLYSTGVKYTTLSNGVTVATETNPAAKTSSVGLFFGAGSRSEHSHSNGISALTTNVLASQSAKGSLLTAKNDREFNGIIAQTTNDNITEAGKLIASIASNAVDIVEKTDLTKHKQYLSAQASAVEADPKSKVLSHLYSSAFQGYSLALPTLGTTESVENLENQDSLRHLAKHLVNNNTVIAASGNFDHDKLADAIEANLKIAEGVKPEIKPASFLGSEVRMRDDTLPKAYISIAVHGEGLNSPNYYLAKVAAAIYGDFYLHSTIAKFTSPKLASIVQEYNIVESYNHYSKSFSDTGIWGYYAEIADKFTVDDFTHFSLKEWNRLSISISEAEVARAKAQVKTALAKELADSSAVTSDIAEKVLLVGHRQSLREAFEKIDAIKVNDVKEWGKSKVWDRDIVISGTGLIEDLLDYNRNRNEMAMMRW

SEQ ID NO: 17414 - protein, 79 aa, Candida albicans
IPLYANEEKTILNMIVEVPRWTNAKLEISKEQKLNPIIQDTKKGKLRLVRNCFPHHGYIHKVRCLPTNLGRSKPITSRN

SEQ ID NO: 17415 - protein, 207 aa, Candida albicans
SETASHTTVTFTKYGAFPQTWEDPNQSHPETKAKGDNDPLDVCEIGEKVATVGEVKQVKVLGVMALLDEGETDWKVIVIDVNDPLAPKLNDIEDVETHLPGLLRATNEWFRIYKIPDGKPENQFAFSGECKNKKYAEEVIGECAEAWEKLIKGESVDSKGIDLTNTTLSSTPSYSDAAAQEIPSASPAPAAPIDKSIDKWFFISGAH

SEQ ID NO: 17416 - protein, 183 aa, Candida albicans
RPARKRTEELNGNVDIVCIGDKVKAQILRTYADKVKLAFNGVGKEEPNFTEVALIADEIAKLGNYENVEILYNKFVSGVSFEPSKFAIYAADAIANSPGLSKYELENEEITSDVAQFSLANNLLTAMAEGYASEVSARRNAMDNASKNAGDMINSYSILYNRTRQAVITNELVDIITGASSLD

SEQ ID NO: 17417 - protein, 281 aa, Candida albicans
NGSLERTTLFLNLANDPTIERIITPRLALTTAEFLAYQTERHVLTILTDMSSYADALREVSAAREEVPGRRGYPGYMYTDLSTIYERAGRVEGRNGSITQVPILTMPNDDITHPIPDLTGYITEGQIFIDRQLHNRGIYPPINVLPSLSRLMKSAIGEGMTRKDHGDVSNQLYAKYAIGKDAAAMKAVVGEEALSTEDKLSLEFLEKFEKNFISQGAYENRSIFESLDLAWSLLRIYPKELLNRISPKILEEFYGRDREQDDDEDEDEEDPDKSGDKLIDA

SEQ ID NO: 17418 - protein, 248 aa, Candida albicans
QAIMSLSDKELFELNKKAVTEGFKIKPRINYNTVGGVNGPLVILDNVKFPRYNEIVNLTLPDGSVRQGQVLEVRGTKAIVQVFEGTSGIDVKKTRVEFTGENLKIPVSEDMLGRIFDGSGRPIDKGPKIFAEDYLDINGSPINPYARIYPEEMISTGVSAIDTMNSIARGQKIPIFSASGLPHNEIAAQICRQAGLVRPTKDVHDGHEENFSIVFAAMGVNLETSRFFKQDFVIKRVFGKNYLVLELG

SEQ ID NO: 17419 - protein, 159 aa, Candida albicans
FFSNWSWNSHRPGVQGGTTCIPGAFGCGKTVISQSLSKFSNSDVIIYVGCGERGNEMAEVLMEFPELYTEISGRKEPIMKRTTLVANTSNMPVAAKEASIYTGITLAEYFRDQGKNVSMIADSSSRWAEALREISGRLGEMPADQGFPAYLGAKLASFP

SEQ ID NO: 17420 - protein, 167 aa, Candida albicans
HFPSINTSVSYSKYTNVLNKYYDSNYPEFAQLRDKIREILSNAEELEQVVQLVGKSALSDSDKITLDVATLIKEDFLQQNGYSSYDAFCPIWKTFDMMRAFISYYDEAQKAVANGAQWSKLAESTSDVKHSVSSAKFFEPSRGQKEGEKEFSELLSTISERFAEASE

SEQ ID NO: 17421 - protein, 455 aa, Candida albicans
QYFFHFQAGALENATKEIKRLSLEDTHESQYGQIYSVSGPVVVAENMIGCAMYELVKVGHDNLVGEVIRINGDKATIQVYEETAGVTVGDPVLRTGKPLSVELGPGLMETIYDGIQRPLKAIKDESQSIYIPRGIDVPALSRTTQYDFTPGKLKVGDHITGGDIFGSIYENSLLDDHKILLPPRARGTITSIAESGSYNVEDTVLEVEFDGKKHKYSMMHTWPVRVPRPVAEKLSADYPLLTGQRVLDSLFPCVQGGTTCIPGAFGCGKTVISQSLSKFSNSDVIIYVGCGERGNEMAEVLMEFPELYTEISGRKEPIMKRTTLVANTSNMPVAAREASIYTGITLAEYFRDQGKNVSMIADSSSRWAEALREISGRLGEMPADQGFPAYLGAKLASFYERAGKATALGSPDRIGSVSIVAAVSPAGGDFSDPVTTATLGITQVFWGLDKKLAQR

SEQ ID NO: 17422 - protein, 208 aa, Candida albicans
ELCSTSFLFGKARTGLTQPIKLQYVSHNINFFFFLVNKFLFLSSSPTMFRQVFRQVTKQSFTGVKRTYATEAAVSTDALKLSLALPHQTLYNDSEVQQVNLPSVNGDLGILANHIPIVEQLRPGLLEIISKNGDSDQYFVSGGIAMVQPGNKLTISAIEAFKTDQIDLSAVKNLIADAQKRAESSDEKVAAEANIELEVLDALQHFTK

SEQ ID NO: 17423 - protein, 228 aa, Candida albicans
KKKTKRKKISTKEHIKSINNTPAMISRVFSRSLASAAKSTKPPIQLFGIDGTYANALYSATIQQSDMAQTYKSLEKIENVIKGDPQLKNALTNPSLTKDDRVAIAKSVANDLSLDKTTANFLTVLAENNRLGNFSSVFQKFGLLNDAYNGVVEAKVTSAKPLESKILKRLQTSIGKSSFVGEGKTLKLTNQVNPEILGGLVVEVGDRTVDVSIANKVARLNQTLRDNL

SEQ ID NO: 17424 - protein, 129 aa, Candida albicans
RSLFSKQQTTNISSMVQSMTSVVKAANFILARPTLSKIITPLAQKFTAYAGYREMGLKFNDLLLEETPIMQTAIKRLPSELNYSRNFRILTAHQLALSHQLLPAEKAVKPEGDDNYLIFSNTAGMENPC

SEQ ID NO: 17425 - protein, 192 aa, Candida albicans
PIMSGAGNREQVFPTRMTLGVMKSKLKGAQQGHSLLKRKSEALTKRFRDITQRIDDAKRKMGRVMQTAAFSLAEVQYATGDNISYQVQESVQKARFTVKAKQENVSGVFLPTFDSHINEDVNDFKLTALARGGQQVQKAKLIYSKAVETLVELASLQTAFIILDEVIKIPNRIIKCHLTPLLFQGTYNSLCL

SEQ ID NO: 17426 - protein, 104 aa, Candida albicans
VIKFINRRVNAIEHVIIPGTENTIAYINGELDEMDREEFYRLKKVQEKKQEAAVAAEQEEALAKAKAEGATDELAIQQDVEALDIKADKEEVDILQEKEDDVIF

SEQ ID NO: 17427 - protein, 199 aa, Candida albicans
LLGSVRALSTTTTTLSNYQQPDYSSYLNNKSGQGSRNFTYFMVGSMGLLSAAGAKSTVEAFLSSFAASADVLAMAKVEVKLGAIPEGKNVIIKWQGKPVFIRHRTADEIEEANQVDIKTLRDPQNDADRVKKPEWLIMLGICTHLGCVPIGEAGDFGGWFCPCHGSHYDISGRIRKGPAPLNLEIPEYDFTDDETLLVG

SEQ ID NO: 17428 - protein, 116 aa, Candida albicans
PVEDVEVEQPEDAPEEEVSEETVEEEEDDDEDDDEDDEEEEETADPLDTLREECTKTAACKPFDHHFHECIERVTKEQEEPDYEHKHYKEDCIEEFFHLQHCVNDCVAPRLFNRLK

SEQ ID NO: 17429 - protein, 167 aa, Candida albicans
WVRRTKKKRPLNKKKLTTADILVYYYKQHYPYIMFKAVQQLTFRRFNSHHLQPSKLLNELAYKPNKQVGEEFIKKYEEKVHHSEGITNLWKRLTYLVAIPAVLLVAIPVGKVELSHAEHRKHQAHLSDDEWPQQYDYQNIRLKPYFWGDGDKTLFWNSDVNRHVVKD

SEQ ID NO: 17430 - protein, 163 aa, Candida albicans
IYRFSIMLSRTTFRIARQQTRLLSTSRVLLSAKAAPETAVKPAKDLAEVTGAASLIGPGAKEGTIPTDYEQATGLQRLELLGKREGVDVFDMEMPISEGKGTMQDPYLVPTYIGYRYVGCKGTPEQDHKPYWMKVEEGKVSRCWQCGTVLKAKYLGEPGMAHH

SEQ ID NO: 17431 - protein, 164 aa, Candida albicans
NCPEKNHRHKRIDHLTSFLPYHLLDKQTFTTTNHIHTILNLIMSEAMEKRKLVAAIADEDTVTGLLLAGIGQISNEPGKESNFLTVIPGKTTVEQIEEAFTTFTSTRDDIAILLINQHLADLIRFKVDSFSNAFPAILEIPSKDHPYDPEKDYILKKVRKLFGE

SEQ ID NO: 17432 - protein, 73 aa, Candida albicans
QRGSFQPRGDDSLQLADYIAILLINQHLADLIRFKVDSFSNAFPAILEIPSKDHPYDPEKDSILKKVRKLFGE

SEQ ID NO: 17433 - protein, 79 aa, Candida albicans
IEISINSTITNNTKMLTVLGRLLERNSIYVATIFGGAFAFQGFFDVAVNKWWEEHNKAKLWKNVKGKFLEGEGEEEDDE

SEQ ID NO: 17434 - protein, 106 aa, Candida albicans
GKTTYTNQNNYRFEKEFENAYDLFEVQRILNNCFAYDLVPAPAVIEKALQACRRVNDYPTAVRTFEALKFKVETPEQYQAYLEELKDIRKELGIDLKEDLYTEDKI

SEQ ID NO: 17435 - protein, 114 aa, Candida albicans
ISHLSKYNTVLSLITNYSIMAGAPHPHTYMGWWGSLGSPKQKYITQYTISPYAAKPLKGAAYNAVFNTFRRTKNQFLYVAIPFVVVWSIWTRARDYNEYLYTKEGREELERVNV

SEQ ID NO: 17436 - protein, 531 aa, Candida albicans
YPIIQTQLSIEDQLPLIIGMSNQIFKKIFVFFFQHFFFCARDFQPIEFHDSVRFIKYTNINFFFLFRAVIGAVVDVQFDEGNLPAILNALTLKNGDQDLVLEVAQHLGENTVRAIAMDGTEGLVRGTEVNDTGAPISVPVGRGTLGRIINVVGEPIDDRGPIECKEKKPIHAEPPSFVEQSTAAEILETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDASVVGQEHYDVATGVQQTLQAYKSLQDIIAILGMDELSEADKLTVERARKIQRFLSQPFAVAEVFTGIPGRLVRLQDTVKSFKDVLEGKYDNLPENAFYMVGGIEDVVAKAEKLAAESN

SEQ ID NO: 17437 - protein, 122 aa, Candida albicans
KGASSRSLFTITTITNNKNVTPLTSSMNFIRCYSAFPELTRDIAKERIIELLEGYDKVDQSKGEITEQNSFTSDLGLDSLDVVEVIMELEHEFNIQIPDNEADSFKTVGQTIDYILAQPDSC

SEQ ID NO: 17438 - protein, 111 aa, Candida albicans
RMFKLAFRSIRAPVARASFVKPIRFYVAPPISKDEVTSRAIQALKTVAPLQESNITLESSFQKDLGLDSLDTVEALVALEEEFDLEIPDKISDEIKTVGEAVDYIYKEESK

SEQ ID NO: 17439 - protein, 315 aa, Candida albicans
QICRNFKQYHSTNQSGSSSSSSGIVQSRSIFDYIENFQWNSSKYRLDKPISQLVKMISQEAITLDNDVRTSYQLYQLAKSNFLAADRKKNGDLSIKSLHEIVKPEQFVLDSEHLTTILIAVPNNLLDDFHKNYETLTSFVIPRSAELIAKDQEFHLFTVTLFKKYQQEFINNAREHRWHPRTDFTYSEEILNELRKEFDLTQATELKLKNDLIRLTKTAYLDIMANWFHIKIIRTYVEAVLKYGLPPQFDNYLIKFNESNLKNVDKAKKELIAKFNYLGGNGYTTGNNNSSNLHEYASLVDTEYQPFVLYELEIV

SEQ ID NO: 17440 - protein, 214 aa, Candida albicans
KKLERERKKIIKIFQPTQILTTIFTTTSSIAISTYTHIHTMSSVAKQAARKVDFNKLVNGLGLTGTTASSLTAFKKRHDEAKKEFIDLSSQSTDIDFNHYRSILKNSKVVDEIEKAVSGFKPVTIDVSKNLKNIEIFELKAIENAKLTEKSVLEEISVLQKTLKEIESARPFDQLTVDDVAAASDLEEKVTYMVKNGKWEVPGYREKFGDLAAM

SEQ ID NO: 17441 - protein, 88 aa, Candida albicans
TYSYIMPVDPATFKFETPQFDPRFPNQNQSKHCAQAYVDYHKCVNVKGEEFEPCKIFFKTFTSLCPLDWVEKWDDQRAAGKFPVNMDA

SEQ ID NO: 17442 - protein, 104 aa, Candida albicans
YHRLQHLLLHNMFAQSALRPARTLPSRILTRRNFQVSARKFDINTIVYGTAKEGPYENLPFKIKNRKFVPFAVWYWGVLGFFFAFPFLTSWWQLKKSGAFNKTE

SEQ ID NO: 17443 - protein, 389 aa, Candida albicans
RPSEKLCGYIFGVAHFVQFSIYISGFFSQRKNQQPYHHHHQMEGLFFNIDYGYLEGVVRGYKSGLLTSNQYVNLTQCDNLEDLKLQLSSTDYGNFLANYSGPLSTTVIQENLTKKLFQQYQYIQSQSSGKLTKFMDFINYGYMIDNVILMITGTLHERDKSEILRKTNALGWFDTLPTLSIATDIESLYLTVLIDTPLAPFFKNCVSADDLDDLNIEIIRNRLYKNYLEGFVDWCDKNLDGPDKEIMERLLTLEADKRVINIALNSLNNPDLSPEDKLSLFPSHGKLYPTYHLELSQVDDVEQLKSIVELVGDYKDIFSETNENLKSLGDWFYYLEMQLCRNAFTQQFTLASVYAWLKSKEQEIRNITWIAECIAQNQKNTIESYIPVY

SEQ ID NO: 17444 - protein, 651 aa, Candida albicans
NLQIFLFYPTKRNSDIKITIDFFFFFSVIMRSAIKPIIIRNLGWRTHAQTHFHTLVGFRFCYIRWAYFEFQLLLFDFLLPSKGPQNLNIINTDYKKKLFLSTSFSLLLSYRRITFSNKKNTMSSKTVPRFPIIRKFFKYTLSGVALTVVGGTSFIAYKVYQESQPVDQIKQSPYFPNGQPKKSIVILGSGWGAVSLLKNIDTSLYNVSVVSPRNYFLFTPLLPSVPTGTVDMRSIIEPIRSMIRRCRGEVNYYEAEAIGIDPVNNKLTIQQSTTVHSGHSGDDTSSNDPKIHQEHKMEHITTELNYDYLVVGVGAQPSTFGIPGVAEHSTFVKEVRDSIKIKKKIIDLIEAANLLPVGDPDRKRLLHIVVCGGGPIGVEAAGEIQDYIDQDLKKWMPQIAKDMKVSLVESQPVVLHTFSSELVEYTNHIFKDTNINLVTNSRIVKVDDTHVDVMRKSDKSIDKVPYGMLIWATGNSVRGFTKIIMDKFSEQQTSPRGLLVDDQLKLKGSDNIYALGDCTFTKYAPTAQVAFQQGIYLAHYFEKLQKVEKLRYKIKQDPSISEVYVHRLQRLENSLPKFVYNYRGSLAYIGSEKAVADLAVGSWSNLSSGGNLTFLFWRSAYIMMCLSIKNQVLVCFDWIKVYLFGRDCSRE

SEQ ID NO: 17445 - protein, 196 aa, Candida albicans
GIVTYVVNVNIRCQLHEEEQALAMQDQGLNRDPPDDSLELLRGSDEEEQEFRFPNDVEPMFPSAGGHGGDDEDGFNFGDIVIHQVIHTIEFCLNCVSHTASYLRLWALSLAHAQLSTVLWSMTIQNAFGKTGTVGVIMTVVLFAMWFLLTVCILVFMEGTSAMLHSLRLHWVEAMSKFFQGEGYAYEPFTFKSIDI

SEQ ID NO: 17446 - protein, 111 aa, Candida albicans
YNRKFFLLQNSNQWKLMKMKQPDDQKSEREREKKFRLIIFNSLLILVNTIYFLSSNYPSHHPIYSIMNPQRIIELQKHYQNTPKPLWLRGRQSAFLVYPFYALFAVSTAIP

SEQ ID NO: 17447 - protein, 104 aa, Candida albicans
VREREREREREREKKYRLIIFNSILIFNTIYFLSSKFPSHPIYSIMNPQRIIELQKHYQNTLKPLWLRGRQSAFLVYPFYALFAVSTVIPLYYSVRAVAGIKDE

SEQ ID NO: 17448 - protein, 175 aa, Candida albicans
SPPLPQQVFNMFMRSLQRAATKANTASITTSILRFNSTVAKSTSAAPRALSNAYIGNLESRWTSLPKQDQQTLIDELKSRMELPWQELTPAEKKAAYYISFGEWGPRTPLYLPGERSQVFWITTGCIVASVVLFFGIRQFASPPPITMNKEWQEQSDDYLKSKNANPFTGYSQVQ

SEQ ID NO: 17449 - protein, 359 aa, Candida albicans
TPRSVIQQLRSQEVKFIENRCVLNILNDFHRSKLFGGGYDDEHTEDADYDDNAALLNEQRNHSLEIGYEAHNLDDISFNSLAGTIARDKVPILRNILWRVLRGNLYFHDIALDDEFPATESSMDLVHKNVFIIFIHGDFLRTRVRKIIQSLDGILFDNATGGSVARNETLTEINGKIEDLNNVVQTTKDQLVTELMIFQELYPDYCYIVQREKLIYETLNKFDEDSTRRCLVGEGWIPTNDFDKIRLALRNLIRQKTRRDGSDRDLTESVNISESIATDTSLFAIDDSDHELTGFEIEDEDDVGSLIAVVNELATNRTPPTFHQKNKCTAAFQLIIDAYGIATYHDVNPGLGHNYYFSV

SEQ ID NO: 17450 - protein, 178 aa, Candida albicans
SSLSQFTHIDANIQLEQLYIYNKVMSPIRLSENSVLSSNNESNEAIFRSAPMTLVQFYVTIELARDMVGVLGKLGNVQFRDLNSKLTPFQRTFITELRSIDGLVSQLDFLHSIMIKQNTIKSDLYVNLHADMKPLPTSSEIDNIKTRLSEFYERIKHLDQSYNNLDRKRLNLLRIDVC

SEQ ID NO: 17451 - protein, 386 aa, Candida albicans
MPMKKDEIFDMAYTGRYVLLLMGVFSMYTGFIYNDVFSISMSIFKSGWEWPEKFNVGETIYAKYVGTYSIGLDPAWHGTENALLFSNSYKMKLSILMGYIHMSYSYVFSLVNYTYFNSMIDVIGNFIPGLLFMQGIFGYLSLCIVYKWSVDWFATGRQPPGLLNMLINMFLQPGDVPEPLYSGQSTIQVFLLLIALICVPWLLLVKPLYMKRQLEKEANQHHGSYSQLANDEESGVAGQEQEQENAAEDDDEDHEEHNFGDIMIHQVIHTIEFCLNCVSHTASYLRLWALSLAHAQLSTVLWSMTIGNAFGPTGLIGTFMVVFLFAMWFVLSVCILVVMEGTSAMLHSLRLHWVESMSKYFEGGGSAFETFTFKGLLKQCFISLET

SEQ ID NO: 17452 - protein, 425 aa, Candida albicans
PSFSSLIYFCSPPLSLIPYQYISRKKGMPEKEEAVFRSADMSLVQLYVPTEVARDIIYKVGQLDIIQFRDLNSKINEFQRSFVKELRKLDNVERQFNLFKRELDVRDIPIKLFPYDLDNVPPQTEIDELIEGSDLLEERVIQLRDSVETLYEKEKYLKQFKYTIQAVNNFFAVQGETTNDNEETALLSQLESGGATSGGGGDARSGSSFISGVINRDKVGVLQQILWRVLRGNLYYHNEDLPEEIYDFKNNTYVAKSSFIIFSHGSLIRERIRKICESLDAELYNVDSTSALRREQLDDVNTKTTDLSTVLGESENALNSELIAISRDLAKWWEIIAREKAVYKAMNNCDYDNSRKTLIAEGWTPTDSITELTTAIQEYDASQSVPTIINVLDTNKTPPTYTRTNKFTYAFQAICDAYGVPKYKE

SEQ ID NO: 17453 - protein, 186 aa, Candida albicans
SMYTGLIYEDIFSKSMAMLSCGWKYVIPENYDLTRGATLVGEKIDGKVYPFGLDWAWHGTENNLLFTNSYKMKLSVLMGYTHMNYSLMFSLVNYLFFKSRVDIIGNFIPGFLFMQSIFGYLALTIVYKWSVDWFGSNRQPPGLLNMLINMFLSPGTIEEPLYAGRKYIQVFLVLVAAVCVTVVVDL

SEQ ID NO: 17454 - protein, 219 aa, Candida albicans
VKSKLSKMQAFIEKEAKEKAKEIKLKADEEYEIEKASIVRSETAAIDSTYEQKLKKASLAQQITKSTIGNKTRLRILSTKDEVLHEIFDEAEAELKKITKDKKQYKPVLVGLIEEGVLALMEPKVSIKVREQDVDVAKEAITEAAKNFEEKAKFKVEISIDDKNFLAKDIAGGIVVVNGSGKIEVDNTLEERLKILSEEALPAIRLELFGPSTTRKFFD

SEQ ID NO: 17455 - protein, 259 aa, Candida albicans
KKGREKKNLHSVENFSYHVNAITIPTMSMINRIALRSARPAMGMAFRPAPIGLRYLSAPADPKQKANSIIDALPGNNLLSKTGVLATSAAAAIYGISNGLFIIHDETILLVTFASFTALVAKFVAPLYTEWADGEIKKVNDILNQSRTNHIEAVNKRIETVSELKNVVATTEDLFALSKETAQFEADSFELKQKLAVSHEAKSVLDSWVRFEQQQRQLEQEQLAKEVIDKVDKVIANPKFQDKVLAESLNEIEKLFAKN

SEQ ID NO: 17456 - protein, 468 aa, Candida albicans
LTIQTPLVIDSTFLFDSKKIIKERIIPWEGLARSGVVSEDDANHIKLLEKQSIENRNNTVKAQLDLYSKCLLNVLNRVDSKDDVLKNILALINDLLLDVPEFLDAVLKLSEVDKSLPYIPFINHLDNKDNLIKSLSLYNLEILLGKVKTINDDEILIKIFSVLSYLIGESADSNYQFIGVQLLQDLLIVKPFKLVYQNNNLLTNFKPINNLIEKLAKNPNSIGLQLSYNVLLVVWVLSYTAPINRSLIHNFPQLVGNLLSIAKDSIKLKIVRVAVAILKNFVDITISSQEQFKVIKVLLFSDALNTVNTLKERKFASNGSDEELSNDLNYLYDNLQEIVTQKLTSFDKYLTELENPKLISWASPTHKSTEFWLENSGKFKDSNYKLVKRIFEILISNTNDSTTINVILLNDLQFLIKNLGKDLITFINTEKGGQYKLLIMTFLDNSQGDNELKYQALKTIQLLVGHNF

SEQ ID NO: 17457 - protein, 382 aa, Candida albicans
TFTSYRNNMLSRASIRAYSSIPNSVKIAAKESATDLTKLSVIINNAGSKTGKLGVSHLLSKFTFLNNGAKSALRFTRESELLGGTFESKVTRDALILNTTFLKQDLPYYVEALGNVVSNTQFAPHEFNEIVLPTANAETKLANANPAFKGVEKLHEITFRRGLGNPLFYNESTPIKLEEVAQFSKEQFSGENISIVAEGANEEDLTKFVSESAFCYLPSSSSNGAKALPTNTFTGQEARVPSSGASSALIGIPVKPADFGKYEVLSAAIGTSTLPSTSTPLAQIPGATSHLYKYQDAGLFVISVSGEASQVAQGIKQAKSVAESVSSSALSEAVKAAELSVALQSTVDSPLNVKVVAEEAPISKFNYVAVGDLDVLPYADEL

SEQ ID NO: 17458 - protein, 122 aa, Candida albicans
LVDLRSRNIDGARVEVVWERANIAANKNTFPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 17459 - protein, 280 aa, Candida albicans
HNRLTKQKKNLEISLEKFSIKSHSQPNYILPIMLSSTLRRSVRAQSKNLPAFARRTYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTNTTKISYISKYFQTMPYRLNEETGIIDYDTLEKNAQLFRPKVIVAGASAYSRVLDFQRLRPIGDNVGNLFIVRYGPLLWG

SEQ ID NO: 17460 - protein, 207 aa, Candida albicans
  UNSURE (175): Identity of amino acid sequences at the above locations are unknown.
TTMSPAAQSSSDKKQSGIARVLGSATAGIAEIGVFHPVDTISKRLMSNHTKVTSLHELNKVIFRDQASQALGKRLFSLFPGLGYAACYKILQRVYKYGGQPFANEFLTKNFKDTYDSAFGPKTGKALMSATAGSLIGIGEVVLLPLDVLKIKRQTNPESFRGRGFLKIIQDEGLXLYKSWGWTMAKNAPGSFALFGGNSFAKEYIFG

SEQ ID NO: 17461 - protein, 96 aa, Candida albicans
LSNHFVNKIFITSIFGANASLIVSAPLDVIKTRIQNRNFENPESGFTILKNMFKNEGITAFFKGLTPKLLTTGPKLVFSFALAQSLIPAFDKLLSK

SEQ ID NO: 17462 - protein, 208 aa, Candida albicans
PKFGHTMKYPLRRFGKFTLNEYPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 17463 - protein, 320 aa, Candida albicans
  UNSURE (12): Identity of amino acid sequences at the above locations are unknown.
EYYIPLSISIDXDLFFIFNFLFIYKLFIMAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLTNEEAGALAGSNPDYAQEDLFKNIAAGNYPSWTAYIQTMTEAEAKETEFSVFDLTKVWPHNEIPIEKIW

SEQ ID NO: 17464 - protein, 476 aa, Candida albicans
QTYPLIMSAYALSQSHRQLTEGHLKDTDPEVDQIIKDEIDRQQHSIVLIASENFTTTAVFDALGTPMCNKYSEGYPGARYYGGNEHIDRMELLCQERALKAFGLTPDKWGVNVQTLSGSPANLQVYQAIMKPHERLMGLDLPHGGHLSHGYQTDSRKISAVSTYFETMPYRVDLETGLIDYDMLEKTAVLYRPKVLVAGTSAYCRLIDYKRMREIADKVGAYLVVDMAHISGLIAAGVIPSPFEYADIVTTTTHKSLRGPRGAMIFFRRGVRSVNPKTGQEILYDLENPINFSVFPGHQGGPHNHTIAALATALKQANTPEFKEYQEQVLKNAKALESEFTKKSYKLVSDGTDSHMVLVSLKDKQIDGARIETVCEKINIALNKNSIPGDKSALVPGGVRIGAPAMTTRGLGEEDFKKIVSYIDFAVNYAKEVQSQLPKDANKLKDFKNAVSGDLEKLKAVRDEIYQWAGSFPLAV

SEQ ID NO: 17465 - protein, 198 aa, Candida albicans
FLDLFISWFVSWWFNLVGNIFVCYIFCYYSDVVRTQLMVVGSVEVAVQKAESTFVETLLKATAGNFYVCLAIFLQLMAKPLHVKFLMMLLPVFTFVAMGFTHLVADMFLVTMGLINGAPISVGKAAWKVFLPGAIGNIIGGSFFGVVITWYLHIYVVERDRAALNLPQYELRDEQPELNQDSRVVRKKTPEWRMKWFT

SEQ ID NO: 17466 - protein, 419 aa, Candida albicans
FLIGMMKNAEVRYEPMGVVTSIVSWNYPFHNLMGPVIASLFTGNAIIVKCSENVVWSSQWFIKFVRKCLQELDIDENLVQLCCCFPNDAEYFVSHPGLSHITFIGSKNVAHHVVSQAAKQLTPCVVELGGKDALIVLDDVKDVQSLSSVILRGTFQSAGQNCIGVERVICLPKVYEQLVEIFTERIKSFRVGSDIDQLDEIDMGAMISDNRFAQLEGLIEDAVSKGARLIHGGKQYQHPNYPQGHYFEPTLLVDVDPTMKIFQEEVFGPVLTMIRANDAEDAVNIANGTEFGLGNSIFGSNFNQVNQIADQLQSGNVAINDFATFYVAQLPFGGIKQSGYGKFGGEEGLTGLCNAKSVIMDKPLLRLFGVATSIPPTIDYPIENDKKAWNFVKSLNIAGYDGRLWNKVKALKNLATGGS

SEQ ID NO: 17467 - protein, 415 aa, Candida albicans
VCKPKPGLPSIKIMSYNILAQTLIRREIYPTNGKILKWSVRSQILLDELKHYNADIMCLQEVDKVQYEGFWVSQLEKLGYSTRFYSNNTKNHGCVIVFRDKLFTCKHQSFIRLDQDLNQEASEKLLPPARIATTNIAFMAYLEFTPTFIKEYPCLEETNGFIIGTTHLFWHPFGTYERARQTYMLLYKFREFQRVLRIIVGNSKRFYSFFTGDFNSEPFDAPYRAITAKPIKFSGRSRNVLGCSLAYTYSKDRSLDEDDIDTEELEQERDNNPLDPEPETFETTPEQDKLINDLEEAHNDLDVRAISLYSVGYKQAHPENANTAGHRNEPAFSNWVDKWNGMLDYIFLLVPWNKSDDRSKRIDMPEDLAEQYKIKLTKLLRLPTPEEMGSPPSGQPRMHQYPSDHLSIMAEVQLE

SEQ ID NO: 17468 - protein, 188 aa, Candida albicans
  UNSURE (50): Identity of amino acid sequences at the above locations are unknown.
FYLEIIIEGHAQATTKGTWDIAAVAKDEFDMEGKVFATIGVGRIGYRILXRLVAFNPKKLLYYDYQPLPEETINRLNVASKLFNGVDNIVERVEKLEDLVSQADVVTINCPLYESSKGLFNKDLISKMKKGSYAINTARGALTDPQAIADAVNSGHIAYGGDVWPVQPAPKDMPWRTMHNPYGKDVFT

SEQ ID NO: 17469 - protein, 143 aa, Candida albicans
INKPTTIITTLTNKQAKMSKPKVLMALYSGGKHANEESRLLGTVENELGIRKLVEEHGYELITTADKEPSSNSDFDENLQDTEIIITTPFFPAYVTKERIAKAPELKLCITAGVGSDHYDLDALNERGIAVLEVTGSNCSICC

SEQ ID NO: 17470 - protein, 116 aa, Candida albicans
INKPTTIITTLTNKQAKMSKPKVLMALYSGGKHAKEESRLLGTVENELGIRKLVEEHGYELITTADKEPSPNSGFDENLQYTEINYHYSVFPSLCHQRKNCQSSQIETLYYCWGWI

SEQ ID NO: 17471 - protein, 82 aa, Candida albicans
LLLLIKNHLPILVLMKIYNIQKSIITTPFFPAYVTKERIAKAPKLKLCITAGVGSDHYDLDALNERGIAVLEVTGSNCSICC

SEQ ID NO: 17472 - protein, 101 aa, Candida albicans
FYLEIIIEGHAQATTKGTWDIAAVAKDEFDMEGKVFATIGAGRIGYRILERLVAFNPKKLLYYDYQPLPEEAINKLNVASKLFNGVDNIVERVEKLEDLVS

SEQ ID NO: 17473 - protein, 184 aa, Candida albicans
  UNSURE (129): Identity of amino acid sequences at the above locations are unknown.
RKTKMGKPKVLMVLYAGGNHAKEETRLLGTVENELGIRKLVEEHGYELVTTTDKEPAPTSAFDENLEDAEIIITTPFFPAYVNKERIAKAPKLKLCITAGVGSDHYDLDALNERSIAAIEVTGSNVVSXAEHAVMTMLILIRNYGEGHAQATKRYLGMLLLFAKHEFDLGRTSNCYWLVPGKIG

SEQ ID NO: 17474 - protein, 132 aa, Candida albicans
KSRGLFNKDLISKMKKGSYLVNTARGAIVDPEAVADAVNSGHIAYGGDVWPVQPAPKDMPWRTMHNPYGEAYGNAMTLHVSGTSLDAQARYANGVKQILTEYFNKTYNYRPQDVIVIDGDYATKAYGQREKK

SEQ ID NO: 17475 - protein, 393 aa, Candida albicans
QLQQLLQQQLNNTKMGKPKVLMVLYSGGKHAKEEPRLLGTTENELGIRKLVEEHGYELVTTDDKDPYPTSTFDKNLPDAEIIITTPFFPAYVTKERIAKAPNLKLCITAGVGSDHYDLDALNERGVAVLEVTGSNVQSVAEHAIMTMLILLRNYGEGHAQATQGTWDIAAVAKDEFDMEDKVFATIGAGRIGYRILERLIAFNPKKLLYYDYQPLPEEAINKLNAASKLFNGVENIIERVESLEDLVSQADVVTLNCPLYEKSKGMFNKELISKMKKGSYVINTARGALTDPQAIADAVNSGHIAYGGDVWPVQPARKDMPWRTMHNPYGKDYGNAMTVHVSGTSLDAQARYANGVKQILTEYFDKTYKYRPQDVIIIDGHYATKAYGQRSKK

SEQ ID NO: 17476 - protein, 115 aa, Candida albicans
QPVLAVTILNDPELYSQWRKDLVTMSSRIGEMRNTLRSKLESLGTPGTWNHITEQTGMFSFTGLTPQMVERLEKHHGIYLVSSGRASVAGLNEHNVDQVAKAIDEVVRHFGKSKL

SEQ ID NO: 17477 - protein, 303 aa, Candida albicans
FHNFIIMYKTQLIKSSTQARFLAVRQLSSTSQLLKWNDIPLAPPDKILGISEAYNNDSNPQKINLGVGAYRDNSGKPIIFPSVKKAEEILLGKETEKEYTAIVGSKNFQSIVKNFIFNNSNKDANGKQLIDDGRIVTAQTISGTGSLRVIADFLNRFYSNKKILVPKPTWANHVAVFKDAGLEPEFYSYYETSKNDLDYANLKKSLTAAPEGSIVLLHACCHNPTGMDLTSEQWDEVLQIVQDKKFFPLVDMAYQGFASGKPFEDIGLIRKLTKLANENKIPSFALCQSFAKNMGLYGGKNWF

SEQ ID NO: 17478 - protein, 289 aa, Candida albicans
STLKLTKNYYFIMAPFAGIKELPPDPLFGLKARYNADSRTNKVDLGIGAYRDNNGKPWILPAVRQAEQKLINSPDYNHEYLSISGFAPFTESAAKVILGENSLAIKDKKIVSQQSLSGTGALHLAGVFIKEFYQGNHTIYLSQPTWANHKQIFEYIGFKVASYPYWNNDTKSLDLSGFLKAISSAPDGSVFLLHACAHNPTGLDPNQSQWDEILAALEKKKHFIIFDSAYQGFASGDLEKDAYPIRKAIDSKVITSPIIICQSFAKNVGMYGERIGAIHVDTSTVESND

SEQ ID NO: 17479 - protein, 188 aa, Candida albicans
DFTSGDLIKDSWILRYMYEEAEIEFVVAQSFLKNMGLYGERLGAVHVIVQDENYVDHAQSTLVANFRHECSFAPSFGARLAQIIFENDKLYQQWTKEVNQVTQRLQNLRQLVYQTLIKLETPGNWKTVIQQKGLFWYSGLTPQQNDRLISNHNVYSTSIGRVNIAGLNEQNVEYFCKAIDEVVRHNYE

SEQ ID NO: 17480 - protein, 241 aa, Candida albicans
TKNYYQTLLVLLVLINKMTVKSKFTHLTKEEPDPIIKTLTQYHQDQSPNKLDVSIGVYKSPDGLLYTFPSIIEAKEIYHNEKNYGHNYTTMSGIKEFINGSQQLLFGKDVITSDGEKKIASIQTIAGTGAIHMGLLFFMEAGYKNFYLGLPSWLNYIPMIETVGGKVNTYEYYNTANGEINFDTVKKTLIEAPKNSVFIFQTCCHNPTGADFNNDQWIEVVKLIKQYDHLVLMDTAYLGFY

SEQ ID NO: 17481 - protein, 526 aa, Candida albicans
KIRQSIMLRVNSRLLTTRKSQFMFTSNSLRFLATFKPADPLTTHDINPQTVEAKYAVRGKIPIIADELNELIQKQPQLHGLPFSKIINANIGNPQQLEQRPLTWYRQVLSLLQYPDLLKNGDPETVKSLYPEDVIERAQSILKHIGSIGAYSHSQGASYFRQSIAEFITNRDGGYVSHANNIFLTSGASTAVSYLLQILSVNENSGFLIPIPQYPLYTATIALNNAKPIGYYLDESNHWSTNPQEIRELIETNQLQGINIKALVVINPGNPTGAILSSQDIIELIDIAAEYGIVLIADEVYQENIFKGKFVSFKKILSELIEQDPQTYKHVQLASLHSTSKGVSGECGQRGGYMELVGFKPEVKDVVFKLASINLCSVVSGQALMELMINPPQEGDPSYPLYKSETESIHNDLESRAESLYQAFLQMEDIKCNKPMGAMYIFPTLDFDPARYHKLYSRAKNSNLQIDDIYCIELLEGTGICCVPGNGFGQKPDTYHLRTTFLPPGKEWIDKWINFHKSFIKKYKDE

SEQ ID NO: 17482 - protein, 176 aa, Candida albicans
KKLLLTLCNCSSGDHSVEYLAGVRPWTKVGQVDVALPSATQNEVSGEEAKALVDAGCKFIAEGSNMGSTKEAIEVFEANRDSNGVWYAPGKAANCGGVAVSGLEMAQNSQRVQWTNEEVDAKLKEIMYTCFENCYKTAQKYSIEKNENGLPSLLKGANIAGFIKVADAMFDQGDVF

SEQ ID NO: 17483 - protein, 298 aa, Candida albicans
IHIYTMVLPHEPEFQQAYDELVSAVEDSTLFKEEPQYKKVIPVVSIPERIIQFRVTWENDKGEIEVNNGFRVQYNSALGPYKGGLRFHPTVNLSILKFLGFEQIFKNALTGLSMGGGKGGSDFNPKNRSDNEIRRFCVSFMRQLARYIGPDTDVPAGDIGVGGREVGFLFGAYKQMRNNWAGVLTGKGLTWGGSLIRPEATGYGCVYYVEKMIEKATNGKETFKGKRVAISGSGNVAQYAALKVIELGGTVVSLSDSKGSIISKNGITADQVYAIAAAKLKFKSLEEIVADSVQLFLW

SEQ ID NO: 17484 - protein, 123 aa, Candida albicans
LKSPTFLSIKFQYKVQPFASRIINKNQSLFLSHHIMTIESSTNYSFGTKAIHAGAPLDPSTGAVIEPISLSTTFAQSEPSKPLGIYEYSRSSNPNRDNFEIAVAALESAKYAIALSSGSATTA

SEQ ID NO: 17485 - protein, 919 aa, Candida albicans
ELFTNTPTYLIMTSASLENGVSRLNIYRTTSNTSSQVSLKHDYIDSPFSGKKDQFDQVLDVLDSTGFIPESLIESEAKWFYESLGIDDVFFARSLPEDIASHIHALYSCKVQAYSSFGEQPLISYKREAEDHAVFFDTVDAESYKRNQFEERIDDKYIDPSSTTTNSYRTEYFSAPLNYQSDPILLGVYQQNKELRDQYVRLFFVYKNNYTILEAAANETDLEKIGDKTFLKIASDNTKQLYTSIVKDVINTTGPVIKHFPLEDSEEYRVVIGYKQKTSARYNSALSDLANYYKLQVTRKYVEQFSNGVTIISMYVTSKLRKSPVDLSIYQVIKEASLLYCIPHNYFHDRFIQGELSLQESIYAQSGVIFVTHFLNRLGPEYNKLSSLLDPSKSIEHAEVLNSLKKRLRAETYTQDYIKEVFDNRRDIVRKLYRQFADVHYIRSSMEKTLSYQRLSQITPVGSEEEFEQLLSRECSQNEHHAIVLRALYTFNKSILKTNFYTSTKVALSFRLNPSFLPESEYPERPYGMFFVVGSDFRGFHIRFRDIARGGIRIVRSRSLDAYNVNARNLFDENYNLANTQQRKNKDIPEGGSKGVILLDPGAAQERPQACFEKYIDALIDLLLKQNIPGVKDNYVDLYAKPEILFLGPDEGTAGYVDWATLHARERGAPWWKSFLTGKSPELGGIPHDEYGMTTLSVRAYVNKIYEKLDIDDAKIRKFQTGGPDGDLGSNEILLSRKENYVGIVDGSGVICDPQGLDKQELIRLAKERKMIEHYDKTKLSPQGYVVLVDDMDVKLPSGEVVTSGVAFRNTFHLKLKQQFGVDGVDLFVPCGGRPAAIDTNNVHDLIDEKTGKSVVPYFVEGANLFITQSAKLILEKAGIIIFKDASTNKGGVTSSSLEVLASLSFDDKGFLEEPLFGS

SEQ ID NO: 17486 - protein, 97 aa, Candida albicans
AINKLGDELANSKELWNDDIEFRHAVLLDSLPRLLLEKVGIENVLSRVPEAYLKAIFATHLASKFVYSRGIDSNPAKFLEFISSIRKDFIQKGLLKY

SEQ ID NO: 17487 - protein, 254 aa, Candida albicans
SFSFFQFVFTTSLSFISNYLTTQTIKKMLRITSKRLYSSTSNLLKTPLHEAHIELGGKMVPYAGFEMPVLYKGQSHIESHNWVRSKVGLFDVSHMLQHNISGKDAQSLLQKITPIDLSKLPVNTSSLSVLLNNNGGVIDDCIITKHGEDEYYMVTNAGCREKDVKFIKDEASQFNSVNHNTFEGTLLAIQGPKAQEILQQFTNEDLSKIYFGQTKFLKLSPIGATVHLARSGYTGEDGFELSIPSSSLTGLEGP

SEQ ID NO: 17488 - protein, 100 aa, Candida albicans
FILITFLSFFSNHLTSQTIKKMLRITSKRLYSSTSNLLKTPLHEAHIELGGKMVPYAGFEMPVLYKGQSHIESHNWVRSKVGLFDVSHMLQHNISGKDAQ

SEQ ID NO: 17489 - protein, 180 aa, Candida albicans
QSTMTPPKRRESSSSITNILTLNNLELGATAGEVRGAGAISEENGLVHHQHHLEDSEHYHTTQVEIESHFSTDDEINHPGNNFNDDQISHLPTIKIKYHRSNSVHAISSANSFDGANNISGDISLLPTIKVLGTGGTIASKGVSSHQTAGYEVDLTIEDLVSTIPDLSQTCQLEYEQVLN

SEQ ID NO: 17490 - protein, 180 aa, Candida albicans
CVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 17491 - protein, 227 aa, Candida albicans
ASNRESRGRGVLIALNDRIGSGFYITKSNANSLDTFKSIGQGYVGNFVNNEIRYFFPPAKPLGLTMFHINDLFSSSYYYYAIGGNDIIPCLPEVTIIYAHQGLNNEIFKFVINDLKSKGIILATMGAGSMSDKTNQYLSDLLINNPNYPIVYSKRSMDGMVPIGSLPKVLAVIKDAADNGKPATKKVPFVNAIAGGYLNPQKARILLQLCLNEGMDLSKIKNVFKTV

SEQ ID NO: 17492 - protein, 383 aa, Candida albicans
QLQQHIYITKMTTSLTEQTAILAKYLELSQNGKILAEYVWIDAEGSTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 17493 - protein, 405 aa, Candida albicans
ILYIYIYWWKNKPTKKKKIFEKFEKNNYSVLILLFLLYKLYSYYTTMCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFKPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSPTFTLEKSLDALDDVPLHRETYDVTPIRASTTHVLVLPEKIN

SEQ ID NO: 17494 - protein, 1085 aa, Candida albicans
LVTNRGEIAVRIIKTVKKLGVKSIAVYSDPDKYVRHSLMADVAIPLHGTTGAETYINIEKVIKAAKESGAEAIIPGYGMLSENADFSDRCGKEGIVFVGPSGDAIRKLGLKHSGREIAEKAGVPLVPGSGLVKDAKEARAIAAKLEYPIMVKSTAGGGGIGLQKVDCAKDIERVFETVQHQGKSYFGDSGVFLERFVENARHVEIQMLGDGYGNAIAVGERDCSLQRRNQKIIEETPAPNLPEETRNKMRKAAESLGSSMKYKCAGTVEYIYDPKRDEFYFLEVNARLQVEHPITEMVTGLDLVEWMLLIAADTPPDFNQKIEVKGASMEARLYAENPVKGFMPSPGQLTEVKFPEWARIDSWVEKGTIVSAEYDPTLAKIIVHGKDRDDALKKLRQALNETVVYGCITNVDYLRSIANSKMFEEAAVATKVLDSYDYKPHAIEILQPGAYTTVQDYPGRRGYWHIGVPPSGCMDQYSFRVANQIVGNDAASPGIEITLNGPKLLFHQDCVVAVTGGKTKVEVNQVEVNQWEPINIKSGDKLDIGKLSTGCRAYLAIRGGVDVVEYLGSRSTFALGNLGGYNGRVLKLGDVLFLGQPDVTSCTLPGPISQPTPVPASLIPNYDNKVWKIGVTCGPHGSPDFFKAESVEEFFSSTWKVHYNSNRFGVRLIGPKPKWARKDGGEGGLHPSNTHDYVYSMGAINFTGDEPVILTCDGPSLGGFVCEAVVAESELWKVGQVKPGESIQFVPISYESAKNLKKQQNAAIENLSGDLPSLETVSLSAPENPILHQFKVSSNAPKVTYRQAGDRYILVEYGDNLLDLNLAYRIHKLDAMVKEYKPKGIFELSAGVRSVLVEYTDEITQKEALDTLVSYEKEIIFVNKWKVSSRIIKLPMAFEDKKTLDAVKRYQETIRSEAPWLPNNVDFIANINGITRTDVKDMLYTARFLVLGLGDVFLGAPCAVPLDPRHRLLGTKYNPSRTFTPNGTVGIGGNYMCIYTMESPGGYQLVGRTVPIWDKLSLGEHSPNTKPWLLSPSDQIEFYPVTEKEVDAFSEQMNAGKFKVDIVESVFDHGKYLEWIQENSKFIEG

SEQ ID NO: 17495 - protein, 668 aa, Candida albicans
NPFTDSSIISCIEPTNNIQRNTNQFNPQTMSYLGWSVEDWKKFHYESTPDESFELLSQLLKSQKAAPEDPAWISLASIENLEHQWKFLQSKSNKRDLPLYGVPIAVKDNIDAKTFETTAACPSFAYSPSKDATTVRLLRDAGAIVIGKTNLDQFATGLVGTRSPYGITPNTFNPKYVSGGSSAGSASVVAKGIVPIALGTDTAGSGRVPAALNNLIGLKPTKGVFSCSGVVPACKSLDCVSIFALNLQDAQLTFNIMAEEDEHDEFSRSMPKNPLLKFGKKPRVVVPTNLLWYGEKENPKLYQEAVAKFEKIGCELVSLDIEPLLELARCLYEGPWVAERYVAVKDFFATNTPEKDLDPTVTKIIKGGEHYSAATCFQYEYKRQGIVKRVNKLLEGIDAIIVPTAPLNPTIEEVTNEPIKVNSCQGTYTNFVNLADMSALAIPAGFRNDGLPFGVTLLSHKFNDYALLDLASRYLKLDNLRTCGVSQKKVSTIHDELYLLPKSTPEETVKLAVVGAHLKGFELHWQLEKVDARFIESTTTSKNYKLYALPKTGPVAKPGLRRVESDGEHIAVETYSIPKEKFGQFIKFVPEPLGIGSVELKSGEWCKSFICEEFGYKQPGTVDITEFGGWKKYQEHLRASKKPFNSVLVANRGEIAVVFSHAGWKDPR

SEQ ID NO: 17496 - protein, 125 aa, Candida albicans
KYGEWIQENSKSIEEFQQNQGGEKLEEFNRLIQISNSELEKLGTKVQDDEKFDDNAELVYSEYSGRFWKSVVEVGDKVTAHQPLIVVEAMKTEMVVNAPRDGKVLKIYHKNGDMVEAGDLVVVLE

SEQ ID NO: 17497 - protein, 453 aa, Candida albicans
LVLVLVLHHMVRQSQRSKLHLLLKHKKPRNSTTHVVCWGMMLMLFTHIWQWKLLFRMKHPGLLKNEGLLEEKFIQNYKGSIDAGILTVMSKMGISTLASYKGAQIFEALGIDNSVIDRCFAGTASRIKGVTFGYIAQDAFTLHERGYPTRDTIKPIGLPETGEYHWRDGGDAHINDPAAIASLQDAVRNKNERAYEAYAKKENEAVRNCTLRGLLDFEFESSTEVPIDQVEPWTEIVRRFFTGAMSYGSISMESHSTLAVAMNRLGGKSNTGEGGEDAARSQVLENGDTMRSAIKQVASGRFGVTSYYLADADELQIKMAQGAKPGEGGELPGHKVSAEIGKTRHSTPGVGLISPPPHHDIYSIEDLKQLLYDLKCANPRARTSVKLVSEVGVGIVAAGVAKAGSENILVSGGDGGTGAAKLTSIKYAGLPWELGLAESHHTVFTTGMAVRVD

SEQ ID NO: 17498 - protein, 101 aa, Candida albicans
GRIPKGTLHPWVGFPQVHLQGMAEDIPFIIWEGGCNFGGKIPICCIIGVGAGSSSYGQTKPTFQIALIIETQEAKEFHHACCLLGYDADAIYPYLAMETFV

SEQ ID NO: 17499 - protein, 336 aa, Candida albicans
RRQIRTGRDIAIACLLGAEEWGFATSPLIAMGCIYMRKCHLGTCPVGIATQDPELRKKFEGTPEHVINFFYYLANDLRKFMAKLGFRTINEMVGRTEKLKVRDDLRNTKNANIDLSPILTPAHTIRPGVATHCVRKQDHKLHIRVDNKLIDESELTLAKGLPVTIDCEVVNTDRSLGTTLSYRVSKTFGEQGLPHDTIHVNVTGSAGQSFGAFLASGVTLELEGDANDYIGKGLSGGRIIVYPPRESKFKAEDQIIAGNTAFFGATSGSAFIRGIAAERFAVRNSGAIIVTEGTGDHGCEYMSGGRVVVLGATGKNFASGMCGGIAYVLDMAQDFS

SEQ ID NO: 17500 - protein, 137 aa, Candida albicans
RSGLKGIKTVSVEWKRSDSGAWQMAEVPGSEEFFPAEVVLLSMGFLGPEADNLEVQKTKRGTITTVDPNVYKVDKDDNVFAAGDCRRGQSLVVWGIQECRQCAREVDEYLMGSTRLPGNGSVEQRNYILLEELAEEV

SEQ ID NO: 17501 - protein, 530 aa, Candida albicans
FLFLKKRNTMSPSASYLPQEEFSTTNVYDYDEVPENKSWASSLPVAKGLYNPELEKDACGVGFTCHLKGVPSHEIVSDAKSLLCNMTHRGGELNPQDGDGAGLLSSIPHKFLKREFQYYCNVELPAKGQYGVGNVFFKKDDAVFEKSKKTFESIADSLGLKVLGWREVPHDSSILGAAALSREPYILQPAVVYKEIWGQEVSDDEFDSKYRKDFEKRLFILRKQASHTIGLHNWFYICSLSNKTIVYKGQLAPKQVYSYYHDLVNAEYESHFALVHSRFSTNTFPSWDRAQPLRLAAHNGEINTLRGNKNWMRAKEGVMKSKLFGDEMDKLFPIIEEGGSDSAAFDNVLELLVINGVVSLPEAVMMMIPEAWQNDENIDPKKKAFYEWAACLMEPWDGPALFTFADDRYCGANLDRNGLRPCRYYVIDDDRMICASEVGVIEIQPEKVIQKGRLQPGRMLLVDTKEGRIVDDRELKSKVVSRYDFTSWVLANMISLQDLNEKLASRKIDINAKPIDVNVNVQSDPSSPRL

SEQ ID NO: 17502 - protein, 151 aa, Candida albicans
LHKRGSVSTEVKSQEGNVKGIKTVRVEWKRSDSGAWQMAEVPGSEEFFPADVVLLSMGFLGPEADNLEVQKTKRGTITTVDPNVYKVDKDDNVFAAGDCRRGQSLVVWGIQEGRQCAREVDEYLMGSTRLPGNGSVEQRNYKLLEELAEKV

SEQ ID NO: 17503 - protein, 161 aa, Candida albicans
YRCMDCGVPFCTSDTGCPISNVIPKWNELVFNDRWYDALQRLMMTNNFPEFTGRICPAPCNGACVLGINEDPVNIKSVECAIIDHGFEQGWIKPTPPAHRTGKTVAVIGSGPARLAAADQLNKAGHLVTVYERSDRPGGLLMYGIPNMKLDKGIVKRRTDL

SEQ ID NO: 17504 - protein, 362 aa, Candida albicans
  UNSURE (274): Identity of amino acid sequences at the above locations are unknown.
LDLIKTHIIYYYQVEDIHLEKEQLFHLVASVLGVGSDIGGSIRYPAAFSGCHGLRPSTRRIYGRGIDGGADGQESVPSVIGPLARSIDDLELWMKSYINDGKPWNFDPWCLPIPWRDMSPPKINQLTIAVVRDDGVVRVSPPIRRALDIVVEKLQNEGAKIIELTTTTHPLTNSKLAYDCATKLSNADGNHLMCQLFSQSGEPLKKLTKWYLNLGDGAKHYTVAENRELNRLRDTLREEYSDFMVENKVDVILGPAYNNVAPHREKVYNESYTXIYNLLDFPALVFQTGLFQDPEIDRWNESDLQYEYRSGMEELENDSYKPDECCGAPIALQIAGRRYFDEEVVAAGKSIVEFLGVDLLKR

SEQ ID NO: 17505 - protein, 436 aa, Candida albicans
  UNSURE (407): Identity of amino acid sequences at the above locations are unknown.
LVHYKDNFNVKGHGTTLGMVNFCFNPQQVEYDSTLVEMLRQLGAILYVKTNVPVAMMMPETTNHVWGSTVNPMNRLLSCGGSLGGESALIKLKGSPIGIGLDIGGSIRIPASFQNLYAIKPSFGRFPTFGTRSGLPGLESVNSVNGPISNSLDDLEFYCKTIIDAKPWLSDAKCIEIPWRQVEFGNDSIDREKVNGNSASSQASPKLNIAILMDDGFVRPTPPIRRGMEIVTEALKKDGHHLIEWDPQDHVRLSEIIGQFFVSDGGHHVLEETTVVNEPFFPYMENYGTSKDIPVSQLWQLQRERTVLIDKYLKRWNSTADITTNGKPIDAIIMPATPFAGNPLGKFPTYVGYTSPFNALDYTVGVFPVTRVDKTVDVGDEAPGNYNEIDVQVWKDYDPEESHGGAXALQLVARRFEEEKVIAMMKIISELINYTD

SEQ ID NO: 17506 - protein, 157 aa, Candida albicans
LLLSIMTITRQHPVYKDIAAKKKSIRDDKFNPEWLIPQHELPDDEVTDVLNWIKKTNHLTPEEIIITESKAVGIVNNIKSQTWTSLEVTLAFCHRASIAHQLTNCLTEIFFDEAIKRAKELDHYQLVSPGGGKLAVPFHGLPICLHHECQDRHMLPN

SEQ ID NO: 17507 - protein, 575 aa, Candida albicans
NTMSVSYETFLNKDPLDKYEDSDIYTKEWLPKVEKYRQDFTDAIPKNYTIELPKPIDDLIKDQFNAVDYLYSQKLLTPEEFAITDLSATELAKKIAAGELSSVEVFKAFAHRATLAHQFTNCAMELFIDEGLKQAEERDNYFKEHGKTVGPLHGIPISLKEQMNYKDKITHGGYVSKIVNIPNSHGVTTSILEKLGAVFYVRTSQPQTLMHLDSANNFTGLTKNPFNLLLSSGGSSSGEGAIVGYGGSAIGVGSDIGGSIRAPAAYSGCHGLRPTTKRISVKGGVSSGAGQESVPAVAGPMARSIDDLELWMKAYINEGKPWESDSTSLPMPWRDVSTPKIGDLTVAIIRDDGLVRVSPPIRRALNTVVEKLKGAGAKIIEFDPPNTKLAYETVHKMYNCDGNHMQRKLLSGSNEPLTKLTKWNLNYGEGAKHYDVASNRELNVTRDQLRDQYNDFMVQNKVDFILSPTYNNVAPHSEEVYNWSYTSLWNILDFPTLSFQTGIFQDPTKDKWTEEDTKYKYRSKLEQLENENYDPSQFVGAPVGLQLSGKRYFDEEVLAAGKAIVDLLGVDLYKH

SEQ ID NO: 17508 - protein, 321 aa, Candida albicans
TMVHHKVTIIGSGPAAHTAAIYLARAEIKPTLYEGMLANGIAAGGQLTTTTDIENFPSFPNGIGGSELMEKMKEQSQRFGTEIITETISKVDFSNRPFKLWTEWNEDAEPITTDAVIIATGASAKRMHLPGEDTYWQQGISACAVCDGAVPIFRNNPLAVIGGGDSACEEAIFLTKYASKVFLLVRRDVLRASTIMQKRVTNNEKIEVLWNTEALEAKGDGKLLKSLRIVNNKTKEEKDLQVNGLFYAIGHIPATKIFADQLKTDEAGYIQTTPGTASTSIEGVFAAGDVQDKIYRQAITSAGSGCMAALECEKFISEQEA

SEQ ID NO: 17509 - protein, 216 aa, Candida albicans
KVSPDTLIIVDGVCSIAVEDLEFDKWGIDFALTASQKAIGVPAGLSIFYASERALAKALNKEKESTFFASLKRWTPIMKAYESGNGAYFATPAVQTITALKTSLDEILSQPIDERFAKHAQVSDKFKSNVEKLGLKILPVDHKVAAHGLTAVYFPDGINGPDLLKKLSEKGFVVAGGIHKKLVGKYFRVGHMGYSVYAGHVDKLTKALEESLNELK

SEQ ID NO: 17510 - protein, 158 aa, Candida albicans
LKYPGPNEFSEDVWHSMATPSQAHTSPEFISTFQSVLKSLRKVFKSTDTNTQGYVLSGSGTLGWDVASSNLLNPGEKVLVLSTGFFSDSFAECLKVYGADVDVLTAEVGDVVPLDKIEQQLQKEKYSAITITHVDTSTSVVSDVEAISKVVKKFLLIL

SEQ ID NO: 17511 - protein, 585 aa, Candida albicans
KLIADRPVPLVKKRLAKNHNKLYAIDFSIIEKLDEANSATKGFSGEFLIQLAFWRSALPELGGFIVNKLLQANGNSFELLGTVLDNFINSVDENEGIKEIPVVPEWVDLKDEVKEAEEKKENEAEEKDKEQAEAETEAEEPKELPFFPIETSFFANPRNPIEAAEEINNTGYKSLAQKITFPEAYNVSKDLRPDLPVKNFVVKVQENKRLTPTEYSRNIFHIEFDTTGTGLTYDIGEALGIHGRNNSEAVEEFLKFYNVDGDSLVEVTNKDDSKIVEIRSARQALSETVDFLGKPPKRFYESLAEFATEEKEKAALTKLASAEGAEELKKRQEVDFDSYFDILQEFKSARPSFEELIKIIAPLKRREYSIASSQRIHPNAVHLLIVVVDWVDPNGRLRYGHCSKYLSDLKIGDELVVSVKPSLMKLPPLSTQPIVMSGLGTGLAPFTAFIEEEIWQKQQGMEIGDIYLYLGSRHKKEQYLYGELWEAYKDAGVLTHIGAAFSRDQPEKIYIQDRIRQTIEELTDAIVTKNGSFYLCGPTWPVPDITACLEDIVRNGAKKNGEEIKDVAKVVEDMKEDGRYILEVY

SEQ ID NO: 17512 - protein, 193 aa, Candida albicans
AILNHFYSFFSGKPSVYLFDGPEFVKTFKKFENVLSTNDIFQLYQGLLDSAAGEVSIDAAFNALNKVTGKNYSQFEYVGSENPKTVFVVYGTHQSTQLSQIVSKLDVGLVKVRVPVPFNQEKLVQVIPQSTKKLVVLSSNDGLMADVTAGLFLGGRYHSLSLDEFNYPLDFKWTPVTVTKLLNEFVSLDFEKI

SEQ ID NO: 17513 - protein, 268 aa, Candida albicans
LKKKNEQWRLVLRKFGQTQDYIYEEFFDNVVVASGHFDVPFVPEIPGLQQFSELDDTLVIHSKQFRSRDDFKDKQVVVVGASVSAMDSIRDILPVAKRAITSQKPTTEPHVYFGTEAFDHDGIEKRGQIVKIEDHTIHFHDGTSTFADAIILGTGFLYHYPFLPKFPELKELIFDANDPSLAFVGHNTPGLTFKLFQWQAILVARVFAGKGNVPTTIRNDPTIHPDFNQYYETLRDASCGALPKWNPVWEEAFYRGHLRRRQYWLDNP

SEQ ID NO: 17514 - protein, 282 aa, Candida albicans
TMTKEQIDEPRYKRIAVIGGGPTGLAAVKALSLEPVNFSCIDLFERIDRLGGLWYHHGDKSLVKPEIPSLSPSQEEIVSDNATPADEYFSAIYEYMETNIVHQIMEYSGVAFPANSKKYPTRSQVLEYIDDYIKLIPKDTVNISINSNVVSLEKVNEIWHIEIEDVIKKTRAKLRYDAVIIANGHFSNPYIPDVPGLSSWNKNYPGTITHSKYYESPAKFRDKRVLVVGNSASGVDISIQLSVCAKDVFVSITDQESPHFEDGFCKHIGIIEEYNYDTRSVR

SEQ ID NO: 17515 - protein, 119 aa, Candida albicans
SRLLTISLCLGFIYVSGQIPYTPDNKPLPASATIADYAEQAIQNVSNILEASNSSLNHIVKANIFLTDMGAQFGEFNKVYAKYFSEHKPARSCVAVKELPLGVPLEIEVVAIEKDDTKL

SEQ ID NO: 17516 - protein, 184 aa, Candida albicans
FSFSYQATMSRALSSTRVLVNDTLLPATIIFSVESGTILEIVDRVLPPNDPILARYNVFPIDYRNVTPAVIMPGLVDAHVHLNEPGRTEWEGFETGTKAAASGGVTTVIDMPLNAIPPTTTVANFNLKINAAKGQTWVDVGFWGGLIPDNLYDLKPLIPMGVRGFKAFLIESGVDELPRSRQPL

SEQ ID NO: 17517 - protein, 408 aa, Candida albicans
HTPILAGAEPTFGKNARKVNTHHLRSYSYTEEDTKVNTPLLLAQQENAELANIDPTAYATFLASRPDNFETTAIAEIINCSTLLPTVPLHIVHLATHEAVPLLRAAKAKGLPVTAETCFHYLSLCAERIGSCSTHFKCCPPIRTDDNRKLLWKALRNDVITTVVSDHSPCTPDLKGMEKGDFFEAWGGISSVGFGLPILYTEGLKLDPPISLAEINKWCSWNTAKQVGLSHCKGTIRVGYDADLLIFDTDAKYVVENKETYFKNKLTAYDGMEFRGRVLETLLPLTSVLLYSFSSVVHLYRSSLLFILLSYFSFPHLSLLVATLHPFPPHFLQSLLLSLSPPSISFSTSSGYYSIPPSIPSPLTLFTDLFSTSLTFNLLSHFAPILLNPHLFSPLLLPPSLLFTTSPP

SEQ ID NO: 17518 - protein, 187 aa, Candida albicans
TLFKAFSMTKILSQDDFQKQIVSQYTDVIGEKLGGKVLSFSDQWFADAENLIKPKPPIRDATRFTYAGAWYDGWETRRHNEAEADWVIFKLGVSSAKLIACEVDTAFFNGNHAPHISVEALQNFDASDENLQNVKEEDWEEVIAKVECGPLQKHFFSRGSLTNKNYTHARLRMYHGRLISHDMESTL

SEQ ID NO: 17519 - protein, 123 aa, Candida albicans
LPGRGHDMSDGWETKRSRHPGHTDWVIIRLGAPAKLLEIVVDTAHFRGNFPQKVNVKGINVDEESKIEANSDAWEVVVDDSKTSADKEHAFKVKDNSKVYSHIKLTIIPDGGVKRIRAFGVKA

SEQ ID NO: 17520 - protein, 214 aa, Candida albicans
TMVLKTFKVDGISPIKAETLTPESFLKYGGVISADHQLEKVQSSEANYGTAIKIHKVAPIVNNYSNCPSGKEATANWNIFRCKAPKHLINHGSLNSVYTSKVLERHPFSTQTFLPLGQDLHKVSYLVIVAKTDESTEEKLPDPTLIRAFVCKGNQSVTYGIGTWHAPMVVIDEKVPHIDFAVFIHENGVADEDVQECYFEPGYSIVYNQIEAKL

SEQ ID NO: 17521 - protein, 616 aa, Candida albicans
FNIHFSLFFQLNFCVVLLLWPLNFYHPSYLINSLKKMIGLPLDENFRSNKRKSIIIGSVVFVALLVTLFSTNLFNYLKIVTTPIPKESSLCPLYEPIAPESYYKDNSTVLEILHDKKYKKESIKRLAGAIQVDTQVFDKQPAVDDAPQVWAKFAKFHDYLEQTFPLVYKNLKVTKVNTYGLVYHWKGSDKSLKPVLLTAHQDTVPVQKDTLKDWTYPPFEGHYDGEYIYGRGAADCKNVLIAILETLELLLAKGYQPKRSILAAFGFDEETSGYHGAAHIGKYLEETFGQDSVYALIDEGAGLTVQELTNTIVALPGTAEKGYVDIQVELTTPGGHSSIPPDPTSIGIISELGYIIEKDPYSPLLPPENPILNFAQCLALHDPKNNIPSSFKKAILRAGYDKFANSKLVEGISKNRLTKYLIRTSQALDIINGGEKANALPEHVKLLVNHRVAIGTSVAEVQEHFVSRVVEVAKRHGLSVSAFGKDVLKVKNDSGLFNVTNFAGFLNAAPVTPTNDTVWEYLSGVTKHVYEDLVFPEIKYPVITAPAIMTGNTDTRHYWNLTRNIFRFTPAFIGDFIGETHIHSVDEKLPFDSHLQLQAWFYEYIQAIDSAKANNK

SEQ ID NO: 17522 - protein, 228 aa, Candida albicans
AFALKKINKFGLVYTWKGKDTSKKPIMLTAHQDVVPVPHETIDQWTFPPFEGGFDGKYLYGRGVSDCKNLLIALMGTIELLLEEDKFKPQRTIILAFGYDEEAAGKGAEEISDYLVNKYGPDSILQIIDEGDEGYQEIEGVKLVLPATGEKGHLNSVIDLFTPGGHLSVPPRHTSIGIMSQLITKIEDKEFSPILTNNNPVLGQLYCLAEHSKILNKSIKRDILTAPN

SEQ ID NO: 17523 - protein, 132 aa, Candida albicans
IDNQEIIEPTEHGYFNYSLIESLEPAPVSPINGESWNIFGGSLRYLYEDLIFPDSNDTFIVAPFLSTGNTDTKSYWDLTRNIYRYQPSIVTKNSNIHSIDEKLDFEGHFHIIAFYYYYLQLVDGKDDKLFEP

SEQ ID NO: 17524 - protein, 491 aa, Candida albicans
NLAHTKNIRIPNATSRHHITRLLLQFSFLLFSFSSYTFMLRRLFPIRQLYTTTRAMASKSTDPTSLHNPYFYQKPGQKDIWSLINETAAQAQQESGEPIVNLGQGFFSYNPPEFAINAVEEALTKPQFNQYAHARGNPNLLKQVAEHYSRSYGRAVGVDEVQITTGANEGMFAIFFGFLTPGDEVIVFEPFFDQYIPNVEMTGAKIKYVEIKYPKKFDNEVVTGQDWEIDWEGLNNAITDKTKIIVINTPHNPIGKVFTEEELYKIGKLAVEHNLILVSDEVYENLYYTDKFPRPAALPQLPELAERTLTVGSAGKSFAATGWRVGYIQGPANLIKFVTAAHTRICFSTPAPLQQAVSQGFEQAEKSNYFENTRKEYEHKYKIFTKVFDDLGLPYTVAEGGYFVLVNLLKVKIPADYEFPGTISDRGTLDFKLAYWLIKEIGVVGIPPTEFLTESNRKGNGLENCVRFAVCKDDSVLEDAVERLKKLKDYL

SEQ ID NO: 17525 - protein, 282 aa, Candida albicans
SMLTDLTSHFQYMAISLFVGYKALLNNETPVSCIVVDSKSDKIISIGYNYTNHSLNGTQHAEFIALQRFGEQKLSIDYNDLILYVTVEPCIMCASYLRQLGIKKVIFGCGNDRFGGNGTILSIHSDITLPNAAYSSIGGICRTEGIQLLRNFYIQQNESAPNPKIKKNTDIESKEYPENQFCSISKDEFIEFYGNERVHIYDGKIFEITPLQNKGYDIKELISLDMMQKVPFLEDELGQITDEQIIEFHNLFFNINDDGTVNYKKPIGKYNSKKRHFANDEE

SEQ ID NO: 17526 - protein, 533 aa, Candida albicans
IPSPENMPIPTPHGGKLRDLVIRDAPLKQQLLQEAKTLPALTLTARQLCDLELILNGGFSPLTGFLNQEDYNSVVNDLRLSSVKNESNGKGLLWPIPITLDVDETTSKKHSVGDRIVLIDLRDETPLAILTIESIYKPDKKLEAEKVFRGDSEHPANKYLLETAGDYYIGGELQGINYPKHYDYVDARKTPTELRQEFEKLGWAQENIVAFQTRNPMHRAHRELTIRAAQDIGDKAHILIHPVVGLTKPGDIDHHTRVKVYKQILTKFPDGLATLSLLPLAMRMGGDREALWHALIRTNYGVDHFIVGRDHAGPGKNSQGVDFYGPYDAQELLAKYDDELNIKIVPFRMVTYLPDEDRYAPIDTIDVKKVRTANISGTELRNKLKTGDEIPSWFSYPEVVKILRETNPPRSKQGFAILIDNSHKLGDYLSFALQSTLNQFLGERRITKLNAHQANDSFIVGELVKAGSGVIVPTTNPTPIVNVVGNGNSLVVNQKNNNNQASGNADGEFNLSNDDLVAVVDEIVNYLKDQGFY

SEQ ID NO: 17527 - protein, 295 aa, Candida albicans
LWSKKSIKLSDGILSEKLENLSLDSIVSKFNVKPFEVVNKASSQKDAVLFLGQLNDELVNAANKENALLINIKIYKPFQLQHLLNIIPSSVQTISIVQQSTTPIVTFAPLLLDFFSEYSKYQALNNFTKIVSATFGFVTDYTAAISQLLANTRSDNPKQNLSFGKVNTVLATKSSKKKYEDYLEAVSEAHNLEQAYLKVLQQINLTNLKVLNEFQAANAGLEVNPEFGFGSFLFDQEQQENLVSLVQKSIKENSFHSVYNGKLIELLSQWLVQIQDSGEVENILPVEIVDLLKTY

SEQ ID NO: 17528 - protein, 60 aa, Candida albicans
  UNSURE (30): Identity of amino acid sequences at the above locations are unknown.
KNWLIGSDAWSYDLGSSGVHNVITSGKNIXMLIIDSEPYSENLPTRPLMVLVKKMLVYMQ

SEQ ID NO: 17529 - protein, 920 aa, Candida albicans
TIFRKSSDKAINGSRKKDVGLYAMNYGDCYVASVAIYSSYTQVLQAFIEAEKFNGPSIVLAYLPYNSELDNTLTVLQETKKAVDSGYWPLYRYNPRVQNEADAFKLDSSNLRKQLSDFLERENKLTLLASKDPLLSRNLTANANTEAKTKQSKIADESFAQLLQGLSGPPLTVAFASDGGNAEAVAKKVNRQALGRGLKSVVLQMDDLSVEDLPTETNVVFITSTSGQGEFPTNGKQFWDGVKNTTDLDLSGIRFSVFGLGDSQYWPRKEDKHYYNKPAKDLFAKLKLYGGVELADIGLGDDQDADGFSTGFNEWIPKIWAALGVDNVEGVEEPKPITNEDMKIGSDYLRGTIVEGLNDQSTGAISAVDQQLTKFHGIYMQDDRDIRDERKAQGLEPAYTFMVRVRLPGGIATPDQYLKMDELADERGNGTLKLTTRATFQLHGVVKHDLKPAIRGMNSALMDTLAACGDVNRNVMVSALPHNAKVHGQVSQIGALISEFLLPKTTAYHEIWLQGDDAGDKPGYREAWENRKEGPTKKKTLVAGNVLADVEPQYGVTYLPRKFKIVITVPPYNDVDVYAHDVGLIAIVEDNEVVGFNVLAGGGMGSTHNNKKTYPRTGSMLGYVSKDQVHIACEKIMLVQRDFGDRTNRKHARLKYTIDDLGVDVFKAKVEELLGYKFDEPRPFKIESNIDYFGWCKDELGYNHFTAFIENGRIENTPELPQKTGLRKIAEFLKSGNRSGEFRLTGNQHILISNVSDQDLDEVKKLLAQYKLDNTDFSALRKSSAACVAFPTCGLAMAESERYLPVLITKLEEALEGYGLRHDSIVMRMTGCPNGCARPWVAEVALVGKAYGAYNLMLGGGHHGQRLNKIYRYSIKEDEILDILKPLFKRWSLERNENEPFGDWCIQSRMSSTRGGRILS

SEQ ID NO: 17530 - protein, 247 aa, Candida albicans
  UNSURE (217): Identity of amino acid sequences at the above locations are unknown.
RRAIEYTGPSDAKSAIFIFGSTGVFVDVLAKAEANSELENIGLITARLYRPWVGGQIVNSIPSSVEKIAVLEQVRKTTKWGPSFMDLLSSLTPPAGRPTPQIVGYRLGYVEPSTAVQALRGIVQNLNSSSPIQNLEIGSAKAPATEHSLEQPHVENAYLKILNQLFAERLYIANQLGSQNAGISSTIAASPEYGFGSLIPRKERPSRFVREIEEASXFTDFTSESRSSLSHWALNVKDASKANKWAP

SEQ ID NO: 17531 - protein, 475 aa, Candida albicans
ISIHTQNYYFISYHILFYLFSPMSMSTRLKLVSKLGIDYPIFLSPMAGVSTIDMSIGVSNNGGLGSIPLASIDFRKQDSIEKLENLIIEYKKKLINSTTTKTKTKTKDNDQLVVNLNFFCHEIENEPNQQQINNWKQLYKQSVFDNNTEDDDAFKLLDEIQFINGNVSFKEIENNENHIDQYNKLMEYLEQLKPSIISFHFGMPSPKTIKRLQNQGIMIFITSTSLEETIYLTNNNNNNNNNNNNNNNNNNNNDDDDAKIDGIILQGYEAGGHRGNFLISDDKFDEKLSTHSLFIQLKQYLDENVTTGYKPYLVPAGGIIDIDTINYYLSLGADAVQMGTAFLATPECINHKFFNTNNMSGQRKPTIMIDLVSGKFARTVTTDFITNLIKNSNNNNNYYTKNELPSYGYAYHGYKSLKSIIKNHTKNIKDIKDIKDIKDIGFYLAGQNYYQIEKNKLTQEIMKILTNGIDRDVLK

SEQ ID NO: 17532 - protein, 257 aa, Candida albicans
KNIPRSLLHYTPITKRTPLITTTIRNLFIQTSETPNEQALKFLPLIKILQDNQTKEFLSGREAASSPLALKLFSIDGIRSVMFGSDFITIEKSNNFDWSLLKPEIFSILTEYLTNGTPILLEDNVDEYGNSLLTNDMAINEDDDEVVSMIKELIFTRIRPAIQDDGGDIEFVNFNEEDGTVYLRLKGACRSCDSSSVTLKNGIESMLKHYIEEVNLVEPIEEEQQQEEINVESSTIKPINRDEPSSSVSSSSSPPSL

SEQ ID NO: 17533 - protein, 266 aa, Candida albicans
ILNDLQISNRRYFFFFSNNYSTSFFIDSTMFVNKRLLAYIPKRLYHFKTLPTPNPNALKFISPECNILPMDDKTFEFTTTLQAIHSPLALTLFKIPGVKFVMLGHDFLIVNKQDYINWANLRPEIVEQLDEFLTSKKHPVITKELVDEAQREAEEESELISMIKELIETRIRPAIQDDGGDIELKGFDEETGTVFVKLQGACKSCSASEDTLKHGIESMLMHYVEEVKEVIQILDPEEEIAVKEFERLEQKLKNGNSQGEQAPPSL

SEQ ID NO: 17534 - protein, 474 aa, Candida albicans
SWKWGKPQPTIKETINSFVGKIFHQSSFSINYTITTSMSSTPDFKVSSETAREYETKYSAHNYHPLPVVFSKAEGAHVWDPEGKEYLDFLSAYSAVNQGHCHPKIVAALVDQASKLTLCSRAFSSDVFGVYAKYITEYFNYEMVLPMNTGAEAVETGLKLARKWGYDKKGIPSGEAIILSAVNNFHGRTLGVISMSTDPDATTNFGPYLRGVGPQIPGEPDGTLLRYGVIEDVEKAFANAGDKIAAILLEPIQGENRYCCFHHQHYLPRVQELCKKHNVLLICDEIQTGIARTGKMLCYEHSKGVKPDIVLLGKAISGGVMPVSAVLSSKQVMLTLEPGSHGSTYGGNPLACRVAIAALDVVRDENLVERAQKLGALLREKLEELQKESNGMISEVRGKGLLSAIVIDESKTNGRTAWDLCLLMKNHGVLAKPTHDNIIRLAPPLVISEEDLLKGVDSIRKSLKELPNVAKTEH

SEQ ID NO: 17535 - protein, 455 aa, Candida albicans
TKTLIMRKTLTSIRFLSDGIRVKDKWNSLISDLVVEPTNSTGPLSGTTYIVKDNIATSHGYTTAASKILSNYESPFNAMIIDLLSSNGSKLIGKSNLDEFGMGSANYNSYFNKVTNPYDNTKVPGGSSGGSAASVAGKMCSFSIGTDTGGSVRLPASYCNVFGFKPTYGRISRWGVIPYAQTLDTVGIIGENVNIIKRVYDVLNKYDDKDPTCLPEEVRQKIPTTKKETLTIGVPHEFVLKELSADVRESWEYALSKTCKLGHLVKPISIKTIKKALPSYYTLATAEAASNLSRYDGIRYGYNTNELVNSPIELIATNRSNGFGSEVQRRILLGNYTLSSDSGDHYLRATQIREELCAEFSSIFNNSHVLLQDEQSLDKVDLIMAPTSTSTAPTWDEFVSANEKNFLNSYVNDVLTVPASLAGIPAISVPVNGIGIQLMGQFGDDDLVLQLADQI

SEQ ID NO: 17536 - protein, 467 aa, Candida albicans
ITKSKSCTTQIMTNSVIGQLKNFLTALNLLSIHSSRKEIFFFLNYKRDSKNLLNENFIYLFFFSFFSFLLFLFHSIYTHTYTQNTNRNMSKGKVCLAYSGGLDTSVILAWLLEQGYEVIAFLANIGQEEDFEEAEKKALAIGATKFVVVDVRKEFVEKVCFPAIQSNAIYENVYLLGTSLARPVIAQAQIKVAEENGCFAVSHGCTGKGNDQVRFELSFYALKPDVVVIAPWRDPEFFQRFAGRKDLLDYAASKNIPVAQTKAKPWSTDENLAHISFEAGILENPDTTPPKDMWKLTVDPTDAPDKPETFSVVFEKGLPVKLILDDSKKEITDPVELFIEANSLARRNGVGRIDIVENRFIGIKSRGCYETPGLTILRNTHVDLEGLTLDREVRAIRDQFVTPTWAKILYNGMYFTPEREYVRSMIPPSQVTVNGVVRAAAYKGSVTILGRSSDTEKLYDETESSMG

SEQ ID NO: 17537 - protein, 206 aa, Candida albicans
NYKQSEYPIDGNPPPIEEEEQNKGEIENLVNPVKLDQDQFNENYKQQVIEYEELLDLVTKKKNNGYGLKDYLLLDARSLDRFIGKANEPRPGLSSGHIPGAINLPFNTLLTGNNNQFKNKQEILEIFHEKNILNGNGSGNGDDKIENLLTNYPKGIIVMCGTGVTAVILKFGIECILKLNVPVRVYDGSWTEWASRAPSEYIQKDI

SEQ ID NO: 17538 - protein, 147 aa, Candida albicans
TTINNNNYYHYHHHHFMSRSFLTTITPSAYRALLSTSNPSKRVIPIDATWYMPNNPKNAKQEFIKERIPNLKFFDLDKYIDPTSPYPHMLPSHISIMEQAYKDLQLNLNDSIVVYDKLGIFLSPRAAWTFSLFGHPKVYLLDNYLKL

SEQ ID NO: 17539 - protein, 190 aa, Candida albicans
THIMFTRTILPTTRRILTQQSRVLVPRLAIPTSTFTRSYHEKVIDHYENPRNVGSLNKESSDVGTGLVGAPACGDVMRLQIQVDEETGKIKDVKFKTFGCGSAIASSSYATELIRGKTLDEALDIKNTLIAKELSLPPVKLHCSMLAEDAIKAAVKDYQSKRKTTTLGATAASTVSSSSASAAAPATATA

SEQ ID NO: 17540 - protein, 161 aa, Candida albicans
AMGNIVQLTPEHISFLNEHLKTLSAYNIIKWAYFTFPNLYQTTAFGLTGLVTVDIISKLSQELEKDHLIDLIFLDTLYHFPQTHELVQKVEQKYRPKLHVYKPKDVSTEQEFAAKYGDQLWESNDAYYDFLVKVEPSQRAYKELGISVVLTGNKKVLRWCP

SEQ ID NO: 17541 - protein, 310 aa, Candida albicans
ETPKESNSLVSLIIMSSSETSEIKGSLLLAWQVKDKHCLVIGAGDVALSRIHHLIKAQAKITVVTGASKIHPQIIELNNQGKLYNFFQRDYQSNDLTIYENINSRINDLDLINSENYNLIDQQVYQEMFAVVCCCIDDYELSTKIYYQCKYLRIPVNIADKPPLCDFYFGSMINQDNLQIMISTNGKSPRLSRMIKDNISKEFENVNLNQAVENLGLIRSRLREMILIDDDLNTIDTRMTWIKNLTDFFTLKQWSEINLIPPSSTPPYDNRFQYVDNIINYFPDYPPKDYEEFKDAIVFTHGDWTIQRAR

SEQ ID NO: 17542 - protein, 235 aa, Candida albicans
KNRRIRINNRHLEPNFIMNKALQPLRTLRRIVWGQPPDNPVARSYLFKLDAFVLSYVCLLYWANYLDRANLANAYVSGMQEDLQMKGNELNIINTCFYVGYIVAMVPHNLILLKVRPRYWISICGFCWAVLTLSMYKVHSFKQLCVIRFFEAMFKAVTFAGTHLILGTYYDEELLPMRTAVFTSSGLLGSLFSGVLQAAIYKNMEDYNGIRGWRWLFIIDFLITIPIIMGWMSST

SEQ ID NO: 17543 - protein, 290 aa, Candida albicans
  UNSURE (240),(249): Identity of amino acid sequences at the above locations are unknown.
SPTWFLAAARGEDKYLEYALDHLNKSMFDRPHHDRQMIVNMLATLMILCAAEICKGDVKNWSVYLHWGWKLLSNNGGILSFNKLKEEHWLISNFAYHDLLASSSSERGTYFPSEEYDFIFRDDDGFSLGNLNPLLGISKNLYRIIGDISTLLYESKKQLDIFYSREFTGTPPGVVEKLNNEDADGNVDDDDDCESQLSDHGKASQILLSVISKVKNLEKQIDESKPAAKDLVGLTDQELXLQLTLFEAXQLIAKLFLRQSIMKCNPSMLESQVLNNELIKCSDVLMGDSF

SEQ ID NO: 17544 - protein, 447 aa, Candida albicans
ARDSPDLWWQTRLNSHIFEPLEYLNVQGLYFLDGFIANVAKKFSIGHESSNYILKTFYQLSEEHEAVSYALAAWGGIFIEGGFTENVNHFLGEAIFKMSQEYPNLNNISKKDVYILLNYYLVYIGLQVCAGDVSQWHQIFHRTIDLVKRQGGLSSIIEMFDCSNEIKWLLSDIQYHDILSLNTFQKGTMLPMEEYNSVFKEAKILELGNYGLDPFQGCIQPIYLVLGEITSLAVDLRLRQHEIEIDGDITLRLEFYHEADKCYRDLSYKISNCIPNIEQMKLIKDDRYELELHLTLFEVYLLTCQLCLNYLIKKLPANTLDMQLLVLNCLALIDILIDTKMKSALSFLLLVCGITCCSKNDRSSMLNRFKIVSDDYKAGNVTLIKSIVEKVWERNQNGQLCVDWLTICQENQLAHLILLRIYFMIYSLEQNMSVNRFIWLLCSEIIK

SEQ ID NO: 17545 - protein, 493 aa, Candida albicans
  UNSURE (259): Identity of amino acid sequences at the above locations are unknown.
IQNLLLVTEVFMSSQSPRFKRQRSKTGCKNCRLRKRKCDELHPTCTFCHTRDLICEYNEIKILNPTSFKPSKRIKKVQKNPLVSCSDLIPLTTDLHFPEPIFSPILNTNALSPLILYLDDQGIDYVRQFEQIASTLSLSQSTNYIKSTFLTLAFSNEAILNLLAAWGALHYGDSDDVNKYLMLAKGSIKNPHDRCDYFTTFACYLIQMAIYINTGDTQNWFQIFGKCETMIREYGGLINFITDFQYSNDCKFLISNFQXYDVMSSESLGRGTTCTMDKYLSLFKRRRILDETYGVDHYQGCCQPIYLLLGEIMNTYVELKKDRHNIVNCESVNVRVQYYKKVNEKVDHLIQSIDKCQPTPIPDGDGLQLKLFELCCIIGRMYVLLYIKQTQPKSSEIQLLLLDAISIIDELISTHLASNLSMALLMCGITCGNKYDRQNINGKFKIVYDKFRQGNLKRIWEIVKESWERNPLGNVCIDWLDICHDFNWKISMI

SEQ ID NO: 17546 - protein, 78 aa, Candida albicans
  UNSURE (22): Identity of amino acid sequences at the above locations are unknown.
ASVVPSSPVVKTRREPSCSQCXRLQLDCDYSDKRPSYMSDPNLQIQKLKEIRAITNQNKRANFLSSKGKAGLRTSNTQ

SEQ ID NO: 17547 - protein, 968 aa, Candida albicans
  UNSURE (17),(20),(21),(30),(38): Identity of amino acid sequences at the above locations are unknown.
QHQLQQPVQQPGQEQWXENXXRNHSLMQQXTRVAATYXRKRALTACDTCRLKKIKCDNVRPRCGSCIKNENLNCHYRTDDQQKDYSSYDPASLNILSKLDVILKDLKEIKSGNSNTGTISTNSTDKPSPDDPSSMSSTFSPAPTQQQQQQQQQHPQRLTKAQGKKFTFDKCIWDMSVLSIFKWDFFKNTFNLSSKDIEDIERQLKNDYDTDNSKNIGVIRHNSLIESIKQYEILEKLVSNNFLTIMNSFFVNAYTKVPILESYEFFDILETFQILLQHLPNMSFSRLVELYIDDNTIPPEVQQVFCIDDDDDNNNSQLNEKRKLTVEQYIRLIKSIPLILIISALGIISVPVQLDNLTKYKNSQEEAKSISVGCLSGDNVFNDIPADFPRQRNVIAFMLKDYAQLLCNVFSFILENNTIESVQYYLFLSQLHLQQNSIILAQRACLTASQNVMYLLEKADLTKVSQLKLEVINRLYWTCLKLECELNVELSPFVPLSGITQVDPPSTFPKIPESPKNDELKSKFNYSDNAIRLSQYYNDRYSWYYFLTEIAVRKVDNEMFDEIYSLENNLNHLWDSQIFADKTIWSSFIEYLNRYNGIINSLTPEIRNFVLHEVNVEQIFHRLKKKYERKQLQENKTNNTATATAVNADEIIDNLDDFLIDEDLIVRAQSENIMFIKTRVVVSKLLLFRPLVYLFLQDKIPFIDIVQAVISVMGDSMNINPNPNTNTNTTSGISSSTFAIDNFNFMDSPNSSIGSATGSATGSKSRSSSTIFNLINDNESNGDLEMDYFNLINAPLFYQKQFPDEDFSKLIEYDYDYDNNEQQQQQQPTTTITIKNLSLVKQRILRIFISNLISIPKLNIPKLGTHRHPGLWYYIRNLFIGNVFQYLIYKKIQQMIYKATADVELQSILKSQLEQAQKENNDSSSSSSSSSQQPKSMEEIIGLINMVIDVKGIIASLEHSVILMEYWK

SEQ ID NO: 17548 - protein, 546 aa, Candida albicans
IYFIQYNPLISTGNGLYPAKMNSEISTNNDDIDPLLSLDQQQQQIRNPNPKRRKHNRVRTGCFTCRKRKKKCDEHQPNCENCIRNKLKCQYPSQWNEALPLNFKLETFQYDELVPLHYKRKKISTNLKSQKVPQDLFGVFLLNTSSLDVSNSNRKNNGIPAIGETVDTENVEEEVIDTKLGNSTSYESVEIITQSPIKSLSSTPSTSLSLLTHNDNQAAEHKTIEVDHPDNALSWVFAGPVTNLHLFGKYIPNIELSPQDAELYVHCARDFMQQVSLPHAHPSLSPPNVWVNLALESSILIDVYLSCGATYLACLHQNLKVDPLHEQSSQQLQINDNEQLSQKYRELSEIKYNLAVKSLMLAISTNSIDLDSDWLMTAGLSLCLRDRANGLNGSRCTKHVSFVYNLIKRRIDKKRQSQSLGNALPLLSLITPVERLLIDSFLFNYTCSLLTCGRQDYASLPSPYSFFPDIENWFDAPIVQNCEVKWMNNPVLGAARNSFQTLAKLIYLLRSHYEFDGDADDNSHYTNDDTFWALILQCPTRRNGRE

SEQ ID NO: 17549 - protein, 573 aa, Candida albicans
  UNSURE (61): Identity of amino acid sequences at the above locations are unknown.
IMIWNSVMHRLILLVVSVLVLLQQVPVPVPVIIVILISHQILPKLICILHLNKVAYYHHHXFLPPPPTSLPSQQSQNQYLDVVPPQQLTNNALKTEANSPLITDSANFTTSQPQFENTILEQSPIFSNSTILSGIDEPLKEKSPNMLNSTLPLSKSTPHHIYQPSSSSSSHVRHNKITKKSSLSRLNTSSKKNLRANLVHSLSTPTELDDANNNNNNDIVTPPKTLSPLLRKKTSFINVKKENDIDDSHDINCKNFSIDIDDMDDEDVLSDFSQPPPPIGGVSNDTMRSLAPVGGVGLGSSGNITGYRSLSNASSTSSHGSHHGLPVMNIFRHNPDSTKPSTPSPILSTASSSSTLSNKKVVKKLRGRKSKTKMNKSSIKTEQVVYEEPQVKNYQDDNDNDNDNGHGHDHDDENGGVSSDVGTGSNSTPSTTTKGKKMKLNVDLNNGGGSGTGSGSCSDENTSGNGTNTNTDSTSTSNPMVKKKHTRRRLLPRSKKGCWICRIKHLKCDEVTPICGGCAKFGLQCDYSSEKPAYVTDKILRQKKLTEVSLIRKRNQAKTKISRKKSSNDITND

SEQ ID NO: 17550 - protein, 102 aa, Candida albicans
ISRLLLNQVMFYVFDLTSNETIATDTLQAHELQPTTTPSNQQHIKLRTILNTLKRSRTGCLQCRARKKKCNEEHPVCGSCKRRKVNCSWRVTSKFKILKNGH

SEQ ID NO: 17551 - protein, 584 aa, Candida albicans
MQNTNRNNSNSSKNNSGNHQQQQQLQRQRQVNQYQSITLPPLQYQSNTHESIVLPSQQPKRGRSEHFNSQFQRNINSRPVLLPSSRDNNNTTNIPIPIILPSSTNSNNPITSSSNSRMFSPNPVSPLYPVVTTPSSALSPPTQHHQQQQQQLHKKFKTSNSGSNTPITGGGIGSPSTTSYLANSANISYTRSQPLKDNNQTSSTTKDNNNTIIENEDQKFFRLAKEALVATAKGVKTNHSNNNGKFGNNTSKIDINNHNKNNNNKSDGNETILDSTIADLLRRLQYASAPHGNPIGQISGLQTNSKGLLEVQDEYSNFPDLQNNNFFKVNNGDNNNTTSNSKFSNNYHHPSGNEPGWNFLLDEASTKTTSNNTRSTGTTGTGIGATTNIISESESELKVKRESSIANIINPSTTTTSTTTNKNNNNTSSSTKTRKYSQDPTRKFPCDKCPMSFRRSSDLKRHEKQHLTIPPNICQFCGKGFARKDALKRHIGTLTCKRNADKKLYIENLNYLNNSSQDDDDAEEEDEEEEEGLEQDRLYKKRRKSNNNNQIIKEEGFEHNDDDDDDDEEDEVKREFPTYGYQQN

SEQ ID NO: 17552 - protein, 381 aa, Candida albicans
SKKPKQSVKVETRKKKGFHDNRILWTNSSCVHGITMETSDGFIPIVAIFYSVFHPIEGTKIVHQFPENSLSTGRSPTSIGDGGLFDFDTIKNYVIPKPQLCNRLISLKIDKYKVIGYPVNMESSHYARNSFNFNFCFVFRYDMGDVSPYESAIKRMGQMFQVLEEQSFMLSSLDKDNSFFKDKAIKSNKALISSSLSSDGTTREPLDEGGNENHFHPHNVQNGTSISTPGFAKTKKIALSSIESLIQQIYQDLNNYSECCIPLDTSNSVDIKLFPILPPPINIKAYQVPIVTVRLNSLVDVNWDPTMIKILPYINGLNSVKKISELADANYLLTKQCIQHLMHYKCIEVIDIFQFGNIYAPTNHIGEFLKHDGKMGEECSA

SEQ ID NO: 17553 - protein, 182 aa, Candida albicans
VVSADFSMDNTSYVNTTTQMHLPYPGSDAHSPTYKYRSSYGTSSVSPYTKYSFLSRSPKNPMVNGSDVKVPTKTTLFYLYRSLNQGQTVKEWYMQHKKILGNVDITRFINFGVLRGIIYRVYTYPLLNSYTGAIERNDTEQYDELLSNLKKKKPKRIVSIGRNENLLKTKVNEQTLRNDVKR

SEQ ID NO: 17554 - protein, 198 aa, Candida albicans
FNILMPTSPTESIPNSSTKEQPILPKMLPTAKSPHTTPAQLPQNSDHHHHHHQQTPPQPTDGQQCSNCGTTKTPLWRRAPDGTLICNACGLYYRSNNTHRPVNLKRPPNTIAVVKEEEGSCKGDGRCNGTGGSAACKGCPAYNNRIVAKKALEKSPKNDSSRAPIDKSLKRSTSTDATTEDESSLAIACCNCGTTITP

SEQ ID NO: 17555 - protein, 523 aa, Candida albicans
QSFNILMPTSPTESIPNSSTKEQPILPKMLPTAKSPHTTPAQLPQNSDHHHHHQQTPPQPTDGQQCSNCGTTKTPLWRRAPDGTLICNACGLYYRSNNTHRPVNLKRPPNTIAVVKEEEGSCKGDGRCNGTGGSAACKGCPAYNNRIVAKKALEKSPKNDSSRAPIDKSLKRSTSTDATTEDESSLAIACFNCGTTITPLWRRDDAGNTICNACGLFYRLHGSHRPIKMKRPTIKRRKRNVSDKKSKDEVQMHLSDQSPIVASDPISPTPHNNENNNNVTNITTTTKTPTRSPHYYQPPPQYPYQHHPINSTTSSAINRLPPISYQSPYQTAPLSHSPMQSSSSYSPGASSVIPSSYYPPYSGSGRIPNGPGPVPGPPPPPPPTQSQPHHQQITTSPTSQSYGSLRAPIHITKKGYTPENIRLPSIQLTSSTSSNSETKLPPITNHSEKCCSNCAGPKSLAPMAIDFTASYRFNNINSQTKLTKEDQNDSEGVSRDNDTKDENKPIKQEEHRSALSIGKLLNG

SEQ ID NO: 17556 - protein, 295 aa, Candida albicans
NISAIRPFRRLKTKDHNVGGNNNHNNNKNNTNFLSSYISSLESTLKQQQLQQQSQPPSQPQPQSLAPVLQSGQPKKVLQCTNCQTRTTPLWRKANNGDLLCNACGLFYKLHGVLRPINGDKKRKYTKRNDKMILTDNTNIFAGLSQQNHGSSQDIAKLQPSLHSFVSQNEQPWGFDNGAIPDFNSFDALVGSNINANNTSNNTTNANNNNNTDNNVDEIDKLLNMNIFQTDFSLNNNNHHQHHDELDLLDPNGLPPGGGHFNNDPDRQNHTTTNDSNDNSTTNNSWNWLDFSPAA

SEQ ID NO: 17557 - protein, 277 aa, Candida albicans
NLSQTPPPHTRRTIGLFHFFFFLPGQMTTSNSQSKQFETVPSIVDLLYSAKKLLNLQPRIDNLHLRRSNSRTQLVMQSQALSMNNRNTASNGKDDNQSFSISPVNNQALGATHDKVLDLLSPLSIDDLKNNTITTTTTTTTSYHQNKLNQRLNGNVNTNPTHNTGNNSDTRSTLFKPRSPHSENTSPKNILSSSSSSATTTVVAVPKVNNLNHNTTTNNDGGNSEFKSSNSSLPLKKVTKCYNCNTTATPLWRRDAEGNSSCSLHLEERQDRIVSER

SEQ ID NO: 17558 - protein, 467 aa, Candida albicans
FQLFFLLKFCISLIAFFFFVIVDLIMNGANQNIPNTLPRLPSFQQLSETIRNPDFPDLLQKTHHQYHQQHRFQNTPIDCKSLMLFPINYTPVNDNGVATAAATATATAPVNGIVTTNSLNGNSIMEYSYGPTLHGRHESYPNQYVFPNQESKTGIPISNRVSPTSMDRTKAHSLDLELTNRVNTTNNDAKTYSKKYKVVFDLIQFLKKFEIKYNELKHYTFDLENDKNSNVLEKMVTELSIDDINEALVNTKKLANVFENIKSINENSTKSTNDMRRKNGLFVYENGNKKQQQQQQQHGEKRKIRKKHQHQMAKTKSLSTNGEAIPMQMSVSRNNGSITSTGFLQLVQQQAPQPQPQSQPQTQHQQLQPALELVPPHTQAQTLSAVTSNLTNGNLNTELSAKPEITCQHCCSQETPEWRRGPEGSRTLCNACGLFYSKLIKKYGLREADKVMLHRKQTGTVNDRRIF

SEQ ID NO: 17559 - protein, 719 aa, Candida albicans
LLPLQLNSFTATTPLSQVISKEQDHIENVWKMYYRARHSLPYQKRMENLTWRMMYINNKSIFTNTNNAPKEIFEQSLDPEIDDFDYVAHIKKIGQFNQQKTQQQQDHLQSNLDNHNSIFADNTGFSNNNDRGSSGGGMTSISSLLKKRPAPFSPMIQPEKTTIIPTATNTMSQLSQQLNEFNKFNHPSQTSNFNDVNHHMEISTSHIAPTSSAFEFSLDPLAFEGPNQNFQPEPHHDFNTNSFDSMTSSYERPLFDDFLPRDHHNIQSSSVPTSASSFSTIVPKNTQFSTSASITSPTSTFSNQGNNSSNFHRLNSTVSITATPGNLLRQESMVSLPDYANHLRSMSQTPTMNSSNAPFSHSFNDGGSYFMNNFTGITLPSQPSPQPIHFDNKPKDDHFNTSLSVSQQQPSAKKLKRKSTITKSKKKAASPETTITSTGSTITTKSTNSNSTGKGTATGPAALNTGVSCTNCGTKTTPLWRRNPQGQPLCNACGLFLKLHGVVRPLSLKTDVIKKRQRGNNNGSGNSSGTTNNSNNYNNKSISKKNEIDDGDDLNPTSITNNTGLTNNNNSKSPAKSKKKSNFDNNSNSALNNLDKSKLKINTNEITNISETTSNSSSPVINLNHGGRSSGVFGNTPDYLNGITSPAVSLVKSEIDNPHQLNNSNSNGMLMTMHQSLHQLSLLTTFDHEVESNNEGSNSSGVNTSTANNQDWDWLNMNY

SEQ ID NO: 17560 - protein, 479 aa, Candida albicans
IVKIGDIETRDNQQQRHNHSRHLSLQHNDITNTTNTTNSTTTTTSNTTENNGRNNIKNSNINKNSPNVSSPHHNEQSLNNNNNNNTNSNNNNTNYPNYEQLYLPESNSTNNFFQQMDNQSPNFMDQNWTPHMLPQTASYLANLDLPNIPTTHSNNQYNNNNNSGLNPSYNTSSIMQTIQNQHNVHDDQENQQQQHHHHQYINLNSPSSSSHQVTPNPTISSSSSSSKSNKQKRPCDQCRKRKIKCVLVPNTNNCVQCEAKQVTCTYTDQAPKRKLAETTTPANNDQLLKRGRIMDTSLLSNGSTIVPPDVAIREVSPIQDYSAMNNSLLKRTLSLQFPRSSFYVGPTSSVFDINLLNSIIKSHEHQMANGNESTTTARNNNSNNKIEQVSLNNLVSLRKVSDTVQFILKEDQSPQSYQTMSNDVDTIEKCISPHGQILVDLYFRIIHPSYPIIHKKISLKNILVLIENLVLLYWQQFMY

SEQ ID NO: 17561 - protein, 329 aa, Candida albicans
  UNSURE (272),(273),(297): Identity of amino acid sequences at the above locations are unknown.
KNFIEKYSRTHREFSAPLLAAVYVLAIQWWEYDPQLNRFPKPNVQMILKIGLNNYMLEILKRPKLSAVQAGLLLLQCKHIINCKSSNDGLRQQGGGSSNSNHSNSVATGDADYSEWILCSQIVSLAEELGLGLDCNDWKLPKWERGLRKRLAWAVYLEDKWLSLKLARPSHINESNWMVLPLYDQDFPEKHGDGDLKEGSSDIDNGKKIFIHLIELSKILSDILNQFYSMKAMKEITEIDQVLKLAKPLQLRLRDWFRSLPIELQMSSVQPXXLCSNGFLQLAYFATELTLHMKITXIIFNQTKAGNPTSPKIIGVCPNAAKTKIMASN

SEQ ID NO: 17562 - protein, 196 aa, Candida albicans
FWPCSATSNFTLIGTFAAILLMSSSTKEETDFYRDQILNYRWILKISSKGFDQAAEALADLDLVLTNIPGLIYDNINVPSLLPNVLDSLSLIQHFQMSHSPAGASPPQNSTSTITTTTTATATTQQRIRAPIRESPLSSPQNMYTPPLNNNNNNNSNVGNSNKGSPMSNAQGLSPKNKNMSGTTSKSPVKSPELTK

SEQ ID NO: 17563 - protein, 251 aa, Candida albicans
FFFDFSSKLQPPTSILIRPMTVKILVINPNSLEKVTKNLEKTITQPENVQLFFYTGPSDSPKEITPTTSLQSEKAVLEDFKVNIEDRLNYDGYLVCCYSDHPLVYSLGKLTKKPVMGIMQATLLFALLQPTTKTTRLFILTSTSEWELVLDQSIIDFVGADNFPVKKFEKTRGLNVNVTNLADEEQFSKIYNVTKSIFNEYKDVGCVLLGCAGMAGLDTKLGEKFPNVRFIDSVKIGIEQLVTLIRFDRQV

SEQ ID NO: 17564 - protein, 205 aa, Candida albicans
IYNRPLSIMSMSDIQQRPQIPTTTTAAVAAAASTNVNTGAATTSTATTGNTPTTTPTSPIENISKVPVKPSVDVPVKPKLEQQQQQQSEQSSKPPPPPPEQQQQHQLPTPPIKPPKTGTTSSSSSSSTTTSSATSSKISMSGPVCGNCQTQTTPLWRRDETGQVLCNACGLFLKLHGRPRPISLKTDTIKSRNRVKQNGSNSQST

SEQ ID NO: 17565 - protein, 386 aa, Candida albicans
  UNSURE (21): Identity of amino acid sequences at the above locations are unknown.
IFTTIPEIQIMSSSSSLSSSXTTATTTSARIRLPSISELTSRSTISGGSNNGNGSALKSQISPRLSDTSRILPSILKNTSGSSTPTSSSTPFKCPPIKSTVGGTLSSGNTQSNYVLGNTKINSLPRLSSPTLPAKVQPQQQPHLPPASSLSPVTRVINTPPQQPQSVSASTSPNTQYQYYQYQQQSSPIQQQQQQQQATPAATPTVMQMAQNQPSHPAPLQYATQQYYPQPVYYQSPAGVPPPPPSVTHQGHIIAVHQHPGHLPQVGVNGMPPNVGYTIVQPEIVNKSTNRCHRCGTTETPEWRRGPKGVRTLCNACGLFHAKLVKRKGAALAAEEVLNNKVTKGKNGRRISMKKHLLNESLKQQQQINGVGIHDDVFTTKWKTRV

SEQ ID NO: 17566 - protein, 509 aa, Candida albicans
ALLAVLAFNLQSKFPKNSEPMRFYLNLGIALRNQASLFIKQLLHNKRNNKRNKTNGIEYCINHEKYKDVLCAVLSMISVDLVWGTMQDTRIYITWCGKVIIAKMQNKKKLSTKASILHRIFLNLKLIQDSTCLDIDSINEDFETNYYGIGIGTGTGIGYDVSGDKYVQQKLDNSDGDATTTTTAVVDDHKKVRKTRIDFIVNNTFTNKKQTKTTTTTTTNKLKSSITTSPSFVNKKLINTMKNDESFATDALYGLPYSLIVLFSETVELLRTKIYYRDNPKAAARIAMKLSNHEKEFNDRIEELNEKLENWTLDWQLYEQQQQQQQNMTTTKAKTRSTTPTSSPTPTDGKPENEEPTTVGDDNDNDDNNEFDHKFYSPMHKATYHHIMSFYHALMIYFNRLIKQIPAENLQNQVKKTLQHLNAIQKLIDDKEANIIPLFWQGFIAGCEAIEPDLQLAFKQWGADIAKYLGSYWGARQIMMEVWRRKRANEIKDDWISVIHDWEMNLMLA

SEQ ID NO: 17567 - protein, 639 aa, Candida albicans
LPAGGDENIWQGRKRRTFEGCWTCRSRKVKCDLTKPQCNRCLKSNRICQGYEIRLGWCQPMIYDHNDTTNNDTFKFLNNEEFEKDLDNFQRRNVELVKYPKHMEYETYEQLNYILNQFDNLEMMNHDNMSKNEDKDSENEKEFTIGPFKCIKWKNINTMNFKKTSNKIMKTPQKSQPLIKPQNESVTLNKSRIKTKTKHSTNTINDTKISNLKSNKITNGNINVYSDLLNFAKLTIVGIKGPKYNITDQTIYHIFEPEFFPNVDSDDDWLIDINEYLDQLFQQQQQQKQKNLPNLSNGNDGCSGGLIITPLLQKLLNNFINQSNEILNFNRMGFQFNYIDIFIIPFIQRIFGELICWDFNDIKSTQLNKSLLIPQHGSTDDNPNDSEEEEEQEEQDDDDDEIGDKNIINIDVIFRNIKLIIVYLVLSLSSFQLSTPINNRFNLDDYLLLSIHLRKLAMKMLNYHLDESDTIIEQLEQEQEKEEQLQNTRWRRNYNLVNDYSCYILLALILQIEIDTYLSIFENYELIYAIGDFIIEKTNPKSKSSSTTTSNTTTPKKKKKLSPLLKLLINIFKIKYIFYESTHSINLFNYQINQQDEEINYRDLNENYDLISTSSLSDNENEEEEEEEEEEEEEEEEED

SEQ ID NO: 17568 - protein, 760 aa, Candida albicans
SMPLDNTIQGSTIGGPTAISKGKKSRNGCLTCKKKRLKCDETKPNCLNCTKKNIECGGYATKFKWKSFNEEKSHTSSSTKSLKRHLELASFSVTGKSIDEVNKENELIAKGINPETVKNSTINRSRTNSVSTVNTQRTKSFDRSHSIPIPSNEHAQLQSASVYKSDLNSLADAAMKQIGKTPASMSSTPPALKAHHQHPAQSFPGDSAMLHMMVPQPPQPPPPFTPNFEAMLTTEKPTIKRNGFGNFDSEINLTPSLSAILNFAFNHEEVEVPSVETLSPLTLNHEARVDASMTNNKPITEQEQILHLFNEHTSGIMSIKNGVHENPWRNLIAPLATKYPCLFNSIAAMTSFHMAGSNNVVHSPEDLRTKGWYYMKKCIFELANGLSNNVKDLPLDVALVTCLNLAVCEQWDTHTSSGIAHLKGAKSMIQQILELLKEQQQFIKQKKFENIDSISSVDEDQELLMNLKKKLVLVDDLDYEEMIHETIKCPEKSVVIPKSIQFILNNWIYFEVLAQMTSDSMCDDKGVDLVAAITSMSQNKLNKDKDRNPKSPSEANDLSDKTFRFFETLNLLNYNNEVIDPLLRCTQSLFVIMGKVANLITKIKKAKHKSQSKKRNTLTTISQASELKQELVNWKPSVVASIMDNEISNESSTTWDLPLCIATAEAYKYSTLLYLHQAVPEIPSFSAHALAEKIFILLASIPTSSNLSIVHIFPLLVASSESEPGEEREWCENRWKLLSQRMWIGNIESCFKRCEKSLET

SEQ ID NO: 17569 - protein, 424 aa, Candida albicans
SMNYPYSSFEDDGQYQTDLSEVASRNADEEAAGHQQQQLQYHRRVQIEEATRQRQQQQQHHQQQTSPSSSDDFNFELQRIKPNRPKNSPPKPIFVDKDGKSMLFYIPEDEPNRNKYRDLIIRYGGVIVEKGFPTVILLSNNEDLYGFSKLKFIDDCIAKNQLLSVFDYGTYGTYNNPEDAAFDTTSIINELNDDLSSNISSLFSTIEGTSSMVEVPVAAPAAIPLPPPHQQQRSIDAFPNPNINNARRGSLGHRFTIEQDEFILEHIRRKPRFRQSQKFYAQLALLEPLRGHTGNSIRSRFRKHLESRLNYIYKTDDQDQLIRDEAGNLIKIGLDEMPGTLKNKFTPEDDYLLCCVALEYRASNNIDSIGLGYSFFDGMNRKYRNRTLQSWRDRFRKYNRDKSDLVEYKEYYENCEKVGMAPRC

SEQ ID NO: 17570 - protein, 141 aa, Candida albicans
TRIFILVVRVGGGLSNVEDISEALEDEITAGAKQKPSTTGQNGATANGKDHTSSETGANRLLLALPEDCRRLIGRMVELAPACRITIDEVLNDSWLKSVNMCTVEESSPGVFEVIKCEDHEHTQVDQSKAHIAAFEKNKKK

SEQ ID NO: 17571 - protein, 563 aa, Candida albicans
QRSKSQSGLSFFFSQKSKPAVKRDSTTDLGAFYNNSYQDRDAPIVSGSPNSLSSAESTVSYGSSAPTRHNSMANLKRFFKKSTPTTSQPVGTLNLSSSLRSASSGASGAMNIPNSLNGQTNNGYQSPSSFSASTSNTSYSQSPGTNSSSVTRSSTLQNKVNYHERRQSVLGIVNNSQQLPFSKRYHSKNAESLGAGAGGSVRLLTRVSDGLTFAVKEFRAKYQNESKRDYAKKITGEYCIGSTLKHPNIIETVEICYENERIHQVMEYCDFDLFAIVMSNKMSREEINCCFKQILAGVHYLHSMGLAHRDLKLDNCVIDKRGIVKIIDFGSAVVFSYPFTKTLIEAQGIVGSDPYLAPEVCVFNKYDPRPVDVWSVAIIYCCMMLKKFPWKVPKLSDSSFKLFASRGEFIPISEMLKKTPNDMEKSNSNGSSGGGLSNLEDISEALEDEITAGAKQKPSTTGQNGATANGKDHTSSETGANRLLLALPEDCRRLIGRMVELAPACRITIDEVLNDSWLKSVNMCTVEESSPGVFEVIKCEDHEHTQVDQSKAHIAAFEKNKKK

SEQ ID NO: 17572 - protein, 317 aa, Candida albicans
LFLSHKQTNKQRLLQSIMSDEPTSAALLEQLVYIDNYINGNASTATDSSTATPNLDMDGQLSLDLAAFADDSFIFPDEDKKHNNDNSNSDSNWNIQEFDNQEIGSSHSHSHSQSHNHHHHHHNHVEDLNNNNILRQQEFQSHLPSLTHQPHHLSTSLLASQSHAHLTTQEPATIDLMNPSSFVNLTDLPKFPVPPGAKSSLFDAGLSQNQIDLLSALVAQHQASLGNPIPSVQSPNATATTTTTPLSVSPAELPLRINNSITTVAPITTTNVNVNANGHLHRSLVSLQLSNTTMALLDPIPSSSSVSPSSVTGGNTQ

SEQ ID NO: 17573 - protein, 319 aa, Candida albicans
IKTSSIRYKYHPDKKASIITAPFSGGQPKGGVKLGPDYILKAGFQKQIESLGWTTDLKEPLEGTDYEKMKTNDKDDFGVKNSKIVSESCQKIHDAVKGSLAEGKLPITIGGDHSIGTATVSASLVHDPSTCVVWVDAHADINTPKTTDSGNLHGCPLSFIMGIDRDSYPPEFSWVPQVLKSNKLVYIGLRDVDDGEKEILRKHNIAAFSMYHVDKYGIGKVVEMALDKVNPNRDCPVHLSYDVDAIDPSFVPATGTRVEGGLSLREGLFIAEEIAQSGLLQSLDIVETNPMLAETEEHVLDTVSAACAIGRCALGQTLL

SEQ ID NO: 17574 - protein, 126 aa, Candida albicans
LINMAINWKSTLQTSASVISLFLIAKELYNLYVTTTNKDKSNSKLTLLPPRTRGIESLIGNTPLIEIKSLSRQLGCKIYAKLELCNPGGSAKDRVALAIIRAGESSGQLIPNANNFSPRRTDTYLI

SEQ ID NO: 17575 - protein, 279 aa, Candida albicans
ARLLPAPVAEDNALGYICHICLPDDTSLEKLQLLKSLGAELEPVKLASIVDPNQYTNAARRGALAVNQNRDGHSQRRAIFADQFENDFNWRIHYETTGPELLQQMGQDKIDVFINGSGTGGTIAGVGRCLKEYNPRTKIVLADPQGSGLANRINYGVMYDSVEKEGTRRRHQVDTLVEGIGLNRLTWNFKQAEPYIDEAIRVTDDQALKMAKYLSINDGLFLGSSSAINCVAAVKMALKNGPGQKIVVIACDSGARHLSKFWKEAAKLPNDLTLDDILQ

SEQ ID NO: 17576 - protein, 266 aa, Candida albicans
VGPAAVCEDNVSDQPKKSVCFGFPYVDTLNILKKFGPGVHFLGLGDDESLDNLEEQLSQGLDILALFCECPSNPLLKTPNLHRIRQLADKYNFAIVIDETVGNFINIHVLPYADMVASSLTKVFSGDSNVLAGSLILNPDSKYYTILKTFFNKEYEDLFWAEDALWLERNSRDFVERVHKIDDTSAKVVELLPNTPLISQIYYPNVSDSKKYYDVIKNESGGYGGLISFLFKQPPQAVKFFNAVNLHKGPSLGYQFYFGRFPYAYI

SEQ ID NO: 17577 - protein, 71 aa, Candida albicans
SSNYLYLLRFGANNSSISNILLNQYSDMPSQEIGMPIPNMPHAVSVTLPTWEATVGYEEGEDWVVSKMNSG

SEQ ID NO: 17578 - protein, 170 aa, Candida albicans
GEGISSRMGEYILKELFEKDNDYNDNYNNSNGADISKMSGNLKQELQSLQIQSRSPSISASRASSAAGYNIDDVNRDFDSFIEQKYGRVLDLKFANEAKAALRRRIAGKADKSTERVEELERAKRGKHLNENDVYLFPSGMASIFYAHHPLLHVSECPNGARGHSPGAQH

SEQ ID NO: 17579 - protein, 442 aa, Candida albicans
  UNSURE (302): Identity of amino acid sequences at the above locations are unknown.
TTMPSHFDTLQLHAGQPVEKPHQPRAPPIYATTSYVFNDSKHGAQLFGLETPGYIYSRIMNPTNDVFEQRIAALEGGIGALATSSGQSAQFLAIAGLAHAGDNIISTSYLYGGTYNQFKVAFKRLGIETKFVNGDAAEDFAKLIDDKTKAIYIETIGNPKYNVPDFEKITKLAHEHGIPVVVDNTFGAGGFLVNPIAHGADIVVHSATKWIGGHGTTIAGVIVDSGNFPWTEYPEKYPQFSKPSEGYHGLVLSDALGKAAYIGHLRIELLRDLGPALNPFGSFLLLQGLETLSLRVERQSEXALKLAQWLEKNPNVESVSYLGLPSHESHELSKKYLNNDAKYFGGALAFTVKDITNTSSDPFNEASPKLVDNLEIASNLANVGDSKTLVIAPWFTTHQQLSDEEKLASGVTKGLIRVSTGTEYIDDIINDFEQAFKKVYNN

SEQ ID NO: 17580 - protein, 267 aa, Candida albicans
GNAIADPCSPVVKTGMLALEYLAIYNNTGYVQKVVALATAARTSAWCISWNETQRQCIFSDPFYDDGYYYETGNKPDSGLSAARMAALLTYRSRNSFESRFGRKLGPRSPNDGGASPRTKHEEHSLLHNDGSKLINGAPVNEKYPPTYFSAQSYMRYNGSKFINRFDANCYIAISRKLDTNDLSRGRVNAPNDANGDPLVHVLKDLSTPTLVIGIESDHLFTITEQKLLADNIPNAIFETLDSEEGHDAFLLEFEKINSFITSFLNN

SEQ ID NO: 17581 - protein, 485 aa, Candida albicans
PKFKLKVSMFQLLKYIFIGGFTYLLYLILEIVFPPFNFPRNIPTIPFYVSFLGACTNLDQEDIYKLYLREKLEKYGAVKMYFASRWNILITKPDFLLEMFKNEDVFAKSGNHVKIPNSVLATYTGDNIISAHGELWKLYRDVVAQSIQFPDLKPISKNTQKLLRFLDNEMGSANQATISVTDILQKYSLANVCESVLGVNFNVLDDKQSLMHEKIKYVKLQIFNPIFLNFPYFDNFPIPSRLKARREVIGFRKWYGQSLIEKYNLQLPNSAATKLVDSLIKEKLTEKQFLDNAIILMIAGHENPLLLMLSLLYVVSKYPQVQELIRNETETTKPYLHSVIYETLRMYPPLGLIINRCTTRITKLGNIVIPKNVYCGYNNFGTGRDRNVWGSDADIFKPERWGLEIDEINKKFTLAKRSAELPAFHGMKRACLGEKYALFEVKQFLLAILGEYKVSLHPNWTEQLTPAGPISPLRLKLNFEKLTVS

SEQ ID NO: 17582 - protein, 141 aa, Candida albicans
RRISARGAGTIISCLPYSFHRTEGVFPEPDKFLPERWIINSEQDKWRVKQQEKYMMPFGKGVRMCLGMNLAMIEMKIAIAKLYWHYSSTIDETWCRVLNDAKPIKMGGGGDGTTDQDKMRMYDWYTTRPLYDECWLKWERL

SEQ ID NO: 17583 - protein, 77 aa, Candida albicans
HISAVPGSLVGVRRISMAGKRACLGEKYALFEVKQFLLAILGEYKVSLDPNWKKQLTPAGPISPLRLKLNFEKLTVS

SEQ ID NO: 17584 - protein, 524 aa, Candida albicans
NCSLMALIIFCPLVVTPQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKLRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 17585 - protein, 313 aa, Candida albicans
ITLKQNQIILTMAPTAVTQEPEDVQETIKRLAGLKVIGHSKNSKGIITGYDPEWADKLPETTKQRYAKYGVDISKGYPYVPVNEKVPKFVDEVFAIRNEEYPYIERGKNADPEKKLLFDAAEDVIHLTPYIGTEIVGLQLSELTEQQRDELALLIAERVVVFFKDQDLSPQKQLELGHYWGQVEVHPQATRIGEEYDGISVIWQEQQRDRWGLNLTFKQSKKGNSQWHSDLVHEKQTAGITHLHLDAIPGIGGETLWSSTYGAYDKLSPALQKFLDGKTAIYRSAHQYLDRNDPLKGPKYVESSPRGWKVPSL

SEQ ID NO: 17586 - protein, 430 aa, Candida albicans
FIQKIGHQRQGIQEPQELQGTIKKLVYLNPIGHSNNKSAVITGFDPNWGERLPETTKQRFTKYGIDISQGYPYIPQNTKIPKFLDEAYAIRDEEYPYIERGTNADPEKKLLFEAAEDIIHLTPYIGTEIVGLQLSELTDKQKDELALLIAERVVVFFKDQDLSPQKQLELGHYWGQVEVHPQAARVGPEFDGVTVIWQHYAKERRSINLTFKQSKKGNSVWHSDLVHEKQTAGITHLHLDAIPGIGGETLWSSTYGAYDKLSPGLQRFLDGKTAIYRSAHQYLDRNDPLKGPKYVEREHPIVRTHPVTGWKYLFVNRGMTVRIVGLLPEESDLILNYLFSIIETNRDIQVRWSWQKELGSVKKNNNQDEQPKQYRGVSALWDNRISNHSVVHSEESIIGRHGTRVTSLADTGYYNPNSKSQRESLGLSLD

SEQ ID NO: 17587 - protein, 408 aa, Candida albicans
FLNRNNNLTSIEITHILPYYKIMAQRFGNSDIHFNKDFDEVDADGVLVINKRNREQAKYPDFLPSWDPSDKLPPLKFEKYIDPGSRADPSFPNLFPKDGSHKIKRITPKFGSEIDGVQLSQLNDKGKDELALFLAQRKVLLFNEQDFADKGPGFAVEFGKYFGRLHVHPSSGSPRGHQELHITYRRPEKGELQRVFAHRTTSVGFHSDVSYEITPLRFTLFQVLESGDGGDTVFVDTVEAYNRLSPAFQKRLEGLHVLHTSEDQAANSAHQGGVERRKAVSNIHPLVRLDPVTGEKSLYVNKAFGRRIVELKKEESDYLLDFLHNHIEKSLDLQLRVNWERGERRKVALFHNSGVSHTATFDTEEGEVRHAYRISVLGERPILNLEDLNKEDYTPGDLADALSAIKPI

SEQ ID NO: 17588 - protein, 390 aa, Candida albicans
PNMPSRYTRPSEALGGGTEYVSDNKGFVQVAPKSAQKINIESSPYLPTWDRNESYKPYEFLEFHDPALRANKDLPNLFPKGGDYTTSNISPKLGTEIKGIQLSQLNDAAKDEVALLAAQRGVLVFRDQDFIDKGPEFVTKYVSHYGPLHIHPTSGAPKDHPDIHVVLSGDTKEYPFEKKTNLVALHSDVSYELNPTALSFLAATNIPQSGGADTVFVDTVEAYNRLSPLFKEKLEGLKAVHSAVEQANFAIFKKGHVKRHPVENVHPIVRTTPLGQKVLYVNNGFTRRIEGLKEEESSYLLNFLLDHIWKGHDFQIRAHWEPNTVVIFDNRVVGHTAILDFDTTDSRLIIRASARGERPVSDLKDLNKPDENLVYHGAEYLGDRLENLKI

SEQ ID NO: 17589 - protein, 130 aa, Candida albicans
  UNSURE (2),(29): Identity of amino acid sequences at the above locations are unknown.
IXRREPEANIIPLVRVNPVTKQKHLYLNXEFGRRIVELKEDELDYLLSFLYDHIEKAQDLQIRVTWEENTVVLWNNSTTIHSPCVDFDEPEIRHAYRISVMGERPVGDLKYLNDENYLQEKYNELGIQKS

SEQ ID NO: 17590 - protein, 232 aa, Candida albicans
  UNSURE (228): Identity of amino acid sequences at the above locations are unknown.
FTRLFSCWDQYIRMAPVADTTKYDDSQFHKAHVGNTSKGSFTVSDHNKSLALYPKFLPTWNPNQKFPSYKFEQYHDKGHAADPLLSNLFPAGGDYKVKRLSPKLGSVITGIQLSQLSDAAKNDLSRFVAERGVVVFRDQDFNQGGPQAAVEFAQYFGPLYKHATSGSPERFPELHVCFRGASQDEIDSVFSDRTNSISWHSDCSYSLNALHLTLFSCMPLPDSRGDTXFDNS

SEQ ID NO: 17591 - protein, 286 aa, Candida albicans
SPIIIPYTKTWYGKKIADDTMKIFENCAAMAKKHINENNGTPKCVMDEWIHLMKEAREKHSEDPDSKLLVREFSNREISEAIFTFLFASQDASSSLACWLFQIVADRPDIVAKIREEQLRVRNNNPDVRLSLDLINEMTYTNNVVKESLRYRPPVLMVPYVVKKSFPVTESYTAPKGAMIIPTLYPALHDPEVYDEPDSFIPERWENASGDMYKRNWLVFGTGPHVCLGKNYVLMLFTGMLGKFVMNSDMIHHKTDLSEEIKVFATIFPKDDLILEWKKRDPLKSL

SEQ ID NO: 17592 - protein, 260 aa, Candida albicans
LIEIFFFFSIFPFFLFVDFLLLLLFFFYKNHKTFTLMNSTKVDNLPFQQQLTSFVELAVSKATGSPITTLFTIIFLILLYDQLSYQINKGSIAGPRFKFYPIIGPFLESLDPKFEEYKAKWDSGELSCVSIFHKFVVIASSRDLARKILSSPKYVKPCVVDVAIKILRPTNWVFLDGKQHTDYRRSLNGLFSSKALEIYIPVQEKYMDIYLERFCKYDGPREFFPEFRELLCALSLRTFCGDYITEDQIALVADNYYRVT

SEQ ID NO: 17593 - protein, 255 aa, Candida albicans
  UNSURE (15): Identity of amino acid sequences at the above locations are unknown.
NDYSPEPWMPEFREXMCAVSCGTFVGHYMTDAAIKKIAEDYNMITAALELVNFPFIFPFTKAWYGKKASDMVLEEFSNCAAKSKAHMAAGGEITCIMDAWVKAQQDSAKYNEKIAKGLPVEDSEKPSHLLREFTDYEIAQTVFTLLFASQDATSAACTWLFQLVADRPDVLERIREENLRVRNGNINAPLTMDLLDEMKYTRAVVRETLRYRPPVIMVPYLVKKDFPITDSITVSKGSMIIPSVSSPRAWQDPSL

SEQ ID NO: 17594 - protein, 278 aa, Candida albicans
FANSINNMLLSLWKSTTKNDVPDYELEEELITIPRKLEWDLTPDLSLVLRFGETRLSDLINQNEFRHLEFKNYGSSQIKKMKFSPDAFVQMAFQATYYALYGKVECTYEPAMTKQYYHGRTEAIRTVSQESNLFVRKFFDSTVSMKEKLQYLSDACKKHSEKTRMSSMGQGVDRYLYAMFCIWKRYLQDYEEEQQQQQHPVEEGSGGEQQMEAVGLSRDDTIVVQMDGEHDDDDSTTVVGTNGGKNLHASGSHGNNDIYDNFDLFFTTRGWKDTRCGL

SEQ ID NO: 17595 - protein, 671 aa, Candida albicans
LRQPPYTYIYIFTPSKMSTYRFQETLEKLPIPDLVQTCNAYLEALKPLQTEQEHENTKIAVDKFLNGSNSKTTNNGVVTGSGIGHYLDRELRQYAKTRPSYIEQFWYDSYLNYDSPVVLNLNPFFLLEDDPFTNESSSINPQVKRATNLTLSSLKFIQALKNETLSVDTLKNGKPLCMYQYTKLFGASRIPSQEGCMMQSDPLSNHIVVMSKSQFYWFDVLDSHNNLILNEAELNINFNSIIRDSLNTPSDEIAKSSFGVLTTENRRVWANVRNNLIGNNTINREVLSIIDSALFILCFDDIAIDDLSELSKNMLCGLSILDNGIQVGTCTNRWYDKLQIIVTKNAKAGINFEHTGVDGHTVLRFVSDIYTDSILSFANSINNNAPSLWKSTTKNDVPDYELEEELITIPRKLEWDLTPDLSLVLRFGETRLSDLINQNEFRHLEFKNYGSSQIKKMKFSPDAFVQMAFQATYYALYGKVECTYEPAMTKQYYHGRTEAIRTVSQESNLFVRKFFDSTVSMKEKLQYLSDACKKHSEKTRMSSMGQGVDRYLYAMFCIWKRYLQDYEEEQQQQQHPVEEGSGGEQQMEAVGLSRDDTIVVQMDGEHDDDDSTTVVGTNGGKNLHASGSHGNNDIYDNFDLLKTVPELFADSGWDKLNSTIISTSNCGNPSL

SEQ ID NO: 17596 - protein, 263 aa, Candida albicans
RWSFQPAWLKINGVVTGSGIGHYLDRELRQYAKTRPSYIEQFWYDSYLNYDSPVVLNLNPFFLLEDDPFTNESSSINPQVKRATNLTLSSLKFIQALKNETLSVDTLKNGKPLCMYQYTKLFGASRIPSQEGCMMQSDPLSNHIVVMSKSQFYWFDVLDSHNNLILNEAELNINFNSIIRDSLNTPSDEIAKSSFGVLTTENRRVWANVRNNLIGNNTINREVLSIIDSTLCILCFDDIAIDDLSELSKNMLCGLSILDNGIQ

SEQ ID NO: 17597 - protein, 307 aa, Candida albicans
TQLKMVDSNFFVDFMMGGVSAAVSKTAAAPIERVKLLIQNQDEMIKQGRLEKRYTGIVDCFKRTAADEGVVSFWRGNTANVIRYFPTQALNFAFKDKFKAMFGFKKDENYWKWFAGNLASGGLAGATSLAFVYSLDYARTRLANDAKSSKGDGKREFNGLVDVYKKTLASDGIAGLYRGFGPSVIGIVVYRGLYFGLYDSLKPVVLVGPLEGSFLASFLLGWAVTTGASTASYPLDTVRRRMMMTSGQAVKYDGALDCFRKVVAAEGVGSLFKGCGANILRGVAGAGCHLPGTIQWQVILVPVRNSN

SEQ ID NO: 17598 - protein, 110 aa, Candida albicans
IMSVFLGSSAQFSQATIDPEKIKLADIQFLAMAFTFNKLLRRCEQKCLLREYGEGELTKGEQECIDRCVSKYVKANVIIGEHLQKQRLDPFNSMPEYRKVQDILASSVKS

SEQ ID NO: 17599 - protein, 226 aa, Candida albicans
KRKIMTEEEKKRLQVLERDAETAYPFLASDEKSSTFKTAEDLESGINPLVSIATTNESQQKLDNVSSISTTTNEKPKPKPKPWVHFVAGGIGGTVGAVVTCPLDVVKTRLQSDVYHSMYNKIPKSGNPIIQAWQHLSETGSVLRGMYINEGASSLFKGLGPNLVGVIPARSINFFTYGATKEFLLGNFSPTNSIQGPRQEETWIHLVSGINGGFVTSFPQAPSPRQ

SEQ ID NO: 17600 - protein, 92 aa, Candida albicans
RTRSGAAGLAKFMASLITYPHEVVRTRLRQAPLESTGKPKYTGLIQCFKLVIKEEGFGSMYGGLTPHLLRTVPNSIIMFGTWELVVRLLSEW

SEQ ID NO: 17601 - protein, 293 aa, Candida albicans
FFFKKQVDPLKSFIAGGTAGAVEGIITYPFEFAKTRLQLISKSSTASRNPLVLIYNVAKTQGVSSLYVGCPAFVVGNTLKASVRFLGFDLIKNLLLDKNGKLSGPRGVIAGLGAGLLESVVAVTPFEAIKTALIDDKQLIKPKYQNGVISGSFKLVRDMGFKGIYAGVVPVSLRQAANQAVRLGSYNAMKTMIQQASGQKPNEPLSGTTTFAVGALPGIITVYTTMPIDTVKTRMQALGADKLYSSTLNCFVKIFKDEGLLTFWKGATPRLGRLVLSGGIVFLCYEKIMILLN

SEQ ID NO: 17602 - protein, 744 aa, Candida albicans
KKIYRTMTQEQFYTFENEASLPKLPVPLLVSTTQQLLASLKPLLPQNEYATVVDEATEFVGNDIINLIQKHLVAISENENYTNYLNFVNDDKTPSIYGEIRGDILPRNPYLVLEEDPYSKTINPPNQAQRAANLVNSSLKFAITLRNETLKPDVTPKNGNALTMKCYMDLFGTTREPEQDDRGFDIRIKKYQHINDSRHILIISNNQFYTLEVLTEFDENEYQQTNSKHNIWFNDSELSKILQHIIDESNKVDAVNAIRNSVGSITTQTLKYWKFARLELEQSNTENLKLIDDALFVLILDSNTPVTDGEKTQVISHGTSVLSLDNVQIGTCTSRWYDKLQIVVTKNSVAGIVWESMTMDSTAILRFISDIYTDSVLKMAKNINGSEYTLFDPNITFASIGKDGNGVVKPEPKLLEFNKTKALQHVIHLSETRLADLLDQHEYMTHTIKLDSYLTTKFNLSVDSIMQVCFQIAYYSLYGRIVNTLEPITTRKFRDARTELVAVQNQSLANLVKLYITNASPLEKFEAFKKCCALHKTQYHDAMLGKGFERHLMTIVQVVKKPKVIARLNQVNTHLPPIPEDLCQAGINLPLLLNPSIDKLLSPELLVSNCGNPALRLFGITPAIDQGFGIGYIIHRDKVLITVCSKHRQTARYLDTFHRVVHDIKIRLRASSNFLLSISDSERRKNELQRLRIEHELSNVSLDIPTMKHPIPLTVGKSEISIDNIALETARTGRATRSEEKSLG

SEQ ID NO: 17603 - protein, 339 aa, Candida albicans
TMAGNSLADSLTQPLNDQLKKATDKLTGGGSGGASSSSGGSKIKLFTPEYYAACTVGGIIACGPTHSAVTPLDLVKCRRQVNASIYKSNIQGWKTILKTQGDSIFTGIGATFIGYSFQGAGKYGFYEVFKKKYSDLVGPKVAQNYQTGIFLAASASAEFLADIALCPWETIKVKTQTTIPPYANSVFDGWKKIVDTEGFGGLYKGLVPLWCRQIPYTMVKFASFENIVAGIYSYLGKPKSDYTNLQQTGVSFLGGYIAGIFCAIVSHPADVMVSKINNEKLPNESIGQAISKIYSKIGFAGLWNGLPVRIVMIGTLTGFQWLIYDSFKVYIGLPTTGGH

SEQ ID NO: 17604 - protein, 378 aa, Candida albicans
ITIIFTNYIMINKLKIDFGKFKIDLKLLGDLFVLAGAGLSVYYILNTILNDYLDNTVKNKENEQKGSGILKKIQAANPHLKNLSFNQYEKALLNSLVTPEEIAVTFDDIGGLSDIIDELREAVILPLTEPELFAAHLSLIQSPKGVLFYGPPGCGKTMLAKAIAKESGAFFLLIRMSSIMDKWYGESNKITDAIFSLANKLQPCIIFIDEIDSFLRDRSSNDHEVSAMLKAEFMTLWDGLKSNGQIMVLGATNRKNDIDEAFLRRMPKTFAIGKPNASQRTAILNKILKDAKLDENDFDLEYIVANTRGFSGSDLRELCREAAILPVREYIKENYNYKSGKLSRDENDDLPVRPLRTLDFTKNSGTVNGDILPSVALD

SEQ ID NO: 17605 - protein, 178 aa, Candida albicans
IIYRSHTCCHIYIYHIMNKGLTITAIAAAAIAGYAVYFDYQRRNSADFRKSLKKREVKQKKLKAKKEAESKQNKLEAVKKALLEDLAQNPIPTDLTEREAFFMEQVAVGEQKAKVDAIEAAICFYKALAVYPNPTDILGIYQKTVPEEVYELVVMMIAVYPPASLFSMSSTRRWKIHA

SEQ ID NO: 17606 - protein, 261 aa, Candida albicans
TTTYIANMGFLTNFTNFKTIVASIKKYMRFIGPGLMVSVAYMDPGNYSTAVAAGSAYKYNLLFLILLSNCLAIFLQILAAKLGAVTGLDLAANCKAHFGYKTNLILYALTEIAIIATDLAEVVGTAIALNILFHLPLFVGVIVTVIDVLIVLMAYRPRGPLLFIRIFESFVSVLVSATVVCFGIELYQVSHDSSIHFSVAEVMKGFLPNEDVVDMSDREGGNGLFLSVAILGATVMPHSLYLGSGLVQARLKDNDIRKKLG

SEQ ID NO: 17607 - protein, 410 aa, Candida albicans
  UNSURE (32),(65): Identity of amino acid sequences at the above locations are unknown.
EKYEDAMFDLTALTIYVGFSNKSIEQVLERVXRKHSIKIVELTPKKLILPSAATIGSFFGAFVEXTEPEGINESHENEGVKALYTALQKINANTQNGYEEADELISKAVTELESAIESATELKPVLAIALEYLAAFQFLKNDPVSAAESIEKAISLKPRPRAYVFRALINADKSSYEAALKDFKTAEELDDKCPDIFYHLGQLFYLTGDLTNAEINFNKAKELHPDNVYAYIQLACITYKNGQIELANEKFTEAKLKFPTSPEVPNYYGEILADKGDIQGACKQFEIASRLQEKLDRFSVGALPLINEATVISRESLEKIGEAEELLTKACALDPKSELARISLAQIKLQKDEVDDAIVLFEESSDLARSIEEKIQATSFAEATKMQKRIKNDPILNNKIAELMRQSGAM

SEQ ID NO: 17608 - protein, 320 aa, Candida albicans
RLIYMELNTTDKQVHTRRFSSREIEVISGLLAGFSTTIVTHPLDVIKIRLQLSRDTPKTTHPLESIISVIKKINQDAKVAYKLNHKPKAFNYLIQYYRGITPNLIGNISAWGIYFALYAEFKSKVKTNNTTMNYFASSVLAGLSTSIITNPLWVLKTRILGSSRNESNAYRSVTDGIRQMLAKEGITSFWKGTIPSLFLVVQASLQITIYDHIKVYLLSPHHRSESIGATSHLSTWQYLYSSASSKIISMLILYPTQVVRSRLQYSQDSSLSIVSIVKELYYKEGGLKGFYKGIGANILRVLPATCVTFVAYENVKRYLM

SEQ ID NO: 17609 - protein, 115 aa, Candida albicans
GGLALVVNTEANNKQFIQQGLFSDSRVLDIRGVEIVTCKSLQPNDVPVIVVSCRAQEIHLYRKAKTGEIAAGTEDHIQLSTYAMVLTRIPEEFDNKVTDGWKIVEFARGGSRPFH

SEQ ID NO: 17610 - protein, 148 aa, Candida albicans
KNFFDQLVVHSNTYFVFRVYQTMLRSGIIKAQPATAIIRPLSRCFHYTNINFNDKPPSSDSPLKVFFDTFKTEVKKSNELKENIKALQDESGRMAESEAFKRAKEAYAKAQLGSTAAGKVLKKGAETVGDAAYKAWESPVGKRVRPGV

SEQ ID NO: 17611 - protein, 170 aa, Candida albicans
  UNSURE (139): Identity of amino acid sequences at the above locations are unknown.
NNTHTHTHTYINMSADHTRDPCPIVILNDFGGAFAMGVIGGCVWHGIKGFRNSPYGERSYGALSAIKARAPVVGGNFGVWGGLFSTFDCTVKAVRKREELGMLSLREFFTGGALTITGGWKHTRHSAITCACLLGISEXFGMMMPTLQAQPTMAPVYPKNILLLVRKKLY

SEQ ID NO: 17612 - protein, 314 aa, Candida albicans
IINNYSTMSTPSEYKLPEYTVKDYASFALAGDIGCVPTHGAMTPIDVVKTRIQLEPTVYNKGMLGSFKQVIKSEGAGALLTGLGPTILGYSLQGAFKFGGYELFKKTFIEYLGYDTAKQYKDSIYIGSSALAEFFADIALCPLEATRIRLVSQPTFANGLIGGFSRILKEEGVGSFYNGFTPILFKQIPYNIAKFLVFERANEAIYNAIPTPKVDLSTAAHTAVNLGAGIIAGCAAAIVSQPADTLLSKVNKTKKAPGQSTVGLLIQLAKQLGVSGSFAGLPTRLVMVGTLTSLQFTIYGSLKKALNCPPAVAL

SEQ ID NO: 17613 - protein, 260 aa, Candida albicans
  UNSURE (58),(59),(250): Identity of amino acid sequences at the above locations are unknown.
IMSKAVGIDLGTTYSCVAHFANDRVEIIGNDQGNRTTLSFVAFTDTERLIGDAAKNQXXMNPANTVFDAKRLIGRKFDDPEVINDAKHFPFKVIDKAGKPVIQVEYKGETKTFSPEEISSMVLTKMKEIAEGYLGSTVKDAVVTVPAYFNDSQRQATKDAGTIAGLNVLRIINEPTAAAIAYGLDKKGSRGEHNVLIFDLGGGTFDVSLLAIDEGIFEVKATAGDTHLGGEDFDNRLVNFFIQEFKRKNXESSPRGWKVT

SEQ ID NO: 17614 - protein, 232 aa, Candida albicans
FNSIDKSTNKLIMSKAVGIDLGTTYSCVAHFANDRVEIIANDQGNRNTPSFVAFTDTERLIGDAAKNQAAMNPANTVFDAKRLIGRKFDDHEVQGDIKHFPFKVVDKASKPMIQVEYKGETKTFSPEEISSMILGKMKETAEGFLGTTVKDAVVTVPAYFNDSQRQATKDAGTIAGLNVMRIINEPTAAAIAYGLDKKSEAEKNVLIFDLGGGTFDVSLLSIEDGIFEIKAT

SEQ ID NO: 17615 - protein, 208 aa, Candida albicans
FKCLKVKELKPKTTTCWVNSNYLVFHQLQEVFPQIEVTFDIDANGILNVSALEKGTGKTQKITITNDKGRLSKEEIEKMVSEAEKFKEEDEKEASRVQAKNQLESYAYSLKNTLGEEQFKSKLDASEIEEVTKAADETIAWLDANQTATQEEFADQQKELESKANPIMTKAYQAGATPSGAAGAAPGGFPGGAAPEPSNDGPTVEEVD

SEQ ID NO: 17616 - protein, 96 aa, Candida albicans
FCCGDISSKIQELLLLDVAPLSLGIETAGGIMTKLIPRNSTIPTKKSETFSTYADNQPGVLIQVFEGERAQTKDNNLLGKFELSGIPPAPRGVPTN

SEQ ID NO: 17617 - protein, 158 aa, Candida albicans
GNIGPLFPTSSFKISEPAIRLQNLRNSHLCANWEDDDDEQLQQFHLQNEENRLLIGENTTNLVYSLPPTSNLMSRSNSVSATNGVPDSLSSSSSTTIAAQLPLEVYEDLNQDIFRIKGYKDFSNSLDTSFVAVLVWVFVASLNLYLIGSMLLGYDVPL

SEQ ID NO: 17618 - protein, 246 aa, Candida albicans
  UNSURE (152): Identity of amino acid sequences at the above locations are unknown.
KGRDYAESPDGSLLTNKYTPSYAAIKYCLNYSYVELVLSLFIVAVFVNSAILIVAGSTLYGKPDAADADLLSIYEMLSYYISPAAGLVFALSMLFSGQSAGIVCTMAGQIISEGFINWTLEPWKRRIITRVLAIVPVIVVVGILGREGVSKXMNSSQVVLSFILPIVSAPLIYFTSKKEFMTVIDTSLTDESTPLLEENDLDEQIPVKKISFENGSLLRNASILTWVIITGLNVYLIIAFANGADI

SEQ ID NO: 17619 - protein, 306 aa, Candida albicans
SSRIMNQQQQQPLLKRVAHSVKKYATFIGPGLVVSVSYMDPGNYLTSVSSGSMYQYKLCFIIFMANLFAIILQALCVKLGTITGLDLAEMCRLHLNPKLNLFMYFCAEIAIIATDLAEVVGTAISLEILFGIPLLYGVVITVLDVLIILMAYHKDGSMKQTKFFEILVSILVAATCVCFILELFKCNFEPGSGWKIFKGFLPVNKEIFKESMALFLSCAIVGLTVMPHSLFLGSALVQPRLKEYDETHGTKANVLPVENEDTTRLVPPHQPVEGSRLRRISGWFIIDKQVYTFVCSNQVLFELLVC

SEQ ID NO: 17620 - protein, 102 aa, Candida albicans
RLSSRRLFSVTPRRSNLIGDLYIQHIKAFKPKALTQADIDSAVKAFQLPAKPSVPQADVNAEAVKEYEASDVETASPSTVAAEQTKPDEDWFVFEEVEEAAH

SEQ ID NO: 17621 - protein, 313 aa, Candida albicans
IISFFFFLLTLLKSRFWYGGAASMAACLVTHPLDLAKVRLQTATKPGQSLLSMIYQIITKEGVFKIYSGLTASLLRQATYSTTRFGIYEFLKEQYMESIATTGGTEQKKPSTAVLLPMSMIAGALGGLVGNPSDVVNIRMQNDSTLPINQRRNYRNAFDGIYKICQQEGINSLFRGLTPNLIRGVLMTASQVVTYDIAKSILVDHIHMDPSKKSTHFSASLIAGLVATTVCSPADVVKTRIMNSKGSTGGGSGGDGVNGNAILILKNAVKHEGIGFMFRGWLPSFIRLGPHTIVTFLVLEQLRKFKLGMSRSD

SEQ ID NO: 17622 - protein, 88 aa, Candida albicans
LGKLEIENVGTVSNESKKFVDTWINPKAINEEKVFTFQADAKQHVVYLYDDADGKGVDSHLFGMKQMLQPNEPVPEIFTDPIFSYSQI

SEQ ID NO: 17623 - protein, 419 aa, Candida albicans
TLFKKNFPFCFQLIYFQEAFLKSTMSQQINPPLGSTDIAKLSIPTLPQVTTEPPKQNGLWSSNPVFSYINDVYITINEHRKSLGLTNPGTIENLNKEVARDVFLGQYFFTGLRADLNKAFSMMPAFQTSHTLSIGSNVLPAYAFSALYATDDYFLQGNIDNDLSFSGRINYGWDKSNISKVTLQLAHGQPSMIQLEQDYQANDCSINVKTLNPNFLSGNEFSGVVVGSILQSLSSKLAVGLETMYSKQPLAPPDTAVSYVARYNAGNWIASAQLQAQGALIASFWRKVTDKVEAGLETQVAATMKQVADPLMGVGFEPVIEGQTTIGAKYEYRTAVFRGQLDSKGKISAFLEKRIMPTVSILFSGEIDQFKNTSRLGLGLQFEAAGNEQLMLMQQGLVDANGYPIPCAPAPGASFIQDD

SEQ ID NO: 17624 - protein, 274 aa, Candida albicans
TGELTVGDLVLINQLVFQLSVPLNFLGSVYRELKQSLLDMENLFQLQNQPIRIKEIPNAPPLKLNNNNNNNNNNNNNNNNSLPGEIRFENVLFGYHPDRPILNNASFTIPAGQKVAIVGPSGSGKSTILRLIFRFYDINQGRILIDGQDISKVLLESLRKLIGIVPQETPLFNDTILENIRYGRLDASDEEIYRVINQVQLNKLIDDLPDGVQTIVGERGMMISGGEKQRLAMARLLLKRAPITFFDEATSALDTHTEQALMKTLRLVFKQTTS

SEQ ID NO: 17625 - protein, 234 aa, Candida albicans
MFIRNVKLIKPSPVRFISPIPFSFPISRSIKISSIRYFTNKSTSNFKSTSSSSSLKSTSTSTSTSKTTPKTLLKPPPKVKPPIQDNDTTSSGSSSSENSESFMLKSLFKTIWPKNNLNFKIRVIIALSLLVGAKILNVQVPFYFKQIIDTMNIDWTNEVGVFLTVIGSLILAYGGARFGAVLFGELRNAIFASVAQLAIRRVAYNTFVKLLNMDLQFHLSRQTSSPRGWKDPRS

SEQ ID NO: 17626 - protein, 67 aa, Candida albicans
TKMAGESSVSKFQITLSDESKERIIKLLDYSKTVAHYGFIPFVLYLGWSATPNKPSILNLLSPFPSA

SEQ ID NO: 17627 - protein, 273 aa, Candida albicans
RRGVKSSSVVSKQCSTCKGEGQVRKIKRVGPGMVAQTYVDCSTCQGIGKIYRTKDKCKLCHGARVIEETKILEFEIPKGSPDHGLIYKNGESDQFPGKVTGDVILEYKCKPHKVFTRKDDDLYIKVKVPLVDSICGFSKLVAVHLDGRGIKITTPKGKVIRPGDYLKLPGEGMPKSTPKKSWFNSTDSSKGDLYLKVEIEFPRDNWYVEKNDLTKIRNILPTKLTQEEKEVDVPEASIELFTDFSIIDSNQLPKYNQDRKYEQQGYEQSCAQQ

SEQ ID NO: 17628 - protein, 397 aa, Candida albicans
IYRVMVKDTKFYDALGVSPNASDAELKKAYRKAALKYHPDKNPSPEAAEKFKELSHAYEILSDDQKREIYDQYGEEGLSGQGAGGFGMNADDIFAQFFGGGFHGGPQRPSRGKDIKHSIACSLEELYKGKTVKLALNKTVLCGECKGRGGAEGKVAQCPDCHGNGMKFVTKQMGPMIQRFQTVCDKCQGTGDLIDPKDRCKKCNGKKTESERKILEVHVKPGMKDGDHITFAGEGDQTPGVTPGDVVFIISQKPHPVFQRKGNDLLIEQEIELATALAGGEIAFKHISGDWVRIEIPAGEVIAPGSIKMVEGFGMPVRTHKGNLIIHFNVKFPENNFADEESLKKLASLLPKPTEVKIPADADVDDCTMVPAKLEQSNPYESDEEAHGGPGVQCASQ

SEQ ID NO: 17629 - protein, 320 aa, Candida albicans
  UNSURE (313),(314),(316),(318),(319): Identity of amino acid sequences at the above locations are unknown.
PVSQVMVRETFFYDILSVSTSATTEEISKSFKKLALKCHPDKTNRDPELTEKFKQITRAYEVLRDPKQRDIYDKYGEAGIDGTVQESTSNTTASNTRNHRRTHSFATDIFSQVFHDINNMFATHNAMFEGPQMSGGFPGFSSNQHMQKHVEPLGEPLENTLIHGEDIFHTCEVNLADMVYGKVIKLSLPKNMKCVQCNGYGGVNPKTCRVCLGSGKVMITYYNQFSRFQQSGSCAACHGTGVFIRDADRCVYCNMGYLESTKILKVVVPPGANTGDRIIIKGEADEGRNIIPGDVVIKLKQRQHPPPPRPPPXXVXGXXN

SEQ ID NO: 17630 - protein, 193 aa, Candida albicans
RGFSSPWGRHTSVVPNGARNAKLNFFYQQSAVNARLFFDLLKGPIATADLVVAHDGFTAGAELGYDISSAKVNKYSVGVGYANLNYGLAATATSNLSVFSAAYFHKVSPLVQVGAKATWDSIKSSNVNVEFATKYALDNTSFIKAKIADSGLTALSYTQELRPGVKLRLGASFDALKLAEPVHKLRFSLSFAA

SEQ ID NO: 17631 - protein, 224 aa, Candida albicans
HNDNIIMSWIFGKSSTNNDNNTTTTTNDQSSIKQTLGFDPKEVADVNTIISTPGAISASRLHPLAGLDKGIEYLDLEEEQLNTVEGSKGLIPSRSWTDDLCYGTGAVYLLGLGIGGLYGFQQGIKTLPESAPSKVKLNHILNNITKRGPFLGNSAGVLALTYNLIDSTIDGIREKHDDLNSVTAGALAGALFKSSAGLKPMAYSSVMMAGAAGIWCGLKRFLQE

SEQ ID NO: 17632 - protein, 538 aa, Candida albicans
  UNSURE (511),(538): Identity of amino acid sequences at the above locations are unknown.
LFALICQFFKFRFFFFPLSCLKIFGLQLLLLRIIFFFRSNTCSVKSFWERETMLRFRQIRLSPIYKSRLINFRRFNSTNSKKPKAEEEDNNNNNDKSLQQHNVPARQDDKTDVGSFKIKPATSRSAPAPMENTGIEQLMHKDNKPYIPKLQHKRVSFEYPNLPNQDEYTNLVEKPKSITRWTRYIPKILTVIVLVWSGYTYHVWMTDTEEGEDSSDLLNPNEFHKFIVTHKEKIDDDHYIIELTPKFSYWEYSHGTDPEGKSLWNGDKFWSVEIKQPDINVVRSYTPLPLYYLKSEYTRSGEREPLLKVINPEIDEYDKHGTMCLYIKRYNDGEVSRYITDRNIGDELELRGPNIEFKFPYHPLHKLHKRPIFKDLPSKVEADNMIETVKRVNNLPDVDNIVFYAAGTGIAPILQVLFSKKPYLGHVDIHYSARHPGELGILQRFLFFLDKLDRINITYHYDDDDDDDEPKTILNAKDINPPGIPNYITPKTLEEKSKFLTGDEIEHLVFXAKHPIPHMRNLWLGPERIKNWSQTQTX

SEQ ID NO: 17633 - protein, 359 aa, Candida albicans
  UNSURE (346),(349),(353),(354),(355),(356),(357),(358): Identity of amino acid sequences at the above locations are unknown.
YSHTLQKTYIYIPPIFRNIDKHPIIKMNHNNNTYHGRSSSPPQARELCNLLNCFLSHPIYNDSTLPLNENSQKKNNTSTTSNQTVSLSAAGMRALIYQLQSIYLRTPIKLFRPSRFDYLAYVRALANKHDNIENKPYRFMTHSSLGMIINVVRKQGWKFIPDQILPPLIANSATGVILYATYLTTLDYYTKQHEKNKVELHTTTSGGGGGTATTTTTTSRANFNWYAPIDTWRAGFVAGAVQSLAAAPVDAIYTRLTVAEMLEGSHENLWVFGFNKLRKIGLIGVFAGYGSSLVKESLGFAFYFLTFEIIKTQGYNLTYKLITYYKRLEQLIKSNLKKIFHWDDDXMMXMENXXXXXXM

SEQ ID NO: 17634 - protein, 312 aa, Candida albicans
HHQTPLIMEIFHPLKEITFGVISGMWGKVVGFPLKTIKVRLQSTGSSGGITTLQMIKTTYHNEGIFNGFNKGLKAPMIGACLANAILFSSYNFGSTVITNYLNKNNDKNQYTTETLPFLGKILAGGFAGFMASFVLTPVELVKCQLQVSNLSLDKSHHTYGTIIKSTIRDRGTIGLWKGLNSTIVREVIGTAIWFGTYEYVNDYYKKVKEPCVSNKDVQLLIAGAMAGVTFNFSMFPVDTIKSNIQTHDLFNNNRNSNSVGKHMGFWQTTRSIIAKPGGILNLYNGLGITMVRCIPANALIFYTYELLKQNF

SEQ ID NO: 17635 - protein, 243 aa, Candida albicans
NMHRALYNSLTKTANACCVSRSVRFVAPQVSVCNPQRLAFRFNSTNASKEAAKEEAPKEEVKSEEEQSSGAESEAQEADPLAELKDKLEKKDKELASMKNHYARAIADFRHLQETTKTEVQKAKDFALQKFAKDLLDSLDNFNLALGHVKEDTLKLNDEVRSLYEGVDMTKTVFEKTLNKYGIEKIDPIDQVFDPNLHEATFQMANPGKEPGTVFHVQQVGYTLNERVLRPAKVGVVKSEDDN

SEQ ID NO: 17636 - protein, 299 aa, Candida albicans
YTKSYPLLQSTKAMSEPKPLPFIYQFVSGAIAGVSEILVMYPLDVVKTRQQLATTNDYNGTINCLKKIVREEGFSRLYKGISAPILMEAPKRATKFAANDEWGKFYRNYFGVTKMNQSLAILTGATAGATESFVVVPFELIKIRLQDKTTKFNGMGEVVKDIVQKNGVLGLYKGLESTLWRHIWWNAGYFGCIHQVRSLMPKPKDSTQKTLIDLTCGTVGGTFGTILNTPFDVVKSRIQAGSTQYRWTYPSILKVAREEGFSALYKGFIPKVLRLGPGGGILLVVFTACMDFFRQYHEK

SEQ ID NO: 17637 - protein, 617 aa, Candida albicans
SNTLLIINRVQLFIYLFIQLFIYLLLSLKKKKIMSSLSSELKAKEIFNQFATEGANEEKIITLPDFINVLSPFTTDIPKQAFSLLYLIADAEKKGFVTEDNWLKFVNTLTSPDGEYKLLYQFLSGQQNTNSKITYSQCIDILNKINSSIDPSYQQKLIKLNWIYFPRFFEPNGSIEFNDFVTLISYLPVTKLIGNFEITASKSKTVNGEELVRLLSTNLNHKLSNKLKINLHNVTDFFGKQQDYTLSNLLFIYDALSKVDLINEVIVNTPPTTKDKDDILINKTDLYNHLNDPLLKSANFKPVSRLELDLLFYLINKKTDEDIPRRELVSFLNPNFNNNLNTLAPIFEHSQSKHSTIDGGDNFSLWPLYDSLYSFFLGSIAGCIGATAVYPIDLVKTRMQAQKHNALYDNSLDCFKKILRNEGFKGLYSGLGAQLVGVAPEKAIKLTVNDLVRGIGSNEDGSITMKWEILAGLTAGGCQVIFTNPLEIVKIRLQMQGNTKNLSKPGEIPHKHLNASQIIRQLGLRGLYKGASACLLRDVPFSAIYFPTYANLKKHMFGFDPNDKTKHQKLSTWQLLVAGALAGAPAAFFTTPADVIKTRLQVAGKNNDAKYKVCTAG

SEQ ID NO: 17638 - protein, 384 aa, Candida albicans
NKMYSKRSLCNCIGWYDFSIFSVFLLVPNLSPVQVHNFLRTGADLKKNKEKRKRKQKISNNLNYNQNLNRLSIKTVESLFRFSNLLAFCLVILINMSIVVQDKEDQILTQLEHPQPDTKSPPKYIAYLAGVCSGINKNLVGHPFDTWKSRLQTAPKGRFKGPIDCAWQTLKYEGPFGFYKGFTPPLVGWVFMDSIMLGSLHTYRELVKDYIYPQEKKLPLVGHMIAGLGSGLTVSFVAAPIEQCKARLQVQYDKKSRTYSGPIDVAKKVYQAAGIRGIYSGLISTMIFRTNFIFWWGSYEIFTQYFEKNTKMSTPSINFWAGGLSATVFWIFAYPADVVKQNIMTDSPIQSEKKFPRWIDAVKYIYKEKAWRGFTKRFGPAILI

SEQ ID NO: 17639 - protein, 258 aa, Candida albicans
KVRLQSAPEGTYNGSLDVIKKLLATEGPRGFYKGTLTPLVGVGACVSVQFSVNEYMKRYYDKRLNGQPMSIIDYFVCGGVAGFANGFLASPIEHIRIRLQTQTGNSKNFNGPLDCAKKIYQTDGIKGIYKGLVPTLIRESVGLGIYFATYEALIARELKTHPKLTRNDISAWKLCTFGGLSGYTLWIGIYPIDVIKSKLQTDSIKDPKYRSSLAVIKDVFRTQGIRGFYKGFLPTILRAAPANGATFAVFEVTIRLLG

SEQ ID NO: 17640 - protein, 305 aa, Candida albicans
KANMSNAETVLDTEITKSVDNSLTRKLKDIAAGFVGGATQVLIGQPADLVKIRLQTTSATSSFQVIKNVIKNEGILAFYKGTLPPLFGVGVCVSLQFYGFHETKRQILQYTGQPSLNLWPQTYIAGAMAGVVNTPVTAPVEQLRILSQSSGKPVSLRETVSKIYREQGIVNGIYRGFGITLIREIQAYGVWFLTYETLIQKIIDLQHYKSRDQISTPELLASGAIAGNALWLLSYPLDVIKSNVQSDGFGKDSKFGGSSLKALRYIYSHHGLTGFWRGIVPCLLRAVPCSAGTFASVELALRLMG

SEQ ID NO: 17641 - protein, 156 aa, Candida albicans
SHFHKQSNQTLRINMGWFWADKPSQDTVKATSFFTTPSACPIDHSKLASSSPTCPVKLNNDNDEVLNPLNNMPMAISSERAPGQRIKLSTERTISTIPRGESEDQGLWEYPSPQQMLNAMLLKGKGDGVPEDAVESMVEVHNFLNEGAWQQILTWE

SEQ ID NO: 17642 - protein, 614 aa, Candida albicans
HLAISILITTSTMAPRIRRRITTSKREEIEKEQEELSKTIIRPYDVLQSLPVSYSQPPTSTSSIFTHPLTIKDTGTLYYSLIKSRNNYLTMCPMFKLFWVKQSSYVRKLLELDKPLPKSMENDIYLNREMVLNNDSSARDIMVKLCDGGLSFSSGIHSFEIRIFIAKDKRSDINEIKLIKQREKELKKINKLKEKELKDKLREENRLIKEQERLERLKEKELEKQLKQKQKEEKQKQKEQREKERELEREKKEKEKKEKEKEKERKDKEKEKKDKEKSSQLKGTGNNVKDTLIVGVIQKSSIGNQKEVGTGDASTSKTLQSKKKQTAKQLNSKDTSKQQPSISTNPKIKLEITTSQSENVKQKLKVLTGTQTGEAAKTVNNNPPNMATSNNSAVAGSQTTPKYNINSEENQLMIKNLNLIAARDSSLNALMRTVALGQASMQQIDVFKEYIKRAKAMGPPPHDDSVWEEVFRTPVWGSAINNELQSSQESKPSSSENKKDKDSVESKVKEEAGKTTQSNDKEKLPKETSSKNEEKAEEAEGQSKDLESTEKKELNPKDNVNVNKNENEKPGLKDKVETNEKESKPKEKEEIKDQEEQTKKNSQELKKDKVEIDG

SEQ ID NO: 17643 - protein, 575 aa, Candida albicans
  UNSURE (53),(57),(59): Identity of amino acid sequences at the above locations are unknown.
EEKETDKLKIEKNEESEKNKAEEPKKDKSEESTKSNEESKKDEESKKDEETLXEKDXDXTQANEDSTKGKKVEIDVKKEDTNEKEIPPETKLDKDLKDLPSKEKKKSFEKPPKVKKEKLPKQSKHSKAEIPDDQKLTAFQERYLEDATLLFEFVENPNVRFLLPKDAICEVLPASTMINAENGNNSDNRDILMSFIWIHNQKEVDEYEKKLEEYKKKKAEEEEKKRQKEKEEEEEEERKNKEQLEKEKSNEKNKEGDELKLVQSLDEVQEGQSKDVEMGDNTTNTVKSENEVIEISDDVQATEEPEEIKQVIEEIEETEETEEIEEIEEIVPAKRRAPPRRGKKKRRVPPPKKPTTPKPLEPPVEPEYRFTTLSFTIHGIPSKLVPIFMNSVNPIKEVQTKMKHILEVGTRTSSFYLWYQVDGKLDEELAENIRVLLNQEEKKMTGIPTIQHETPSEPKKYPKKRKIKEESKTGNEQGDDDLGENNNNNNNNNSKKIKVESIEDNDEQNESNKSENDRKVRDESNELVLKDHDNDESQPQNEDVKEAPVATDTVDSLISDQIEQTPEPIKENSST

SEQ ID NO: 17644 - protein, 520 aa, Candida albicans
FIFEMSPHDIIEDKHKSFIHASPIESTYPTPKNVPIISTAEIFKKSDPNANFITPTKPSRSAGSNEDSMRENDMEHANEHVNGNANINGHVNGNARQVSDNSDRLSLKNDRAPSTAPTTPKLNSIGQNKENLDFFHDYVKEISSLKAQNEVWKTKFDNLNECYQQELQQREKQHIEYDKLKEMYRKEIEEKNQLKKEIQLMNTRIQILEYGEENLKLLVDKYKDIATQLKENNNQSPSKMQRSPSPVDKQDSKHAEHPVSDLISFDNLEEVKTSTLPKKINHAVQTELRNFNITAPVSKPSCTCNSNKATQTLNTSSTKINKAIQTIQIQEKTPQQPSEQISKPEFASQTENKLTPEQTTIQVATTSLSLPPSQPATASTANNETINKETHESSPVSVFPEFSLSSYNSKFHNYYKQLHLDQIDELNKRDLQYLIKTTMCQFMIDYYNIDASLIRYARFLSIVYQFLNDLHLIIYPGQILKSSDYYRGRVYRDGKIDEEMIGLKECLNGIQNKIRETLGE

SEQ ID NO: 17645 - protein, 223 aa, Candida albicans
FNSTGFFFSGLVFQMYTYMEYLQKCFYKSTNWNEDNIYSNITATSQALLDFPIPNGFKIDSSSKTTDYLASSFTLSNHHQINGSLAYLYSSIPLTNTMGTKDVSLQDAIAGFRIIEPLVGLRSKLKNNIMSNRSSLLYGRMYFPGSALEAMIIKLLTKNSQLLIKCVNNPHLEKNGTMIVYLQNNTAKYLRELIYSTNEALIGLRCLYNLGDFLTAGLEDHAL

SEQ ID NO: 17646 - protein, 280 aa, Candida albicans
YNLGDATSHNFTNINPAVIPKFDNSVVSIGTEIWYAARTMSPGLSAALRYSTRSTSTGKPLTMTLAINPIVGHVSSTYTVKTSVASTFCSKYDFNVFSYASNLSLGFELYSYANKKKNSFPSFEHHEIHSSSEENKYLKKHPELQRHHNLHHNLHHQRVPIKSHKYEGNRTIINPIQNLDNVYHINPTLLSSNGSTSTTTNNENTNTSETVTAAFQNLVNESDFSSVFKFSTSLNDKVVKILWEGRLKEFLVSTGVKLSLNPITNTPEFNKLGISFSYAL

SEQ ID NO: 17647 - protein, 223 aa, Candida albicans
RGFVFTVKQGMFNQFKSASVFNSIFGSFRRFKHEYAPRFKEVEKAQKGRVSVRTGGSIKGNSLEFGKIGLRLKSQGIRMHANQLQAADKVLRRELRPTKSKLYTRFVCDLAVCIKGNQTRMGKGKGAFDHWASRMPTGKVLFEIDGPIHDKVARDALRKAADKLPGLYEIITPESKVRVSLTHLIDKPEPVDYVEKLNAKPTKKWANVQAYHTVPMYKQYSGR

SEQ ID NO: 17648 - protein, 838 aa, Candida albicans
GGLPPRGEDVHEVGTLCQIIKTTGSEILVYPHYRVKLVDISTPNSRSESIEKEQDNSQTSYLKKFEVSYAVTQQLKDEPYDEQSITINAWTRRIKELYEKLAPKYDQPENKEEIMSNPSMLADFIASKVHAKPEQIQEILESLNVETKLELSLQLLQVEADADEMRQTALKNIRERTEKAYAQSLIKEYTKELLKAAGIGENSKVHKFDERIKHLKMPEEAMKAYKTEKERLGTQSDMEQNVVERYLDWLTQIPFGVYTKDSFNVKKAREILDRDHYGLKDVKDRILEFISVGKISGNVDGKILCLAGPPGTGKTSIAKSIAEALNRKYTRIAVGGVQDVHDVKGHRRTYVASIPGRIVTALTQAKTSNPLMLIDEIDKLDTTSHGGAARAFLEILDPEQNNSFVDNFIEVKVDLSKVLFVCTANYLGSIPGPLRDRMEIIEVNGYTKNDKIEITKRHLIPAAAKKVGLDEGRVVIPDETISRLIDKYCRESGLRHIKSLINRIFSKASRKIVEELEETDVDSHNKDTVEGTLVAKESEKVISDKAKIDTENLPIEYIQSNTEVKAETTTESQQEKEKEKEKDEEIKKLDLPADLKIEVKPETLKDFVGPEIYIKDRLYETLNPGVATGLAYNTSGDGDALYIESILTDSISSDLGNAGLHVTGSLKDVMKESASIAYSFAKQFMVRQFPDNRFFEAAHIHVHCPGGAIPKDGPSAGIAFTSSLVSLALNKSLPNDTAMTGEITLTGKVLAISGLRQKSLGAKRAGYTKIIFPKDCEYQLDEIPDEVKEGLTYIPVEWYSEVFEHLFQGISKEEGNSVWKEEFAKLEDKKKSKKTNTK

SEQ ID NO: 17649 - protein, 358 aa, Candida albicans
FRFDWPLHSVMITPIYLCRGAFSHYRRYISQSTHDPLKIAFFGSDNFSVASLNKLIQYQKKNPDKVDSVHVITRSLKPQGRYMKTVQDLPVGKFSSQQGLSIMRADTSQEIRQLSEQYLFNLVIAVSYGRLIPSTFIQHCKYGGLNVHPSLLPKYCGSSPLQYALLNDDKFTGCTVQTLHPTKFDHGDIIIQSSEILILDDDNSVSLFKKFGEIGGDLLVKSIDQGLFVNPTPIENNYTRSMAPKIPKAKLQVFWNKYLAREIKRLYDALGPIFTFLNVNVIRKRKQICEKQRVILSCVKEYQLTDSFEQLKEPGDFMLVEEGLLVKAKKGGVLVERIKMQAQEEESPEKFIGTYSKK

SEQ ID NO: 17650 - protein, 272 aa, Candida albicans
RDILFGRVSVAIARLRNPEVIELLSTTIANLVEGEFMQLKNTVLQNNNNDEIFNDGDVKSIPQPTGKVPTKLHQYSVQQQQRTTNGGNGGDSADAAVVVDHEINVEAAFEYYLHKTYLKTASLMSKLCRAAAVLSGAQDDIIENCYQFGRNLGLCFQIVDDMLDYTSSDKTIGKPSQADLKLGLATAPILFAWKQEPKLGDLIARKFNQPGDVEIARRAVEKYDGVAQTKEMATMYCHQALKNLRVLPESEARSALELLTNSVLNYVTKGSK

SEQ ID NO: 17651 - protein, 184 aa, Candida albicans
PIVMLSFKQFRVSTSSLLTRRIRSRHHSSSTFKTAVETAEKLVTPPTSKFLDPFSIVSHEMSNLAKSIANLIGSGHPTLNRVSSYYFEAEGKNVRPLIVLILSKALLKIPLEQRNRIPIDTIDVTEQKSFNGTPTKQNSTIAGKSIDDSLSPLAILHGINPKVILDPLSKPMDKLPIINGHNKP

SEQ ID NO: 17652 - protein, 113 aa, Candida albicans
TMSSKQEISKKIISLLNTLPKEKLKHYSSFKDSQIKRFSDLQKVNQISEQDLKLQYIALKNLCNDKYKRYYELDDKLLRPKGNPHYYERLMNEINGEKKENLFSALRTVVFGK

SEQ ID NO: 17653 - protein, 215 aa, Candida albicans
LIEVIMLTRRIISLKPFPVSISTRSKATSASPTSNSTSPYGDVNLSNRRVMKRIVQGKARPAIFYQFETLVEMSDGSVIKRYSQAPKDEIRMINDQRNNLMWNPNNNDLRNGGIGGLGGDLQAKGKINKFKQKFANSFEEEEEEVGKQSKEGKEGKEEKKVEGEGEVDEEAIRRKQLELQKARDEELFELMGENAEEVVGGGKLYDKKADKKRFK

SEQ ID NO: 17654 - protein, 149 aa, Candida albicans
HAVADSVSKIVQVSREKTLDCFGRAKTQAKRKLSIAKIYLVKGEGEVLVNGKSLIEFFPNIYARKNLLYPFQVVEQEGKYNVFAQVTGGGYTGQSEAIMYAIAKALVVFNPLLKPRLSKAGLMKSDTRIVERKKPGKVKARKSPTWVKR

SEQ ID NO: 17655 - protein, 163 aa, Candida albicans
NVAPSSGVVKTKASRLRRKLDHSCGKHLIESLSARSLSFPEDSKLNWELKSIQNNPKVVLFNIIPDADGIACFVQFILKLKTNQKISIVKDQKVVKEQESSVEDYLVYSMNPISKELLLVGKLFESDHIRGLKPEMDVFDQKLMQRFLKTSSDIYRTDPKQTK

SEQ ID NO: 17656 - protein, 268 aa, Candida albicans
ERATERRKKIFNIERKIVSDRAVKPTASFNINHIMLKRTLQPISVLKRCLTTSRTAFASETGSKSSNQSTNNKINKHTEFLSKYYNPEVLQSIQAAESLVTPEQYLNLQLKGSDAKSKVGPTDEEFDYSFNDPEWEEPIIYPNQGLGRAPYPEIPQVSSPDRSALKIRFSDAPVATQKDEPTGIKTPQQIAQELSDLTGLDERYIKRLYVRPLIMKRVSLKTAKSNIAHFFVLSVAGDKNGMVGLSIGKSRNGIRTAAHQAPWNAVKN

SEQ ID NO: 17657 - protein, 177 aa, Candida albicans
YLVAFFLSTLYLINNYPTMTSEDQSLKKQKLESTQSLKVYLRSPKGKVPTKGSALAAGYDLYSAEAATIPAHGQGLVSTDISIIVPIGTYGRVAPRSGLAVKHGISTGAGVIDADYRGEVKVVLFNHSEKDFEIKEGDRIAQLVLEQIVNADIKEISLEELDNTERGEGGFGSTGKN

SEQ ID NO: 17658 - protein, 126 aa, Candida albicans
TNISFTMFRSIYRVTLKRASPIINTRQLTVSSIRFNETTTTTSTTTTTTPKSSCPAGTVLNLKVFKKGDEPVAKEDSEYPEWLWTMLDPKDNLKAIQNEDFLRWRRIKLSKENNSTIKNNNFLSKL

SEQ ID NO: 17659 - protein, 143 aa, Candida albicans
RWYFVIWSIKSGSKRHALSGKQGNKHYYKGTVSTGIVSWISRGRYHINWEKVRTYVVPEGLNNTELKALVSPKSPKFIQQVVGYRDHFKSPELAFHNAKDFIEYGANYSDVDLEQEGYIHRIVHPDILEAERKENMDVEGIKN

SEQ ID NO: 17660 - protein, 92 aa, Candida albicans
LLVAWKDIALSCGSACTSASLEPSYVWHALGADDALDHSSIRFGIGRFTTEAEVDYVIQAINERVDFLRKMSPLWEMVQEGIDLNTIEWSGH

SEQ ID NO: 17661 - protein, 335 aa, Candida albicans
  UNSURE (33): Identity of amino acid sequences at the above locations are unknown.
IFDFYYLRGNMYKSIFKTTGRLGKTVSSRNFVXTLPKPLATRSSPATNAPNKTSNPKTGELHVSTPVDTAKISIEPPEGSSISLKSASRDASLFGTRPIYLDVQATTPVDPRVLDKMLEFYTGLYGNPHSSTHAYGWETDKEVEKARTYIADVINADPKEIIFTSGATETNNMAIKGVPRFYKKTKKHIITTQTEHKCVLDSARHMQDEGFEVTYLPVSSEGLINLDDLKKAIRKDTVLVSIMAVNNEIGVIQPLKEIGKICRENKVFFHTDAAQAYGKIPIDVNEMNIDLLSISSHKIYGPKGIGACYVRRRPRVRLDPIITGGGQERGLRSGT

SEQ ID NO: 17662 - protein, 214 aa, Candida albicans
LLYHQSTMSLALRFGTVASIQEALWGVVPRLPSITIRLGLQNRLGNQSTTDERLQELKEKIEESGGEAPFMIDNGTILKAVPKKKLSRARRRKKLYAPGNKQVHPINNIVRCSACGSVKRSHFMCMNCFAEIKTFLKSLKRKNGIIKDTVNPQSDLNPLDERVIYPGKFETDHERQLKAKEWVPKREKPMPYDNTQVRHRKVNPKKGKVMVELE

SEQ ID NO: 17663 - protein, 175 aa, Candida albicans
EDVVQSIWSNILSAERWPRMTYTEAIEYLNKTLPQDEQLIWGDSLQLKHERLLAEKSPIFITDYPESQKPFYMLKSANYNAENPTVACFDLLVPEFGELAGGSMREHDYQVLLANMKQENMNIEDMEWYLNLRKQGTIPHGGFGLGFERLISYLAGYDNVRDISAFPRAPELCNC

SEQ ID NO: 17664 - protein, 329 aa, Candida albicans
YSRPVAQLTTSMLIQSRFPLKALQQVLSKRFNSSSLNPTIKNQLSNPPPIGSIIEARGFVKSIRSSKKVGFVDITDGSISNNLNIVLQGPDQPKFKVGQSIVVKGDWTVGKGKQPFELKYNPENPQHAITILGDVTDDYPLQKKATSMSFLRNFPEIKHRTSTLGSFLRLRSHLEFKLMEFFQSRDFIKVTPPLITSSDCEGAGEVFKIEPLNDNNPKEPFFGKNAYLTVSTQLHLECLALALNRAWTLTPCFRAENSNTTRHLSEFWMLEAEISHVNNVDQVTTFTEDMIKFVTKSLVESSHSTELSDLGAGNGNAYLNVFNRRGRTM

SEQ ID NO: 17665 - protein, 99 aa, Candida albicans
  UNSURE (7): Identity of amino acid sequences at the above locations are unknown.
SELVRLXRHCEDRRNGDGVMPYLHKQLLQKHDPTGKRRALVENSNTGLRAGDIIKVTYLDRSDVTGRVIGIKRGFLNLGTNILIRTKLNKVGSELRIPV

SEQ ID NO: 17666 - protein, 87 aa, Candida albicans
FGFYLLSPICVMYYVGLDTDKKFNLPGFWPDPSTLNQIPKEPHEIQAEIARIKRARLEKRKRLEEKARELGISEEDFEEEEQQEILS

SEQ ID NO: 17667 - protein, 154 aa, Candida albicans
SMIKRLVKLLSKMSIPPSSTSAMETTTTNIVQPNSTISQEFNTVQEGKATILTPKQDEVFYNPIQQFNRDLSIMAIKAYDEIRHEKIQAIKKKSKNKRTKLNGLKILESLAASGLRSCRYGLEIPEAGKIVANDMLAEAVKSINKHVEYYKLTD

SEQ ID NO: 17668 - protein, 248 aa, Candida albicans
CTDAGVLAGSGYPEKCFALYGGNNFGNAYVNGESNHEVGIRLILNLIASTAAKYKKTIEPMLSLSIDYYFRVFVKVKTSPINVKNHASETMLTYGCNGCGHKIVQPLGMKNNTKFQYPKLQGPISSNCQYCGTSYNVAGPMYAGNLHNREFIDKVLKINESSDKEIYVTNERIKGMLTLAYNELDDAPFFFNLNQLCSIFKSPPISIEQYTKAVGNLGYKVSLTHAKKNCVKTTLPRFSTRPSAKSSQ

SEQ ID NO: 17669 - protein, 670 aa, Candida albicans
RIMLKQLSRSLGIRSSPIVANLIRSKQVCTRGFHISLVKQNTSSKVNEITDITSDSLKVKEDAAGSDLPSTKTDKKSKLESFQPVKFEDFKGKGYIHDSIINSLHKNDFKELTPIQQKSLVRIFNTEKGLVCRAKTGTGKTLAFAVPTLQYAYKNRGKGVSTVVLVPTRDLAFQIEEEYRKLISHLKYNERPNLELIIGGQRTSFNPRRPAEIVIATPGRLEKELQTDRKLAKCFSNVTYRIYDEADRLLDVGFESVLNEIDGLLYKVRTTPKPIKSLLFSATVDEAISEFSKKHIHPEYEFLNTVTKDDLEIPENIHQQLIECTDGIDKVNVSLLELHGIMKQHNDYKVIVFLPTKTAVDWFYEYITNALDDELFELFSKPPRVFMLHGGRSVRQRSAALKGFKVAKKGILISTDVAARGIDVKDVTNVMQMFPSVEIADYIHKVGRTGRAGKKGKASLFATPAELPYVLLLKRKRKVKFQEVIQSEKLNSSNIIDQIESPLDSTKEFLATMVGYLQQLQSAHRLDYDLLVIENMELYRKLVRDDKAMLESRILSRIGKGISAHVKRRYFTRTRYQSHDDAEFDSYSDFSRSGMSQRPRSNDRSSKMTFNGRGKYGNNRNNDWSHQNKNRYNNNNNRQTERSYDSDRKSHNDWKYEKKFEHRRIRDHDE

SEQ ID NO: 17670 - protein, 187 aa, Candida albicans
HCIHIRESLKLNDFPAFIQCILETRNWNANHYEYPKFLLMQLEKLIVNCCVNPFTALFDCRNGELLYGNNLTFTWKRIINEAKHVFVKEYTILNTIPDADSFLNTDRLLKSVVDVCKITAKNSSSMRQDVRNLRNTEIQNLNGYISFLGRKLKVGTPVNDMVTNMILSKINIDRGIDRQAADSLSKL

SEQ ID NO: 17671 - protein, 236 aa, Candida albicans
SWELNAPEITTVMSRVDMVTGTLGKAYGVVGGYITGKTNLIDWFRSYAPGFIFTTSLPPAIMAGCSASIRYQRATLKDRIAQQKNTRLVKNNLNELGIPVIPNPSHIVPVLVGNAADAKRASDLLLNKHDIYVQAINFPTVPIGEERLRITPTPGHGPELSKQLVEAVDSVFTELNLNRINDWKKLGGLVGVGVEGAAKVEHIWTEEQLALTDADLNPNVVNPAISPLDVSSGIST

SEQ ID NO: 17672 - protein, 309 aa, Candida albicans
  UNSURE (43): Identity of amino acid sequences at the above locations are unknown.
SQTSGALANQARQCPIAGNAIRAKEISIRSYSSATKPARATAXTPSTPEATFNVTSSFELGSKETAFDYNGYLGNELEKKRSDKSYRYFNNINRLANEFPKAHRTQEEDKVTVWCSNDYLGMGKNENTLKEMKRVLDKYGSGAGGTRNIAGHNSHAIKLESELAALHKHDAALVFSSCFVANDAVLSLLGQKIKDLVIFSDELNHASMIQGIRNSRARKHIFKHNNLADLESKLAQYPKSTPKLIAFESVYSMCGSIAPIEAICDLAEKYGALTFLDEVHAVGMYGPHGAGVAEHLNFEAHLKLGIERP

SEQ ID NO: 17673 - protein, 385 aa, Candida albicans
QLYQSSFIPLNFLEDTVSKKDLEEEHTRELQVEQAYKLFQSALKLQKQKQYESAYKVYEELFKLDIVSNHYFEELDFIRGLQDGSQNTDTDELTLLSPNVNSLRYLIFRNRGFLYLDMLKSNTENKFAEKVKEMFYPLLDDFCIALLYNEPDEKLLETLHEIFSYIGSERLSRFVLEYSLTSRKESDDLSGLLPIDQTVLSQYKTMLEHLLSGKFPKLDLKHLLFLEPIRLDIFAQQEKLASKKVAVIKSTSTKWVDLLDAINIHLKENQDESKIEDANRPRIRIFEPYVLTEEPLDIVRIEFTKRGVAVPATETEVTKAQPEQIVQERKPEEDNRVQRSSKRLSKVEDEIPAVTLESSHFLNMDYFRNQMNETIPNFENFGGLF

SEQ ID NO: 17674 - protein, 658 aa, Candida albicans
  UNSURE (2): Identity of amino acid sequences at the above locations are unknown.
PXRLIFQPPVENVYSGDDVTIKPAHCMSHDNSWPVATKFMNLGASKVKDNRQIVCTLDHDVQNKLEQNLTKYTNIEKFAKSQGIDFYPAGRGIGHQIMIEEGYAFPLNLTVASDSHSNTYGGIGALGTPIVRTDAASIWATGQTWWQIPPVAKVELIGQLPKGVTGKDIIVALCGIFNNDEVLNHAIEFVGDDAISKLPIDYRLTIANMTTEWGALSGLFPVDETLVEFYQNRLKKLNKPDHPRINNQTIDQLINNKLTLDNDAVYAKHLQIDLSSLSPYISGPNSVKISNSLYDLSQQNIAINKAYLVSCTNSRLSDIQAAADIIKGHKVNPNVEFYVAAASSLVQKDAEQSGAWQTILDAGAKPLPAGCGPCIGLGTGLLKDGEVGISATNRNFKGRMGSKDALAYLASPEVVAASAVLGKIGGPEELNGEPVKQAPRIIKSIETESNSANEAESTSEEASGSIDILPGFPQSIEGELILCNADNINTDGIYPGKYTYQDDITKEQMAKVCMENYDSQFYSKTKPGDIIISGYNFGTGSSREQAATCILARGMKLIVAGSFGNIFSRNSINNALLTLEIPDLINKLRQQYEGNDELTIRTGWFLKWDVTKAQVTVVDGDDNLILTQKVGELGTNLQDIIVKGGLEGWVKSELKTNQ

SEQ ID NO: 17675 - protein, 775 aa, Candida albicans
RLTTRQLFHTMLSSRIPKGKLLKQTSATSYLNLAKSMPITTARYRPNQYYANELAKPNVFTIHNIPSPCFSQVRNFHLSFPRKLHMQQTEQGDNRPALEKFGSDLTQLAKEGKLDPVIGRDHEIRRTIQILSRRTKNNPVLIGNAGTGKTAVMEGLAQRIIRGEVPDSMKDKQIITLDLAGIISGAKYRGDFESKLKSILKEVEEKNGKVILFIDEFHLLMGLGKAEGSIDASNLLKPALARGKLSMCGATTIEEYRKYVEKDAALARRFSPVTVNEPTVEDTISILRGLKERYEVHHGVRIMDSALVTAALYSNRYITDRFLPDKAIDLVDEASSTLRLQHESRPDAIATLDRQIMTIEIELESLRKEEDQLSIDRKHKLEKELEVKKSELKELTDQWESEKRAIDAVKNAKSELEKAKYELEQATREGDYARASRIQYASIPELQDKIQELSKNELAAKSSNLLHDSVTSEDIAGVISKMTGIPVNNLLKGEKDKLLDMNILLRQSVVGQDEAIDAVSDAVRLQRAGLTSENRPIASFMFLGPTGTGKTELTKSLAQFLFNDKNAVVRFDMSEFQEKHTISRLIGSPPGYVGYEESGELTEAVRRKPYSVVLFDEFEKAHPDLSKLLLQVLDEGSLTDSHGKKIDFKNTIIVMTSNIGQEILLADKNTYEDGHINSEVKLQVLENLRHHYAPEFLNRIDDIVVFNRLSKTALKEILDIRLREIGDRLVDKRIILQLTDEAKTLLCDMGYDPTYGARPLNRVLRKKLLDPLAMR

SEQ ID NO: 17676 - protein, 404 aa, Candida albicans
VKKKKMTTILALAYKLEIHNPDMSLRSIHTLGRCSRPLTTAAGSSSTVQEVSQNKPVIPSNSTVFSMIQPTGRIHLGNYLGAVKSWRTLSESNTDPSNRFIYGIADLHAITIPKDPIEFKEYRYAAIASLIASGLDTSKCILFFQSSVPEHSELNWYLTCMTSMGALNRMTQWKLKAQQLDNSSILEDNVLEKTKAGLFCYPALQAADILLYKSTHVPVGDDQSQHLELCRSIAKTFNSTYKTNVFPLPKTLLTPAKKILSLKNPQKKMSKSDPVATSCVYVTDSPEDIQFKIRKATTDSIQGSIYYDPIERPGVSNLINIVSGISNKPVDEVVKDMSSFVNHKQLKDYVSVVIISEFDDKRQLYEELMKDKVYLDSICSQGRDKARELSLVNLHQVKSIIGMD

SEQ ID NO: 17677 - protein, 348 aa, Candida albicans
IFFSSPQESNRYLTVGALQIGSSVADMFKFTTRFLSTSRLLLSQAGESTSSASVSATIPRFHVKFGAKQFIEPGTNKRRAKRLRRKETRIKKQIIRDVNTLKQHEVKNVSLKVDPVLGDPNCGFVERIMKKVENQELTLAYGIDRVEFEKLLYAAEKLSLENASKNEALRESVIQTEENKRKAVMTILNLKNTNVPDKKKMAIKFAREEMQRSPGDTASPEVQAAIATIKIHYGMQQVKNMPKDKINIQGVRKLVQYRQTILKYLKRKNPELYYYTIAKLGLTDDVIVREFNMGKQYMQDFKVWGDKVLVKETNSVAKKNKKIKDLKDRVAKYNELAKKNYEIMYGTK

SEQ ID NO: 17678 - protein, 358 aa, Candida albicans
  UNSURE (147): Identity of amino acid sequences at the above locations are unknown.
PHTFNHHKLHGIMIRGSSLIFTRSISTSFSLPVNKTLEILKATNANFEGLFTNNAINQLWFQRGQQLVQNLNQHLAQTNNGLLSDSNNINNNTSSTSDNGNGDGENVVNYSLNEIISITMNKPELFHIHKNATNLYNLQFFFENIRXLEQQPTEIIPSGSEVLLQTPKDQFKNVPLDKELVDWIEHSFGSIQELRNLIINSAKGIKGDGTVWLVAESTMSENYLSKSNFSSPLFHNLAIVNTYNGGRIDDSERSGQLRRMKSVLQQQQEQDKSTENKQKHNNSTSEFELGSVEQAELETAFHNKRLVPALAIDVSPRNYLIDYGAYGKQQYLENVWECIDWDIVSRRLPPRSKQVITV

SEQ ID NO: 17679 - protein, 208 aa, Candida albicans
KTYHDRGIPYRRCYLLYGPPGSGKTSFIQALAGELDYNICILNLSENNLTDDRLNHLMNHIPNRSILLLEDVDAAFNKREQTNDQGFNNGVTFSGLLNALDGVASAEECITFMTTNHPEKLDPALLRPGRVDYKVMIDNATEHQVKRMFLRFYENEEELCEKFLAKYRKLNMQHVSTAQLQGLFVYNKRDPEAAIAMIETLQNPNTVF

SEQ ID NO: 17680 - protein, 102 aa, Candida albicans
CRMAQTPQSIDFEKIKESSDGTLKGMLTQGFNEIVVNNPYFAAGGGLMLLGTGLALARLGVVKGSGFIYRQLLVDLKIPSKEKSYPSFWEWIFPFKPKTSLP

SEQ ID NO: 17681 - protein, 270 aa, Candida albicans
RAPSNMCRIVARRSVLESAFSNKEIRELLELPAKFVPLPKDLLDFDTKKLGRVDKRRVSLLEKYSKQQKEHTNRSWELEYYKSPKEFIPGENDLLKSTKFVINKPANDPLAPHKVEPTDETVTENNELVILSIGYQGSPIQGFEELGIWYEKNRLQNKSGRILSTKSKEKDEHNAVFKPGGYAAGWIKNGPQGAIASTMMDSFDTTDKILEDLANDAYIKTNSDKELEFSNAVDWGNWEKLNTYELERGEALGKTRLKVCNKDEMLKLMK

SEQ ID NO: 17682 - protein, 203 aa, Candida albicans
FSTQRMDGNTRSGRLVASIWKSFTRSIHYKPLAPNKYPKVNVNDVDLNPPRYGFRRIRPPIIAQSPTKTLFPSVEIAKKYIEEGKRVPNRFMDQFGPDHARKEFEEFQEKLALEEPHFKIGGKQIYFPQGRICLLRSNAKHTPYQAKFLVPKSMNQMDLRDYLWHIYGLRALNITVQLQPARWKRSPYPLGRVFTTAGRSQML

SEQ ID NO: 17683 - protein, 164 aa, Candida albicans
KFLVFVRSIPHQSNNRTMFNPLNKPTTTSNVIKHFVRGKRQATELNIATQKIVNQLSVLSASRKQPKLLKLCNEDFIKHKTIMNAWKLLQRRRITQQSEKLSKQYKSIVNAMEDLKQTSPELFEAANAKNPKRFTTFPIEMRVPTDYPPNKPWTYNFVPSKTHH

SEQ ID NO: 17684 - protein, 319 aa, Candida albicans
WKHIFKSQYSTKKKEVPHYSQELHTYNQLMSPKAELLTEQKTLKQYPMIKLLDGMETLPKYLAEYLINDTNTKIRYNTSIQDIDAVTGKINGESYDHIRSTINTHDLAKTLPTTDPLVPELKSIEYVSIFLTNVYSRSSNLIPKGKPGFGFLSPRYGNVWKNPDALLGTIYDSDIENNVEGLFVDTKPVHNPNNKITIMMGGHYYTNWTIPSNSVNLKIVKDVLTSKLKVDLSKFNLKVIKDGEPLQIDEINDNDLVISYSFHSNCIPQYNLGYQETKDKVNQLLDKGYKLSFGGTVFADGVGVPDCVLNGFKDALKLK

SEQ ID NO: 17685 - protein, 207 aa, Candida albicans
LFFSYNHYPPPHFNQLMTLTTLPQNAKVAVLGAGILGLTFTYFLSKLRPDLQFTIFEKLKRPGGWMSSPKLHVNNTNESILFEKGPRTLRGVKDGTLLMLDILRKLDLDSQIEVINEKCNANKKYILDSSGEIIQVPNSIGTTIEFLKNVKCVDRKLITGIIKEPFVKPIKVDETIEQFFKRRLGSTVLTDNVASSIIHGPSPRTSD

SEQ ID NO: 17686 - protein, 284 aa, Candida albicans
RKPKKDQNKDEEEQLREELKKKFAAKHPGTNPDNLKIYKFDLRTLGNYVLLFGSTILTFYLINRTSESEIQQLTFQDFITNYIEKGLVTKLTVVNKAVVEAELIPGAVSNISHNRNGKPYVVFTIGSLEFFEDEMNKVQDRLKIPINERLPVVYEDHTSWLSYIMPILPTVLLIGGLYYLTMRRMPGGAGGAGGAGGPGGIFKIGKSKAKLFNQENEVKIKFKDVAGCDESKEEIMEFVKFLQDPHKYEKLGAKIPRGAILSGPPGTGKTLLAKATAVSLHYER

SEQ ID NO: 17687 - protein, 402 aa, Candida albicans
  UNSURE (78): Identity of amino acid sequences at the above locations are unknown.
ERGNGRMGVNDERENTLNQLLVEMDGFDTTDHVVVLAGTNRPDILDKALLRPGRFDRHISIDVPDVEGRKQIFKVHLXKLKLKSVQDIDAKQKDVDFSKYQQLKNEEIEKLAGRLAALTPGFAGADIANCCNEGALIAAREDAPAVDTYHFEQAIERVIAGLEKKSRILSPEEKKTVAYHEAGHAICGWFLQYADPLVKVSIIPRGQGALGYAQYLPKDQYLTSQEQFKHRMIMTLGGRVSEELHFDTVTSGASDDFKKITQMAQQMILKLGMSDKLGQICYDTSSDNGNGFKVHHNYSETTARIIDEEVKRLIDESYEACHKLLTEKLDLVDKVAEELFKKEVLTREDMIKICGPRPFPERNDAFDKYLQGEDAFKGKPKSKDQNSNDDGASSPSSAPETA

SEQ ID NO: 17688 - protein, 228 aa, Candida albicans
SPIPSKDDLPKPDSKEYLKFIDDNRHFSMIRNLHMADFITLLNGFSGFYSIISCLRYTLTGQTHYVQRAHFFILLGLFFDFFDGRVARLRNKSSLMGQELDSLADLVSFGVSPATIAFAIGFRTTVDVLFLAFWVLCGLTRLARFNISVNNIPKDKHGKSQYFEGLPIPTNLFWVGFMALLVYKDWIHDNLPFGIVFQDTLFEFHLVTIGFVLQGCAEISKSLKIPKP

SEQ ID NO: 17689 - protein, 101 aa, Candida albicans
LKSSMSTASKITLGASCAFAVGAFVFINYSQQAERQALRQGPIKDAARQQAKQLEKLKKQLANELEHKEQTELREKYLKLQPLSDEIIKGEEGKIIPPKDA

SEQ ID NO: 17690 - protein, 308 aa, Candida albicans
  UNSURE (297): Identity of amino acid sequences at the above locations are unknown.
TTLVLTPLPSLFCIKIMTRVVVTGMGMVSPLGVGLSRNWKQLIANKSGLISTTTLPDYESAGWDKIPSKVIGKVPHGTILEGHWQVGDHIPASEARRMATFSHYALASTHEALQDARLLTEDNNALNMDTNKVGVAVGSGIGSFEDIYNNSIAYNASGYKKVQPLFIPKLLNNMAAGNISIKYQTKGPLHSVSTACATGLQAIGDGFNFLKMGYGQVMICGGTESSIHPLALAGFARARSVVTDSEFNSNPTKASRPFDKSRNGFVLSEGCGILVLETLSHALERGVTPEHIYGKSXFEHAACGPQFG

SEQ ID NO: 17691 - protein, 93 aa, Candida albicans
RAKYHRTKSSIGHLLGAAGAVESIFTLNAIKTGQIPATLNLDNVGQHEGDEQSQFKFDYVANKSITMDVNYAVCNSFGFGGVNSSLCFAKYHN

SEQ ID NO: 17692 - protein, 865 aa, Candida albicans
LSPLYCLIMIRQVNKKAISNSLFKRLSLSSSAFANITANKKSSTHQLNQKTQLTNVRFYSTKSTVIQLLNNIGSKREVEQYLKYFTSVSQQQFAVIKVGGAIITQQLNELASCLAFLYHVGLYPIVLHGTGPQINELLENEGVEPEYIDGIRITNPKTMEVVRKCFLEQNLRLVTALEKIGVHARPITAGVFEAEYLDKDKYQLVGKITSVNKSPIEAAINSGYLPILTSLAETSLGQLLNVNADVAAGELAREFEPLKIVYLNEKGGIINGNTGEKVSAINLDEEYEDLLKESWVKYGTKLKIKEIHDLLQHLPRSSSVAIIDVNDLQKELFTDSGAGTLIRRGYRLINRNSLRDFGNPDLLRNALLRDPEIKTGKVSVASYLKFLDSVQFKSYGDEPLEVLAIVVEQNDKIPKLDKFLSSKTGWLNNVTDNIFNAIKKDYSQLCWVVNENDANLPWYFSKSDGSFAKNGQILFWYGLNIDEASKLIKEFDSSSIGSSLSSSKESGVFTSAQQKRGFHHSTVRRNTNPNPPLSEGKQTERKKVALIGARGYTGQNLIKLIDNHPYLDISYVSSRELEGQKLQGYNKDNIVYSNLQIEDIKRLEENNEVDVWVMALPNGVCKPFVDTIDLVQNPNSKIVDLSADYRFDTTGEWTYGLPELNDRKTIAQAKKISNPGCYATAAQVAIAPLKEYISGTPSIFGVSGYSGAGTKPSPKNDVNLLSNNLIPYSLTDHVHEKEISSQLGLQVAFTPHVAQWFQGITHTINIPIKKGSLTSREIRNIYQDRYQGEKLITISGEAPLVKDISGKHGVVVGGFAVNSNEDRVVIVATIDNLLKGAATQCLQNINLSQEFGEYDGIPTESLIRG

SEQ ID NO: 17693 - protein, 219 aa, Candida albicans
RSPEIDHRDKTYVPVLSGANMNFDRLRFVSERAVLGEGKEVSLAVTIPEKPGEFARLQKVINPRAITEFSYRYNGEENADIFVSFNVLDKKKEKSSVIAAMENCGFEVVDISENELAKSHGRYLVGGKSQSTKSSNEKIYQFEFPEKPNALFNFLQALRSDWNISLFNYRNHGHDVGKILCAFTLPEGSEEDFQEFLKNVGYTFVDESDNIFYKKFLRS

SEQ ID NO: 17694 - protein, 193 aa, Candida albicans
IVQRPNPLPLLQKWPELLDSDFIVNSQGEKQPDYVKLILTSRVYDVVDEAGTPLTNAINLSHRCGANIYLKREDLLPVFSFKLRGAYNMIAHLHSNSPQPISGVIACSAGNHAQGVAFSSSKLNIPATIVMPTPTPSIKYTNVSRLGAQVVLYGDDFDSAKQECERLSTEQNLINIPPFNHPYVIAGQGTIAL

SEQ ID NO: 17695 - protein, 414 aa, Candida albicans
IQIFIKTEFVKSTPPPVDLQKSIGYWLLGTSTLVSGIVVLGGLTRLIESGLSITEWKPVTGAVPPLNQQEWEEEFNKYKNSPEFKQLNSHITLNEFKFIFGMEWGHRLVGRCIGAFFILPALYFWARGRFTPQLTKRVVGLTGLLGLQGFIGWWMVKSGLDEEQLAERKSKPTVSQYRLTTHLGAAFLMYLGVLWTAFEIFNENKLANLAKKSPEAVQAILKQLNNPALKKTKIVGLSLLALTFVTAMSGGMVAGLDAGLIYNTFPHMGDDWIPNGSELMSPVFSRKSDQSDLWWRNLLENPTTVQLVHRIFATTTFFAVLGAHIYVNRNKGVVPIAAKRIMHGVMGVVTLQVALGITTLIYLVPIPLAALHQAGALALLTASLAFSAKLKKPRPQFVQFINSNMKSKLLKTRV

SEQ ID NO: 17696 - protein, 303 aa, Candida albicans
FFFIFFFFHFFDQTVNLRTITITIIPPIMLRLGLTRSFRATSASLKTVRVGIPSNIATRSPLIYSSIRFNSSTTTSGTEIQDKLTSFDDTTTSAILENVTNLHSDQLGYLQSIGLAQGWGPTSLIERLLEVTHVYTGLPWWGTIVVATIAVRLVLFPLYVRASSNATKMSKIKPQIDELLQQIKTGDTVDQMRAMEKRRLIMKENGVSTLATLFPAVQLPLAYGFFQALRKMANHNVEGFSDQGYAWFQNLIEVDPYLGLQAISAAAIIAVVRVGGETGQHAMAAGMKKVTTGLHDGMASCLV

SEQ ID NO: 17697 - protein, 547 aa, Candida albicans
MFRKGLIRFQHTLTHTMTRPVSNSIVLTTTEEKIRNVLVGYCDYYNKTNNDSLELRITGGWVRDKLLGNESHDIDIAVNHLTGEEFVNGLHDYLRQHEPELSMNHVHTIKMNPEKSKHLETCTTKLFGVDIDFVNLRSEEYTHDSRVPSIEFGTPEQDAVRRDATLNALFYNLNQGEIEDYTKRGLSDLQNGILKTPLAPIKTFLDDPLRIIRLIRFASKFNFVVESETLNAMKEEHNKSALLTKISKERIEIELRKILTSNNPGYGLQLINYVDLASSIFYVPELAKEFDNESLEEARSQLACHMEIASLIYPNFKQTINNSTEKFKNEFAALMTNDDYKNVFWLSVILHPYTNVKSCKPNRDIFNQYLRLGLTSKKSDIAKVSAINMNSAELSRFFSAPELVKRSDIGLYLRKFPEFASLNLIVNALLDCVRKVDQFTQLPKELPVPFPEVGEKILGDENINKVISEIVSRYENLFVQIENWDLTNVHLVKPLIDGTTLSKSLGMKPGPWLRPTIEEILVWQLDNPQSSVDECFEFVKSIIPKYK

SEQ ID NO: 17698 - protein, 195 aa, Candida albicans
  UNSURE (7),(8): Identity of amino acid sequences at the above locations are unknown.
ARPLNFXXGPSGEEQIRLGSAIGGEAQTYIKNGSLVPDNIMVGLITAELEKKKWLTQSSSWLLDGFPRTVNQARELDRVIHDRANFNLVVELDVDQKVILQRIEARWIHEASGRVYNLDYNPPKVPFKDDVTGEALTKRQDDTAQVFQKRLDQYNEEIEPLKVFYKQQGLLYTVSGDTSDIIYPKLENLIVDKIM

SEQ ID NO: 17699 - protein, 686 aa, Candida albicans
PPPVHLSFGPPCVKTDLSRIIGQLQYKCKFKTNTRTEAIILGKMLNDSDNAQSSISEFFGNMEKQTIVEILRNMDVIGVDNLYKVFDCDSIDASVIPKELQEIYQEHKLKDHDDEIAEDILKLQENKQINPLDKKSLEELLPVDSFGLQVIRHSLLGLKPDLEAALKFADQVEKIIEDVDDEVLNQDIMSGKINYFEMYSKLKTEEQRQAFNEALNVFNLERQKQIEIRGIEGAKEKWKHDFEELQKRGDLNLSKGLNAQCYKWLQDVLPVLEKEYKLCEALINGNNSVIEKDDPNAKDRAMYAPFILKISPDKAIIITILELFKLHSTGGVVRGFRAYKAIQSVGKAIEAEYRIGLQAKKENKLFSQKHLSPQLQKLMRRTMQKGNESTPEWDDATRARIGGVLVSILMSVAKVNVRKETPQGLIEDFHPAFYHGMQFIAGNRVGVIKVHTDISNILSGTSLTESIQPQALPMLVEPKPWNSFYGGGSLYSKTPLVRVKDSPETEAYLKAANERGNLTGVFEGLNVLGNTAWTVNKKVFNVISHYWNSGEEFLSIPPVSEEPQLPQDIPGNSDPQKLLHHTTSKYQALDEYISNKSQRCDNNYRLEIARAFIGEKLFFPHNLDFRGRAYPISPHFNHLGGDLTRSLFLFWDGKELCEEGLNWLKIQLANVYGVDKESLAKRVEFV

SEQ ID NO: 17700 - protein, 337 aa, Candida albicans
DADYLSPCVKTTNVYGVTVIGAIEQIRKQIIHLFPKDADHHAAARYVAVQVYASIRELFENAHFIQAWLTESAKRITKSVTLDFGESQYSEQELLSTVIWTTPLGLPCVQPYRLHKKKQLKTAVQDLNIVMPSNTSAVDSRKQQNGFPPNFIHSLDATHMLMTATKCAEFDLNLASVHDSFWTHAADVPQMNRIIREQFVKLHTTNLIELLKEEFSERYKDNYQVLPIPNNHELARKVKAIKKEWAEALNRPVQIADELYMERKRLQMLESEDPEEVEVAKNMETTISITMNYKPYEFANRQVYNSFQILVPIQFPEVPSKGEFDVNLVKKSQYFFS

SEQ ID NO: 17701 - protein, 278 aa, Candida albicans
EPNGFYWIKYQLASLFGQKNCLEFYEENYDNIIDSARNPMTGKKWWMKADKPFSALAVCFEIKKILDYRMSGGKIEDYKCRLPIHQDGSCNGLQHYAGLAADETGGAAVNLIRLETKQDVYTKVLEIVKKKIEQDILEQNLGTVNLETAKFFLPILNRKLVKRPVMTTVYGVTLAGASSQIMQTIKEIVEDHRTNPSKTTFSNETLHKLKSVQLTQTSYLAKKILDSIDELFVHAKQIEKWLLQNTKRILTSYNIKTIDHLLNNNPSSFETIFTTPMS

SEQ ID NO: 17702 - protein, 729 aa, Candida albicans
SYYLATNDVIMQILRLLGRHLCNITLKCLKRQITTLSVPDRSVSDITSSIFEVTKDINHGPRSSTKVMKYVSSFYQNVKIMNLEQISRILTDIANDMLKRDDNVINNCEFYFNCLKIGLNCFSESTSTEALYLLRNNIEDYRKVIVKFRGLGTVPETVPYSEMKNIQNLFLKTILHLYSVSKQSGKSRIITNPITEYFLHNLKSFDTDIQEFANELTQEESLQKALTEICFSKQISLPVTKTSIEREPYHLVSIDQYLDEYGGIDYENICKYISDYKFTWRGQYINDKLFNYYDTLSTEEKSQFMEAYLDFNKSKELIIEKYTNRIVHVSLEASKQFEKSFKFGMSEKNLIHKWITDTTEQIEKILEIETSLSNEEVIIHHFKPFLETVTIQSIINYIIFSILGSPDGKLTTVIEKMKYSFPSVLSQHASPNLKGEVFQYINDDAYIKLTHQLVKLIIENCKVPITSKQMEQLQNSLKLENKEIADQFLISSGGNDDEYLAFCKETKRITNTKNKTYIIVKMHPYIELKLQSLKLGTHLHYLPMLHPPKPWVNPQSGGYLTIKTSFVSTNDSIQVELLNRAGVRGQLDNAYSCLDQMGNTAWAINPLMLDVFNKLMGNPDGFLSIPPLVPDETLPQKTKTELKSLRITFEIMNKLANAFGENGDLLYHCYSLDFRGRIYPFSPLTHYGGDLARSLFMFWYSEPLGTQWILLDKISISFIVWTKKLFRVL

SEQ ID NO: 17703 - protein, 240 aa, Candida albicans
KIMRIPSARFVRTGLCSFKPRSFASGRLPYTYLATRAFHSSKIRAINFDPYKTLGVDKSADDRQIKKAYYDLVKKYHPDVNKEKDAEKRFHKIQESYELLRDKEKRAQYDQFGASAFDANGNANPFAGQGGNPFGGFGGGSAGGNPFSGMGFDFEDLFREAFAGGRGGAGGGRGGRSFVTEHVGDNIEVLKTIPFKDSIFGTSVTINYKAVDSCTTCSGSGLKAGAKKNTCPTCHGAGQT

SEQ ID NO: 17704 - protein, 88 aa, Candida albicans
LFNTNIMVFSFHIFKEPHAAGPHPLAPEGLVPSGLNSTKSSTYHNSNPVEPQNGEFFARSELSARFRYRTIKAEEIEQVESGGAEFVF

SEQ ID NO: 17705 - protein, 619 aa, Candida albicans
CRKFSHVLQINNIRKLTNPANLIFVVAFLLISFSVVVSVYHYPFYSFLFVKTQMSISKSIYELAVIANSLGKVLEGSSKIVQNEAYQWYKSSFVSKIIQDSCDNSQPMYEEMQNISTTIRNQVSPNINQKENPFQSQSQKRSYSTKSYSPGDEVELETESTSSNTVPDIKPKLTKTFEMSQSEVPSSRLARIFHYGSLAAGIGLNAATQGLRHYASGNSDAITMKSLVLSPQNIERMARKFSKMRGAALKLGQMLSFQDASILPKEIQQILLRVQNSAHYMPPGQLERVMSKELGLNWRERLFTSFDDVPIAAASIGQVHTAVAEDLTPVVVKVQYPGVVDSIDSDLNNILMLLTASSLLPPGLFLDKTIANARVELKWECDYIREARNLVRMRKFLKDDDAFEVPRVFHQLCGEHVLTMERMRGIEIVKGDWGQSTKDWIATNIMRLCLLEIKEFKFMQTDPNWANFLYNEKTHKIELLDFGAARDFGDHFIDNYVKLLRAAVKKDRKRVEEISKDLGYLTGLESPQMVKAHVDSVMCLGEAFSPVDNNGEPFNFKKQTISDRVRGNVGLMLNERLTPPPEETYSLHRKLSGVFLLCSRLNATVPCEDLFREIIGYED

SEQ ID NO: 17706 - protein, 72 aa, Candida albicans
  UNSURE (11): Identity of amino acid sequences at the above locations are unknown.
GLSQSRMLPAXVCEKQNQRIIKEVKGMLGLSLVESKKFVESAPKVLKENVAKEDAEKIKATLEGLGAKVSLE

SEQ ID NO: 17707 - protein, 180 aa, Candida albicans
SNKKKEKFFSKKKRHTPNNNQTMSFQLTPKEAFAKLPQKLHNFFIKYPPRPFAQYKDGPSTTTDPLRNPFFPNKNQESGNWQSAKFSRRRSADLFKLAKKFGIHDLLPPTPRKFHEDKYTNKLWLHGMINPASKAKQEELDAKLKARAEAIANMDNIIVATRPSYKKLLEKREKRKKTWF

SEQ ID NO: 17708 - protein, 314 aa, Candida albicans
NKIYQATKFVLGRLVQDYIPPTTSELTGKESLVEKWILHKLSHAAKLTNESLEARNFGDATNHIYNFWYDLCDVYIENSKSLIQDGTPEQKKSAQDTLYTCIDGALRLIHPFMPFITEEMWQRLPRREPEITGNLKTIMKAPYPVYKSEFDDIKSLEAYNLVLDITKGARSLLSQYNILKNGQVYVETNNEEIYKIANDQQDSIVSLIKGVEKITVVKTLDQVPSGCALQAIGPECTVHVLVKGQIDLDAEIAKVEKKLSNVLEQKKKTDESISKFTEKTKPEAKDSAYKRLEKQTAEIEGYEQTIAILEKLKL

SEQ ID NO: 17709 - protein, 427 aa, Candida albicans
  UNSURE (18): Identity of amino acid sequences at the above locations are unknown.
IYMLYSRNLLLSASSILXRKRIDFCMRRKLLSSSSIVTNNMSDSSTNPPPPPHPAAAAAAAAAAAEQPVATTPQEGQPKQKTAKELEKERKKAEKLAKFNAKKAKQAAEANNKPKKDQQKDDKKTKKANTPTTKIPEFVDKTVPGDKKILVSLDDESFKAYNPKNVESSWYSWWEKQGFFEPELTANGEIKKEGCFSIPCPPPNVTGALHIGHALTVSIQDTLIRWNRMQGKTTLFIPGFDHAGIATQSVVEKQIWAKEQKTRHDYGREKFIEKVWEWKEEYHQRIKNQFKKLGSSYDWSREKFTLNPDLSQAVTEAFVRMHEDGTIYRASRLVNWSVKLNTAISNLEVDNKTIPGKTLLSVPGYESKIEFGTLTSFSYPVVDSETNEKLTVATTRPEIFLVILQLLFIPKIQDILIYMVNLFNIHF

SEQ ID NO: 17710 - protein, 384 aa, Candida albicans
  UNSURE (376),(382),(383): Identity of amino acid sequences at the above locations are unknown.
TRNIFGDTAVAVHPKDPRYTHLHGKFVQHPFLDRKLPIICDAETVDMEFGPGAVKITPVHDQNDYNTGKRNNLEFINIYTDDGLLNENCGPEWKGMKRFDARYKVIEQLKQKGLFVDQKDNEMTIPVCSRSGDIIEPLLKPQWYVDQKQMAKDAIEVVKRGEIVINPKTSEAEYFQWLENIQDWCISRQLWWGHRCPVYFVNIENEQIHDKLDNNYWVAGRTEEEAFKKAQEKFPNKKFTLEQDEDVLDTWFSSGLWPISTLGWPNETKDMELFNPMSMLETGWDILFFWVSRMILMSIKLTGKVPFKEVFCHSLVRDAQGRKMSKSLGNVVDPLDVINGIPLQGLHDKLLTGNLDPRELKKATEGQKLSYPNVIXSFAKRXXF

SEQ ID NO: 17711 - protein, 161 aa, Candida albicans
LKPTQLIRILLKGLLSSSSKLTTDLNDLYNQMDHYFTNFDYIRAIQCWWSVINQANQIFQSAEPWTYVKLIHSPENPAELKEKYRILNNYFVYLCAETTRISSILIQPVMPQLSKKILDRLNVSGRTSEFTTFGADLQYGSGANSKSHKVPLEKIAPRDIK

SEQ ID NO: 17712 - protein, 147 aa, Candida albicans
ISIMSAVKPLWYRWARVYFAGGCLVGTGVLFWYTIRPTDEQLIARFSPEVKADYERNKELRQQEQKRLIEIVKETSSSSDPIWKAGPIGSPFEKEQRNLSMELVDAELFHKTKHEEQQKQEIDRANEESKEAERLMQQNKKPWWKFF

SEQ ID NO: 17713 - protein, 206 aa, Candida albicans
RENNKDLVEDIHAVSIGPLKSQDILRTALAKGADNSTLIETSNDSVNNDVEPLQVAKLIKKIVEKDNSNLVILGKQSIDDDFNQTGQILAGLLNWPQATNASKIEIEIDNDNENNQVLVTREIDGGEDILKSKLPMIITTDLRLNEPRYASLQNIMKAKKKPLTKLKPQDLGIDKIENKLEILKIEEPPIRQAGVVFTHRGWKVPQ

SEQ ID NO: 17714 - protein, 175 aa, Candida albicans
TALAKGADNSTLIETSNDSVNNDVEPLQVAKLIKKIVEKDNSNLVILGKQSIDDDFNQTGQILAGLLNWPQATNASKIEIEIDNDNENNQVLVTREIDGGEDILKSKLPMIITTDLRLNEPRYASLQNIMKAKKKPLTKLKPQDLGIDKIENKLEILKIEEPPIRQAGVVFTLRK

SEQ ID NO: 17715 - protein, 233 aa, Candida albicans
KLLLERPGLFAIKRGMITWFNEKGEHIPATVLEVDSCEVLGYKLFKDFGYTAVIMGTIDKLKNVKSTNDLRIFETAKVSPKQKIGEFKIRSIDNDIESKLIPVGTELTADYFSVGQKVDVKGVTKGKGFAGVMKRWGFSGGRATHGTSKAHRTPGATGGNQNPGRVFPGKKMPGRMGHQNNTGFNLEVLHTDGEAGILIVKGNVPGPKKSIIKVSDAIKEYGNSINNTIPQEK

SEQ ID NO: 17716 - protein, 173 aa, Candida albicans
SNGRVVEKGGVVLYVGTHKNNSSIQEALVKASERSHGYYVNKRWIPGTITNYTEVTKQYGQIKTKMEVDMKDQKITTKNSNKIIKPDLMVLLNPVENRNCIKECISAGIPTIGLCDTDMEPSLLTYPIPCNDDSVRSVNLMLGIMSKSAESGLQKRISAVKKLEENDGKVVKA

SEQ ID NO: 17717 - protein, 295 aa, Candida albicans
SCACAIGYLRIFTKIFQRGLVQKKIFFYNNTNTSLAIQKYHLSWAMIRSTTATTTTLRYCARIFRNLSRSYFTENSQPNPNEQPPLEHTLSHKELREQAIAEALAREEEAILKTKKLRELTQESQNLISALNKTPTTLINERLNKLNEDLSKLSQDKIKQLDEELKDYLNQNMILPDHLKANRPWLRSSDNNEDISKKLKTSINSASSSDSNHTSTTTTTSSRYTEQFPNLKPTPDYKPYSEQELYIRQLNHTRINGRIGSRLTQVYKPQRDINNPPKFDNTTIANLHHRLADTE

SEQ ID NO: 17718 - protein, 229 aa, Candida albicans
LTMFSIRSSSRVLLKASSATTRATLNAAASKTFTRSKYSLPELDYEFSATEPYISGQINEIHYTKHHQTYVNNLNASIEQAVEAKSKGEVKKLVALQKAINFNGGGYLNHCLWWKNLAPVSQGGGQPPSEDSKLGKQIVKQFGSLDKLIEITNGKLAGIQGSGWAFIVKNKANGDTIDVITTANQDTVTDPNLVPLIAIDAWEHAYYLQYQNVKADYFKNLWHFINWDE

SEQ ID NO: 17719 - protein, 67 aa, Candida albicans
KPIASSLILNFSSLINHAMITENEKISLPKIDWALDALEPYISKEINDLHINKVCSAMHRKCTTPTY

SEQ ID NO: 17720 - protein, 171 aa, Candida albicans
HHVAYVNGYNAAIDALEKAVGKRDLKSVVEIQQNIKFHGGGHTNHSLFWKNLAPVSKGGGKHPDTSSALGKQIVAQYGSVSNLIDITNSKLAGIQGSGWAFIVKNKQNGGALDVVTTANQDTISAPHLVPIIAIDAWEHAYYLQYQNVKLDYFKAIWNVINWAEAESRYSA

SEQ ID NO: 17721 - protein, 180 aa, Candida albicans
VSIILILIVVFCGITLSLVPEAAHVSSQIIAHELSQLLVTEESPCGMNAKDVQRAKNPLISSLLMNVESKLARLEDLGRQIQCQGKITTIDEMVDKINRLTIKDLQNVAEKVLTGKVITSNGGTSLGLPSIVMQGERETFGDVEFILRRYGLGNYKGPEITEPRDFSSNQNEKKKKSRWF

SEQ ID NO: 17722 - protein, 378 aa, Candida albicans
SSLTFFFLQVSRHPPSMLSRRTITRKLNKGVSKSLLSFARYNHSITSTTTPASLQPHIELTTFANGLRLITDSTPGHFNAVGAYIDAGSRYEDPKAPGLSYLRDRLSWKSTEDFTGQQMLENLSKLGGNYMSSAQRESMIYQASVFNKDIDRMVGMIGQTIRYPIFSDQEFQEALQTAEYEVAELAYKSDLYLPEELHTVAYKENTLGLPLFIPQERIPLVSKSDVIDYNNKFFQPQNTVIAMVGVPHEYALKLIMENFGDWANTTTTKPNPGIKNYTGGEISLPYTPPLYANLPELYHIQIGFETTGLLNDDLYALATLQKLLGGGSSFSAGGPGKGMFSRLYTKVLNKYPFVENCMSFNHSYIDSGILRYNIIFSP

SEQ ID NO: 17723 - protein, 418 aa, Candida albicans
QLQYRHTYSFIMLRSTTRNTLRLATRYTKVSSSIIRHTLPTVFGSSTGGSGIRFASQLAHVKTPPNLQNEPVKNFSFKDTKDWDLLRASITKFTDEGALKVPLVVGGKKIYRDEIKTQVNPAKHSQVLADVSQATPEDIIAAIDAAKAAKAKWATTSWTDRAAIFLKAADLISTKYRYDMWAANMLGTSKNVYQAQIDCVAELIDFFKFNVKYAEEMYQQQPIQTSPGVWNRAEYRPLEGFVYAVTPFNFTAIAANLVGAPALMGNTVVWKPSATAALSNYLLLTILEEAGLPAGVINFIPGDPVEVTDIVLNDKEFSALHFTGSTDVFKSLYSKISNNVAADKYRDFPRIVGETGGKNFHLIHPSASINHSVLSTLRGAFEYQCQKCSATSRLYVPESIWPEFKDQLVGAMFTDHYW

SEQ ID NO: 17724 - protein, 390 aa, Candida albicans
KTIFLLEEVSDSLYGHNYCMILRRNSIIPLRHLTSGCRLFAKKAATKKAPSPLLEEWDRGGRNQDTGLSPLLASMKRLIDLNPGCVSLIQVGSFYELYFEQAEEYGPKLGLKIAKKKTLNHVVPFAGFPTTQLRKFTEMLIHEQQVNVAIIDQCDQGSKTNQNLVHRKISRIITPGTLIDESFLNFNENNYLVAISFAPSSLSLPPDPQMKVGLSWTDISVGESFVQLTTLGELSSDIARINPSEILLPKEFQDHNLHLGQWYSPLQELKRYIIRYHSTTNYNELKLQYHDSIQKVRRHLETFSPREQAALNMIMSYMSINLPDVDILMTLPTRYFNETCLQMDSRTREALELTERTIAGRTSSVGSLVSVIKRTCTSSSPRDCRIALFK

SEQ ID NO: 17725 - protein, 87 aa, Candida albicans
VNKCRTLFATHFGKELEQLLVANNIDQKNIRYFRTRVLENGDNEKGFVIDHTLEPGISERSHALDVARMAGFPENALKAAEKVLDNL

SEQ ID NO: 17726 - protein, 238 aa, Candida albicans
PIYLPMFTATKTATTTTTSICRLFSTSTKTLSNVGKKPIRLYEGVNYSIESIPVEFCKKFTKRNKTFILDRQIITSGPLGKLRVEIPEFINISENNTNENDKSIIVSVKKPENKIQRSLWGTYRSILYNNIIGITEGHLSIVKFVGTGYRAILEKDPQTGEDIISLKIGLPFTPKLKIPKGLKVSSPNPARLVIEGSDKQQVKLFAAFIREHKKPEPYKGKGIFVDDEKIVLKQRTVK

SEQ ID NO: 17727 - protein, 324 aa, Candida albicans
HLIFFSSSPTTYKHSSFFFLLLLLLLLIFIQFHSLKNKKRTRNLNKTIMSETTTVPPIETVSEPNPFIVFATVATIISAFIGYYFLQQSKKHTPVLKPDEFQKFPLIEKIRVSHNSAIYRFGLPKLTDRLGLPIGQHISIGATIDGKEVVRSYTPISTDDQLGHFDLLIKTYENGNISRHVAGKNVGEHIEIRGPKGFFTYTPNMVKSFGMIAGGTGIAPMYQIITAILKNPEDKTKIHLVYANVTESDILLKEELDNFAARHPDRLKIHYVLNEAPANWQGSVGFVTPEIIDTHLPKASNDTNLLLCGPFSTEAAGRNSVPVN

SEQ ID NO: 17728 - protein, 113 aa, Candida albicans
DGKYRVTYEVIGSPPNIAVPTHFFKLVVGETQGSEKISCAAFVLPNDVIDNSTPLTSFQVPIEALERSSGLDLLQKVPYYNKQDLCKQVKCEIIVREFPKQVDKVLALPAGKP

SEQ ID NO: 17729 - protein, 173 aa, Candida albicans
SAINPQGFFKFGFPGPIHDLANRTEFVSCYDRSTRNPYWVIEHITKASLAKAELNGDRKRSVFKEDEAIPLKFRNRLRDYFRSGFDRGHQAPAADAKFNQLAMDETFYLTNMCPQVGDGFNRDYWSHFEDFVRRLTNKYDDVRVMTGPLYLPKLGADGKSSPRAAGSAYCPRR

SEQ ID NO: 17730 - protein, 197 aa, Candida albicans
IKRNISYHPPPSKMLRFTRTTAWKLRSIPIATIQYRQFTYSTICYQLKTLTPSLGINNTIESNIPSETNRLAKTGTRFWKKGEVKFNNETQKYEIQLDGKTLRTPLGFPLELPINKKQLAYLIAHEWTHLPDIKVKSSTLPLTALATRAIDLSQQHLSDLKTEKAEEMLALEDIKLQMLRYLDTDTCVLFAAHLHQP

SEQ ID NO: 17731 - protein, 316 aa, Candida albicans
  UNSURE (300): Identity of amino acid sequences at the above locations are unknown.
YNTIIMEHQLQFLPKDSVEIDYEALPDDASLAAHLTAGALAGIMEHTVMFPIDSIKTRMQMNLSNSEISRGLLKSLSKISSTEGFYALWKGVSSVVLGAGPAHAIYFSVFESTKTFLVNRLTNSPHLNRIVTDENHPLIASCAGITGTTASDALMTPFDMLKQRMQANAAYQDGKSTSVRLFKLASDIYKAEGLSAFYISYPTTLLTNIPFAALNFGFYEYSSSLLNPSHVYNPYLHCVSGGIAGGIAAALTTPFDCIKTVLQTKGISQNQNFRHVTGFKSAAVALLKQEGAKAFWKGLXPKIIFNIPSTAISWTA

SEQ ID NO: 17732 - protein, 740 aa, Candida albicans
ITLMFCRKYVFQTWKQLSRSYSTVNSIGAAKTRNIGIIAHIDAGKTTTTERMIYYSGRTKRIGNVDEGDTVTDYLPSERERGITIQLAAITLPWNQHKINIIDTPGHADFTFEVIRSLRVLDGAVTILDAVAGVEAQTEKVWKQASALNLPKVVYVNKMDRPGAGFSRTVQEVIQKLETRVVLCNLPYFETNKESDLEFKGVIDVIHQKLLKWNETDANGNEISVVNIDETTPDLLQILEKSRESMVETLGEYDERIIDSFLEHDENYLKIPPMLLDQVIRKATIDNYLTPVFCGASFRNIGVQPLMDGITKYLPSPLETSLPQITKNGKDVTKKVDGEKGLVVANDNNLTLALAFKVMTHSTRGPMTFVRVYSGKLNAASNLINTRTGKKLLIRKLLVMHGDSPEEVKSISAGNIGVIPGYETDFQTGDTLVSSAVAKRNFTAKDSAYRLLPIDIPPPLFNAAIEPHTAGDEAYMKQCVETLIREDPSLKVHLDKEMGQVVLSGMGELHLDIVRERLVNDMKAKVNLKDVVVSYKESFVGKREKEAVITNEEIEVAVTLSHIEDARDYVGQEGALVIEEDNNVILLSETALSEHVRATIDERRWKCENNLEELKEAILNGCLTALQMGGPILGFPLHSTLVTVNRWNVPVEVAQEQALNLMNASRQAVQSLKDEKKDFSILEPIMSTKVYVDSNDLGEVSHDLTQRCKAMIVEIQDQSTQNLETAAWAKDDAAKVYVPP

SEQ ID NO: 17733 - protein, 280 aa, Candida albicans
  UNSURE (146): Identity of amino acid sequences at the above locations are unknown.
KFLFQAQVVEIFIDLSLLINPITTKMPKVFTIQKNVASHKKMIYKNLCANLIRHEYIVTTSAKAKAAQPYIEKFLANTIKQNKELPEAVTNLEDKLKSIKALSYLQPPDRVECGLKMLEDIINRYPQRTHGFTRVIKLEPRLGDDXAPMSVIELVDSNYEIKLRYTAKTVARLELQGIELDDITELNIKKLTQYRVNGEQVFREAVETCKKEFFNVAEETGEVPEEIKSDLSNLPNMSRHLGELKGKLLVSKQFKTKPRPERQSINIPQSPFLKQQQEQK

SEQ ID NO: 17734 - protein, 601 aa, Candida albicans
KISYSDSFFSSPMSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQLREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRSTLAKYAKLVSDASKGCVTHL

SEQ ID NO: 17735 - protein, 654 aa, Candida albicans
  UNSURE (66): Identity of amino acid sequences at the above locations are unknown.
MGCNPQIPLIKKTSTIVRTKLCPYKRLEGSAPMYLELTWEPLILLCQLWDQIKSHRSLKTKKANVXTPSMVAFSKEGETLVGLPAKRQAVVNPENTFFATKRLIGRKFEDTEVQRDLNNVPYKIIPSKQGDAMLSSHSGQTISPSEIGGLILQKLQKVAENQLKEKINSAVVTVPAYFNDSQRQATKNSGKLVGLDVLRVINEPTAAALAYGCDKSREDGIIAVFDLGGGTFDISILEIDEGVFEVRATNGNTHLGGEDFDIVIMNYILENFKAETGIDLSGDRFAVQRIKEAAEKAKIELDHSDEIEINIPFVSQDKHIKQTLTSQEFTKMVMPIIEKTIDPVKRCVRDAELKFKDIDEVLLVGGMTRMPQIRKMVQDLFGKKPSTAVNPDEAVALGAAIQGAVLSGQVKNVVLLDVTPLSLGIETYGGIFTPLIPRNSAVPIKKEQMFSTAVDGQTGVEIGVYQGERTLVKDNKHIGQFKLSNIPQGPKGTPQIAVSFEIDADGIINVSATDKTPYPKDLEHYGKPNTVAIQVTEVGLTDAEVEKMIQESNRNKKADEEKKRLYEHASRAEILCTDTETALIQFGELMEDEEKKTIKEYANTIKEMIDEIRSGEKLHHPNILNQKVNEMQKTCMEAIQKVALKQQQDKESKN

SEQ ID NO: 17736 - protein, 516 aa, Candida albicans
KARGGQYSPQQIGGFILNKMKETAEAALSKKVNSAVVTCPAYFNDAQRQATKDAGKIVGLNVLRVINEPTAAALAYGLEKKDGEVVAVFDLGGGTFDVSILDIGAGVFEVKSTNGDTHLGGEDFDIALVRYIVDAFKKESGIDLEKDKMAIQRIREAAEKAKIELSSTVSTEINLPFITADASGPKHINQKISRAQFEQLVEPLIKKTIEPCKKALKDAGLSTSDVSEVILVGGMSRMPKVVETVKSIFGKEPSKGINPDEAVAMGAAIQGGILAGEVKDVVLLDVTPLSLGIETMGGVFARLISRNTTIPAKKSQIFSTAAAGQTSVEIRVFQGERELTRDNKLIGNFTLSGIPPAPKGVPQIEVTFDIDTDGIIKVSARDKATNKDASITVAGSSGLSDAEIEKMVNDAEKFAESDKARREAIEFANRADQLCNDTENSLNEHKEKLSSESVQKVQDQIQQLREIVLKAQAGEEVSPEELKQKTEELQNEAINLFKDLYKDGGESSGSSEQPKN

SEQ ID NO: 17737 - protein, 120 aa, Candida albicans
FNLIYIHIITMPAPFEKGSEKKGATLFKTRCLQCHTVEKGGPHKVGPNLHGVFGRKSGLAEGYSYTDANKKKGVEWTEQTMSDYLENPKKYIPGTKMAFGGLKKPKDRNDLVTYLKKATS

SEQ ID NO: 17738 - protein, 306 aa, Candida albicans
IFIMSSTQKQKKGAVDFVAGGVAGLFEALCCHPLDTIKVRMQLYKKSGQKPPGFIKTGVNIVQKEGFLSLYKGLGAVVIGIVPKMAIRFSSYEFYRSFFLDENGKISTGKTFLAGVGAGITESVMVVNPMEVVKIRLQAQHHSMKDPLDIPKYRNAPHAAYLIVKEEGFSTLYRGVSLTCARQATNQGANFATYSTIKAYLQKQQNTELLPAWQTSIVGLISGAVGPLTNAPLDTIKTRLQKSKFTNKENGLVRIVKIGKQLVKEEGINALYKGITPRIMRVAPGQAVVFTVYEAVKHYLTNEPTA

SEQ ID NO: 17739 - protein, 270 aa, Candida albicans
KIFFFSLHTERPYNQQQHNMSLIRAFTAASRVPRASLLSCVAVRFNSTSKASKQPLLAEIYPLNKDSITEKDLDNWIDAVKQLKSGKASHETPEEIYLGQLSQPQQFLKQTYEPTVDQIEETKKYANKKIPLRSDPTVDNLTNLIMRHGKKAKAQKVVSRALYIVQLKLRKDPIEVLRETLDKLGPLVNTKTMSTGVAKKRVVPIPLNEKQRNRFAIKWILEASNSRKSNDFSVRLAEEIINAYQGKSSGYDKKAQMHKQATQQRAYINL

SEQ ID NO: 17740 - protein, 257 aa, Candida albicans
SSIAGNQGKVYSLTNKRAGPVTESSTSTSRSISTDASPESSSPPKESFSDIEPSSEVPVKSTTSYILHDAPLEASNKNNGETINWSDSFHGLGAQPFSKEIAEILLAPVAEEDIEIKPDGLLYLPEIKYRRVLNRAFGPGGWGLAPRTESLVTSGQISREYGLICHGRLVSIARGEQDYFGGEEKLTTALEGCKSNALMRCCKDLGIASELWDPSFIRRWKKKYCEEIFVEHVNTKKKKKIWKLKSIKTIDYPYKMT

SEQ ID NO: 17741 - protein, 186 aa, Candida albicans
  UNSURE (168),(180),(183): Identity of amino acid sequences at the above locations are unknown.
FTQGIYRFLSTKTIEAESSTQSNHVISSKQLLYTTDPTSPGSIFFLPHGTRILNKLIQFMKNLQTKYKYQEVVTPLIFKTKLWKKSGHWDNYKDDMFKVVGNDITKEEYTDNIEEHEYGLKPMNCPSHCMIFAKFDRSYQELPVRYSDFSSLLSYEGSAAPSGLTRVXRFQTRSLTSLGXRPXNFW

SEQ ID NO: 17742 - protein, 327 aa, Candida albicans
QPHLNFFFPYQLTLSFFLFLTKTIDIMLTHHLSKLATPKFLVPFAGATALSIGLALQYSTSNNYIANETGKTFTDSNEWVDLKLSKSIDLTHNTKHLVFKLKDENDVSGLITASCLLTKFVTPKGNNVIRPYTPVSDVNQSGEIDFVIKKYDGGKMSSHIFDLKEGETLSFKGPIVKWKWEPNQFKSIALIGGGTGITPLYQLLHQITSNPKDNTKVNLIYGNLTPEDILLKKEIDAIASKHKDQVKVHYFVDKADEKKWEGQIGFITKEFLQKELEKPGSDFKVFVCGPPGLYKAISGPKVSPTDQGELTGALKDLGFEKEHVFKF

SEQ ID NO: 17743 - protein, 203 aa, Candida albicans
ARRNNKKKNKSNNTTFFSLIFLYFNNIIPTIIMSELSKLNEAKAKVAELEALVKKQASVMVQARQKLVDVELRNKKNQAAQNINQQPALDLTDYVNNDDIVQLVTELQTQLDALEARTMRRTYNATVQGDDEKLAPITNKDGDLPDFALPVTLKEFKLLEKIDLIRLGVFYEIILPDGEEIDHALQQTNSKEAILDINKKPVL

SEQ ID NO: 17744 - protein, 599 aa, Candida albicans
HLTPEEIKVGEYLRQDFERSGIHMDPQTRENFVTITQEISLLGSQFGNQINGLKSYWCPVTVAEWESIEDPQLKKEIKNYQSKYDGIRQSETIQIPLVANIPYTILTNCSSDTLRKKVWVALHNSPDEQIETLNRFISYRALLSKMLNYKSFADYQLEHKMAKTPENVITFLSNLQKSLIKKGVVEELSQLSEIKHNGSGSASVNDIVNDIKPWDRDYLLARLQQRMQSEVSAGNVKEYFSVGTVIAGLNELFTRLYDISFVPMAALKGETWDSHQVRKIKVVDNAANKTLGFLYLDFWSTKVLPSHFTIVCLRRLNTSIGSETIEGMEKLVQLDEDYQLPVVSLVCNFASSGHFLFGRFAGVENEKPTLLTLDQVDTIFHEMGHAMHSMIGRTELHNLSGTRCSTDFVELPSVLMESFSKDPRVICQIGRHFDTDEKLPESLLGQAHEHRIMLDACETFMQSKMAMLDQKLHNEEMVNLLAKGLYEVDSTKVYHLVEKELKVFADEWSTWHGKFPHLFSYGAVYYSYLLDRAIADKIWQGLFAKDPWNGEAGKKYKESVLKWGGTRDPWECLADALGNDELKQGDSRAMEIIGQNSNL

SEQ ID NO: 17745 - protein, 173 aa, Candida albicans
  UNSURE (144): Identity of amino acid sequences at the above locations are unknown.
KSLIIYQCCPLAQKTATIMKAGIPLLRCTQRLPLLVARQVSRNITTTTTKFLLAPEYNHIRKVFDSQKYFNHFTKQGSHATLFSSPQTGLFHNEYLTTPQGLVDFSQQSLSQAKQLVSEMLSQVNTVDGKLKFIKKLDQLSDMXCKVIDVAESIRVVHPSVKWINAAQQTHEM

SEQ ID NO: 17746 - protein, 350 aa, Candida albicans
MSQTERKLIINTAGGAAANMKQKEIPSTKNDAQKVSTLGGFLAGGVAACMAVTFTNPIELIKTRMQLQGELVKKSKDAVVLYKNPLQAFAVIYRNEGIRGLQQGLACGYYYQLALNGCRIGFYEPSRFYLSKAFAPSHIMPDGQVKQSLSINVLAGFVSGASGAVLASPMFLIKTRMQSFSASNTGGAAVGQQTFYKNTWDGFSQIYHSEGIKGLYRGVDAAILRTGAGSAAQLPTYYLTKSFLLKHGLAKENSFSLNFISSIMAGLGVAIVMNPWDVVLTRMYNQKGNLYSGPIDCFKKTIAAEGAMALYKGFWAQLFRIGPHTILTLLFMEQCMKGMVLIEKKLRSFN

SEQ ID NO: 17747 - protein, 264 aa, Candida albicans
  UNSURE (37): Identity of amino acid sequences at the above locations are unknown.
TPLLYYAYLHPPPHQYNLLQPLMSNVNNLNVRWIIPXRSSWLSKLTGDKKEQPKAAPPPVSEEPSCPVDHNARSVWANSVSVQVTAPEAIETTGTCDSSKIPNTLEDTTTTNIDLPGERELSSIPRTSSNTNWIYPSQKQFFEAMKRKNWDPQQEDMKVIVPIHNLVNERAWKHILMWEKPYAEDTQQKCGGITLTSFKGDLKKLTPRAWLKSIFGYDKPFDRHDWLINRCGVEVEYVIDFYTGSNSPVYLDVTPKLNTFKKGI

SEQ ID NO: 17748 - protein, 371 aa, Candida albicans
YIQTTMATFAPHISKITKSSTKFNYGRIAKTFLGVAGSAAIATYFYNNGNPFNNNNNNNNNNGGSKNAAKALFGASAGANVKIAKVPEGKSASDYQKVYNDIATKISENLEFDENAGYYGQLLRLAWHTSGTYDKSDNSGGSYGGTMIFAPEEFDPENAGLQVGREFLMEFLVKYPWISRGDLWTLGGVAAVQESGGPKIEWRPGRVDDNTASKVPPNGRLPDASKDGKYVKDLFARMGFNERETVALLGAHVLGRCHKHNSGYDGPWGPSFNQFTNVFYTTLLGDWHVKKWDGKKQYEDDETGEFMMLPTDMALKEELYFLKYVKMYADDQDLFFKDFAKAFSKLISNGIKYPADSKPILFKTLDEQDEE

SEQ ID NO: 17749 - protein, 311 aa, Candida albicans
NCIGRLFIPFSVETIFWLPIMIRSYIRNIILAILSPLLTTPPPLILPPPYEKIIQEITTVLSINNYDDGSLAPIILRLAWHCCATYDMTTNTGGSNGATMRFVPEITDEGNYGLDIARAALEPIKQRYPAISYADLWTLAGKVAIEYMGGPTIIWKSGRVDYTNDRCTPSNGLLPFADKDANHIRKTFTRLGYNDQQTVALIGAHGVGRCHKRFSGWEGKWTRTPKTFSNQFYVVLLNETWSQGEVPETGKTQYFNADKSLIMLNTDMELIRDKSYLHWVEIYAKDEPKFFHDFSSAFAKLLELGIKRETL

SEQ ID NO: 17750 - protein, 307 aa, Candida albicans
RQSDKNAGITFNSKNIENYLLNENKNLILKQQLITLIICTSLKLNRGLQYTERDYTTQLYLIENFMAWTKMIENNEWFCNPDATQYDEVLKLIGIPPGDYRIEKYLQDILKLVEQEYQTKNLYIFITSIMRTLVDKAPHLTYKYFYFKDAQIRQRSLNRSNVLIQDDLTYTMQACLKFDSQKLFDLYKNNQDLHDGDEGGQESLILELSKVTKDWNALQKNFENMYGRGNLPLTVHYGIAMQALNTLRADEELGRLYDQLQKRGLHLNSTVMDALIRSKIRLLDQTKVIELFAVYAKSHQAVEGPKY

SEQ ID NO: 17751 - protein, 268 aa, Candida albicans
AWYFLFFNFLISIVLVFKHYSSFITMASVLRGVFKTHLPRTLTRPKCARTFQTTTFLRNEQVKLPQTYDEEKVIIDEINKSLKPDDLQASSRLRNIGISAHIDYGKTTFTERVLFYTGRIITIHEVRGKDSVGAKMDHMDLEREKGITIQSAATYCSWDKDDRSYHFNLIDTPGHIDFTIEVERALRVLDGAVMVVCAVAGVRSQTETVDCQMRRYYVPRVTYINKMDRMGANPWRAIEQINAKLKIPAAAIQVPIGAEENLQRVVNI

SEQ ID NO: 17752 - protein, 210 aa, Candida albicans
RLVRMHSNDMEDVAEVGAGEICATFGIDCASGDTFIGQGTQQQITMSSMFVPEAVISLSISPKTKDNGAFSKAMNRFQKEDPTFRVHYDSESKETIISGMGELHLEIYVERIKREYGVDCVTGKPQVSYREAITVPSAFDYTHKKQSGGAGQYGRVIGEMNPIESENKFETQIIGGKIPEKFLFACSKGFEDCLEKGPLIGVHSGLENAS

SEQ ID NO: 17753 - protein, 756 aa, Candida albicans
  UNSURE (21): Identity of amino acid sequences at the above locations are unknown.
TKTKNKLPTQTQRGDKGNGVXGGILSRDLGDKLLPIIDRSFFMDFKPTDNEEGNDIYNSIETYKPLDSVIGIKKFEKLVKTMNNAFTKGQLKQYYDHQQSLNPGIRWKSSSSLVKTKLIEGIILDVWNISKSKKLIVNDMLEDRQILLKPWQRYLLGLNQSLLFKNMLRLKVKGKFSKNKLQLIGSEADLNFIEPELNKLLQDYTMESIDLSLIVDKNIEINFELIQEIAKVYFHKTKKTSNIYEIYGKNIEGISLAKRLLIWSINSNPHIKDEIFTTKSLTSESSSLPFVPFLNEELFPWYNRPFNYFVPLKKDHRSSNDLIFDKFDKMSNYFIELDELEELNDARFSLNEDIPQDNSNNAEEEEFDDDIDKLLNTTTITTTTTTKMDFPDMTKILDNQEKAKQQQQQQSHQDLEDLRKELGKFSNEDVDVSEFPNIAKLVEDFENADSTRTNQSENLNLENLRKELNQFSVESSNEEESKKNDIKFDVIDKLKLIELETDEKVPLFTTDTNNIDEHLTPKQIDELYEQVSDLKFTSDLNGVNEDKIISSAYTLQFGTIVMKNKKTPSSNGLIPKPIINSGDFQFQFVNSAPFMNDLISSYPVIPQPGCRQQFNEQPYANSMAIRLIPSMYQMKKKNNNNNNNNKYEITDKYLKYPPVEIQAQLDRGQILHYTLQVLSLEAVKNVAIPLPKLPCDIQVSRLLLGSLLPMNNEEENLSVSVSVSPKVRLSNHQPDLINFFGRIKIEFHWEQNNINV

SEQ ID NO: 17754 - protein, 481 aa, Candida albicans
  UNSURE (453),(465): Identity of amino acid sequences at the above locations are unknown.
IHSKKVHLYPLILLVGFNWLLTSTQFRYFPDTPNKQNVTVNNMMPRVTKPTPTNTFTTSPQLPSTEYLKAFNNKELISFFMIGLATLNKPILQLCIKLFPYVPMSIIKALVYRIYCGGETIDQVKKTGLRLHERGINNMMISLTIEACDGNDNVDPKYIVEETAKSIETILVPHTVAMIEQATDDINDIPPGYVALKPTGFAKDAANVLKNYNTTMIKEFDELVDKAIIVCQKIYDSNKELSQKYPERVSPFVVGVIDAEKHELQEGVYELQRRLYQKFNKLNQPISIVGTLQMYLSDSANLLTKEENLANENNYRLGLKLVRGAYIHSEKNRDIVIHKTKQDTDNNYNSGISYCIDSILNQNQNQNGSTIGHLVVASHNAESMRLASDKVYNPMNESNKNKTNVVLGQLLGMADNVTYDLITNNKIGNVIKYVPWGPPLETKEYVLRRLEDXGDAVKNDNGWPXVKASFKMLTKRLFGSG

SEQ ID NO: 17755 - protein, 482 aa, Candida albicans
ILSSFFLINQQKLKNMFKRLSALKKYNGGIKYRGFNTAAVPSPTYQTSILPNGLTVASESMPGTRTATVGVWINAGSRADNPKSSGTAHFLEHLAFKGTQTRPQAALELEIENIGSQINAYTSRENTVYYTRSLASDIKQNIDILSDLLTKSKLENRAIDNERHVILQESDEVDKMYDEVVFDHLHAVAFKNQDLGRTILGPREMIKTINRQDLVDYITTNYKGDRMALVGVGCVDHQELVKLGKNFFGNIVKSEEPFNQSGGTLPLFYGDEIRIQDDSMPTTHVALAVEGVSWSAPDFFVASVANGIVGTWDRSVGIGSNSPSPLAVTAATGGPGKTPIANSYMAYTTSYADTGLLGVYFTADKNANLKLLVDAIQKEWGRLSRGDITDEEVERSKSQLKASLLLALDDSSAIAEDIGRQVVNTGYRLSPEEVFSRVESITKDDIVNWANYRLKGKPIALAAVGNVKTLPSHKEISEGMFF

SEQ ID NO: 17756 - protein, 155 aa, Candida albicans
QREMINNNTTLRTERLIGCKQHIPKWLSFVVGGATMSYVREVSEVDLVNRTLVMKSMNLTMNNLLLVKETVIYKPDDELPHNKTVFHQSAEITAFASLSRLCDKLEDWSVERFGQNAKSGRLAFENVLNKLTLKWEENGIFENNKILQEVKNLLI

SEQ ID NO: 17757 - protein, 79 aa, Candida albicans
TRIFHSRGGRRYHEQELTKDIEWLKNHELYPEMDIILNDTPNKFACTKYDIRVTDPTNPLNLNSRLFGFRGKRYHAIQT

SEQ ID NO: 17758 - protein, 99 aa, Candida albicans
AGINQFQTTMRRILDSKNRPWIIFLIGPILEGLSPGYIWKQFGYLFPNTEFEIPLMGPEAYYDKKWQNSLLVRESYWKGHIFNYWTTYLHYPTTLNFST

SEQ ID NO: 17759 - protein, 223 aa, Candida albicans
FILLAMLSTHHCIIPRLAKSSICTKRQLSFFWKMLAMDDSKNKVIERPLYTWDESPYEDIRERAAMIRAQALCPVTSKPVNFVCPYSGIPTHHSKEAWEQDKQYHESKVYEKLKKVNLYEHDLRSGRKFAEFAFPKKQERDFMVNISDWDSFFYTRDFPPMNDEFNLAAATKVLTYPITIASILHKFSPLQLEPKGPLTLKGAKSLGALKYTLYPPQLGKSST

SEQ ID NO: 17760 - protein, 189 aa, Candida albicans
SEEIAQVATISANGDKHIGDLLANAMEKVGKEGVITVKEGKTLEDELEVTEGMKFDRGFISPYFITNTKTGKVEFENPLILLSEKKISSIQDILPSLELSNQTRRPLLIIAEDVDGEALAACILNKLRGQVQVCAVKAPGFGDNRKNTLGDIAILSGGTVFTEELDIKPEYATIEQLVSCSTTGTIGPR

SEQ ID NO: 17761 - protein, 277 aa, Candida albicans
ERITQFRNIYSTLTMSFRTTSMRMARLATAKATLSKRTFSLLANATTRYTAASSAAKAMTPITSIRGVKTINFGGTEEVVHERADWPKERLLDYFKNDTFALIGYGSQGYGQGLNLRDNGLNVIIGVRKGSSWEAAVEDGWVPGENLFEVDEAISRGTIIMDLLSDAAQSETWSHIKPQLTEGKTLYFSHGFSPVFKDLTHVEPPSNIDVILAAPKGSGRTVRSLFKESRGINSSYAVWNDVTGKAEEKAIAMAIAIGSGYVYKTTFEREVHSNLYG

SEQ ID NO: 17762 - protein, 69 aa, Candida albicans
RISTRGEDLKPVFEELYESVKNGSETKRSLEFNSRSDYKERLEEELQTIRNMEIWRVGKEVRKLRPENQ

SEQ ID NO: 17763 - protein, 169 aa, Candida albicans
EFNSQELELYNTIQGYVQYIASSIEVKFSLNTIVSDLMKMTNTISEAIKTTNTYNQDLIFDSYQKLLICMSPVTPATAEECWERFALNQGKPAPKSILYEKFPTDVPIESNLTMYNIFINGRHRGTMEAPKSFAKESETEIVKQISGVEKFNDLITGPVRKVIAHSSPT

SEQ ID NO: 17764 - protein, 123 aa, Candida albicans
MIKHVEIIHRVRYSTASTIAKKIQFSKLDEKWKAKWKSQSPTGSLHPTKHLIPETNEKFYSLAMFPYPSGVLHIGHLRVYTISDVVARYKRSKGFNVIHPMGWDAFGLPAANAAVVRMCLHHG

SEQ ID NO: 17765 - protein, 504 aa, Candida albicans
  UNSURE (481): Identity of amino acid sequences at the above locations are unknown.
SGAIVEKRNLEQWFIGITKYAKELNRDLKNLPDWPEKVKTMQKNWIGESNGVEINIPVNFPGLEHVTVFTSRPDTLFSMQFVALALNHPIVEAAAREDQELAAFIESAKSIDDPTSKAGYMLKNIKASIPIDVDNNIKKSFDIPVFTAPYVLGNYGHGAVMGCPGHDERDFDFWKLNGPRGVPAIQIITPKKQNAKDDYPYTLKKGTLEDSSVLTHGLNDIGEYKGKTIEKATQMITDCLKSHSLGDYTTQFKIRDWLISRQRYWGAPIPIVHCHDCGPVAVPDKDLPVMLPGVKGKNFGKGNPLGNIEEFVNCKCPSCGKDARRETDTMDTFMDSSWYFFRYLDSKNENLPIGPEASKQMPVDLYVGGVEHAILHLLYSRFIAKFLSDCGLWDGEPHHKEPFKKLVTQGMVHGKTFSDPITGKFLIPDELDFTDPANPLIKTTGKTPVVTFEKMSKSKHNGADPGEFIERYGADVIKAHXLFLAPVSDTLNWQEYKFPVQIDG

SEQ ID NO: 17766 - protein, 206 aa, Candida albicans
KQLDYDLKHSPIYEVKSFENTKGKIFTPPVSYFRQDKSLYFPDFIAKTLAGNQRSLYDSLDNRLSIVKLFSSVAGEQCTRSYFKVENKDYYSQDYDTFVEEYPHTQILDVNMPQSWIKGFVTNLSTGNLRKTLKPALRYENYFILPGHIMSAEIREQLYCDNQCSGYIYIVDSMGKIRWATSGYATPEDLKLMWKVVKGVQREMTK

SEQ ID NO: 17767 - protein, 170 aa, Candida albicans
RVLLERQVAVERAQATMQDDIQKYLDDFKTRYVNCEADEVEDYHEKLVRLQYAIFGINPNLSLELLQDEETIDVNFVKGLSYIANLKVERHLKLNPQTEFELPLNGPVEELPFFLNDVEVAISQVKQLRDSGKSRMLHKIEVIPFLKQAIESHMQQEENIGGYEEEQNKN

SEQ ID NO: 17768 - protein, 224 aa, Candida albicans
ESENAGKDKELFFSNKFSNSLFSNHIIHNRSKTMFKTTLTKPLTFKSARFFSTTPRAWGTKVFFNTSINGEKQPPITFELYDDVTPITAENFRVLCTGEKGVGYKGSIFHRIIPQFMLQGGDFETGKGYGGYSPTHNNDKFNDENFIKKHDRPGLLSMANAGPNTNGSQFFITTVPCPWLDGKHVVFGEVVDGFDVVKKIESCGTSSGTPSASVVIEESGEAEK

SEQ ID NO: 17769 - protein, 281 aa, Candida albicans
LIIMFKQSIRSLATKSPISSAAATTTTASTTSTTTTASLNFAKPPSYTLAQLREFPSLEPKTFIPLPTTFFNTEKPIRRDILWSCVTYEADKARVGSNYAILKSDSPYSNRKLRPQKGSGRARLGDANSPHMDNEIKAHAIKGPHDWSTDLPSKIYSRGIQNAFTMHYKQGNLNVVENELDFQYGYDIITQLFVSVHNLNKLNLLFITNEPRDNLMESIKKFYINEKEFNSLNKKEKPKYLQKLKGKVLTKEDVEVRDILRAHRVFIESSALQWFITKHTV

SEQ ID NO: 17770 - protein, 214 aa, Candida albicans
YVVLARLCEDSWSDLTPLPNVKCLILGQDPYHNYNQAHGLAFSVLEPTRPPPSLVNIYKTLAIDYPQFQIPDYNKLSKEGKPGGGNLTKWAERGVLMLNAVLTVEAHKANSHANQGWELFTEQVIKVAIDYHSKNNKGFVIMAWGSPAQKRVAKYSKQLSDSNHFLVLRTVHPSPLSAHRGFFDLKVFFKCNEWLAKHKKDKIDWGIIDGNIIQ

SEQ ID NO: 17771 - protein, 134 aa, Candida albicans
IVLNKQDLFASRSEEMISNYSRLLDLPKNYFHVVSCSTGSGIDNLQKLLIEKFKDLSQSETSNPIIVSSRVQDILENDILFGFKEFYHWADAEDVLVATDCLRQSVDGIGKITGQSIDLEEILDVVFSSFCIGK

SEQ ID NO: 17772 - protein, 409 aa, Candida albicans
TVLMRFWIWNFVSSIFFFSYPEKIIIVGYLESLMFRQLLHVGKRSLSTDNPLKPTVFALSTKFGKSAIAVVRISGPQSKYIYHKLTNSTKPPKNRIASVRKLYSPEPHSNKKSVFLDEALTLFLPGPKTYTGEDLLELHLHGGVAIIKSVLQSIKKLHDPNNGVIIRQADRGEFSKQAFYNGRLDLTELEGINDMINAETELQRLASLASLSGQTKIEFMKWRNEIINQMANLTMIIDFGEDHDIEETDRMIRDVKENIAKIELEIKAYLSKVKSLQILLNGIQLALLGPPNAGKSSILNILANKDAAIVSEIAGTTRDILDIPLEIGGYKVVVGDTAGIRSFEEADSIEQGGIKRAKQRSMLADFVIVVLDPMSVEKEPLELKEHLKTLVKANKQMLIVLNKQDLFAS

SEQ ID NO: 17773 - protein, 421 aa, Candida albicans
SYCWKGEELVKEYQLSIMLRLLIQRTYSKTTIPQISRSCVSFSSIRHNTTTSSTNTSSSTTPITIKTNSSKSKTNGTLVDSNKFLRTTYESIDDYGSYKHNIFTHRLPESSGKQSPPLVALHNRLQLPKSFKLATLSQCLNLITKPEESDGLANNFGLNTLGKSLLSYYVTEHLLIHYPRLPMKIHQAAVDSLMGNLALLEIGKTWGIEIDEVSKLDRFLGQESEFMKFGRLRYLYDQDKSDKFYNNNGNYKNVSGIEEVIDEQGKLSQQDLAYASAVKAIIGGLYTHCGESAAKDFINDHILSRKIPLDQMFEFKRPISELIRLCDKLEFKQPVSIRLIAETGRLSAHPQFLAGVFVGNDKIGEGIGSSLKEAQIRASINSLLGYYLYSPISANGEPIKEPSDSVDYKFEGMIGLGDVAV

SEQ ID NO: 17774 - protein, 165 aa, Candida albicans
  UNSURE (63): Identity of amino acid sequences at the above locations are unknown.
TQIMGISRGVKTTLLTLTWFPVLYSFTNHGYQPYQINGSSMTPTFIPGTSTMTKDIVLVPKYXIKNPDSLSRGDIIMFRSPENPDKLLTKRVVGIQGDIIRRKSPPYPKSEVKIPRNHFWVEGDNSFHSIDSNKFGPVSQGLVIGKVVTIIWPPSRFGSELKRNL

SEQ ID NO: 17775 - protein, 257 aa, Candida albicans
ILIIEQTNTMTNTFEIVFAVPMECDSCVDSIASVLKGLDGVEKFNINLKDNLVSTEGSLPPSEISKAIQSTGKDAIIRGTGKPDSAAVCILESFDPNDIQHPVKGLARLVEVSPNDLFVDLTVNGLPKGVYYPSIRVSGNLSQGALSTGPSFYELNPIEVKTPVNAETTISSRGAKLEEDSTLYAGQAFLHAKLNINQLIGRSIILSKIKDQVAPDSLCGVIARSAGVWENDKQVCSCSGKTVWQERIDARVKGVHV

SEQ ID NO: 17776 - protein, 385 aa, Candida albicans
FNQETDVKIKFKDVAGMAEAKQEVMEFVKFLQNPEKYEKLGAKIPRGAILSGPPGTGKTLLAKATAGEAGVPFYSVSGSEFVEMFVGVGASRVRDLFKTARENAPSIVFVDEIDAIGKQRSKGNATGANDERETTLNQLLVEMDGFDTSDHVVVLAGTNRPDILDRALMRPGRFDRHVHIDNPELLGRKEIFDVHLQKITLQKDIDPDLSGRLAALTPGFSGADIANVCNEAALIAARYNAEFVTLRHFELAIERVIGGVEKKSKLLNPEEQKIVAYHEAGHAICGWYLKYAHPLLKVSIIPRGQGALGYAQYLPPDQYLMSTLQLYDRMIMTLGGRVSEELHFASVTSGAHDDFKKVTGIAQSMVLRFGMSTTVGMVNYYDTRS

SEQ ID NO: 17777 - protein, 104 aa, Candida albicans
ASICGSARPRGEDDETSRIIDSEVQRIVSDCYQKCKQLLTEKSKEVELVAQELLKKEFITREDMIRLLGKRPFPETNDAFDKYLDGKPAFKNEQPENEKKDSAN

SEQ ID NO: 17778 - protein, 184 aa, Candida albicans
SMTFFESLKFVGSTLSWTLRAGCIAHLIHENVYEFTETRGESMLPTLQNQHDYVHALKKYKYGRNLIMGDCIVAIKPSDPSHRICKRITGMPGDMILVDPSSSSELTNSPNEIIQHDGYNKYIRIPEGHVWCTGDNLCHSLDSRSYGVVPMGLITGKIVAANSMSEGISTLYNFRWITNTLQDE

SEQ ID NO: 17779 - protein, 1001 aa, Candida albicans
GTFQPRGEDRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIESRAENIGVEIVEIPLATKQGVEELSRIADKFCGALVQYPEYNGEITDFTELGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLGELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 17780 - protein, 157 aa, Candida albicans
  UNSURE (87): Identity of amino acid sequences at the above locations are unknown.
HIKGSLTQMFQWTKLCSENLNKRLRLRVPTRVLNTISKEGGLDQYLLKSTPARVKTMGLKAWQLRYRILQERERRQRGNVTVLDGTXKPIQYISSNGLKFHATKDAMLSELYEAVQRDSYYPIKPFHFERDYSWLSYEEIVKKLEQYNWDFSELATK

SEQ ID NO: 17781 - protein, 124 aa, Candida albicans
TVKKKIDRKKTSPITDDSSHPIQHIFTFVPTSIMITKYFANVLVKFNPFSNAGKSARLFLSRVPTGTKIDCKVLTKPSDIQEIKVTFKDKHVMTANPATMRLADLSEYFDIHSRKLAIKDSIQD

SEQ ID NO: 17782 - protein, 192 aa, Candida albicans
GPSSRLVKHCGHRNWLMKYGKVRMVIFAPSVSAMKFLGEPGFKKRRRTGLKRDLYTDSRLIGVVNSEKAPGLGYDARVLVRDQPVLLEPSSAHRDEDYSVIEISPGKYTASQIENIEHFLLAIYLTNKKLVDILPTLAPGAMYMAKDLPEEMLQKSSYEFTCEDIIKLSKAYENWPFKPSVADLYDFDITFS

SEQ ID NO: 17783 - protein, 303 aa, Candida albicans
LHSLTKISKLTLSNLLNFSFQLNLMYFHSFIISSLITSAFANPIKKCGFPQDEDITNVGANGWAMSPDEPCTPGKFCPFACPPGKLMNQWDPEAVSYTFPKSMNGGLYCNEDGTTSKPFIGRSLCIDGVGTVSVVNKASDVVSFCQTVLPGNEAMLIPTEVGDGDEQVLAVPGPGYWAGTAAHYYVNLPGVSSKDACVWGTPEKAIGNWSPYVAGMNQDSNGNTFVTIGYNPKYIDDFSGNIPNFGIRIVCDNPDECNGLECEINPRQGFNKAMGPASGNSLGADYCIVTAKNHAHARIEVFQ

SEQ ID NO: 17784 - protein, 67 aa, Candida albicans
  UNSURE (5),(28),(48): Identity of amino acid sequences at the above locations are unknown.
FSLGXKRRYQVTYVKVDQISAHQLAMVXELVKVELSEDKKTRQELNQXRKYKTGFELIKDGMKKSYA

SEQ ID NO: 17785 - protein, 636 aa, Candida albicans
YTRPTPPPPYLVTDSMLRLQEVHIRKCYGSKIILKHNLHISSTLLYNKPSIPSSRRSRLKQKFTSKSKYDDSFFKNIFQENKDNKSKSIETQSQDTHQEVKTSGLEKIQNLVKSKVKSRSIFDSYANLRIDITKPNDELVRSIIKNTKTMNKKRFTDPATSWLSNFSQKQIQELQDFLNNDLPINGTINGKTMETPIKIGDLVTLGSESLRLYLVTSVPKTFNSRICTFLSDRGEIMFAPFSTIGYRFSGLIPDKYHKIIEKFVVLEQKYLNIPPIGIPDAVFSKSNSALPKELQDRENGTKKVATEEKEEVVDVDGNGDPDESAYLDPNDFIVQQASSQLLSNTDVQTFIVPTTVRQIYVPALLQISNEAFWKMGPMYRKLEELHRSLQVDDNNGEFNTPRIVSIFEILSKLKQPTSEQSTSTIKLGKSPTNLIDYDQRQYKISDVMAVLSLLKKQSHLWTILPCKLSFTPTKVTIWPLAQTKEEERTVEYLNNDDGLTEITKYCGQVALGQKPANTKPIFYNNVEKMLREYVNGKYKDDASISTTLVSLLRKVDKYFVELGIPLKEEAYKNEYSYGKAYDLLTKLNNDVVVNPLLCSEQVNLPIEENASPKILTKQKFYNYMDQEIANETPNEI

SEQ ID NO: 17786 - protein, 524 aa, Candida albicans
QNTIANEIYNEDPLHHLRQDMRETPIYCIDDPTAHEIDDGISIHEDQQDYIVSIHVAEPSSYIKPNSIISSLAFEKTSTSYMPDTAFPLLPKLVSDIAGLGIPDKDTRTFVIQYRVDKKTVDEYISNKVNDKNYKVDQLLLDQIISQINESSNIVFATVSNFRQGFTYDKVNEVLNDEIKINQYKSMGQSNDLDFNNLIKLQYISSLLWEIRKSNHAYTNSGNTKLMVKKNNTSNTNCDTEFIYDANELQMKLANSNNTISIGFANLESASIKLVTENMIIANYLTARFATTNNIKILYRYLDPKFNDELLSEYQKLMKLSDTNNNTSIPTDQLTQMFPYFTRGLVTDKPQKHLLMGLSMYSNITSPLRRYIDLVNQWKIQDFFLGKQQQQQQQSRIDDKNIPAIASNLNGQGEIIRNIQLRANTFWQGLFLRNYQDLKNNYNHNHNHNPIDFKLKLITNPTMGPTVGVYIPYVRFINAHVEVSSEMLEDFKLGQLKIGGLIDSNKLHLKQVDFLENEVIFEYK

SEQ ID NO: 17787 - protein, 707 aa, Candida albicans
  UNSURE (10): Identity of amino acid sequences at the above locations are unknown.
PVYYSPPCRXYSTDLEKLKKESDTTESDNSASATGVIDKTHNEVLLYYDHIYPFTTSRNVVKQYLSRFSLPWSTAYDNEKLKQKVWDLSSPLATTAKITEFVPLRRDSGAFVKFKYPPEVPATKFIEEIRENVERNEQERVNSNILTRLYHQIWRNVPKVYSVKGTPWIEDLRRFPSPKLSVKFEGDPLTEEELYVLFRRYGLINEIEPGATEAFIYFHSTRAAISAKHCITGMVLNGGKTTLHIQFVAIKRSNFLVLLISNHTKIAIPVLIALLATFAVLIFDPIREWFIEYKILHNRKSFDQFKESRWFKYLYIPYRTITGWVYSSYDYIDSQIQEVTGLSCSEEGDSSNGSNIVDGQSVRDLKNESNMFWIERYEKSKQLQLWIMENANTFIIVKGPQGSGKEEFVLEHSLGSDERLSKKVLVLECDQLGKARSDNNLINTTASQLGYFPVFTWTNTVSRFVDLGVQGLTGQKSGLSESKETQIKNMFLLATQAIRKITTNEYNKYVKSVERRNKRLKDDEKIEVLKEEQFLQQHPEAKPIIVLNKYSRRADVLLNDFIPPLVADWASGLVQNNTAHVIFLTADVGSLQLLNDALPNQVFKDISLSDASMSSSRQYVCDVLKVKDTSTLDECLEPLGGRMLDLQSFIRRIKSGESPQQAINEMISQAAELINTFFLNSHHKFGAGDSNWDPSQVWLIMKLWSEC

SEQ ID NO: 17788 - protein, 152 aa, Candida albicans
NCGLNVDTLIIVSWVKLHWFKVSKETLEILTTLEKYDLISLKRDKGVLDKISTGRPLFKAAFANIISDLRIWKLYETEYIGRLISLEAAKIQKLEEELEKIYKIGKVDGIIDYVSQKIEASNKKILDLEKQAADVASYTGKPDGKSFLGIKF

SEQ ID NO: 17789 - protein, 260 aa, Candida albicans
QQLQKKARELGIPLNELRIKFQDKIEKVKLELGGIDPTEELKQFFEHEKQKKQQNQNDNDDGTIKIRGIKDRDAPKLPYKVLDNYINLSKAKELPRDDIIKIWTARFINNDRALHAILTHLQFAQLYTNAFKYPQFVLPLPKPQQDGYELEFVQWQFVGPNTINCMFTTLAEYKLHGEYASPHTTLTFHLELAQDKDLVLMNGFNNKESGISMDEAHLLVVMLQRFYSGKNPQMTQLLHEFNKGNAEFDIDALIKQATSV

SEQ ID NO: 17790 - protein, 289 aa, Candida albicans
YQSTVNMRGSTFHKVIRTYSTTPASTSSSISLTLVLSRLPIITPDVPKFDQQFYNYQTELWRRLMWTFPKWFYFRPGTLSEQKFKELNENPVSYDPKVIYPRGKPDLKHNRDRRFRQYIRLPKTYKEESELVEGEENTQLDQDIARKIVPNSRITEADKKNDSTSLERKLSRTLYLVVKQSESDGEWKFPNFKQPENGELVPLHELAETGLYSIGGKKINYFNVSRVPCHVIQDSKDFSKQYFIKSHILSGAFEAQEKDVEFKWLTKEELGECLSAEYYKDIEHLLNDV

SEQ ID NO: 17791 - protein, 546 aa, Candida albicans
NFSTFKPYRHLSYLINCIHLINLLTINNHKKMTKRYINSSWCLIILSLFLLSLVSADEDGMSMDMGDPSSRPEFHPINPGSKTFHWLLTLFILLILPSISTSLAIANKLHWSLFLQYISTGYSIFESMFLDFPDNIDNHENKTSKGTSWFLSILLGLTIFLGTFINGSNLIINKFYPHLQTRQNSNSNSNSNSNSNSNSNSNSNYEYGISYKLYKILSFLTVLTGWVRVCMAPVALFGFCYGKHTGQCIAHGIMESAFILYSFVLSLVLVIPWIRKHQLLHTSDGGGGGGATGTSQEFYDSTVMMVWGVVNTFTEHRWGRESWSMGDYQHTAMGIIWWGGGLLGMYLSRKNHRSFIPALLLIFTGYSMSQHAQHLIISTKVHSVFGISLMGAGITRIIEILFLLNDKSCHSLGQILSFQYLPPFCLTLAGVLFMGATEEQLQLVHDLGSDHSAYILVVSAAAFTIFLWIQLVIMFYLRLVGYNEDGELGQQQQHHHQYQSVDVEEFELGDLSEEEEEEEEEDQSGSTNNHHRELDTPPLSDDRNKD

SEQ ID NO: 17792 - protein, 324 aa, Candida albicans
FFYRDIKPDARPIADGDLVSPADGKVLKFGVVENGEIEQVKGMTYSIDALLGIDTGKLAAPTHSLNFDYNSDDETIVKRDEEFAKINGISYSMDDLVGGNSKSTYHMNELTYKDEHDGTAAGERASFSKELRVAEELTPNPVEYFRKKNLYFAVIYLAPGDYHHFHSPTSWVTTLRRHFIGELFSVAPFFQKTLQGLFVLNERVALLGYWKYGFFSMVPVGATNVGSIVVNFDKDLKTNDIYEHEVYSSASSVNESTPLLDQKDYSANDILTITNSEYEDTKRKKLRKNTVYEATYTNASRLLGGYPFSKGQFSQPRWTHPHYA

SEQ ID NO: 17793 - protein, 463 aa, Candida albicans
  UNSURE (153): Identity of amino acid sequences at the above locations are unknown.
SKMPRRIDKVSSMTKGHITMSMNKLNLFNIYRKDPLQYFGKTLYQQKWAAKTETRNYHGQQIKEKRFKNVLFDSNLKTYSQLDASLKGHDVAPTPITLQTYGTLEKRLEIALFRSMFASSVRQARQFILGGYIKVNGVVIKHPSFALQSGDVXSVDPKKVLFALGKTKPSLEKALSVDKKQIKKWNNYVFEAKKNPEKIWDLKQNKPDLLDTLKQVEDFEKQKKSVQNAQKLMKIQQNQVTRQSILQEIIQLGNAASEPASLETFNKYGDVARTKCLQIYQTLTNKNHPITKDPSTKNIEGFLAKDENKSPEEKHEVRLINSTLRELQSSEWERIRIQFENFEEGTDTKFFQTSFAKALRGVPKLNKEEILEDESKAKVQLPWQKHLFGRKDPSRSYFTPWTPRPFLGAFAILPSHIEISFDTCHAIYLRDPVARPGHSEVISPFPDHVHERAYMYYVRKGKS

SEQ ID NO: 17794 - protein, 103 aa, Candida albicans
TVKMVTTVLMLVKLVCPRLQWPSEQPSNGMSIGGLYCKNGKLYRSNTDNDYLCEWGSKDVNFVSEISEDVAICRTDYPGSENMNIPTLLSAGGLHHAAGRIRA

SEQ ID NO: 17795 - protein, 349 aa, Candida albicans
IMLVFRRPVYQLFTRGFAYSRIIRNEAKVPKFSPVELEAARLAREAGLGWLKHFPRKVIPYLELMRLEKPVGTWLLLLPCYWGITMASYSIAAPLWVTTKAIALFSVGALVMRGAGCTINDIWDRNLDNQVARTMERPITSGRVSVPQAVAWLGVQCFAGLAVLLSLPFECFYLGALSLPFVAAYPLFKRFTYYPQAMLSICFSWGCLLGFPAVGAPLNLWVAVPLFISNWIWCLTYDTIYAHQDKKFDIKAGIKSTALAWGDKTKPIMKGLTVAQAGFYGFAGFMNSMGPGFYIAGAYAIARLYNQILKVDLDNPKSCWSAFTSNIGTGFIFWYGIVFDYILLLLGYI

SEQ ID NO: 17796 - protein, 497 aa, Candida albicans
YLSLMKQKKRARQTKKNFQHNGLLSLLIDLDNHIYYTLGLLTMLRTYSKSLLKTSTTIKKSFLFNTATLSLPTYKKYSTSVPDANDESHTGKFINSISKPYSVTTYARPNLVLTHGKGSYIYDLEDRKYIDFTSGIAVTCLGHSYEPITQLIKDQSEKLIHCSNLYYNLPAGELSNKLIVKTKEFDGMKDASRVFLCNSGTEANEAALKFARKYGKSINPEKYEFITFENSFHGRSMGALSVTPNPKYQEPFSPLIPGVKIAKPNDIESVKQVINKDKTCAVIIEPLQGEGGVNIIDESFLIELRKLCDENNVLLIYDEIQCGLGRTGKLWAHSWLSPEAHPDIVTIAKALGNGFPIGATMITEKVEKSLNVGDHGTTYGGNPLASTVGSYIVDHIGDKEFLQQVENKSQIFLEGLNKIAEENSNLIEKVKGKGLLLGLQFKENVDIGEIVAKCRQHGLLIITAGMNTIRLVPALNIPDQTIKDGLEILTQSIKEVN

SEQ ID NO: 17797 - protein, 333 aa, Candida albicans
  UNSURE (326): Identity of amino acid sequences at the above locations are unknown.
NQIFKIMMVFLVSFISVEMKSMHCAPLFRQLVFSRSLHYSKTIFHNGRGLTSTSESEMSHFNALASSWWDVNGPQRILHKMNLLRMDFIHDTIRQNLKLNENTDDEVYIPPFSVDLLPQGIKNKIDEDQEMRRDEILNDSSLTVLDVGCGGGILSESMARLSFVLSVKGIDLSADVLEAAKLHKQKDPMLKDKLSYTLNAIEDIPETERFDIVTMFEVLEHVDYPSRVLLEGLKRLESGGWLFLSTINRDFVSWFTTIFMGEHVLRIVPVGTHTLEKYINQSEIKDWLQEDSNRKSEFRVADTKGCVYLPAYGWKFTSCPDVGNYXMAIQRVK

SEQ ID NO: 17798 - protein, 541 aa, Candida albicans
ILLSLKNSDLLGVYLKKYSYPFSVSPAGPNAYMKLSLPIIRNYSKAGSLLKDSLAELAANSSHLSRQPKTPARTRFAPSPTGFLHLGSLRTALYNYLLAKSTGGEFILRIEDTDKNRLVPGAEDNIINTLKWCNLHIDEGPVEGGPYGPYRQSDRKHIYQKYANELLSKGLAYKCYCSKERLLELRESAQRLKPPTNVTYDRKCILESEHEGLPYVIRFKSPNNYPPFRDLLHGELSLQPQYNDKDRRFDDFVIVKNDGMPTYHFANVIDDHLMKITHVVRGEEWLPSTPKHIAMYHAMGWEPPQYIHIPLLTSLKDKKLSKRSGDLNILKLKDEGILPEALVNFVALFGWSPVRSNGEKFNEVMDLSDIIELFSIDQLTKGNAKVNDLKLYYFNKLHLAKKLESAEGLETLVEEYYPHFKQFSNQSKEYLYKLLKFMGPNLTSIHEIETDHQYLFQEIDYSKVKVPNDQTKSVLEYVLENGYYDAINKLPQQGIPKKNIFMSLRYALSGGKSGLAIPHFIELLGEIEFNRRLSNALKTVM

SEQ ID NO: 17799 - protein, 142 aa, Candida albicans
GRGFSSLVVTISDVFKKLEGLGFEDIRHNYILDRENAAMVADEYGIEVEVVEDSGDDLFPAPIKPDLLVERPPVVTIMGHVDHGKTTILDYLRKSSIVSQEFGGITQHIGAFSVTTPKSKKRITFLDTPGHAAFLKMRERVP

SEQ ID NO: 17800 - protein, 482 aa, Candida albicans
KENHLFGYTWTRCIFENERKSAIITDIVILVVAADDSVMPQTIEAIKHAKKSGVPMIVAVNKCDKPGVNVEKVLGDLSLHGVDIEDYGGETQTVQVSGKTGLNMDKLEEAVITLSELCDFKAEPKGIHAEGWIIESEVVKGMGNVATVLVRRGSLKNGDIIVAGKTFCKIRGMKDENNKMVKIAGPSTPVRIWGWKDLPDSGDQILQANSEQIAKKVIDYRITRSQEIQATRDIEDINVKRLEEIKEAERLEKIAELKKAGLDASTLEKAEQDKKTIKCNYIVRSDVFGSAEAIKESIDGLGNEEVESVVISHEAGPPTDSDIELAKTFGATIFCFNMKVPKPIAVRADKEKVKVKEHNIIYRLIEDVTDELSSHLKPRVEIKTLGEVDIKDVFVVTVKKQKVKIAGCKVTTGSIKSSSQVKVLRNGQEVYCGKLSSLKHVKDDITEATKGKDCGIAFEKWQDFEAGDKIQVYEEILHKRYL

SEQ ID NO: 17801 - protein, 428 aa, Candida albicans
MSFDINWNQLTIDDTINQSIKEFLDQQFKNISLPSFISNLAVTDFNLGEIPPEVTIRHIGDPFEEFYEDENNLGVMNEANNDSKDEHLKNHGDGINKDSGYNSQNLDDEDEDDEDDDEDDEDEEAEDEDDYDDHDLGTINEGISLLNFNENSTTPSANSFAGLAAPPLPPPLNPSRDSFHSILHPYGVNSIIGATGAGSETPTNILNQNYLSSRVLPKISVKQKQPHHDDNDIQLIVEINYKGDMHINLLVNLLVNYPSPNFISLPIKLHITDIVIHSIATIAYLKKSVFLSFLCDVDDTFPDFDSNVQTPTSTTGGNFVDYYSNDATINKERIDIVKKIKIESEIGEVENNILRNVGKVEKFLVEQLRNILRDEIAWPSWICIDMNDDDDEEEEEAELEDNDGGNSDLNDNDGKHGDGRTDETEAGE

SEQ ID NO: 17802 - protein, 251 aa, Candida albicans
RSTEPFFKDKSTDKYLTSNNIKKHNLEQFVAPKNEDIARLAHNLDRVLFSPGVHFLQDPRTRIYNFSPFLKKVIHYKDFNFKAIENYTPVSKHQQLLENSQKFEKQFYSSTSSMTSLLSKFYHFLNKYDRYNVKRFGPIPFTGMSNDLPTNLILKPQGEFMDSTTKEKKPVYSIQADNSCDLDTLLSAMGMCMETLLTNPQNEFVKYHKDSGVEFNEPLGNTYNYASYGDFLLRSQLDCYDERLQEMVLLI

SEQ ID NO: 17803 - protein, 260 aa, Candida albicans
  UNSURE (21),(80),(94): Identity of amino acid sequences at the above locations are unknown.
KYSQSESLERNDIQIWRLIAXYESYAQEFRDMIRTGPMLKYLFQARIGQMDGIFIAYHSINTIFGFQYLPLEELDKLFYXRDTISEFPDVSVRXLNEHRLPDKLPSLIGETQFKFSLEIWQKLLQEHILKDLNKEFNNKPTPFRLSVKYDTLAHLLRVFVIPATDEEIDVLQSFPERFKRDFAEDENLGEVKKHARELTKFNEKCLETKEVFSYVIQMDSCMIDGKIRQYHQLPRDYFKDWQLIYNIKRTSNAPKSSPRG

SEQ ID NO: 17804 - protein, 105 aa, Candida albicans
SSILRSAKSLQPLFDRVLVQRLKPATKTSTGIYIPEKNQEKLNQATVIAVGPGITNTTTGQVIPVSVKAGDKVLLPSFGGNPVKVGEEEYLLYTDKEILAKIEEN

SEQ ID NO: 17805 - protein, 142 aa, Candida albicans
SCPFKVLIPQDLSLIVKARHGGSDYIFSLLTGYPDEPPAGVVLPEGSNYNPYFPGGAIAMGRVLFDDLVEYEDGTPATTSQMAKDVSTFLNWASEPEHDDRKKWGLKALVVLSSLYLLSIWVKRFKWTPIKNRKFRFDPPKK

SEQ ID NO: 17806 - protein, 182 aa, Candida albicans
YKSYNNMSQRIGITASALTRVWHHVDVAADNRSLGRLASSIAITLMGKHKPTYTPNRDHGDYVVVTNCAHLKVTGNKLKEKTYWSHTTRPGTLRLVPMERMIDNKGYGEIIKRAVKGMIPKNKHRLVRMDRLKLFDGDDHPYKDNLIAFADENPDMRNKLAELEKNEKNRAELREKYLSHQQ

SEQ ID NO: 17807 - protein, 230 aa, Candida albicans
GKGLSTNRLQLHKYINFFSKMGRNVLKYGGKSGILPKVRPIFRKPIRPPTEYEQAKEHSIETGYAEGIPLPKINGKEVSRKQPPKKYVTVEQRINQIKFPELTLKQMNELPEEERDAYKRQYYRAQFLKDAYLQEEKRLNRIDELKEKVHQQNLERQARLQQEEKLEHQNKNIEGLPTMQALLDKGMMRRRTKEEIELLKEQRNLNRKLKELPDKENQAQKVLELYHAAC

SEQ ID NO: 17808 - protein, 401 aa, Candida albicans
ILYCILCATLHLVLLMMFRSTFKPTCIARRGFFRFNSSNSSKPPTGIVFMNMGGPSKVEETYDFLLRLFSDGDLIPFGRFQNILAKFIAKRRTPKIEEHYREIGGGSPIRKWSEYQCKKVCEILDKTSPETAPHKPYVAFRYANPLTEETLNDMKKDGVTKAVAFSQYPQFSYSTSGSSMNELYRQTLIHDPERTIDWSFIDRWPQQPGLVKAFANNIKEKLAEFPPQDRDDIVILFSAHSLPMEIVNLGDSYPAEVAATVYKIMEELKFSNPYRLVWQSQVGPKPWLGGQTSKIIDKLEKRDDIKGIVLVPVAFTSDHIETLHELDIEILEDATNPHKIKRAESLNGNETFIEGLADLVKSHLKSGEKYSKQLELDCILGSERAQGTFKHPNEIFGNRKN

SEQ ID NO: 17809 - protein, 220 aa, Candida albicans
RLVDHALMALEDKKPEIGKEAILKLLDAVDEHIPTPSRDLEQPFLLPVEDVFSISGRGTVVTGRVERGVLKKGEEIEIVGGFDKPYKTTVTGIEMFKKELDSAMAGDNCGVLLRGVKRDEIQRGMVLAKPGTATSHKKFLASLYILTSEEGGRSTPFGEGYKPQCFFRTNDVTTTFSFPEGECVDHSQMIMPGDNIEMVGELIKSCPLGSQPTFQLERRW

SEQ ID NO: 17810 - protein, 159 aa, Candida albicans
FRIGCLSFIIWKLGKFLTLHIRDGRVTYRQSLAVLERAKQTNSSLITKTSLMLGFGETDDQVLRTLRDLREIGCDVVTFGQYMRPTKRHMKVVEYIKPEKFDYWRDTALDMGFLYVASGPLVRSSYKAGEAFIENVLKKRKHNVGETPRLAQEIKPSIY

SEQ ID NO: 17811 - protein, 424 aa, Candida albicans
KNLRQPKIELKLWEKQNISKDSFFKKKIMVIYHLKTGKALNEKVERQRRFRAMKIAHEKSLQEKAYQERERARELAREAKGKGKNFKSGGSSNYDTGVMVDRNDTIFDYVFGTHPVKAVLMAGKRRILDLYTFNNEDPDIVKLAMEKYGIIPKRLKDKNALNILCKNGVHNGVVLKTNKLDIPYIKEVGHAENGEYKLAIEELDDAAAVDDDGEVKVKTKKVIRDDDIEQIEELYPLSLYLDEITDPQNMGSILRSAYFFGVDFIVVPNHSTAKLGPVANKASAGALDLIDIYQTGSSLKFIDSVRQNGWHVISTSGRPTGGTKSKEITHVENDAENDADVDVDVDVDQPHLKNKFIELQDLRTILKKTPVMLIIGSEGSGVRTNMKIRSDYLVGIPKIRRNDNIVDSLNAGVATGVILQNCLD

SEQ ID NO: 17812 - protein, 355 aa, Candida albicans
TQALILQFVVKTTIKPWTLGDVGVITKAPHPKASASGLFSRKQVTGYQAFVAQQNFEHTFLKENKEAFFGCTVGTRNLKKKLMKVLEKTMAASLRPTHLAIQQELEETSYQFKVEFNDRPLTPQMYLANNIDMLKLGTKDLSHNFSRNELKAILKNALDQKVLDLMAERYWNKPFELKGSSVEPDLRELTQINMDNDIYWHKKLDLTTSSLTKLGVGRLSTNLITNALLTEIDNLVDNTQLRNHPMAKSAVRDAARSVLGNKYYSTADQVENCIKPYKYEIELEDREWLTSKENAVTLLKEQMRQCEEVYHDLKSQVGGRKLQQVVTYLEKLKLLNNSHVDLTTHETLSFSPTLI

SEQ ID NO: 17813 - protein, 342 aa, Candida albicans
KWGRFFYHTISTFNPIFLTNSFKNTTQYIMIPRNGRLIMKSRALPLRTFVLLRSSAHNTHFKNVSTFVPTRNLGFLKVLTRAVKMPAYIGGTMAAGGTYVAYKVEQASSYTQDKLSAFKDFADGVFDKTGDFFKNLGGTDGATGGNGAEDGASSGGAGGGGGGGGGGNDTATAVGATAAAVGLTSDEDESTEAETDIEEEDEETLIEDDSDDDDDLANDETDDHMLNLTRQMIEIRNLLSSLNHDGIKLPSIVVIGSQSSGKSSVLESVVGQEFLPKGSNMVTRRPIELTLVNTPEAAANVAEFPALKMYNLTDFQQVQSILFVVFTAGHGRYRYCVTTQKS

SEQ ID NO: 17814 - protein, 123 aa, Candida albicans
LRAWMAPAVVCENRESQGPEIFLDAVASKITSTSILFLNVELLSDFYYNFPRELDLKFFNNLSKDEIEKFAKEDPKIKKHIELQERKDLLENALSKVESVLAVQRTTQKDNTEDRNKKSVFGW

SEQ ID NO: 17815 - protein, 386 aa, Candida albicans
SLDYVPWDEVYHINKFIQDAQMFIDDIHNRGKIPIVVGGTHYYLQTLLFNNKTIDDSNSNLKELTAEQLEILDGPVDILFRTLQEVDPIIAKKFHPQDHRKLRRALEIFYTKGEKASEIYHEQKLDELDSSSLKYNTLFFWVYCDPEILNDRLDKRVDKMMENGAIEEIKEMYDFYKSKQEQNLTCTSGIWQVIGFKEFLLWLEDNQLDTKLFEHGIERMKIRTRQYARYQVKWIKKSLLTELEKESKFDFVNGGKLYILDATNLDNWHENVDDIGIQIAQDFLSKGANGVSLPQAPDELKHFFEAPNEIKSNRRLESQENWKHFVCDICKDKQGNALVAVGEDSWSVHVNSRRHKKNEESIKKRKHNEEMIRLKKMRSNQEGVIN

SEQ ID NO: 17816 - protein, 320 aa, Candida albicans
QLSIQIQCQTGDYYYEGITRSHRSFVTSLRRRQQQQQQQQLLQQLQQQHPLQQFTEEPRVNQLGIQYLSNDLHKKVFPTTSTKDYLSPQHPQLLEISKKHLQENELLGKKTQITEPITIKNFPSLVGKSMDEHFNKLGQKSSDPYLAMATNFLKKELPCKPPKSQWKFQSGWTRYTKDGNPPEQVPYPLEDTLVFDVEVMYKISNYPVMATCASNEAWYSWVSPALLDWEKQKNNSITTDQIDWNHLIPMNCAKKPKVIIGYNVSYDRARILEEYNIKQTKAFYLDGMSLHVATSGICSRQRPKWAKYNKVKKLSQEKCE

SEQ ID NO: 17817 - protein, 743 aa, Candida albicans
  UNSURE (15): Identity of amino acid sequences at the above locations are unknown.
IPSQQLIRILLPVMXTLRATRDALLTKGKSYVLFKVPHPNGPSLRCTHILSKLYVRNFEDGTLTSEYDYATKILNLNNEASYWLGNRNRIKDQFVVYNQQGKNKFFDTIKKSKEHSSMGIIIPNLATMGTITRRATENTWLTASNAKKNRIGSELKSLVEAPKGYCFVGADVDSEELWIASLVGDSMLQIHGGTALGWMTLEGEKSQKTDLHSKTASILGISRNDAKVFNYGRIYGAGVKFATRLLKQFNANITDEEADKVARQLYDSTKGRTAVSKYLPLRIYYGGTESIMFNALEAIAQQEEPKTPVLGASITDALNVKNLNTNQYMTSRVNWTIQSSGVDYLHLLIISMEYLIEKYGIDARLAITVHDELRYLVKETDKYKAALLLQISNIWTRAMFCEQLGIKEVPQSCAFFSEVDIDHVLRKEVSMDCVTPSNPTPIPLGESLNIGQLLLKCQHGDILADKNTKPLTLRTTKYSPRQPIINQLDKNLTIAEKIAKIELQTSIDKDEWKKNLYNLAKVSRNKQNGKNNSTEKPQRVIKRKPIVEYDLQEDNNKKREIKYKKDPPKSKIATTTTTTTKKKASSNNSKTKSNVKVDESKSAMTILDLKTDQQRPTYNNRKIVYRKTSSKLNSIRKSTSGSTTTTIATPPSPPITTSNNRQPSFLQQQRHFKTSTRLESLVNKDYSSRPRNYYLISEQKLMVSTDLSNMMMESIESKRRRRRQRQQQRQQQSKIGDEDNFYD

SEQ ID NO: 17818 - protein, 385 aa, Candida albicans
IHRRQMYHIHRLLAPIRSNSVFFSLAQLPKPSLIGCRYKSNNVGSQDSKRTLKNSILHNLGSYSNSAESEILNKLKPITPNDLYVSCTSFDRIGNITAVSRKYPKMQFLKENHLFPRDLRKIDTSSIDVVPVIMIRPSSAILVNLLHIKAIIKKDNVMVFDTSKSEVATKLGIFMYDLELKLKSPANNVCYEFRALESILVSVTSYLEAEIKLHRQQCGIILAELEDEVDRAKLQELLIRLKKLLSFHQRAILIRDVLEELLENDEDLAGMYLTDLKRFEPEEENYEEIELILESYYNQCDEYVQQAGSLLSDIKATEEIVNIILDANRNSLMLFELKITVYTLGFTVATLVPAFYGMNLKNYIEETNWGFGLVLVVSLLRIPAT

SEQ ID NO: 17819 - protein, 493 aa, Candida albicans
QKKTTKEKVKEKYIELCPSSDYYHFGKKKKGIKKNNLNMATPETVPIADEIMSDFEDVSSPNSPSLSLEQSTRGSTPPTSTSSPPSTQNNDSKSKESLETDDVQDTVDNKKLLDDVNESQESTDSKDNQDGEETRKESTDAKDIKSNGTKKNQDSKDTKESKKIKKSKPISRAPIATGISTEIEVTGEKPKPIQEGDPSLEDDVLYAIFVILYEEDLTEKGMTVKHITDVLDEKYPQFTKNTGKVSNLVSAKINSYIKRLEAGQTSLRYAISRDWGTNTPKRMLYRYRGILAPGWEVKLKELQKQQESKQQQQQQEQQSEEQQNEQHSDDSQELNLEQIEQQQQNESKEKSRSPGSESPKSRKKVSRAQSVSTNFKDHFAELDKQQDQFSLPLPTTATSTSTSTSKTATKRRATMFDLGRPTFLTNGEFCDQPPPYLTRKPAKIEDVLDEDVLEDDEESLTTLSQKDDGCNNILRIKKRRLTGASIRETGDDD

SEQ ID NO: 17820 - protein, 60 aa, Candida albicans
RGFRPVVKTAFGFGKFKFVPPDQVVEPISLEQEELIKQKTKEEFAKMTLPPQQSVLSMDE

SEQ ID NO: 17821 - protein, 335 aa, Candida albicans
PFLFILFHQMLRATSKLTYPSVRFLSQTSKVTFQQRQSFLDKYRTDQESIEAPTKLASESTLPVIEQDLKIKPRQPKTKAPFLSEDEDKKIELPSWKEKIGQFVVSTFGVDMDKSRSGPVAGGIYFSECKRQALVYPNEPMSDTAKFYYETLRLPKSFSQQVQITILHYWILSVRMRALPFKYSKEYQQKLVDRIFNDLDYRMSTELGIKSNRTIEGYLKDYHTQLLGCVLSYDEGLMTDDITLASALWRNVFNANENVDMRHVEALLVYVRSQLYVLNKMTDRAFGFGKFKFVPPDQVVEPISLEQEELIKQKTKEEFAKMTLPSQQSVLSMDE

SEQ ID NO: 17822 - protein, 212 aa, Candida albicans
KTTSNPTTRSRSIMSWVTRTFRFERNVNKYPENLRKHFQKNKEITNLPSFKNFFPTTLPRSQQKTNVEAGIMEGDLAYVTTGSHKGKIAEVLSYSPEYDAVSLSNISSKKLIPKIFWPEGQTSHVFDFPDYIPRNQVRVVGKDKDENGNVSYVVAEDIELRDKYYDDRFKNSCLYGVLSFPKNMKFHGAKPQGLKIWSIVPHQKNFAMENKF

SEQ ID NO: 17823 - protein, 111 aa, Candida albicans
  UNSURE (9): Identity of amino acid sequences at the above locations are unknown.
FPRTLSLPXPCVKTGVTDWVFPFDSAIANGWLTYLAYVFWQQQEKNYKNGAKPTSEGLALAGVHAKKLFWCSVWHLPAVLILAMLHKKDQWNRLFEHIGLKTRKIEGRLEV

SEQ ID NO: 17824 - protein, 388 aa, Candida albicans
TEHRYIIMSHRVVTVPRLHSVNNFNYFFHNTKRNLVIDQNFINNQYLLRKVLLPSLSGRVRHLTSHTSRISDNTSIGGLLSSLSVIENVASKVLTCQEPEAQLSQKTGIDPSDNTTNKHIPFKITPKDSQALKTQPVTLFPKSKAQLKNTCTAYLKLTKPNLTVLVTLSSICSYAISPLSVSLQELMFLTVGTALCSGAANAINMGREPEFDKQMPRTVGRPVVRGLITPTQAYQFAAVSGPIGCGMLWFGVNPTVSLLGFSNIVLYAWLYTSMKRKSIINTWVGAVVGAIPPLMGWAASSSLAHPAIWCLARLLYAWQFPHFNALSHGIAQHYKLAGYVMTAAENPRLNAILAFRYSVLMCPLCFGSSYFGVTDWVLPFDPALAMGG

SEQ ID NO: 17825 - protein, 274 aa, Candida albicans
TMNRLRIYTPIFRSTIVKPAVFRPYAFIVSRGIHTTGKLFQMQHQQQPSVPDQSSIEKQREWVDRLAREREERQKYRNRTATYYTASLGIFFLALAFSAVPIYRAICQRTGWGGIPITDSTKFTPDKLIPVDTNKRIRIQFTCQSSGILPWKFTPLQREVYVVPGETALAFYRAKNMSKEDIIGMATYSISPDNVAGYFNKIQCFCFEEQRLSAGEEVDMPVFFFIDPDFAKDPAMRNIDDVVLHYSCFKAHYSDGELAAAPIGNMEMKASVVS

SEQ ID NO: 17826 - protein, 560 aa, Candida albicans
GKEQQWELVVENFQILNSSNLDAAQLDKLKHNNPQDIPPQFRYLQLRTPYYQKSLRLRSEAARLIRDIFIKNHEFVEIETPLLFKSTPEGAREFLVPTRSFNKFYALPQSPQQYKQILMSSGFTRYFQVAKCFRDEDLRSDRQPEFTQIDLEMSFVNNSDQVGIVVEDVIHNVWNKVGGKLTYKVNDEGFLVEADLAEVGESLQFSKLNYIDVLVKYGIDKPDLRSNLSFISLEDFFIAKENADFPVVEVCVLKGAFDASSGKYKLPKSFINDHNFSSRRPYVWAIQRNDDTFGYFKKLIDANIIATTNTFDESKLQELLNLQPGDILAVSTRAKFPYENPTPLGKFRQLAIEEFPHKWQRPIVMENGQLSVDYDRNDIVVGSWVVNFPLFNPVEESGQTSHVTEESSKPKYPVYNFKKFESTHHPFTMAKIEDYDLLESDPLKVRGEHYDLVINGVEVGGGSRRIHDPALQQYIFEEILQISNFQQLFGHLLKALSMGCPPHAGLALGFDRLCAMLMGSTSIRDVIAFPKNQSGVDPVVESPTGVKEATLNEYFITTKN

SEQ ID NO: 17827 - protein, 84 aa, Candida albicans
LFKRNKPSPDEEIKLSALLADIVGKSKGEMRRLIKAGGVYMGLDRNQIEDPDDVILFDVDNHLIDGKLLLVRVGKQNYYVVEFV

SEQ ID NO: 17828 - protein, 179 aa, Candida albicans
KKKFNRRNDNQKFNQTSSNMLKTHTRNIPLIRRLARFNSTIARDPVTIIPTIYELTEAKDLTPETNPDNSLLEYLQSRHLIESITDDNLYKLTKRGSNHKFKLYCGADPTASSLHLGNLLPLMVLLHFKMSGNDVVGLVGGATGLVGDPSGRKTERNKIDEVEVEDNVFTTRSRLRVWI

SEQ ID NO: 17829 - protein, 387 aa, Candida albicans
QIFILEGSDQHRSWFQSSLLNKIIYSGSNGTSFQPMAPFKKVITHGFITDAKGQKMSKSLGNVFSPREAIEGCKKPLTPYLGTDGLRLWVASSNYKQDVSFSPEVLTRVSEVAKKYRVTFKYLLGNLHDFKDPVNYDQMSALDKYILHTLFQLQQACLEFYQDFNFSRVVSSINTHVNSISSAIYFDVSKDCLYTDSANSVRRRSIQTVLNEMMKTYLGLLAPIQPLLTQEAWSEYIRIASLKEDSVFKVDSKFFILSEKYENETVEKSFNEFLELRDDIFRTVESLKQQKFFKNKLELEILLSVKENTNIFRFLKENSSYLDDLFLVSSVKLVDGDLDYTFRVNDEPVLIRIQHSSKCKCPTCWKYTSESPDILCEKCDSVVESFN

SEQ ID NO: 17830 - protein, 606 aa, Candida albicans
NRRFLQQHISLYMLRFKSKVRTFATSLVELEKKNFSKTLLLPKTNFGPKIPKGDIREVLIKQLSQDIYKWQKENKANRREFVLHDGPPYANGDLHLGHALNKITKDIINRFELVFHDRLIKYSPGWDCHGLPIEMKVETLGKKYESAVEIRKACRDWANAMIDKQRQLFKEYAIMTDFDKPYITMNHAYEINQLKIFSKLIENGLLSQQLKPVWWGCDTQTALAEAELEYNDKHKSVAVHVKFPVVSENLYKYSELKGHAVEFGKLKLLIWTSTPWTIPLNRAICVNENMTYTLIQNVTETLVVAKSLAEQVLKIDPSYKIVNIDIPGSVLTGTFYTNPASDDSKEYPVLHGDHVIETAGTGLVHNAPAHGREDYIVGRKHGLSVESAVDNNGKYIAKFLPPGFQKLGDAKVTDVKTNVICANILNESGMLFHLDKKFVHSYPYDWRSKTPVIQRATPQWFVNVEKIKPYAKEALSKVEFYPQSGSNRLTLFVENRSEWCISRQRVWGVPLPIVYERATGDAVLDLKLINYIIEKIDEFGTDEWFVEETDISRWLPDEMDGLKYFKGKDTMDVWFDSGTSWSTLKSSLQECATTNEPLADIYFGRK

SEQ ID NO: 17831 - protein, 721 aa, Candida albicans
  UNSURE (111): Identity of amino acid sequences at the above locations are unknown.
IMLLCQKPTYRLLRYSVKRYVASLYSLRGVSTRVNLIHRTYATTVAKDNIDHNDLSPVFNNNEVRFENINALIHPILLDLKNKLIKGKFDSPYTILNDQPSDVKTEIFQSXEQQLSKALLSKSTPENKITLVDYLNHTLDNISLLLHLISNNTYPNNFLEFSNLSSNNDLIMQLFTQLLHKIFLQYRIENASFEKPKVDFSNPAEWFPEARKMKRKIIMHVGPTNSGKTYNSLIKLSKSKTGYYAGPLRLLAREIYEKFNSQGIGCNLITGEEVVPSIDKYGKVSGIASGTIEMIPLHKKMDLCVIDEIQMIADPLRGSVWTNAVLGVLAHEIHLCGEESAVPFIQKMVEITGDELEIKKFNRLGKLTVEKLNTSLQQLKKGDCLVVFSKKKILKFKCDIERNTRLKVGVIYGALPPEIRSQEASQFNNGEYDVLVASDAIGMGLNLKINRIVFSGVNKFNGSTVEKLSVLQVKQIAGRAGRFSAQHGLKEGFVTALHRSSLVYIDQCLKTPVSEISKACIWPTSNIWRQYMANDPRKSSLSSVYENFLTNVLKFQSDNFFISELDQKVQLLNLVAKNRLLSTMIIDDQLTISETPINFRTSVNPKLLKNTVIKFYETIVKRDCKSILDFDFLDLELLSQNSFVGTDVMVPLQKVDKLEDMHRLVLLFLWLSQRFPTLFIDKDSAMEVKALVEKRINQELVNVERANSFFLDRSNGYEPRR

SEQ ID NO: 17832 - protein, 209 aa, Candida albicans
LNFLVAGYLYFDVAKHKTNSGRAKWYDLYAFFFTINMDLLNFFFRFHHLLFYQINTIIALFTHHNQMSSPIMSVAEKTAYKRNMVKIRLARFGRKHQPIYNIVVMKAKKAQQKLPMEVIGTYNPIPVPLSGNDSGLKIKDVSLDLHRTKYWLGMGAVPTPRVTWLLKKVGLLPQFWPKTSALSQHIDKPVVEEIRETQELPVDYVRKRD

SEQ ID NO: 17833 - protein, 434 aa, Candida albicans
  UNSURE (203),(204): Identity of amino acid sequences at the above locations are unknown.
QPSRKTALFSFLACFTNNTKFISRPMNSLSKIAPISRGIIYSQSSIRSLSTQILRSTNQHYLRSRQGSNPVANSRRFASHSTINLLQQQEQIANNELNNPQAQLEFYKTLLAYNYPHILVQRFETQGIASSPECVQLYIDALNKVGQTAKAAEVARQQQQHQTQYQTNGGNIGVGLPYGFGSRQEPVHVVVSESLLTILSKWXXWLIPIALLTYGATNAFNYLVENGTIFRNSETSDKSVDVSQSTVRFKDVQGCDEARAELEEIVDFLKDPSKFTGLGGKLPKGVLLTGPPGTGKTLLARATAGEAGVPFFFMSGSEFDELYVGVGAKRIRELFSQARDKAPAIIFIDELDAIGGKRNPKDQAYAKQTLNQLLVELDGFSQTEGIIIIGATNFPESLDKALTRPGRFDKEVIVDLPDVRGRIDILFFTSRLEG

SEQ ID NO: 17834 - protein, 303 aa, Candida albicans
RGRIDILTHHMQYVDTADDVDPSIIARGTRGLSGAELMNLVNQAAVHASQLSAPAVDMNHFEWAKDKILMGAAKKKMVITEESRINTAYHEAGHAIMAMFSKGATPLYKATILLRGRALGITFQLPEMDKVDMSKQECFARLDVCMGGKIAEEMINGKENVTSGCASDLSNATSVARAMVTSYGMSDKIGPVRLSDDWESWSPQIRNMSDNEVRDYLLDSEKRTRKLLYDKRLELKRLAEGLLEYETLTKEEMEKVVKGEPINKAKTMSNTVIKKSSKSSEIKDILNDPMPTALSNQAAGRSS

SEQ ID NO: 17835 - protein, 201 aa, Candida albicans
TLRILPGGLCEKLNHRSNKPLKEIDTDESVEQEPPKKQQPKVVDVLENKEKFTEIPFMPKMANETLKAQLGNASWKLFHTILARYPDEPSDQERNTLENYIHLFAQVYPCGDCARHFTKLLAKHPPQTKNRKTAALWGCYVHNIVNEKLNKPEYDCTTILEDYDCGCGDDEKEKDYTLKGESMDHLRQIKIDSKKDKQRGG

SEQ ID NO: 17836 - protein, 119 aa, Candida albicans
PIITKNSNQKMLKLPYRPVFCTLKQFRLYSSTPVKDIVANGKTYKGDNWTNVPPYILELTKRKLYKNPNHPIGILHDLIKTSVNGMGYTVYEDFPPIVTKYETFDSSLRSCRIAAYVWN

SEQ ID NO: 17837 - protein, 305 aa, Candida albicans
IFPDFFGKDEIDRTHYPAFHQLEGARVWDRNDPNLLENIRKDIDEIPKTDIIVEDEFRENPVTENNPNQKHLKEEEVRLVAEHLKKTVEFIVYQVFEKARQSAKEQGLTMAYLDEPLKVRWVEAYFPWTSPSWEIEVWWKNEWLECCGCGIVQQQVLLNSGIGENKISWAFGIGLDRIAMLLFNIPDIRLFWTLDERFHNQFRQGQINTFVPYLKYPGIKRDVSFWLDRDLHANEVMEIVRLHAGDLAESVSLVDEFVHPRTQRKSLCFRINYQSMDRNLTNLEINEIHDKVENELVEQFNVEIR

SEQ ID NO: 17838 - protein, 175 aa, Candida albicans
DLLAGSLDRGAMAINGIDKLLKSQQLLFAMVSISPSILILYQMYRLLTNSGKGNGSGAASIMINGKQLNIVCLKCLNNIENLLILLQLQEKKPQQKEQNSRSTENVSNKHHQEFYEGELLIEIINLFVFSSYLIPIDLKDDWIDDLNELNNKQFDVTTKLDLIRKIWNMYGAYFR

SEQ ID NO: 17839 - protein, 534 aa, Candida albicans
HFYLLFRFGTISKEDIEEEGTMDLISLGLTPRKSKKILQIINNNRVSRDIELEFNQLNSYTKAFLVNQLSIDSSQQEEQDYEGHQLNGEVNDNVLQVFQELYFLLDVENFKFNHVYTDIDLNKLKLIYMKLTSIGGDGSLNDNTKTVLEIIEKYIILITTLSLTNSLIYKTLILKNQQVYWQALNNSSTINKLIYFMQTSPIKLYNFGCDTFAKTRRMLFHNSNDDGSKVYQLSSQSGGKEEDNIFSRYLLVIKNVCKLAFNGLITFVRQQSLPSIGFIFLSNDRSGKKHKKKQRTLSIKWYLHSIKPVIKFPINLVVKEAKSKLRKIDHEIALNVENIDKLIKTNPKDYLETLSVILQLDSTQDHPTSQDLNTVYQKKKNMILQAMEHVVKFDKQSYDLTSAPGFLTRYWIIIALVIFYGPSQTKKVYANRQEIIYWVKYNGIEPVVGFFKNWVIKPVYDMLDILRNTSSDSQLSITSKDSLNSEFDSLNSMIYQFAQDNHIDVSESQITDDIKNGDLKIIMSTYEKRNQITP

SEQ ID NO: 17840 - protein, 128 aa, Candida albicans
KKIQSYPYHLSITMPFRFPVKFEIPKHAHLNARVLRDQFKRLQVAEHEVTRNALKYIARNEELPARARVEAQLQLASMPKYTSAIQIKDRCVASGNAKSVIRDFKLNRTEFRNRARAGLIPGVKVASW

SEQ ID NO: 17841 - protein, 414 aa, Candida albicans
YPHPNWIEDWLKKKGSKKNLVKNKTPSKKRQIFQYHLHKVMIRQFLRNASSNATKATISTTSSLSTSTNNNYVNTPEQQRQEQRPELLTILPSKRILNRILFDIDSQLTYKQMIPILNHIYKNLSTPESINLNQLKIQSSYDLMKFKKLLQEIRKVTNSIDVHLLDLENELIEQLAELGNNDAITILAFETVRKRQILKEIVDEEDYQHANELIKQLIDINHPLVFKMAGDLSWELNQPNQAIEYWQTYIQLASNKNSGGDDYDDHLCQIYYNMGYYYFTYLKHPNLTLAKLNFQKCINHGFGGGGGSSGGNSNEFIVKSHFYLGQLYVNTNPKLSKYHWEISSSSGLKDSIINLGFLEMNCFQNYNLAIEWFKLGVELNPNEAQCLIGLFDAYIALQNWKLYSSTEARESALS

SEQ ID NO: 17842 - protein, 484 aa, Candida albicans
QNFFLIIDRLTIDKSRPDFNYETDEDLIDITKEIFASLESITNNKVVKSPYFELLEGTRALEVLNPRLDTGLIKLTPEEITFDCSKPQEVNVIINIQTKLLSNLVNWLESNSLPVTVLSCRYVQTLLVNYLNHENSGLGKFSFYNSRLPAVDYLKDNLNYQFVHRVLKTFTMGLCKFIGFTIYLSRTVLYEEEDLNTKSMNLNFFEDISPVYFIEEINDCIEWILSNDEIIEADTLITQLKIVANLVKFENTFKTTQHTSFMDGKNDIATSDSKFDFCLDAINQITKLQNVKFDDTVIPMGSFSKFIQVDLVNKSIPEKLTSIDLETTWDCLTNIFKTIHRFTNQANSIKSINQLYDFLHYNIKFPIEKFSVFARGFFQLYFIRDNKSIFGSNNVNLPNLVIDWIENVIGKSTIMLGKFENNLSQIKDNVKAEIIKVHNANLNDLESGMYHYLTTFASNPCRLAQLLSKGLILWEPLASWLGFI

SEQ ID NO: 17843 - protein, 192 aa, Candida albicans
KNQDYLIKSLKAMRNLTQCQLKYLSVLSKLQIIDYTKGPINNLTSMENLYYLIMKPWSSIGVPMFPTFEQYQSVLTTNTAPGLNNKLTLMKCLELLASAKNNLVVVEKEYHQLIDYIKRDTKNNFLQDSLIITWYEELISAIEQLNDNISQISKIISLNKDDLKLKNKYKINITQGCHKYFPNISIIPCIGK

SEQ ID NO: 17844 - protein, 175 aa, Candida albicans
  UNSURE (9),(38): Identity of amino acid sequences at the above locations are unknown.
EVVYNFGKXFFYLHFKFPLWIMMSITMRDLSGGSSWDXTHNKALDPSLYEEGILWFQDLSIADPMHVFPVILGITALCNIEWTLKTLELLRLTKKLKFRPTLTDAFGNLTKMSIVFMMAISLHAPAALTIYWISSQLYSLLQNVMMDLMLPISFTPKKRINYAKIKNDNAVNVIN

SEQ ID NO: 17845 - protein, 174 aa, Candida albicans
RRLEAGSQTTCTKQVKYKITMFSNKINRLGPLVIQNSSHKYPGVRNFSIDHNAIINTMTSSFQAVHEFSGLPWWALIPLTTFTLRSVWTLPLAILQRKRIQKQSQLRPLVSAMNPILKLNLARRVQQAKKKLENNSNTKEDITSIQASSTLINMKYEQIWFLSSSLRKRAGSAN

SEQ ID NO: 17846 - protein, 81 aa, Candida albicans
  UNSURE (68): Identity of amino acid sequences at the above locations are unknown.
KIQFNATFFFPYSLLFFLLKYFFYLFNQKPFTPFADTNIFSLIIMSSENKQTESKPKPCCVCIEEGKXRDECSLFKGIESE

SEQ ID NO: 17847 - protein, 173 aa, Candida albicans
RSHVRILAVRSEDKWEQFELLDKTLIAPMTSIYRFKLRREDEVLDIPTGHSLACCFNVDGKDEVRFYTPISNQFDKGFFDILVKHYEHGVVTKKLANLQVGQTVQFRGPFGKLQYVPNLAKELALVAGGTGITPMLQVITAIITNLEDDTKIKLLFANNTERDILLKDELDNM

SEQ ID NO: 17848 - protein, 219 aa, Candida albicans
SQPLLLVYCYIHRQATTHKTTQMTSRLDELNKKLQQNSNQGLASSSSSSSSSSSRSSLKPPTSSSSLRPPPTMGSNRGLFPAINSAQRAANATTTSSAAANQRKKVILQPGHSPLDWAQLNRTQPRHKLRGVPANTPPPQYISINKQELQKHKSLQDCWTCINGKVYNITPYINFHPGGVEKIMKCAGKDGTSLFNKYHSWVNVDRMSENCIVGVCHTD

SEQ ID NO: 17849 - protein, 283 aa, Candida albicans
GPTGVEAAGEIQDNIDQDLKKWVPEVADELKVSLVEALPNVLNTFNKKLIDYTKEVFKDTNINLMTNTMIKKVNDKSLIANHKNPDGSTESIEIPYGLLIWATGNAPRDFTRDLIAKVDEQKNARRGLLVDERLKVDGTDNIFALGDCTFTKYPPTAQVAFQEGEYLANYFDKLHAVESLKYTIANPTPKDNVEKLSRKLARLEKNLPHFIYNYQGSLAYIGSEKAVADLVWGDWSNISSGGNLTFLFWRSAYIYMCLSVKNQVLVVLDWAKVYFFGRDCSKE

SEQ ID NO: 17850 - protein, 194 aa, Candida albicans
ALYPRDMQYVGKVGGYVYNQWNSLNPATLSGAIDVIVIEHPDGTLHTSPWHIRFGKFQIIKPSQKKIDLYVNDIKTNLPMKLGDGGEAHFVFEVDDKNHALSHSVLTSPIISPVSSPGSSPVSTAAEPLDDLDLNENTNVEERIKLSDIHSPRSKSPTPSLKTKKAFENAKKITQKLNIPTKFDLNGDMLIDLD

SEQ ID NO: 17851 - protein, 400 aa, Candida albicans
  UNSURE (40): Identity of amino acid sequences at the above locations are unknown.
LSSIERIMFQIEEAQWFYADFVRQLNPDLQSMKMKTFSTXILEKCPLIWKWGDPQEALSKFGKYKSTIPVRGVALFNKDLNKVVLVKGTESNSWSFPRGKISKDESDIDCAVREVEEETGFNCRHLIDENDCIERNIRGKNYKIYLVKNVPEDTLFEAPTYEISQIKWFDIKTIQKKCKTNPNTFFIVGTILKPMTKWINKNKGVLNEEEIMLQVELKLKELLGLNAKEPEENVDAGRELLNILQKVGQKESQSAISPSSSYQNNDQQPQPPMVNVPVPQHLHNQIPFFAGAHAAFPFYNQPFFNPMSFMPPQFMPHHPAYVSPHNQQPPNPQSFQKPKTNSKELLSILTAKSDKKRDDENSKQRKPVEDDNIRSRAQQLLSVFPKKHIKETNTSAGVRG

SEQ ID NO: 17852 - protein, 634 aa, Candida albicans
  UNSURE (236),(239),(263): Identity of amino acid sequences at the above locations are unknown.
HTVNYTLMLIQSLLPRVGSRRLFPRSLPPLRNSINYTPCIRRFHQSCTRYNLTSEQEEILHQERARDYVDVCIVGAGPAGLSTAIKLKQLDNEQGNGDLRVIVLEKAGDFGSHIVSGAVIEPQAFKELFPESELTEENGIPLPLDIITKVTSDHMKYLTPNSAFPLPEPPQLTNKGKNFIVSLNEVVKYLAEQAEELGVELYPGISVNELVYNEDKSAIKGIITQDMGVDRNGAPXDSXEPGMEFFARLTVLAEGCHGSLTKXAISNFNLRENSEPQTYGLGIKEVWEVSPEKFDKGYVGHSLGYPLTSKEYGGGFIYHFGDGLVAVGLVIGLDYANPYISPYQEFQKMKTHPFYANVLKGGKCISYAARALNEGGYQSIPKLHFPGGILVGCAAGFVNVPKVKGTHTAVKSGIVAAETIISTFKQMELDPCDEENFEELSTPIDLSQYEENFKDSWAYKELYAVRNVRPSFNSPLGMVGGLVHSGLLTMITQGKEPWTLSHHGTDSGATQDANKFQPIEYPKPDNELTFDILTSVSRTGTYHDEDEPCHLKIPDQDCRKHAELNWTKYRGVEQRFCPAGVYEYIEDELEPLGVKFQINSQNCIHCKTCDIKVPSQDITWSVPEGGDGPKYYMS

SEQ ID NO: 17853 - protein, 112 aa, Candida albicans
  UNSURE (112): Identity of amino acid sequences at the above locations are unknown.
LDSTTTSMASYIAKRLFSRTTVRLNTLALVEGVSNGISPASLSTITAATQIGEPVTAIVFGSNGDSVAEAVAKTEGVSKVLVAKDSEYDHYLAEKVSPLLKKIIEDQKFTHX

SEQ ID NO: 17854 - protein, 286 aa, Candida albicans
TCNTGETKKKNKGRREKKIFLVMTGEITILYGSETGNAEKYAKYLKQRLRSYNLKPINLASLNDYPLKRLVTHTSYLIIICSTTGQGEIPRNGKKFMKFILKKKLPLDLFQHLQLTTFGVGDSSYVKYNYAIKKIHTRLMQLGCQLLSPRCEADEISPEGVDGYYIEWEAELIAALLNKFPSASKISSEAVPMPEYRISVSKSDTTIDPKEVIDNPIVSRLGKNGLKLGTVLENNRLTSSNHFQDVRDFKFSSNGLNYLPGDTVSLFPCNFDEDVDALLQLQPQWG

SEQ ID NO: 17855 - protein, 355 aa, Candida albicans
TIYQEILFHCFHVTSMRMLTRYYNCSPNGVKIADKPLNLKNFPHLEGGFADILTLRTLFKYHLDIMSIPRRSFFALLWHFVDPSTEDGEREQAKLKEFGSLDEPEELYDYANRPRRLILETLLEFENNLTIPVSYILDLFPLIRPRMFLIASCPSSKEVELVVAIVEYKTIIRKIRRGVCTRWLKNLKPGDQFLFSIQRSSFKYKDDNSPIIMVAPGTGIAPMKSLIDEVIQNNSKQELYLFFGCRFKEKDNLIESFWHGNENQNLHLVSAYSRDSNSKYRYVQDALFAHSELIGKLLIEQNAKVFVCGSSGKMPKEVKITFVEIVKKFTGMDEGDAQKYIIGLEDNGRYKEDAW

SEQ ID NO: 17856 - protein, 688 aa, Candida albicans
  UNSURE (37): Identity of amino acid sequences at the above locations are unknown.
RMRHPVYDTFDGSDFQALKEPIIDRVVKLITELPVHXEEATNHKATHILDFGPGGVSGLGVLTHRNKEGTGARIILAGTLDSNPIDDEYGFKHEIFQTSADKAIKWAPDWLKELRPTLVKNSEGKIYVKTKFSQLLGRAPLMVAGMTPTTVNTDIVSASLNAGYHIELAGGGYFSPVMMTRAIDDIVSRIKPGYGLGINLIYVNPFMLQWGIPLIKDLREKGYPIQSLTIGAGVPSIEVATEYIEDLGLTHLGLKPGSVDAISQVIAIAKAHPTFPIVLQWTGGRGGGHHSFEDFHQPIIQMYSKIRRCSNIVLVAGSGFGSDEDTYPYLSGYWSEKFNYPPMPFDGVLFGSRVMTSKESHTSLAAKKLIVECKGVPDQQWEQTYKKPAGGIITVRSEMGEPIHKIATRGVMFWKELDDTIFNLPKNKLLDALNKKRDHIIKKLNNDFQKPWFGKNANGVCDLQEMTYKEVANRLVELMYVKKSHRWIDVSLRNMYGDFLRRVEERFTSSAGTVSLLQNFNQLNEPEQFTADFFVKFPQAGKQLISEEDCDYFLMLAARPGQKPVPFVPVLDERFEFFFKKDSLWQSEDLESVVDEDVQRTCILHGPVASQYTSKVDEPIGEFWNSFREGHMARLFQEEYAGGESKFLLVEYFGVGNVQVYQVHLSMLLTVTKLFMKLTPNSQTNKSG

SEQ ID NO: 17857 - protein, 394 aa, Candida albicans
  UNSURE (382): Identity of amino acid sequences at the above locations are unknown.
PIIIYILFPYYTMSTHRPFQLTHGSIEHTLLVPNDLFFNYSQLKDEFIKTLPEPTEGFAGDDEPSSPAELYGKFIGFISNAQFPQIVELSLKDFESRFLDNNNDNIHSFAVKLLDDETYPTTIAKVKENIVKNYYKAVKSINKVESNLLYHCKHDAKLVAIFGGQGNTDDYFEELRELYTLYQGLIEDLLVSIAEKLNQLHPSFDKIYTQGLNILSWLKHPETTPDQDYLLSVPVSCPVICVIQLCHYTITCKVLGLTPGEFRNSLKWSTGHSQGLVTAVTIAASDSWDSFLKNSLTAVSLLLFIGSRCLSTYPRTSLPPTMLQDSLDNGEGRPSPMLSVRDLSIKQVEKFIEQTNSHLPREKHIAISLINGARNLVLSGSXHESPLLGFNFEF

SEQ ID NO: 17858 - protein, 303 aa, Candida albicans
PTKEVIQVGSVDYEAGTSYGNPVTDYLSRNGKTIEESVIFENAIPLSSGEELTSKAPGTNEPYAIVSGDYNPIHVSRVFAAYAKLPGTITHGMYSSASIRALVEEWAANNVAARVRAFKCDFVGMVLPNDTLQTTMEHVGMINGRKIIKVETRNVETELPVLIGEAEIEQPTTTYVFTGQGSQEQGMGMELYNSSEVAREVWDKADRHFVNNYGFSILDIVQNNPNELTIHFGGAKGRAIRDNYIGMMFETIGEDGALKSEKIFKDIDETTTSYTFVSPTGLLSATQFTQPALTLMEKAAYED

SEQ ID NO: 17859 - protein, 402 aa, Candida albicans
FLFLPQLTMKPEIEQELSHTLLTELLAYQFASPVRWIETQDVFLKQHNTERIIEIGPSPTLAGMANRTIKAKYESYDAALSLQRQVLCYSKDAKEIYYKPDPADLAPKETPKQEESTPSAPAAATPTPAAAAAAAPTPAPASAGPVESIPDEPVKANLLIHVLVAQKLKKPLDAVPMTKAIKDLVNGKSTVQNEILGDLGKEFGSTPEKPEDTPLEELAEQFQDSFSGQLGKTSTSLIGRLMSSKMPGGFSITTARKYLESRFGLGAGRQDSVLLMALTNEPANRLGSEADAKAFFDGIAQKYASSAGISLSSGAASGAGAANSGGAVVDSAALDALTAENKKLAKQQLEVLARYLQVDLNKGAKSFIKEKEASAVLQKELDLWEAEHGEFYAKGIQPTSPH

SEQ ID NO: 17860 - protein, 414 aa, Candida albicans
RSSLQRCSRITGPKTKVSAKGNIEYEETQKDSVRKFEQYVYEMAQGGAMTKVSQPTIQEDLARVYKAISKQASKDSKLELQRVYEDLLKVVESSKEIETEQLTKDILQAATVPTTPTEEVDDPCTPSSDDEIASLPDKTSIIQPVSSTIPSQTIPFLHIQKKTKDGWEYNKKLSSLYLDGLESAAINGLTFKDKYVLFTGAGAGSIGAEILQGLISGGAKVIVTTSRFSKKVTEYYQNMYARYGAAGSTLIVVPFNQGSKQDVDALVQYIYDEPKKGGLGWDLDAIIPFAAIPENGNGLDNIDSKSEFAHRIMLTNLLRLLGAVKSKKTTDTRPAQCILPLSPNHGTFGFDGLYSESKISLETLFNRWYSEDWGSKLTVCGAVIGWTTRYSFDECPQHYCLNVLKNWVSKLPPN

SEQ ID NO: 17861 - protein, 73 aa, Candida albicans
EFLWDWGRSRRLFNEFELNFGQFNFVIGETFNQCIQFMNRANPTLIKFMQYHIDHCPEYKGETYKWPRDWVNN

SEQ ID NO: 17862 - protein, 376 aa, Candida albicans
ETMGYSFYKSDPRIAPLRGALAAFNLTIDDIGVASFHGTSTVANDKNESATINNMMKHLGRSEGNPVFGVFQKYLTGHPKGAAGAWMLNGAIQILESGLVPGNRNADNVDKLLEQYEYVLYPSRSIQTDGIKAVSVTSFGFGQKGAQAVVVHPDYLFAVLDRSTYEEYATKVSARNKKTYRYMHNAITRNTMFVAKDKAPYSDELEQPVYLDPLARVEENKKKLVFSDKTIQSSQSYVGEVAQKTAKALSSLNKSSKGVGVDVELLSAINIDNETFIERNFTGNEVEYCLNTAHPQASFTGTWSAKEAVFKALGVESKGAGASLIDIEITRDVNGAPKVILHGEAKKAAAKAGVKNVNISISHDDFQATAVALSEF

SEQ ID NO: 17863 - protein, 79 aa, Candida albicans
VCEDAKTQTPIDEKDIKSKYEEEILEHSGIRLIEPELFNGYDPKKKQMIQEVVVQHDLEPFECSKETAEQYKHEHGRKM

SEQ ID NO: 17864 - protein, 365 aa, Candida albicans
  UNSURE (363): Identity of amino acid sequences at the above locations are unknown.
NHLNVLKKQLSNTNTNTGEKCEIFEIEESGEYTVRILKGATLYVPKALRFDRLVAGQIPTGWDARTYGIPEDTISQVDPITLYVLVATVEALLSAGITDPYEFYKYVHVSEVGNCSGSGMGCVSALRGMFTDRYADKPVQNDILQESFINTMSAWVHMLLLSSSGPIKTPVGACATAVESVDIGIETILSGKAKVVLVGGYDDFQEEGSYEFANMNATSNSIEEFKHGRTPKEMSRPTTTTRNGFMEAQGSGIQVIMTADLALKMGVPIHAVLAMTATATDKIGRSVPAPGKGILTTAREHHGNLKYPSPLLNIEYRKRQLNKRLEQIKSWEETELSYLQEEAELAKEEFRDEFVLQRAGRQXHA

SEQ ID NO: 17865 - protein, 395 aa, Candida albicans
NTIYIIMSQDSHAKINYLLHIINSQRTPPIINNPSISSNTHRVRTKTKTRTRTSPNSKTKIKTKIMNIMKTNNRNSILTETEELFTNESQIIESFNSNCTIVDSNSDFHDKLHVYKSPIIDITKYFSPTVESQMDLELIILNEYYSKTHQHHQEQQNDEDEDEDDELNYFYIDAHLKYILSSLIDPMPSGYQVLDVNHSWMIYWLLNSYYLIQNPTMEINQSILDLIVNKITKCINYGDSLSGVPFDGIGGGNNQLGHLASTYAAILTLILTDQYELLDNLRELIRDWLLTLKKRSSCGSGASFIMHENGEMDARSTYCALIIINLLNLTNYEENSSSPEELDPLIDGVENWLNSCQTYEGGFSNIPNTEAHGGYTYCALASYFLLYVNRKHFLL

SEQ ID NO: 17866 - protein, 95 aa, Candida albicans
RVILPAPVVEDQGQGQQQEVKVFDEEKLRQYLLIIAQDESGGFKDKPGKQVDYYHTNYSLSGLSILEHSYNFSQDDEGRSLAFQIDVEREEEERG

SEQ ID NO: 17867 - protein, 474 aa, Candida albicans
TIGTKRSNHAESLALKGCIIFQTNGNKDDARSYIDRAAAKNPNNYLVDHLIGLYYRANENYAEAAKWLSAAMENGSTNKAILRDLSFMQIHIRDYKNLRDSRQQYLEHAPGYRANWTGVAVAHHLNKDYASAVGTLAKIEDIIKDHLTESDMYEQSECVLYKNQLIGELGDFAKALDVLQKDDNSIKDRLSFLEYKAKYLLLLGQKKEASLVYRELLKRNPDNVSYYNLLETALGTTTQSPEIRYKLYQKLSKFYPRSDPPKFLPLTFLPSDSSLFEKAARDYIIPQLLRGVPATFVNVKPLYKNPAKLKVIESIVKDFYEHDVPKISNPTVKVWTCYYFAQHYLYQNDLTAASKYIDIAIEHSPTLVELYIIKARIIKHQGDFVKASDVMNEGRLLDLQDRFINSKTTKYLLRANKVNEAIDCISLFTKLDENAVNGCKDLHTMQANWVLVESAEAYSRIYHDLHLGNGSPRY

SEQ ID NO: 17868 - protein, 268 aa, Candida albicans
MIRNKMMNHLMRLLRILKSTVDWQLKRFHAVLKNFDIFYNDQFDFHSYCLRRGTPRDYIDTLKWEDKIHTTPIYTRALKGLSELYFEIYEEQQQQQQKSKADENDAVVVKKNSKKQKKAKSQLNKKRAELVSKVESEKDDADPFGIKLYHDLIETDVLESLFELFKPLSEEGKNLRLTWEVLFRIYLLQGKYVLALQAIKSLNKILTRGDLDKKLKQIGEMVLELSTTVTNDSNANVAIVKVVEKGLNSAFPDFEKLSCDEFAKLYNQ

SEQ ID NO: 17869 - protein, 359 aa, Candida albicans
LQTSNSKPQAIQNNMNRLLSFILPIFLIFSTVLSSDSPNDSVNINNSDPSRHSNNWAVLVSTSRFWFNYRHMANTLSLYRTVKRLGIPDSQIILMLSDDIACNPRNAFPGSVFNNMDEAIDLYGESIEVDYRGYEVTVENFMRLLTDKWDSDQPRSKRLLSDENSNIFIYLTGHGGNEFLKFQDAEEISAHDLADAFSQMYDQKRYNEIFFMIDTCQANTMYEKIHSPNILAVGSSEIEESSYSHHSDMDIGVAVIDRFTYYTLDFLEKIDRDSKETMDKLFAEYTFENVHSHPGIRTDLFKRNVSEVLLTDFFGNVQNVVVDDVNMELLENEKVTESNEDNNQTKNIIKERGPTQFSF

SEQ ID NO: 17870 - protein, 135 aa, Candida albicans
  UNSURE (6): Identity of amino acid sequences at the above locations are unknown.
LWDNLXRSLSMYTAKSSFNHYIQKEKKATTSITGSSLEHIDNTSDNDDQDDDMDGHKLITTGIYLIFRHPSYFGFFIWFLGLQIFMNNLIILIIGGIILWKFFNERIQFEEIYLIKFFGIDYINYRNKTKTWMMI

SEQ ID NO: 17871 - protein, 280 aa, Candida albicans
  UNSURE (187): Identity of amino acid sequences at the above locations are unknown.
WSYDITTSPIFLPLLIKHTKTTLTMSLTYNPRNNNLLEIFIICFIMGITFTISIITLLLGTSSLSNKYIWLVIYSLLLHGFFILEFINSSLYQYNSVTSKSFLIYGNKGNKQFWYLQLLTIWEYLLLRLGKLNVIVKYFPNIGNWSWWWWWTILQVFGLLISLLGLFIRHLAMKTCGLSFNHYLITXSPSPSKNQYENKLITHGIYKYVRHPSYLGFWLYCIGIQLMLLNIGNLTLTIYILNWFFRIRIEYEENQLINKYGDKYINYQQTTKQKILIPLI

SEQ ID NO: 17872 - protein, 303 aa, Candida albicans
GNIQYALSLGTAIGFPQGLSPLTLLDDVKVWKPDLLALVPRVYTKLEAAIRAQTINNMEKPWLQSIFSTAINAKMEAHAKKENEHTNPSFLVYDRILGLLKKKIGFDNVITMTTGSAPIAPETIKFLKAAVNVGFAQGYGLSESFAGVMASSKYETESTSCGAISVTTEMKIRDIPEMGYSAHDKEGARGELLLRGPQIFKEYYKNPEETAKAVDEDGWFYTGDVACIDSEGKVKIIDRVKNFFKLAQGEYVSPEKIEGLYLSQFPYIAQLFVHGDSLQTFLVGVVGIKSNHYWYLYQEKILR

SEQ ID NO: 17873 - protein, 325 aa, Candida albicans
  UNSURE (321): Identity of amino acid sequences at the above locations are unknown.
KRSMLICQLIPVHLPNQFHYLILKHQDFPQFTEMDFPHDALLNVPYPGLDTLYKLFEYAVDVHGNKPALGSRVKNSDGTFGDYVFQNYDTIRTRRNNLGSGIFFILQNNPYKTDSDAHKKLKYDPNSENSFILTIFSHNRPEWALCDLASVAYSITNTALYDTLGPDTSKYILNLTESPIVICSKDKIRGLIDMKNKYPEELSNLITLVSMDDLTTEDSILKNYAHENNITVFDIKQVEKLGEINQLDPIPPTPETEFTITFTSGTTGANPKGVVLTHKNAAAGVTFLYCNFMGKENVRFYSFLPLAHIYERANIVPPRAXRSAN

SEQ ID NO: 17874 - protein, 459 aa, Candida albicans
PIAPIPPKPDDVFTISFTSGTTGAAPKGVVLTHKNLVCGITVHVAGFGLVPGRIHYSFLPLAHIYERVFLQYGLISGMKIGYPQGPLPTTLFEDIKVLEPTFLCLVPRVYTKLEAAIKAQTVDSDKPLMKYLFTKAINNKLELQQQEDHVNPSNLAYDWLLNLLRKKIGMKNVELFVTGSAPLAEETYFFLRAALNLPRGFHSGYGLTESVSGCSVSPGHANKFSSGPIGVSTEMRLRDIPEMGYFAKDEVGPRGELLLRGPQIFPRYYKNPEETAKAFDENGWFCTGDVAHIDAATGRINIIDRVKNFFKLAQGEYVSPEKIEGLYLAQFPYISQLFVHSNSLQTYLVGVVGLDPTTIASYIKKRFHDKIEKEADILQFLNSPQNKKIMLQDMNKVIAKELQGFEKLHNITVSFEPLTVEKGVITPTMKIRRPIAAKYFQNEIDQMYEEGSLVKNGAL

SEQ ID NO: 17875 - protein, 61 aa, Candida albicans
LEILHKIHIEINPLTVEREVVTPTFKLRRPVASKFFANVFHRLYEIEQSLLHQAKLRTAKL

SEQ ID NO: 17876 - protein, 617 aa, Candida albicans
IKMSLDLFSASDFSKEVAISHLPFTRDITESVPLKPDANKNDNYSPIFRNKATASRLIQRIHPDLDTHHKLFNNAADMFGDRPCLGKRPYDYKNKTLAPRFDYFTYSEVKTKKNNIGAGFIRSLLGNPFLDPQLESHKKVVNHLRDWPTYGLQKSGRDNQDFEIEKNASFILTLFAVNRLEWVLTDLACSSYSITNTALYDTLGSDVSQYILGLTESPIVVTTNDKIPVLLDLKKNFPEQTKSLISIVSMDPIDLVSQNWFDQAKELKITIQDLNQIEELGSRNPIRELPPKRDALFTISFTSGTTGSKPKGVMLSQAGAAAYITSLTCIKPHAAPGDKVFIFLPLTHVYERQTSAFAWSTGYYLAFPQVTIGQENVNAFSNMLEDLRIFKPTYMSIVPRLLTRIEALIKGKIKELSPEEQDKVNQIIEYKIKEQAKHDGAKGLNAAFDQYPPYKFLREIVGYDNIKWVQTASAPIAPSTLVYLKASLNMGIRQQYGLTESGAAITSTDDYEAKAGSCGTILPTGQLKLRSVKDMGYSIDRLEGEVMLQGPQMFKGYYYNKEETDNSIDADGWFHSGDIARIDPKTGRVSIIDRVKNFFKMQQGEYVFTTPCRIRTE

SEQ ID NO: 17877 - protein, 254 aa, Candida albicans
ILFNIFFFIFCLTKNQQIVMTKLPSISETDTVYADDTKPYIFENPNDYPIETLVNHILPFPQEVAGESVKIPGTAETGFSEIYRNAATPNGIKSGLIQGLDTYHAIFENSAQVYADEPCLAFHEYDYENSQHLERYASISYKEVHERKNNLAAGLFFLLSANPFKNNSLESHRKIDSHSKDYKTYNSDNLSFVVTFYSGNRVEWILSDLACSSNSITSTALYDTLGHDASKYILQSTESPVIHFLPKNIFRGLI

SEQ ID NO: 17878 - protein, 497 aa, Candida albicans
LCPWEPLTQRIHTWWILLSQTKLNGMIFLKLNVRGAFFLPKNCPPHFKKFFTITFTSGTTGANPKGVLLPQRCCASAIIGYSALVPHHKGTKEFAFLPLAHIFERHMLSAMFLFGGSVAFPRLGGTPLTLFEDLKLWKPTFMANVPRIFTKIEAGIKATTIDSTSSVTRSLYSRAIETKRSRQIKDGESGDHFVYDQLLIKKLRKAIGFDNMEFCFTGGAPISPDTIKFLKASLGIGFAQGYGSSESFAGMLMSLPFKHSSVGTCGVISPTMEARIRELPSMGYNLNDENGPRGELQLRGAQLFTKYYKNEEETSKAIDKDGWFSTGDVAQITDDGLFKIIDRVKNFFKLAQGEYVTPEKIEGVYLSSNSLLTQLFVHGDFLQTYLVGIVGVDPVGIRSYIKTTFQKDISTNEEVIAFFESPKNRRVLLQDINGNVAGKLQGFEKIHNIEVAFEPLTLDRGVVTPTMKIRRPICTKFFKKEIEKLYNEGSLVKNGNL

SEQ ID NO: 17879 - protein, 160 aa, Candida albicans
PQTTTTTTTTTTTTFPMNQLLINKHEKFFNRCVIGLPSTAQSEDSNKLAIIYFCLHGLQLIQKFQFTNQELIYYRNFIINQFMIENNQIISFRSTYYFQKTNQKYDCPNLSSTLFALYNLLILKSPYHTMINRKKIRNFLCKCQVKDGINKRWVCADTLL

SEQ ID NO: 17880 - protein, 158 aa, Candida albicans
IASLKLLNYPLEKLKSTKEWLIHRQVDYPENLYPKDGNGDNYEYYRNIDIGGFNGRENKLSDTCYSWWCTGSLYNIDVNFIKLVDLNKAEDYLLNKTQNQLFGGFGRDPDSTPDPMHSYLALASLSLWNHEKFALQEINPILTITKELYQFFKEEIKY

SEQ ID NO: 17881 - protein, 174 aa, Candida albicans
MGITIRQATIEDIQAMQNANLHNLPENYQLKYYMYHILSWPQASFVATTYDEVINVNDGEIDVPVTQDPKGDTAYINRGEKIVGYVLGKMEDDPEAADKTPHGHITSLSVMRTYRRMGIAEKLMRQSLYAMCELFGAQYVSLHVRKSNRAALHLYRDSLKFEVQSISKIILSRR

SEQ ID NO: 17882 - protein, 97 aa, Candida albicans
RQSHRASYVSLHVRVSNTAALRLYRDTLGFKVESVESKYYADGEDAYAMRLDLTDQWLDWKEIERKDRERAKSDEKDADEGDEVGSLGKKEEKTVRV

SEQ ID NO: 17883 - protein, 180 aa, Candida albicans
SSGPFLNFSAWHNRTKLIPKIYNLIQQQQQKDGKIFGDLPGIELFQNPILLLKNDLEMIKTGVYMSPEDTSVWLYLYWLLTDDLFTNAFKSHQQDYMNILHEQLQLINEVNEMEKEDTGQDNVGCLKSMIFINALIQNENNKPVLTEQVKSCLKQLAKIDPLRKNKYLDQLAGNAPIFHH

SEQ ID NO: 17884 - protein, 264 aa, Candida albicans
YYFQQWRKYKSQINETANTDKSAIFKAIGLIAFEVGNQMATYLDAILDNIREGLSYTSNAGVQLILAKAASNESPNISTTNIASLASGFKYTASRKETEPAIFDCISKLSIAVGPALTKHLQRDILDMMFANCSLSKHMQDVLQVLIENIPTLTNLINEKLLNLLSLVLSGKGFQPPGSPFGTIKVNASLARDCRLIMISRDTGMSINTILMNQERYEKLDSKILIQALEMLAFFKFENYQLNEFVRYCTITSSPGGCQDPNSE

SEQ ID NO: 17885 - protein, 272 aa, Candida albicans
RRLRESCINTLTYMLVQLGPEFTVFIPVIKKTLLQKNIHAIKFEQLVGKLIGGDPLPLHLDIYKDYDYSLYDIADTDMPSKKLPVNQASLKAAWDASQRRTKEDWQEWIGRLSKELLLQSPSHAIRACAGLASDYYPLAKDLFNASFASCWSELYSQHKEELVESFCIALSSPSNPPEIHQTILNLAEFMEHDDKPLPMSISTLGQYAQRAHAFAKALHYKELEFYDQPTTPTIESLISINNQLQQSDAAIGYLKHAQLHHDLQLKETGYEK

SEQ ID NO: 17886 - protein, 147 aa, Candida albicans
HNDAKELSFVDKVIDTDLKNNSAWSHRFFLLFSKTHLATDNTIDEELNYVKDKIVKCPQNPSTWNYLLGIHERFDRSITQLEEFSLQFVDLEKDQVTSSFALETLAKIYTQQKKYNESRTVYDLLKSKYDPIRSNFWDYQISKLTSV

SEQ ID NO: 17887 - protein, 76 aa, Candida albicans
KPLMMNWDWCEEIALDNEKNYQIWNYGPLIIVQIMELNNNDFDPYREFLILEAMLSSDPKNHHVWSYRKWLVDTFD

SEQ ID NO: 17888 - protein, 156 aa, Candida albicans
LMVKKKKKSTKKKKFLNNLFFMALAETVIRKVKKLGLVPKAIAILPRLSLLVAALSVLWLVTLPQDGNYRNVYISENALMPAQANSYFRESEWNIVRGYREEIGKMVEWSVADRNEVIASWLVDSGLQISYHENGFANNTLYAIMHAPRGVIVIGG

SEQ ID NO: 17889 - protein, 241 aa, Candida albicans
RLKKQNIWQALYTGGSILPTPLTTCRYQHRPINWSKLHDVGFSHLPPNQTKSSMVASYTLPNNPKLKGLRPMTGKDVSTVLSLLYKYQERFDIVQLFTEEEFKHWMLGHDENSDSNVVKSYVVEDENGVITDYFSYYLLPFTVLDNAQHDELGIAYLFYYASDSFEKPNYKKRLNELITDALITSKKFGVDVFNCLTCQDNTYFLKDCKFGSGDGFLNYHLFNYRTFPMDGGIDFKTQEFV

SEQ ID NO: 17890 - protein, 210 aa, Candida albicans
  UNSURE (192),(201): Identity of amino acid sequences at the above locations are unknown.
IQYILKYINTEEVDDDSNAKPRTSLKRLEIHLIVLLLINILFNPAFTGGNVLPMKIFQKVIISFIISSFFTFPIISFTPGIIVILIFGGILYGFTIFQLTPILNDNDVNWLYNYVMKDETRVHIISIWVAMSVTIIPMVFYFANYLRLNTRRKIWHGLMVIALCFTPEILFGQIEFTLISLLGTLIVFMVVXGIRSNRFLXFTSTPRSIE

SEQ ID NO: 17891 - protein, 324 aa, Candida albicans
THLIMAPLTIAVGEAKPGETAPRRKAAQKDGAVMRPTDSKATTMPEFIDECFKRNGNKDAMAWRDLKDVIVETKQITKVIDGKPTKVNKDWTYYEMGPYNYIKYPELLKLVQNYSKGLLELGLLPDQQSKLMVFAGTSHKWMQTFLAASFQGIPIVTAYDTLGESGLTHSLVQTESDAIFTDNQLLSQLIRPLQKASSVKYIIHGEEIDPKDGRQNGKLYQDAKSAKEKILEIRPDIKFISYDEVIQSGANAKDKQSLHYPKPEDPICIMYTSGSTGDPKGVVITNSNIIAAIGGISCNAGRDLIRPTDRLFFTHGSWPHPHYL

SEQ ID NO: 17892 - protein, 345 aa, Candida albicans
LIEFKPTVMVGVAAVWESVRKGVLSKLKQASPIQQKIFWAAFKAKTTFKHFGIPGADMFDVVFKKVKSATGGQLRYVLNGGSPISVDAQVFISTLIAPMLLGYGLTETCANAAILEHTHFQIGTLGTLVGSITAKLVDVADAGYYAKNNQGEIWLKGGPVVSEYYKNEKETKEAFTDDGWFKTGDIGEWTSDGGLKIIDRKKNLVKTLNGEYIALEKLESVYRSNHLVQNLCVYADQSKVKPIAIVLPIENNLRQMLKEEKVIDNAETEEFAHLVHDKKVTKAVLKHLLTTGKHQGLKGIELLQNVVLSDDEWTPQNGFVTSAQKLQRKKILESCKKEVQEAYKE

SEQ ID NO: 17893 - protein, 676 aa, Candida albicans
NSKPLNMNFARTERRKSMAERRPSTVYTPPVIPHLAGLEKPQDQYLKMDNCDVLIIGTGLQESILAAALSWQGTQVLHIDSNTYYGDSCSTLTIEQLKKWCGDVNSGKIHQFQDAQIYIPGGKQSNQYTSKDYGIDLTPKIMFCQSDLLSLLIKSRVYRYLEFQSLSNFHVFENDDFQQKVNATTKQDIFTDKSLSLMTKRYLMKFLKFLLLDPDYKQRVKPYADTPIQVFLQQEFKLEEPQINELVYSIGLSYKEQTSTKQALIRMKRFLSSFDVYGKFPCMVSKFGGPGELLQGFCRSAAVAGTTYKLNTNLTDFDPISKIAHFNDGSHIKINEKIIISPTQLPKFLQSSYNKVVENLQPYYVTRLVTVVRRDCKEWMSGNESLAIVVFPPHSLPTDNQHSVQVIIQNGNSGVCPDGQAIWFSSTVEQDLSRAKVDLESAFEKMETSLLRESSEEIVNDILGDNNNNNNNDFVMNAQGTTTPVLVNSFKLGSSLINFVPKDKLEIVCKLGYVEKTFINPDLSNIFKPTKTNNIVYKDVEDANNEIIFTNMPSSELSYDGIITDVKSIYQRITGTTDDFFDVDFEDEEDEYDRNNQPVVQPKRSSVVGGIVGGGSITSLTALREQHNENNHSDNAIDSDEDEDEDINDMNDMNDNEEEDDHGRGPEPFGADEMEL

SEQ ID NO: 17894 - protein, 209 aa, Candida albicans
QLHDGSFHGDKYFEVDIRFVYTAVSSFSLLNALTDSIADTASAFIMQCFNFDGGFGLIPGSESHAAQVFTCVGALAIMNKLDLLDVANKKVKLIDWLTERQVLPSGGFNGRPEKLPDVCYSWWVLSSLSILKRKNWVDLKILENFILTCQDLENGGFSDRPGNQTDVYHTCFAIAGLSLIDYKKYGFKEIDPVYCMPVEVTSKFVRRLA

SEQ ID NO: 17895 - protein, 141 aa, Candida albicans
IPLCILFGSTAYRDISYIQEFFLVLFSFDSNFFLSFLFNFKRGLFIHQNSTPIDKPYYLISVSAKIFDYKTMSNLPPDEKVILFDKSKHVQYIVEQESHRSFEYWLSEHLRMNGLYWGVTALITMNELSALAQQDVIDYIM

SEQ ID NO: 17896 - protein, 223 aa, Candida albicans
NQNESNSSIYNDVNHDPTIFENKNEPIKVNLISHSMGGLDSRYLFSKIHKENENYKVASLTTISTPHHGSECADFIVDLIGNNQILKNVCPQSIFDLTTSNMKKFNQSVKDDPNVQYFSFGARFNPRWYNLFSLTWLVMKYEIKKDKARELRRLIDNDGLVSVESSKWGQYIGTLDEVDHLDLINWTNKARSTFDKVMFAQDPTFNPIALYLDIADKLAEKGL

SEQ ID NO: 17897 - protein, 286 aa, Candida albicans
IISYYSLNQISQWNVNVFIPPINPTSTTKQKIPVLIYLCGLTCTPQDATEKSFFQYWASKYGFTIVFPDTSPRGAKIEGEDDSWDFGTGAGFYVDATQSPWNKNYQMYSYIHKELLDKLSEQFIELDFENNIGITGHSMGGMGALVGFLTQPKKYKSISAFAPISNPSIVQWGEKNFGNYLGNDDKQNWYKYDPTHLIKQYTTTNDYQPSILIHQGLNDNFYADQLKPENFVKAAKEANYKGEIDLRLVDGYDHLYFFISSFVEDHAKHHAKYLGLTTTTTTTKND

SEQ ID NO: 17898 - protein, 206 aa, Candida albicans
SADSSSGRGSRHDTENRKRAKLGLPLLSKTGNAVNGNESQELPVSATLPISEGIDTDFSLDKEFPTVSLSEPAARDIINNLTTPDAAVSNFVDPYEFEDPIDPDFYEARWNEFARRNTDIYRMVFHCQPDDVVGRWSEYTHFTKLQSMFMKAQDTDTDQGQLAENYSDEKVEAGDNQEPRRANNSQLEKIDEASEDQYGLLRMAPP

SEQ ID NO: 17899 - protein, 363 aa, Candida albicans
NGDNWTNTYGLLGGYRFMLWKIRHARSRINRRFSVIFSNIAQDDRITAENFANFQVFVGKDYSNLRVKDFLELEKPYESMYNRNIVPRMPWHDVHMYTCGQTARDLSRHFVQRWNYLIRQKRPSRLTPLLLPPSDLTEEEVLAHGLDGTCEVQLLRSSGNWSLGLKEHEQSIQNAYLKLIETSEHFVYIENQFFVTACFIDGTEIKNRIGDALVDRIIRAHREGTNWKAIIVIPLMPGFEAQVDEAEGSSVRVIMQCQYMSISRGETSIFAKLRKKGIDPDQYIQFFSLRKWGRIGSNRTLVTEQLYIHAKTMIVDDRSVIIGSANINERSMRGLRDSEVAAVVRDKEMVKSKFSPQGWKIRV

SEQ ID NO: 17900 - protein, 200 aa, Candida albicans
IVISKSVPEIWRLQNRDDDDSLFDNSSVAQQQMHENENKFFPHLKITLENRERKLVMLPKSQREHSLWIDSLRIMQNLTIWSQNKRFDSFAPVRENCFAQWFVDARDYFWAVSTALEMAKDTIMIHDWWLSPELYLRRPANGNQQYRIDRLLQRKAKEGVKIFVIIYRNVGTTVATDSLYTKHSILSLDVENIDLIRSPF

SEQ ID NO: 17901 - protein, 285 aa, Candida albicans
QVCPLGAPAINLMASCLLEDEHGITRAPLLLSVLGFKLSDVTPKETSRNRRFRIDLEYGIDKHRMKWSIERNATDLAYLAYKLERTRIVSRVVGNKSQPLPRLPIPPIRKLDNKRSKKTKSVLSDLRARDDRMSVPDINDNHSLSPVPSALSRVRLRLGSITSVGSLEKHPELLELRRKKNAQFMKDVESYLKELIEITELKTLANILFTFFELSPLSSLLSYESGYTGKQGPVHIGGTAKAQGWRVGHFKVNDLKGIYERRVEKWMLVRNSYITFVSVIKSITR

SEQ ID NO: 17902 - protein, 530 aa, Candida albicans
LELSTYMSEENPPQQDQQAPNVSDKPQGDLLITPRETHFHNVFVKYLIMLISAVGSVIYTTVLCTGSILNHWFDIVTGREKTVLADIEQRSHGYVPREPYDELSKMKPTSDLQYYLQQLNLDLQEYRVTTCDGYILTLHRIIDPRELEEQRQQRKPVLLQHGLLSCSGTWIVSGKNSLGYYFHEQGYDVWMGNNRSWFIPQHKTLSGSLYNNEQYWDWGVQELAYHDLPALISTVLANKKYFQKLVLLGHLQGGLQSFLMLKNPRLGEIHEKVELFCPLAPAVYPGKLFYTRQFIKFINNRSEFMWLILFGCCAFLRNLCLVRHYIASSWLFGKLSYYMFKYLFGWTGRNWGPYKKVWHFCFIFNMSYASVELMKYYLSKHSDCGFTTLLQPKAAYSSDAHFTENVTDDKKSYFQFDTTWFSGIKVPMIVFIGDEDFLVDGEKVVAHMRKYEPGYREGSNFEAVSIPTYNHLDIVWAEDVIGTIGYTICNKLKQMKARDVQEGLTLESKEQAVTIPEGSSGHHQQQEEWV

SEQ ID NO: 17903 - protein, 413 aa, Candida albicans
TNTFPEKIFFYCFVINHLFSLFLPTMKVNLKLIIGSILISQAQAIWPFDSSGSSSSLDSSPSETGSSGGTFPFDLFGSGSSLTQSSSAQASSTKSTSDSASSTDSSLFSSSNSGSSWYQTFLDGDSGDQKTDYAPFNLTCPSKKTFIRTASELSQQEKDYIHKRQETTNKNLIDFLSKRANLSDFDAKSFINDNAPNHNITIGLSFSGGGYRAMLAGAGQILGLDGRYEDANNHGLGGLLDSSTYVVGLSGGNWLVGLLALNDWLSVGDIVNGKSTIWQLQDSILNPSGMRIDKTIAYYYGLAQAVQAKEDAGFQTSVTDTWGRALSYQFFEEDDSGTGGANITWSSIRNLSSFQDHLMPYPIVVANGRTPGTYIINENSTIFEISPYELGSWDPSLKSFSDIQYLGSSVNNG

SEQ ID NO: 17904 - protein, 61 aa, Candida albicans
LPKDTLYLCDGGEDLQNVPFYPLIQNEGGVDIILAFDISGDNNSSGPQRYFDTGNLQTTIF

SEQ ID NO: 17905 - protein, 610 aa, Candida albicans
EMLVWQSILLFLVGCVLSKSPTNLYTPGYVQCPEGKLTRSSLDGINSNEKAYIDRRYANAKSELSKFLHNAKIVDFDVDGFLETANPTIGLAFGGGGYRAMLVGAGELLALDSRATNPSVLSGILQSSSYIVGLSGGSWLVGSLASNDLIPVDQLLREDKLWDIQNSLVAYYGVNIVRNTAMWGNINLQVQTKQLAGFTVSITDVYGRALSHQLLTNFDNQGASFLWSDVTETTSFQNNEMPYPILTALGREPNTVLMNFNSTVFELTPYEVGSWDPSLRSFVDTKYIGTRLDDGAPVSKRCVNGFDNAGFFMGTSSSLFNIVLQQLNNMPIPPFLKELISKFTLDPVEKLNIDIAQYNPNPFHKSNNSDTKIAQSRTLYLADGGEDGQNVPLLPLIHRKVSAIFAFDQSADKNNWPDGSALIKTFERQFSSQGDGIAFPYVPDQNTFRNLNLTSKPTFFGCDAQNLTSLTENIYDVPVVIYLANRPFTYFSNTSTFKLKYSDTERQGMISNGYDVASRLNGKLDNEWAACVGCAIIRREQERLGIEQTEQCKKCFENYCWDGTIYKGEPLGDNFSDEGLTTSAADYNLNNVAGINDGGIALVKRDDLSN

SEQ ID NO: 17906 - protein, 637 aa, Candida albicans
LTPQIMELLNIIVVLFLSIYTNPIIAWSPTDSYAPGEIQCPSNSSLTRNADSLSPQEQEWLKGRSPIANENLISFLNSANMTDFDPESFINGLNRSIKIGLSFSGGGYRAMLNGAGQLAALDNRTRGGFESGLGGLLQASTYLVGLSGGNWMVGTIAYNNFTSVQHILDQDSIWDLSHSIMNPGGWNIKKTYNYYKNISDALDDKRNAGFDVSITDTWGRALSHQFFPGLDDGGDALTWSTLQDVDVFKNYEMPFPIVVADGRTPGTYVISGNSTVFEFNPFEMGSWDPAVYQFSQVKYLGTEVKDGKPSLNGKCIGGFDNAGFIMGTSSSLFNQFILQINTTSLSSTIKSLLTSILQDLSNDDNDIAVYKPNPFKDSDVAGSKSIASNDTLYLCDGGEDLQNIPLYPLLQEQRQVDVIFAYDNSADTNQYWPNGASMVASYQRQFGNQSNGTSFPYVPDVATFVNSNLTAKPTFFGCDAKNLTSLTTTQNKTSVYDIPLLVYTANRPFSYWSNTSTFQMKYETKERNAIIQNGFEVATRMNLTLDNEWKACVGCAIIRRQQERQGLEQSDQCKKCFEKYCWDGKLTTNADAININFTTEGTTNDTESMKVNSGVLTSVSWSLWAMMLAALSVFILG

SEQ ID NO: 17907 - protein, 208 aa, Candida albicans
GRDRGDKLVFFGCNCSDLEDLVAWHENDKINVTDVPLVVYTSNTRMSYNSNFSTFKLSYSDQEKFGAIRNGFETVTRYNLTDDENWSTCVGCAIIRRQQERLGEEQSDECKKCFQEYCWTGGFKDAASVSSVSGISGLAAKTHTSGGTFSTTQQTSTTTGSSSNGVLRKRGSSSSSKKKNGGDLVNGGVLSSIFLVFNSLLGLIIAYL

SEQ ID NO: 17908 - protein, 329 aa, Candida albicans
  UNSURE (1): Identity of amino acid sequences at the above locations are unknown.
XQKYLHFYKELLIEVRDKKKAGFHTSFTDYWGRALVRRIFKSTARTPGATISAATHVLTSFKEYDQPFPIIGTIEKDPSNPEFSTNFESHCFEFTPFEFGSWDSYLHAFIPIKYLGTSLKANVPTKKSTTANHSYCVSGFDNVGFITGTSSSLFNHVFFSVYKLLESYELDAVSLIETTLKSLGLSSEWKALKNPKLHADYALYSPNPFFQYGKKNTSIWESPDLYLVDGGDDGQNIPFHPFLNVARNVDIILAYDMSNERDNYPNGTVLARTSQRYKHTNNTNIEIPYFRLPDGIINKPIIKSIFSKVPTPKKFITHGIEQVSNISWL

SEQ ID NO: 17909 - protein, 528 aa, Candida albicans
IRCEHTPIQILVLHFSGGGYRPMLIGAGEISSLDSGTKTNTPVLAGILQASSYIAGLSGGSWLVGSLASNNLNSVDDMLSQGLWELTHSFLSYYGIEHPIKQVEEWVNVGNQVASKRNANFNVSLTDIYGRLLSYPLLTNTEDEGDAYLWSDVTSASNFQSHQMPFPILISDGRAPDTTIINLNSTVIELTPYEFGSWDPSLNEFVDTRYLGTKLDNGRPTGKCYNGFDNAGFFMGTSSALFNEAVLSITEANIPSFLKDIIDDILVDPILKSNIDVSAYNPNPFFKSSGSNTAISQSKNLYLVDGGEDAQNIPISPWLHRNVSDIFAFDNSNDVLNWPDGTSLVKTYERQFSSQGNGIAFPYVPDQYTFRNLNLTSKPTFFGCDAKNLTSLTKDIYDVPLVIYLANRPFTYWSNTSTFKLTYDDNERQGMISNGFEIATRSSGSLDDEWAACVGCAIIRREQERQGIEQTEQCKRCFENYCWDGTIYKGEPLGENFSDDGLTNSATEYNLNNVAGFNDGGTLILKKA

SEQ ID NO: 17910 - protein, 203 aa, Candida albicans
QTMKNQTLCQEELHYITQRNAKTEISLKSLLYRNRIPNFDIETFWSIKTKPIQIALAISGGGYRSMLTGAGVILALDDRYPNSSLCLNGLLQSTSYIAGISGGSWLVMSNFINDFEPIHKLQNLIPEEWDLSELLLQGVPNFDTSDLQKTPLQQQQQQQRNKYKSKKQGMFSSILDLFTSMKSASTSSSTSSSTSSRGSSTGS

SEQ ID NO: 17911 - protein, 713 aa, Candida albicans
LSFLINLNIKIMNLLISLLLLSISLVLGSSPSGGYAPGIVQCPINSNSNSSSSSSRNTTFSFIREADSISDLEKQWIKQRQLKVNKSLIEFLKSANLSNFNPQNFIDAKDYQGINLGLAFSGGSYRAMLNGAGQLMALDSRSSSSPSESGSGSGSLGGILQSANYIGGLSGSSWLLGSLAMQGWPTVEEVVFENPHDVWNLTSSRQLVNQTGLWTIVFPVMFDNMNKALSHMNFWDNNADGIKFDLEAKEKAGFETSLTDAWARGLAHQLFPKGKDNYGSSETWSDIRNIDAFANHDMPFPFVTGLGRKPGTTVYNLNSTVIEMNPFEFGSFDPSLNTFTDIKYLGTNVSNGVPVDLCVNGFDNSGFIVGSSSSLFNLFLNTLVCDNCNSLNSVIKWILKKFLTYLSKAHEDVALYKPNPFFNSQYAKSDNITTSDTLYVIDGGIGGEVIPLSTLMVKERALDIVFAFDSDTNTKTNWPDGSALISSYERQFSQQGSSSICPYVPDTKTFLEKGLTAKPTFFGCDAKNLTALEKDGVIPPLVVYFANRPYEYYSNVSTFDLTFTDEQKKGLIKNGFDVATRLNGTIDPEFKSCIACAVIRREEERRGIEQLDQCKKCFKNYCWDGTYASGPAENYVNFTDSSLTNGSTVFYGKADAKVSSSKGGLFGFLKRDTQNNDEKEEFIGVVRESNSDSLTLSKYLTIASLFTLYLVIM

SEQ ID NO: 17912 - protein, 101 aa, Candida albicans
ISLYSLFAADKKPLRILRNGCFKYFQRGGECVNGPIGLLSGMLPFPMLLFNHFFSVAFYSVYLNFIERGLLGFPLALFEAFEVLFTAIVIFTPYLWNEIVR

SEQ ID NO: 17913 - protein, 84 aa, Candida albicans
ETLVVRSAWALIGLILGNYPDEEPIKRGIQFLMKRQLPTGEWKYEDIEGVFNHSCAIEYPSYRFLFPIKALGLYKNKYGDKVLV

SEQ ID NO: 17914 - protein, 249 aa, Candida albicans
KVQCLEQLDSKVLFILARMEILEPYRVEMIRYIVNTAHPVDGGWGLHSVDKYTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTECLHHGAGRYRAY

SEQ ID NO: 17915 - protein, 406 aa, Candida albicans
  UNSURE (403): Identity of amino acid sequences at the above locations are unknown.
NSSIQKDIYYSLPNPIFFHHLLSNLFHIKPPIYTMGKFLQLLSHPIELKAVIQLFGFRQPLHPGKRDVNDKELVRCYELLNLTSRSFAAVIEELHPELRDAVMIFYLVLRALDTIEDDMTIKSSIKIPLLREFDTKLNTKNWTFDGNGPNEKDRTVLVEFDKILNVYHRLKPQYQDIIKSITFKMGNGMADYILDEEFNVNGVATVEDYNLYCHYVAGLVGEGLTNLFVLANFGDKTLTENNFAKADSMGLFLQKTNIIRDYHEDLQDGRSFWPREIWSKYTENLQDFHKVKTPAKEFAGVSCINELVLNALGHVTDCLDYLSLVKDPSSFSFCAIPQVMAVATLAEVYNNPKVLHGVVKIRKGTTCRLILESRTLPGVVKIFKEYIQVTNHQSSVSVHQPVXGHC

SEQ ID NO: 17916 - protein, 407 aa, Candida albicans
  UNSURE (28): Identity of amino acid sequences at the above locations are unknown.
SRANTRCPSKGNLPSPGTRVNPDARGEXMPFLPRQPIPSLQHNQLPITKNQLIHFTMSDKLAARERFLDVFEDLVEELKQILVSYNMPQEAIEWFVRSLNYNTPGGKLNRGLSVVDTFAILNNTTSDKLNDTEYKKVALLGWAIELLQAYFLVADDMMDQSKTRRGQPCWYLVEGVNNIAINDSFMLEGAIYILLKKHFRQDPYYVDLLDLFHEVTFQTELGQLLDLITADEEIVDLDKFSLEKHSFIVIFKTAYYSFYLPVALAMYMSGINDEKDLKQVRDILIPLGEYFQIQDDYLDCFGTPEQIGKIGTDIKDNKCSWVINQALLIATPEQRQLLDDNYGKKDDESEQKCKDLFKQLGIEKIYHDYEESIVAKLRKQIDQIDESRGLKKDVLTAFLGKVYKRSK

SEQ ID NO: 17917 - protein, 313 aa, Candida albicans
  UNSURE (1),(23): Identity of amino acid sequences at the above locations are unknown.
XMDGFGTRSSHIQRSFPFKLLDXLGLQHIQTAFVGTSLFIRFRTITGDAMGMDMISKGVEYSLKYMVEECGWDDMEIVSVSGNYCTDKKPAAINWIEGRGKSIVAAARIPADVVTKVLKSDVDALVELNISKNLVGSAMAGSVGGFNAHAANLVTAVYLACGQDPAQNVESSNCITLMEKDKETGDLNVSVSMPSIEVGTIGGGTILEPQGAMLDLLGVRGPHPTNPGANAQQLAKIVASAVLAAELSLCSALAAGHLVQSHMQHNRSKAPAAGATTTTTPAITDSKASNGSIASNGKDLKRLEEGSVTCIKS

SEQ ID NO: 17918 - protein, 338 aa, Candida albicans
LDLNIKYQLLLLLPILQQHHPEDVPHVVGKAESSHCLSMLRDHLVVIGGLLSCAIYAHHLTGLRNFCILSSLILSFDLILVYTFFSAILGLKVEINRARRTEDLQNALEEEGISSLVAARVAEQSATIEHPNEHNFFKSNNSSIAYFKVIMSLGFFAFHAFWLGSSWLYSTTDGGESFSRFSFLSNIPTLSQDISQQIPIGRKGTVVTILPTIFFMPSGFMVQLEDFIYLVLSKFSSAIRDSIISKFLVFGFALSIVTNVYFLNAARYQVSATHKLIEKEISRPQDSSVTATTTTTATGTTSSGAATSKAIGNNKGLKSVQEIPDNEDDFQQPVADHS

SEQ ID NO: 17919 - protein, 289 aa, Candida albicans
LERSIMLSFLTEVTGAIAQTSARRPIQFMVVPALLASIAYLSIIDDYIPEHIKSSSGSSGISYYHPYTSSHYKSQPDLDKWTAIDKEHINDDIYTQANQISVIPLRFRRFQDVVPNVPNAIHISDNEQILIVPTDQIENSLDQLQEITNNGITWKARNNDKLAKYYDYIRYGLNKVQDAIQHAENFDILLIFVAYLGMWYALIKVFVDMRKIGSKFWLAFSTLTSSTFAFLLALLVSNKFLHTKVSLLSLSEGIPFLVSVIGFKHKVSIATIVANSSTASPRRCPSCCW

SEQ ID NO: 17920 - protein, 133 aa, Candida albicans
  UNSURE (4): Identity of amino acid sequences at the above locations are unknown.
EETXVLRKLVNINHGLLVALGVSHPALETVKIIGDKHRIGATKLTGAGGGGCAITLVNDDVEESVIHNAIKEFEDSGYESFETSLGGKGVGILFHEDLDDATKFSESQICNYVDRAAIEDSLGMANVKEWKFW

SEQ ID NO: 17921 - protein, 217 aa, Candida albicans
LMSQLPFIVGAPGKVIIFGEHAAVYGKPAIAAALSLRCYLLVSPSSDSNTIRLQFPDIKLDHSWNIKDLPWEEIKPYLTYDSANKPQIPSELVPEIVDKLSSFLNGFDNKMHYYACFCFLYLLMNLCDSKVSGMNFIVRSTLPIGAGLGSSASTSVCLSSALALMGGWINKPLLHENDKLDTADIPDLEFIDKWSLIGEKCFHGNPSGIDNAVATFG

SEQ ID NO: 17922 - protein, 409 aa, Candida albicans
  UNSURE (398): Identity of amino acid sequences at the above locations are unknown.
ERWSFQPRGEDKAFSAPGKAFLAGGYLVLEPIYDAYVTALSSRMHAVITPKGTSLKESRIKISSPQFANGEWEYHISSNTEKPKEVQSRINPFLEATIFIVLAYIQPTEPFDLEIIIYSDPGYHSQEDTETKTSSNGEKTFLYHSRAITEVEKTGLGSSAGLVSVVATSLLSHFIPSVISTNKDILHNVAQIAHCYAQKKIGSGFDVATAIYGLIVYRRFQPALINDVFQVLESDPEKFPTELKKLIESNWEFKHERCTLPYGIKLLMGDVKGGSETPKLVSRVLQWKKEKPEESSVVYDQLNSANLQFMKELREMREKYDSDPETYIKELDHSVEPLTVAIKNIRKGLQALTQKSEVPIEPDVQTQLLDRCQEIPGCVGGVVPGAGGYDAIAVLMWXNQVGNFKQKTP

SEQ ID NO: 17923 - protein, 255 aa, Candida albicans
  UNSURE (254): Identity of amino acid sequences at the above locations are unknown.
IPTSEYSFRSEHFFFSDHQLAMSKAFSAPGKAFLAGGYLVLEPIYDAYVTALSSRMHAVITPKGTSLKESRIKISSPQFANGEWEYHISSNTEKPKEVQSRINPFLEATIFIVLAYIQPTEAFDLEIIIYSDPGYHSQEDTETKTSSNGEKTFLYHSRAITEVEKTGLGSSAGLVSVVATSLLSHFIPNVISTNKDILHNVAQIAHCYAQKKIGSGFDVATAIYGLIVYRRFQPALINDVFQVLEFDPDDLPRXL

SEQ ID NO: 17924 - protein, 349 aa, Candida albicans
TLKYWGKRDKSLNLPTNSSISVTLSQDDLRTLTTASASESFEKDQLWLNGKLESLDTPRTQACLADLRKLRASIEQSPDTPKLSQMKLHIVSENNFPTAAGLASSAAGFAALVSAIAKLYELPQDMSELSKIARKGSGSACRSLFGGFVAWEMGTLPDGQESKAVEIAPLEHWPSLRAVILVVSDDRKDTPSTTGMQSTVATSDLFAHRIAEVVPQRFEAMKKAILDKDFPKFAELTMKDSNSFHAVCLDSYPPIFYLNDTSKKIIKMVETINQQEVVAAYTFDAGPNAVIYYDEANQDKVLSLLYKHFGHVPGWKTHYTAETPVAGVSRIIQTSIGPGPQETSESLTK

SEQ ID NO: 17925 - protein, 61 aa, Candida albicans
NYNEVKDFKYVSADELKVMFEDDSLVFTPWFKLICQSLLFKWWDNLDNLDQFKDEEIHRLL

SEQ ID NO: 17926 - protein, 181 aa, Candida albicans
FPRKCSLIRLLRGEDSESSDSDLFDGHDEEQIRLMEELCIVLDYDDKPVGAGTKKLCHIMDNINAGLLHRAFSVFLFNEDGKLLLQQRADEKITFANMWTNTCCSHPLCVPSELGVDSSLEGAKDVYNLTNAVKGAKVAAQRQLEHELGIPFEDAPIENFTYLTRIHYKSPSGDESSQWGE

SEQ ID NO: 17927 - protein, 154 aa, Candida albicans
RQSGNRKMSLLDDPNARAGTSTTVSNDPYSGSKFLVWQVAPRPKVPFNLTAFAVTLNGLDDKLKPWLPPTDTRLRPDQRDMEEGLYDRAADEKHRVEVKQRQARKQREDNKETYVPNWFVKRKHPVTGDMFWEYNGKYWPRRKAQDLANTGDIF

SEQ ID NO: 17928 - protein, 230 aa, Candida albicans
KLPATVLIVNDIFAYLCGITFGRTQLIEISPKKTVEGFVGAWICTGIAGVIASHILSKSDYMICPAQNLSTHLYNFPHCDLNPIYIPQVYQLPANIVELTGHELITFKPFYFHAAILATFASLIAPFGGFFASGLKRAFGIKDFGDTIPGHGGITDRFDCQFLMGSFTYLYYHTFVSNQNVNLGHVLQLAIMNLSVPQLLQLIKSLLKYLNREEVLTSEQLLRIFDILEN

SEQ ID NO: 17929 - protein, 245 aa, Candida albicans
  UNSURE (4): Identity of amino acid sequences at the above locations are unknown.
YRLXYSYIMISNGKDTSLKQVEAEVSTKSTSITPTKNELFNSTSKPTPTNDKSTEQTKEQLVVNEKEKKKQAFVTRTIWTFVMIGGFFAILASGHLALIIMVSVFQMLTFKEVIALTSEPARDKKIPWNRSLNWYFLGTTWYYLDFPALFDFFQESVYSSKFLTLLVKNHKFISYSLYIAGFVFFVWTLKKGYYRFQFAQFCVTHMTLLLVVFQDHLIIDNILQGIICFFLPATLVFSPGGRDPT

SEQ ID NO: 17930 - protein, 89 aa, Candida albicans
RQRGPLSIPNPKQFVTSTLNGVGRRNGAQERFATSTPYWTHALMHFAIDNTVGVYSKIANKLNLQMHQSIRRRALKKAARLAAAAEKKD

SEQ ID NO: 17931 - protein, 224 aa, Candida albicans
ENYLKLEKAVFDLPVTILINNVGQSHSIPVPFLKTEKKELKDIITINTTATLRITQIVAPIIVSTVENPHPKQLRGLILTMGSFGGLLPTPYLATYSGSKSFLQAWSAALAGELQADHVDVELVISYLVASAMSKIKRTSLSIPNPKQFVTSTLNGVGRRNGAQERFATSTPYWTHALMHFAIDNTVGVYSKIANKLNLQMHQSIRQRALKKAARLAAVAEKKD

SEQ ID NO: 17932 - protein, 249 aa, Candida albicans
LQRHWWAMKKKKKFFACNFFFLCCSTLMIRLYPGIRPLRTGVVHFSTKQAIRSSLWTIPNVLTYTRIITTPFIGYYITTGQSTAALLLFTYSCVTDFVDGYIARKYNMKSIVGSIVDPLADKLLMTVCTVSLGYVHAIPPVIASIIIGRDVMLSFMSFYYRYKSLPAPKTFDKFISIGQIPTISVHPNMLGKINTALQMVYIGSLVYRPLVESVVSGAVYDGLGLVVGATTLASGANYLFSKSSWRYVK

SEQ ID NO: 17933 - protein, 313 aa, Candida albicans
HFIPPLIFILHTRTNKISTIMSAVSSFFTKLKFYLKSGLYGTLVAGCAIYGVLASIILRIVNKAEYAQYAVAKACYYVVSLFLGLKINIKNEKYLQNLPAIVVANHQSALDIYVLGKVFQPGYTVTSKKSLKYVPFLGWFMALSGTFFLDRSKSASAKKVLDGALTGLKNQGKALFIFPEGTRSATEDLTMLPFKKGAFHLARQAGIPIIPVVVSNTSTIFNSKRKIFNTGEINIEVLPPVSTSDWETHEDVTNACYNIRDDMIKTLKKLGNSKIPGSKPREDFYPSESEKYSETDVEIINEQTPLKATAVSD

SEQ ID NO: 17934 - protein, 417 aa, Candida albicans
HKRGLRFRGENKVQATSDELPVNEEVKEEEVPLALTEEQEETPSIVVNEEATSSLNLDEKSSIAPPTVIENKEVEVLELDEKLVAPSDVTKIEETNNVEEGVSPLTVEELKPAAPVEPQVPGDEGLTEVQRRVNHLLQEEGSFLGYENPPRKKLSMDEDNRPKVGLWGILKSMVGKDMTRMTLPVSFNEPISLLQRLAEDIEYNSLLNTAAGYDDSTLRLIYVATFAATEYSSTIDRIAKPFNPLLGETFEYSRPDQNFRLFVEQVSHHPPISACRAESPKWDYYGENAVDSKFYGRSFDFKHLGKMFCVIRPDKGVRNKNGELVEEELYSWKKVNTAVVGIMLGNPTVDNYGKMVVENHTTGDIITVDLKQRGWRASSAYQLSGHALDRDGVAQWAMGGHWNSKIFAKKIVNGNIN

SEQ ID NO: 17935 - protein, 783 aa, Candida albicans
LPANPTLQTQEIVQLKETILHYAVQVASLATIQHLVNNCEKYSLDINAQDTQGNTPLHLAASSSRLDVVKYLLLLPTINDTIVNLDRKQPVEVCKDTNIAQLMQFERAKFVEKAATNLRIYFSNRDFDNLENILIANPRASELLDINGTEPQTGNTVLHEFIKKDDLAMCDWILKHGGDPFKRDKHGKLPIDLVNSKNEALKKLLKAASKDQTIMDPVATTNNAIKTGGAPVYKGYLRKWTNFASGYKLRYFVLDHNGILSYYTNQDDTNNSCRGSLNLGYATLHLDSSEKLKFEIYGKNGLRWHLKANHPIETNRWVWTLQNAITIAKDNIKKRNLNGERRSTPSPATIELATTNETDTQHEHSNEPEKKRHRLRIPGRKKHKRISSLSSFESGDESTGELSRSSTFKNNLKDIKEGSRLTGISTTQGAPFELLSTRKTSHEDQYSYQETDNENFDYDIDDYDAGDYDSETEASVDIDQLNDSIATTRRSLQVELTSLLELMKSLQDDKLLSNDDAKVNEICVIGGNTIKGIHDLMAKYDISVDARYGKLKKNLDRQLEVNALWERSIRQLENEIAEKDSKLAHLQGQRKQLKKYFTTSSAAMAKSAGTVSPAPSNKNLSNEEKQPENKQALTEVLREEPDETQIEEVDEKLDKLLNIKERQVVEEAPQMPGALPDEVIEKYLGEDSDEDDEFFDADEFEEDGLENVELGGVAAALGAAQAKVEATSNELPANEEVKEEEVPLALTEEQEETPSIVVNEEATSSVHLDEIHLIDPPRVELKS

SEQ ID NO: 17936 - protein, 122 aa, Candida albicans
KNWDLLYMELMIIPVIPFLLFVPSKMPAVSRMLYDMGIAVVIVSYPATPLTSARARLCVSSALTKEDLDYVLAKISDIGDLVFLKFSSGIAGGCKVPGEPPRWSIEDVLATNVEDCKKPKLM

SEQ ID NO: 17937 - protein, 311 aa, Candida albicans
NYLGFAQSSGVCTDFSVKCVDDYGTSGCSPRLYCGTTDLHRQCEEVIADFVGKEDAIIVSQGYGTNANLFASIADSKTLVISDELNHASIRFGIRLSGASVKVFKHNDMNDLENLIRNQIAQGQPKTHRPWNKIIVAVEGLYSMEGNMCNLPEIVRIKDKYKCYLFVDEAHSIGALGPEGRGICDYFSVDPAIVDVLMGTLTKSFGATGGYIAGDKTLIEKLRLNYISQSYSEGVPPPVLGQIISSLKVIKGELNPGEGKERLQRIAFNSRYLRLGLKKLGFIVYGADDYPCDTIFIVCAFKNASCISYAL

SEQ ID NO: 17938 - protein, 112 aa, Candida albicans
LFLFCSKMISETMVEKNGKLYLRNIPNAPEDNRPLSERSDREYGKLTSNDYLYVSKHPLGEPLPTPIDDEPPYIILIATYINYLILIIIGHTRDFFGKIFKPKEYEHLVGKR

SEQ ID NO: 17939 - protein, 286 aa, Candida albicans
IQHYRIFEISYQFNLKINNPRSSFDIDPLHKPISNNHEQHHSGANHTIKSPQPVSQPTADPISIPQKTKTITSSTTTTTTETPKNIRRHTSPMPMPMLPRRSLDGHVGSSKLQKLTSRTDSAIALTRHSINIDRPTNRSTFGGTGSPRALPISYTHEIQRMRDSILLKRHMKKRPTEEDKVLVGNKISEGHENFVMAYNMLTGIRVAVYRCSGVMRKLTEEDFKATKKLSFNFDGSELTHSSKYDFKFKDYCPEVFRELRQIFGIDHADYLVSINGKYILSERADP

SEQ ID NO: 17940 - protein, 193 aa, Candida albicans
  UNSURE (181),(193): Identity of amino acid sequences at the above locations are unknown.
ISVLLLKPFIILNINQLLRMLKDYHHHVKDNPNTLISQFYGLHRVKMPLFGGGSRKVHFVVMNNLFPPHRDIHLKYDLKGSTWGRNTTIFPGWDEKELSKHTLKDLNWLERHQKIQFGPEKRHIFFKQLEADVKLLQKVNVMDYSLLLGIHDVKKGNTADIEKQLSVFEPKSFDKRALINXNPRDVHRQQDSX

SEQ ID NO: 17941 - protein, 336 aa, Candida albicans
SQAMSTNTIYDDHYIKMNTLFKSIYTQTKLNIYEFLFAISFLVNFILGRFIHFSAPDEEVYNYYNNKRNILNQWFVKKGWGWTTLVIILFYSNIIYKQYNSKATTNTTTTNNNNNNKQGVIVQTIRNAVINYIVVTIWWIFFTQWCFGLPIMDKIFVLTGGKCSIDTNSMAHFNPNHHHVHANFVQKLENIWESTGITSYNCRRIKGSQWIGGHDPLGHVFLMIHSSLYLFNEMINYWPGWTYIKHNISQILTSGNDNGNDNGNGNGNGTRSLSIGDKLLLLWNTPQLIIGGLIGLWWFMLLMTNIYFHMSLEKLVGLGFGYIGVAGLYWIPRWLL

SEQ ID NO: 17942 - protein, 241 aa, Candida albicans
CRQSLLSTESICHLKRIQVTIPTQPFNDKNSSTNCNNPLVSFLTYGQSHQNYHHEFPHDYRVDNSYLTYDPTKWFIWILEQLGAVDELSRTPGNLIVQLKLQQQQLIINRTKSQLNWGTPISKLPLISPSDFKKIISSTSNKDRIYIVIQNIIHDITPFMDQHPGGVALLKASHGKDATKAFYGGVYGHLTAAVNLLATMRIGVLDDGDDEEVWRRVAREEREVSNSTDSRPGHHHTAEAA

SEQ ID NO: 17943 - protein, 308 aa, Candida albicans
HFTMTTVEQLETVDITKLNAIAAGTNKKVPRVVAAGLGGKLMGTSDLVKVTAEEITKDSMESLAEKDAREKAKYANKKHISEEPWTLDNFAKKINWLNMILVVFIPVFGAYCAWNYPPQWKTLVLTFVMYAFSGISITAGYHRLYSHKSYDAALPVRLFFAFFGAGAIEGSIKWWGHSHRIHHRYTDTPRDPYDARRGFWFSHMGWMLTKANPKNRARADISDLVADWVVTFQHRHYLLLMITAAFIFPTLVAGLGWGDYWGRFIYAGILKGFAIQQATFCVNSLAHWIGVQPFDDRKPLVIMCEQHL

SEQ ID NO: 17944 - protein, 126 aa, Candida albicans
TSLVQQQQKKLDRMKNKLNWGAEIEKLPVWTREEFNERAKQEGLIIISGIIHNVKNFIKEHPGGQALVRASLGKDATKAFNGAVYAHSNAAHNLLATMRVAVVKDGEVNADTFDLQEQMMEKEKQS

SEQ ID NO: 17945 - protein, 264 aa, Candida albicans
LNDLFSKWVEYGIPSFGNWAFFTGFILIQALFYVTLPGVWTKGQPLTHLNNKQLPYFCNAIWSFYTSIVLLLVLHFTGVLPVYYMLDNVGGIMTTAIFYGISLSIILYLICIFVTGDYHRMTGNHIYDMFMGAPLNPRIGKYLDLKMFFEVRIPWFILFFLSFGLCFKQYETYGYVTPQACFMLYAHWLYANACAKGEELIVPTWDMAYEKFRFMLLFWNIAGVPFSYCQCILYIAYQETEISQWSIGYNVSWFVLITNAYYFF

SEQ ID NO: 17946 - protein, 300 aa, Candida albicans
VGSRPLVKIFKGDLTSDKDVSDAINQSKCDVIVHSASPMHGLPQEIYEKVNVQGTKNLLSVAQKLHVKALVYTSSAGVIFNGQDVINADETWPYPEVHMDGYNETKAAAEEAVMKANDNDQLRTVCLRPAGIFGPGDRQLVPGLRASAKLGQLKYQLGDNNNLFDWTYVGNVADAHVLAAQKILDKSTRDDISGQTFFITNDSPTYFWTLARTVWKNDGYIDKYYIKLPYPVALTLGYISEFVAKNILKKEPGITPFRVKVVCAIRYHNIAKAKKLLGYKPEVDLETGINYTLDWMNEDL

SEQ ID NO: 17947 - protein, 215 aa, Candida albicans
STNHMIGHAGAMLQARQLGKELYVGVHSDEEILANKGPTVIKLDERITAVEACKWTTKAIANAPYVTDPKFMDEYGCPYVVHGDDITTDANGEDCYQVVKDMGRFVVVKRTPNISTTDLVGRMLLMSKDHHYPAILRTTESLLTKDNLDRFKRYATDETGLNPGSGVYLNRGELEEIVSPKAEIGDIVYIDGGFDFFPPGTYGDNSKWNNQRPQS

SEQ ID NO: 17948 - protein, 319 aa, Candida albicans
GSLPRPPGENRIKLYGLYKQATEGDVDGVMLRPVGFTAEDEGAKKKWDAWKREQGLSKTEAKKRYVSYLIETMRVYASGTLEARELLNELEYLWEQIKDLPSSDEETDHHHIPLPSRSPTFSQTDRFSNRTPSITGARTTGTSNLNNIYSHSRRNTTLSLNEYVQQQRMQHQNQQQLHDTTSQPGAPVGGGGGGGGSIYSLPGRMGANNVIEDFKNWQSEVNMVINKLTREFFNSRREVQGNENGDPSTGDRDEELDDVEIIKRRIIHILKFVGWNALKFLKNFAVSLITFMFIVWCIKKNVHVERTYVKQPTNNANKL

SEQ ID NO: 17949 - protein, 77 aa, Candida albicans
ANQVSNLSKRPSDDELLKLYGLYKQATVGDNNTDKPGTFDFKGKYKWQAWKDLEGKSQEDAEKEYIDLATELISKYN

SEQ ID NO: 17950 - protein, 307 aa, Candida albicans
SIQFIYLFVCLKFIMSSISNVYHDYSSFLNATTFSQVYQNFNQLDNLNVFEKLWGSYYYYMANDLFATGLLFFLTHEIFYFGRCLPWAIIDRIPYFRKWKIQDEKIPSDKEQWECLKSVLTSHFLVEAFPIWFFHPLCQKIGISYQVPFPKITDMLIQWAVFFVLEDTWHYWFHRGLHYGVFYRYIHRRHHRYAAPFGLAAEYAHPVEVALLGLGTVGIPIVWCLITGNLHLFTVSIWIILRLFQAVDAHSGYEFPWSLHNFLPFWAGADHHDEHHHYFIGGYSSSFRWWDFILDTEAGPKANQGRE

SEQ ID NO: 17951 - protein, 322 aa, Candida albicans
KMEVLHQLTTNHTSNLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSQASAESKHKKTL

SEQ ID NO: 17952 - protein, 105 aa, Candida albicans
IPSMLLFKNMPPPHLFTLTFLIVLRLFQAVDSHSGYDFPWSLNKFFPLWAGAAHHDEHHHYFIGNYASSFTLWDWLFQTECGTYARKRRERNSRGSAESKHKKTL

SEQ ID NO: 17953 - protein, 219 aa, Candida albicans
GWVKKAILLKRVGLKFTIIGTPVSVSWTSPTENHSVRDWIGLYKIVQTSYSRNKTILSSAGRWTWCKEPKGSFIFDKEKLFWEEGVYEFRYHLDSKHDVAYISEPFEIKSIELKVPEFKEDAIKFAENLKLEIFDKVIKLTDISEAISPIANQSDNVIEVYKLISSMISKSTKINITYKIFLNQGDDDLLSIKDVAIKLINIKHVLEELSYNITDKKDV

SEQ ID NO: 17954 - protein, 224 aa, Candida albicans
  UNSURE (224): Identity of amino acid sequences at the above locations are unknown.
IFHLKIFFFFFELLMTFTINNTNSTVFDSTNNENMTISEPVQPVLKGPKGITFSGETFIVPETHDMVKTLFDPTVKKSNFELIILSCLFSNLLVFLIPNNQIRIYIFIALYIFWRLSYNFGIGWLLQNQSNHNLLVSWSQKYHLFDPENKGALAQSIQNEIKSQRGENYDIKSMPVEFNTWLIFRKFVDLILMLDFITFCCVVYCSAIKDDYQFINNQSFWLVX

SEQ ID NO: 17955 - protein, 371 aa, Candida albicans
LKTRTEATNKVVKDTYLAKKVVGTQLDLKKFKAMSLSLQLHDQKYIGKYAPKLKIRVRFETYTELRKKFWRVLLEESNSTPENRDSCDYIELISLLDTLGCVNSDELVELFYSNLGKLSWGGDLLTFDEIIDQMETYVNQNVESGKVKIFEFEKCPICNEKRVSKKQDLDIITHFAICASKDWSVVGKLLLSSYVTPTQATKKWFTKALIKLTYGKYKLGGNSANILVQDRMTGIIVEEKMSVYVRLGIRLLYKGLDKARSKRVRILLKNMSIKQGKKFDAPQLKSDIASFIKFHKLDLDECEIDDPSQFATFNDFFYRKLKPGAREIEDEKNSKIVTSPADCRSVVFESIDKATQLWIKRCRVYYTQIDS

SEQ ID NO: 17956 - protein, 239 aa, Candida albicans
KGAGFTIPKLIHNDHLMRVSSYTLGIFRLAPQDYHRFHSPVDGVIESIKHIDGEYYTVNPMAIRSELDVFGENVRTIVTIKTKDFGNIYFIAVGAMMVGSIVLTKDTGYEISKGEELGYFKFGGSTVLLLIESEKFKFDTDLVKNSSSGLETLLRVGQSIGHSPDVEEYKRDHISFDKLDKSKQLRLIRVLTGGDLKDKHKLSNWEATKIDMEDFQEIEDEEIFNKDMPDEDASIKSED

SEQ ID NO: 17957 - protein, 192 aa, Candida albicans
DAVLPGRGEDFSDASFLSDGGYASDASANLFDQKETSSDLKKSRIKSKMRLRRSKQEYENFELASRQVLGVVFIEIVSCEDLPPYKNFTRTSFDMDPFVVVSFGKKTFRTGWKRHTLNPVFNERLAFELLPHESNFSIQFLVLDKDHFSFHDNVAHISLPLRTLTEYATAKPTEGDSSDVNTSDSTSFSQTG

SEQ ID NO: 17958 - protein, 458 aa, Candida albicans
NMARLTRKRTIEKELNGSSRVTRTLSMESISSLFKRNKKRKHNDGNDSSVNSSDNENINITDDEEQDHIDTKPNHKKRKIKTKAEEEFEANEKKLDEELPIDLRKYRPRGFRFNLPPEDRPIRIYADGVFDLFHLGHMKQLEQAKKSFPNVELVCGIPSDIETHKRKGLTVLTDEQRCETLMHCKWVDEVIPNAPWCVTPEFLQEHKIDYVAHDDLPYASSDSDDIYKPIKEQGKFLTTQRTEGISTSDIITKIIRDYDKYLMRNFSRGATRKELNVSWLKMNELEFKKHINDFRTYWMKNKTNINNVSRDLYFEIREFMRGKKFDFQKFIEDGNSQNSSNHGSDEESTNSSKVSSPLSDFASKYIGNRNKDLNRKGILNNFKGWINRDDHSEQETEEEIKPIVIKPIRRSRRLSGGSSTSSVPSTPVKRTASSASTTPKRKSPLKKSSSVKNTPKTK

SEQ ID NO: 17959 - protein, 484 aa, Candida albicans
  UNSURE (460): Identity of amino acid sequences at the above locations are unknown.
RIYFDPPNFKNLEYFSITPILLQCMGPNLGKSQDDQLFNKLKQFEYQNPLKTKKDDQSFISDDLVLDKINHLYRNRLLYKRFHSNRSFRALNLKKFNVFIIQNIIIPIIKFIQKMLIMMITIINYKFLNLKSGSNYDDGLSLVGVSRVFRQLDLRLKQFNYFPTQFLCYYYDKNILYSRNSLKLPIFNDNLNINNSNYINLYNSIWLIFNDILIGVTLYHMIMDNFTSIIKFIRFRVMEKYLFLELMKLITWISTENPAGFKLNTDLGKFLGDLYIWTIGFCQNIILKLDRGSQHFNYISLMSKILGLLCYYGGCSFLLSFLIDGINLITLHIYGFYYCSAKIYRRQLEIIKSLFQLFRGKKYNVLRNRIDNLNNYELDNNNNNNTTAIDGFGFDIDQLLLGTLLFMMMIFLLPTVFAFYLVFFIMHLLILMSLNLLENLQIIICFIPLFVILLKLKNSXRLQGGIKFEFIKFYQGDDNIKIIK

SEQ ID NO: 17960 - protein, 178 aa, Candida albicans
  UNSURE (168): Identity of amino acid sequences at the above locations are unknown.
EGWAHVTLGEHENEVYEMNQPNVNCRGILFGKMKMELGDHMYVKCRKTGLEADIDFKTKGFISGTYDAIEGVIKNSKTSEVLYQITGKWNEVMEIKDLKTGKKRVLVDTKSSVPVKPRVRPLEEQGQYESRKLWKPTIDALARRDHTVATEEKFAVEDEQRNLPNKRXSLRSARTKLY

SEQ ID NO: 17961 - protein, 214 aa, Candida albicans
  UNSURE (3),(4),(5),(7): Identity of amino acid sequences at the above locations are unknown.
LYXXXVXLPPKKLRRFLFFNCIQYEVKFTMGLTSKLEKLKLKELTGHEAAVKSNVVNGADTDDTDDIDEMDNEGQSILMGIIAQLRPGMDLSRITLPTFILEKKSMLERITNFFQIPDMLLKANRTSDDVERFVSVLAWYLASWHIAPKAVKKPLNPVLGETFNCYWENISDDCSAYYISEQVSHHPPKSSYFYLVPEAKIKVDGILIPKSRFL

SEQ ID NO: 17962 - protein, 845 aa, Candida albicans
NMETLEVHSKDFLIKWINAPDNSIIDWEAKPLKKSINFSFYKKKEESLNQSETSLLDTNSTAALEPPTAIAPPPQRTRSRSASTASVNQFTKSNDVYRSKSRASTLLSINESDLILIKNYNKLVANELIHGKFEVEKGGMFAFVFDNSFSKTIAKLVQFSAKIVSKSKSEEHIAQQKVVAEVHDQHLFDENDVAPGETLQSIMLKKRRKKLQGFTKRYFVLNFGRETLSYFKVDDNKLRGQMPVKDCIVSANPSSREFIIDSGMEVWHLKAINKADFNAWVNAFNTVKKEETVVPTSTTEESDSKEPVIASTPLGASNSELQLIAQKLAQLKTENPSPLANEIHQDFLNLLTRAKGQSSSSPGSADVQSVFSSDFHDAVDHFDETGVYFLDDEGKIQEDEEVADDGESSSEEEEEEDEEFVQVAPSGVHADQGIVQDKELPQPTVEADDDNLYPLPHDPVSRSSDIPICTHTPPSILSFVRKNVGKDLSTIAMPVTYNEPTTVLQKFAEMLEYPEVATNALISDFQDESGEKLLRVAAFALSYLSTQRAKERNKRKPFTPLLGETYELVREDLGFRLISEKVSHRPPVFAYHIDTEHWTLDYALSPGQKFWGKQSEVTTKGTVYLKDKSTGEVFTWTQPTTMIKNIIAGETYAEPTGSVTIKSSNGYKAVAEFAKGGMWSGRSEGVIVKAFDNRKKELTYSVEGNWTESFTLKTKSTEKTIWQAGELLPQYQKKFGFTEFAGTLNKITEMEKGKLAPTDSRNRPDLQLYEKGDTDTAETLKNKLEQDQRDRRKQLETAGEEHIPKFFKLKGNGPVDEAEWEFIQGEKSYWNTTKKGDWDDLIKLW

SEQ ID NO: 17963 - protein, 232 aa, Candida albicans
VTNTYSGIGKAIAEVLLKDPNTKVVVVARTEAPLEALANKYGSDRVDFVVGDITDSSTSEKAVKLAISKFGQLNSIIANAGVLEPVGPIESTSVDDWKRLYDINLFAVVELIKHSLPHLKKTNGKVIAVSSGAATKAYSGWYAYGSSKAALNHLILSLASDEKDVQAISIAPGVVDTEMQTDIREKFGKNMTPEGLQRFVDLHENKQLASPEEPGTVYAKLALPRMVRGIEW

SEQ ID NO: 17964 - protein, 265 aa, Candida albicans
RYVLMNKIYDVETSNLNFSTNSNKGIGKAIAEILLKTPSSKVVIVARSQAPLESFQKQHGSDRVAFVAGDITDPATSNIAVETAISKFGQLNAVIANAGVLDPIGPIENTSVDQWKQLYDINVFSVVELIKHSLPHLKKTNGKVIGVSSIAAFTAFNGWYAYGSSKAALNHLMYSLASEEKEIQAIAVAPGVVDTEMQNDIREKFGKNMKEEALQQFVDLHKNEKLVSPEEPGTVYANLALKGWSEDLNGKYLDFDDALLKDYQL

SEQ ID NO: 17965 - protein, 405 aa, Candida albicans
NIYKVKGISFILYLENPFRSLFLFDLFLCLFVSFFLSFFSLFIINILALSIIMLAKFKLPNAEVWKTFPPFDTPVPPSPFENEFLNKIYYASMNVTTPLTIAIIYFTSVHFINSIIRNKQIAKYNSKTSSESKVDITKLDDKKLQKILPTVPNSIAKTSIFKLFVFLHNVFLCLYSIWTFLGMSHTIATTMNLFEGNFLQSLVNYQPKKLDIFLHSVCDPKIGIFSRLLTNEKGLHNLEVFGWWFYISKFYEVLDTAIILLKGRPSSLLQSYHHAGAMMCMWAGIRYQSPPIWIFVVFNSFIHSLMYFYFSLSCLKIRIPNFFKRILTTMQITQFIVGGSIAILHSFVWIVDTSHVISPDNLKWVICINTPNQALPILINVLYLLPLTALFTAFYIESYLKKKSA

SEQ ID NO: 17966 - protein, 106 aa, Candida albicans
  UNSURE (6),(106): Identity of amino acid sequences at the above locations are unknown.
FNILGXKFPQYIDLKGKLFGNDIIQNQLIYSIICISFNPIFWNIVARLEYKTHFLTKICFNSAKLGCYVLAITIFSLGIYRDHVYYQALETQPTYQPFAPPPPPPX

SEQ ID NO: 17967 - protein, 338 aa, Candida albicans
WIQAELVSRELIPSSSFIGTNSGHDALEDVSRFFFGEHDTEKMFETLEPLHQMLQKDQETMREQPFAIAFGRELTDAYEWVLNFRSTRDITNLNQAWDIYYNVFRRVSKQVQLLASLELQYVSPDLKHAQDLELAVPGTYQAGKPVIRIIKFDPTFSIISSKQRPRKLSCRGSDGKDYQYALKGHEDIRQDNLVMQLFGLVNTLLVNDPECFKRHLDIQQYPAIPLSPKVGLLGWVPNSDTFHVLIKGYRESRNIMLNIEHRLLLQMAPDYDFLTLLQKVEVFTSAMDNCKGQDLYKVLWLKSKSSEAWLDRTTTYTRSLAVMSMVGYISGLGDTHPL

SEQ ID NO: 17968 - protein, 284 aa, Candida albicans
MKFGPNGVNFPYQTRVPEIRLARSEMLDYRAGNFDPQFSQPNNVSLLFIALNDEVFGVRKVAIQILGRLSCINPAYIVPSLRKTLIQLLSKLEYSTTSRKKEESAILLSLLISNSKELTRPYVKPIVDALLPKAKDLSSSVASSAIKCLGELSVVGGEDLKPFIPDLMPLILDTFQDQSSSYKRDAALRTLGQLAFSSGYVIQPLLDYPQLLGMLVAILKLETSPDIKRETVRLLGILGALDPYKHREVEQNSKNIPVEQNAPPVDVALLMQGSLHHGAGRTRD

SEQ ID NO: 17969 - protein, 183 aa, Candida albicans
SMSASASTSAQLQVVDGVALTEIFKGLTSTSEEERSKYAVELHNYLSSIARDLSSEQFNRYNNDINKTIFDLLHGEKTSEILGGIAALNALIEFDSGVGKENAGKTARFSNYLGSLILCNDLVIMKQAIRTLGKLATLGGNLTGDFVDFEAKRAIEWLQSDSKQHENRRHALSVFTTGVADTP

SEQ ID NO: 17970 - protein, 201 aa, Candida albicans
  UNSURE (199): Identity of amino acid sequences at the above locations are unknown.
TAYRYFQAGLNMMLDRISGKVIHIDFGDCFEAAILREKYPERVPFRLTRMLNYAMEVSGIEGSFRITCEHVMRVLRDNKESLMAILEAFAYDPLINWGFDFPTKALAESTGIRVPQVNTAELLRRGQIDEKEAVRLQKQNELEIRNARAALVLKRITDKLTGNDIKRLRGLDVPTQVDKSIQQATSVENLCQHYIGWCXVW

SEQ ID NO: 17971 - protein, 360 aa, Candida albicans
KFIQRTCTFLSLKFQVINMGLTAKLDKLKLKTTSEDIEDDSGHAKPDNSDDIDEVDSEYQNILLSIIAQLRPGMDLSKITLPTFILEKKSMLERITNFFQIPKLLIDSNSIEDPLDRFIGVLRWYLASWHISPKAVKKPLNPVLGEVFTCYWDELPNNKSAYYLSEQISHHPPKSSYFYIMPEEKIRVDGVVIPKSRFLGNSSAAIMEGCGYVTLGKWDNEVYVMNQPNVYVRGILFGKMRTELGDHMYVKCERNGLEANIEFKTKGFIYGTYDAIEGIIKDSETQKELFQISGKWNEVMYIKNIKTGKKEVLYDTRGSKTLKPKVRPLEEQWDFESRKLWKPTIAGLAKRTTNLQQKRN

SEQ ID NO: 17972 - protein, 108 aa, Candida albicans
TLETNNCWFGEKNHELATEEKLNVENEQRIKAKKRIEDGVEFHPKFFREVNENDNGVKNLEYVIYKEFDLKGDPEVLRERLLTVAPIVPGQKFDEKFHYPAFKKPESN

SEQ ID NO: 17973 - protein, 373 aa, Candida albicans
VQSFFLSFGFGLANFTTMDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRTDDSWFVKDAEAHED

SEQ ID NO: 17974 - protein, 641 aa, Candida albicans
GLTTFKLILVVVVVIAVVLMVVEEEGVTFINNNNWSKRAKKKKISPNNLIKKFKSLSFIYTLYTSPPQFMMEISPANIKEQSRSRSRSRTRNSTANSRSTSATRRPSLSSTHRRSLSSSSLNKLTITTTQVDQERSVPSVQVYLDNSLPLDFFKQDIIALTKTLKISKWHKRQLTINNLSINRISGALTNAIYKIEYHDESQNIHLPTLLLRVYGKNVDELIDRDNELAILIKLSQKRIGPRLLGIFSNGRFEQFLDGFITLNKEQIRDEILSQMLGRRMKDLHYKIELDAKDYESKQPTCWNLIDKWLKIFEQELLPGYLEVNYNLQDIFIVPFDQFKQIITKYKQWLFNKYDDKHFTNNYKFCHNDTQYGNLLLHESFNPKDIVVSTSDTTNSSNNIIDGEVTIKSTSNKKDTNLVVIDFEYSGANFPAYDIVNHFSEWMSDYHDPEKSYFIHQENYPNQLEQINLIKSYIEYDFQYPSSNLKTGKTPEDLINNTTNPISIIQYEIEKLYNECIYWRATVQIFWCLWGLIQNGPLKKPLNSNALSEQGINSTYNITVGGIENLDISDHTQDEIAGSNNDALIEEIITSSDDDFDYLKYANQKVALIFGDLIQFGIIDEKEVDEKYLSIIKYIDTKTFDI

SEQ ID NO: 17975 - protein, 322 aa, Candida albicans
NLTFSEDPTQRSWIRSKLEKRRHYAKPIEEGSPMRSLGLGQIVQSNSSRFKPGDIVYGIILWGDYSVLEDTSLYNSIDTSLGLPLEYYLSVLGMTSLTAFFGLTEAGDLKQYLNSPPGKGPIVCVSAASGATGSVVVQIAKNLLGASKVIGISGSSEKCQWVEKLGADICVNYKDPNYQDQIEKFLGDEFIDTYFDNVGGDILSFVLTKVKKFGNVVACGSIAGYNNREALKVSNWGEITVNSLTVRGFIVTDYQEHFPKAIGILTDAVKAGKIRTDGAYHVENLHGHDLIHRLENIPKIWNKLFEDNKPNGKMITKVALDI

SEQ ID NO: 17976 - protein, 387 aa, Candida albicans
LIHNLRFNSLTMSPVQLAEKNYERDEQFTKALHGESYKKTGLSALIAKSKDAASVAAEGYFKHWDGGISKDDEEKRLNDYSQLTHHYYNLVTDFYEYGWGSSFHFSRYYKGEAFRQATARHEHFLAHKMNLNENMKVLDVGCGVGGPGREITRFTDCEIVGLNNNDYQIERANHYAKKYHLDHKLSYVKGDFMQMDFEPESFDAVYAIEATVHAPVLEGVYSEIYKVLKPGGIFGVYEWVMTDKYDETNEEHRKIAYGIEVGDGIPKMYSRKVAEQALKNVGFEIEYQKDLADVDDEIPWYYPLSGDLKFCQTFGDYLTVFRTSRIGRFITTESVGLMEKIGLAPKGSKQVTHALEDAAVNLVEGGRQKLFTPMMLYVVRKPLEKKD

SEQ ID NO: 17977 - protein, 279 aa, Candida albicans
ERRFIITEGLFANSGDIANLPRIVELKNKYKYRLFLDESLSIGVLGGTGKGLPEHYGVSRDEISITIGSMANSFASSGGFCVGVNPMVHHQRISSNAYVFSASLPPYSAKVTSQAIREILAPENLDPTTGKSKLMVQLHKKTVDVYDRLEAALEKLPMHIVSSPQSPMIHLRLREKVREQLNLPLMYGNSTFITTGKPAKLLNEFDEYLNLESFILQKVIDYVLEHEGILITRSKLILEHENLPVLPPHLLIMINIGVKEEETQSCCGGLAKNNRKCFY

SEQ ID NO: 17978 - protein, 178 aa, Candida albicans
LSMKSSKLNPVTTHKEFNGISGALGITIGLPTLTVLFYLLCNQTYSIHGINVDFAKIKSQLPITQDELWQLVFDKTCWLAYLAWFFILVILDYLLPGKSLNGVKLRDGTVLNYKINGLSMGSLLIVLLLARLFQLNSDSSLEYYLPELQFIYDNQLQLIIICFLFSFKLAVTTGRNPR

SEQ ID NO: 17979 - protein, 241 aa, Candida albicans
YQCLIMPSIDQEIPPSPTSLSPSSPSIIDKISSVKNDDNNRTKLYLIYSLDQVKIHDKPNDLWMILYNKVYDITNFTSVHPGDVEVLLDCGGADATEASEDVGHSYFAFQMLKPYLIGELQLLDKKKYESKLLSAPKIEVTSDNNNTNGITSKKGNTDNNGILTNGKHIKTKKTNNNSNNNDNITTKDIHRTGITKSKKKRRNNNKPNKIREHFRMLSLGILALVSLILFLYIQRFRWLHM

SEQ ID NO: 17980 - protein, 429 aa, Candida albicans
QWPPRLVKMLEARIGPRSDVYSEEPSLKKCQWEFEKDMENFIQIAEKIVFEYEWSRFDSLVLPSSFPYGGMEIPNMTQLTPTLISGDRTQTKVMAHELAHSWSGNLVTNSSWEHFWLNEGWTVYLERRIIGAIAAAEAKEEGRKDAEKYGEQVRHFNMINGWNELADTCETFDKRYTKLVLDLENGDPDDSFSRIPYEKGFFFLYHLETKLGGIKEFDPFIKYYFNKFKYQSLNTAQFVDTLYEFYEPKGKAEILDNIDWETWLFVSGLPEKPEFDVTLANQVYALVDKWFAYVKNGGELPGDETADFEGEQDMLFLETLTEKFKTLDVKPEIIRLFPEIYPKYGASKNGEIISRWNELLISYGKYSSQDKLVQSFASWLGTIGRMKYVRPGYLLLRKGISHEFALEVFKKYEHIYHPICRTMVKKDLS

SEQ ID NO: 17981 - protein, 119 aa, Candida albicans
YVGTHKKKCRNLCHLFFFSLLLSSLLLISTTNMTRAIVESIKKRFHELDPCTNSNYSKFKVIHTDLTLTVSFESKTLDGTVVYDLKNLDNASEVILDTSALNIKSTKFNSSPRGWKDPR

SEQ ID NO: 17982 - protein, 419 aa, Candida albicans
FKRDLFKVGLVDLAMYLSTYFAFFVQYACKNGYLSWKKVGWWLQAAFDGLFLFFWLWIALEYCLDFPWIAKVFLVLHSLVFIMKMHSYAFYNGYLWLIYKEGLYSEKYLDKLTNGKVTLPKGHTKNETEKVLQESIAFTKYELEYQSHATTENPDDHHVFDIDQTDKSIAKLQQEGLIKFPQNITLFNYFEYSMFPTLVYTLNFPRTKRIRWSYVFGKTFGIFGLIFLMILIAENNLYPIVLRCEIARKLPVLERIPQYFFLLMDMIPPFLMVYLFTFFLIWDAILNAIAELSKFADRDFYGPWWSCTDFSEFANQWNRCVHKFLLRHVYHSSISAFDVNKQLAAIITFLLSSLVHELVMYVIFGTLRGYLLLFQMSQIPLIIMSRSKFMKDKKVLGNIICWFGFISGPSIICTLYLVF

SEQ ID NO: 17983 - protein, 444 aa, Candida albicans
NNISSSSPQYIFSSSQNSKSSSEETAKSSSWTSFLKSIASFNGDLSSLTAPPFILSPTSLVEYSQYWAEHPDLFIAPSLIKTTENPTKEEIEAINLQQMIAVTRWFISTLKSQYCSRNESMGSEKKPLNPFLGEVFVGKWQDDKTGETDLVSEQVSHHPPVTAYAIKNKKHGVVLQGYNGITSSISTTSINIKQYGHALLKYPEIDETFLITLPPLHIEGLITAAPFVELEGISYIQASSGHIAVIEYSGRGWISGKKNTFKARIYRDAYASASKENALVTILGQWSGKSYIGKGSSTPTSKNDVFYDASKTPTHHLQVKPIEEQHKLESRKAWFKVAEAIKKSDYNLIATEKTLIENEQRKLRKQEKDAGITWETRWFDKIDYLNKDADAPIKDEFTNLTNISNLSIHNAPSGTLKDSKYDHGEAKHWRVNLKKLEDEKEIVF

SEQ ID NO: 17984 - protein, 265 aa, Candida albicans
VTTMEEIHISSSILQDSDSAPPNHFQHAQQQEQPSWKKLLYLQQPFPDNYTDQSFLSQLKRNTTVAKYSYKNLVQAFSFIVFYISCILLVILMFIGIYEKQWDPIIPTLISTGISLFGFFSLKNLSMNMRSLMVITFILLIVSPILKSLTKSTSSDSIWAISCVLCLANSIFHDYSMKVSYRPIVSTNISLSNAIVLASRLSTTLDVFLFVLFAIEVNILLPLFDAKIRLLGLETIHWPIAFLTFNLTSYLMYILLNYKSLVYWI

SEQ ID NO: 17985 - protein, 165 aa, Candida albicans
RRRYLEMIKDKTGGLFRLAIKLLLLYSDVTENDQLISLANLMGILYQVRDDYLNLVDAKYSAMKGTTCEDLIEGKLSLPILHCLRTTKDSPVHKILYDYDSSSDRVSQNSLIDLSLSFMKNESKSLEYTLNLIKVLEKKLRQLILKYPELENSALLKIVERLCDL

SEQ ID NO: 17986 - protein, 162 aa, Candida albicans
HSRYLFATSLYILFSNYNMQLDINKLIQPTEAYVPESSDPIVQPYTYISETPSNNQNVRTRFLHAFNDLFYKISDESLLARISEIISVFHNSSLLIDDIEDDSKYRRGVPVAHVKYGIPTTINCGNLMYFVALQQAQQLSGPHGSMEVKFTSSQILIDELLN

SEQ ID NO: 17987 - protein, 248 aa, Candida albicans
YSITLPSIFVPTITITITMPSAKSSDLSPTKTNFESTTKQKVSVQDIFLYIPNLIGYLRIITAIISFLCMANHPVATLIFYGISGFLDAFDGYAARKFNQGTRFGAVLDMVTDRCATSSLIVYLGVLYPQYTVFWQILVSLDLSSHYMHMYAMLSAGSTSHKNVDETQSKLLSLYYNNRLVLFFVCLINELFYMAVYLHYYKFFWLGTVMLVASTPIWLFKQIANIIQLKNASLILARMDAHDHSKRD

SEQ ID NO: 17988 - protein, 151 aa, Candida albicans
TNIDYIPNKMSESATDKSQLSKFEQHYFSSYDHFGIHEEMLKDTSRTLSYRNAMYRNKDLFKDKIVLDVGCGTGILSMFAVKAGAKHVYSVDMSSIIDKAKEIVELNGFSDKITLLQGKLEDINLPVDKVDIIISEWMGYFLLYESMLDTV

SEQ ID NO: 17989 - protein, 196 aa, Candida albicans
  UNSURE (31): Identity of amino acid sequences at the above locations are unknown.
YARDRYLVESGLIFPDKCQMYIAGIEDAQYXDEKIHYWEDVYGFDYTPFIKTAMEEPLVDTVNNQSLITKGTQFFEFDINTVTKEQLSIKRKFELQAIDNDYCHAFIVYWDAVFPGKQRVILPTGPMHQYTHWKQTVFYMDQVLDLKKGDTINGEITAVPSKINPRELDIDISWEVKTQANDKSRELKGGYTYFLR

SEQ ID NO: 17990 - protein, 332 aa, Candida albicans
NNLKPTMAKAPKKKFSTASNPTANKVAAEKHLNSVFKFNTNLGQHILKNPLVAQGIVDKAQIKPSDIVLEVGPGTGNLTVRILQKARKVIAVEMDPRMAAELTKRVHGTPQEKKLEILLGDFMKTDLPYFDICISNTPYQISSPLVFKLLNQPRPPRVSILMFQREFAQRLVARPGEELYCRLSANVQMWANVTHIMKVGKNNFRPPPQVESSVVRIEIKNPRPNIDFNEWDGLLRIVFVRKNKTIAAGFKSSNVIEILEKNYKTFLATQESNNNDSMMVDDKSISLKDVVKNKITTVLTETGFSDKRAGKLDQTDFLKLLYAFHQVGIHFA

SEQ ID NO: 17991 - protein, 315 aa, Candida albicans
  UNSURE (144): Identity of amino acid sequences at the above locations are unknown.
LRTQKKIILIRVNYSFCSSSSSPTMTSTNLEGTFPLIARGKVRDIYQVDDNTLLFVATDRISAYDVIMANGIPNKGKILTKLSEFWFAFLPIENHLIKGDIFEKYPQLEKYRDQLEGRSLLVRKLKLIPLEVIVRRYITGSRWXEIHKSKTVHGIPIGDVVESQQITPIFTPSTKAEQGEHDENITKEQADKIVGKELCDRIEKIAIDLYTKARDYAATKGIIIADTKFEFGLDGDKIVLVDEVLTPDSSRFWSAAKYKLGQSQESYDKQFLRDWLTANGVAGKDGVAMPEDIAVQTKQKYVEAYENLTGEKWQD

SEQ ID NO: 17992 - protein, 130 aa, Candida albicans
LGNLISYPPKQKIHIKKQQTQKDDVDDIDVELENDKTEINFDDQYVLFQLPKHLPTYTQPPSAVKLEPGVQSVEVDEPATEEKEISKLATNNSKLRGKMGKINIHQSGKITIDLGNDIRLNVTKVAPTDF

SEQ ID NO: 17993 - protein, 257 aa, Candida albicans
KKYLFPMSRQFPYSSAPLRSVKEVQFGLLSPEEVRAISVAKIEYPETMDQTTKRPREGGLNDPRLGSIDRNFRCQTCGEDMAECPGHFGHIELAKPVFHIGFIAKIKKACESVCMHCGKLLLDETNPAMAQAIKIRDPKKRFNAVWSLCKTKMVCETDNNEDEMTDQPSRGGCGHPQPTIRRDGLKLWGTWKQNKNYDDNDQPERRLLTPLEILNVFKHISPEDCYKMGFNEDYARPEWMLITLLPVFSQCRRPQCG

SEQ ID NO: 17994 - protein, 372 aa, Candida albicans
YWIPNWDGVIPPPAVVKPKQLWTGKQLLSLAIPKGIHLQRFDGGRDLLSPKDTGMLIVDGEIMFGVVDKKTVGATGGGLIHTVMREKGPKVCAELFSSIQKVVNYWLLHNGFSIGIGDTIADAQTMRDVNKTIQEAKQKVQEIIIDAQHNKLEPEPGMTLRESFEHNVSRVLNQARDTAGRSAEMSLKDLNNVKQMVTSGSKGSFINISQMSACVGQQIVEGKRIPFGFGDRSLPHFTKDDYSPESKGFVENSYLRGLTPQEFFFHAMAGREGLIDTAVKTAETGYIQRRLVKALEDIMVHYDGTTRNSLGDIIQFIYGEDGIDGTQVEKQSVDTIPGSDESFERRYKIDVLDTENVMSSHTAAGRSTYVQH

SEQ ID NO: 17995 - protein, 244 aa, Candida albicans
RILQDNQRALQKTVVPIKSIRARLKGKEGRLRGNLMGKRVDFSARTVISGDRNLDLDQVGVPISIAKTLTYPEIVTPYNIHKLTELVRNGPNEHPGAKYVIRDTGDRIDLRYNKRAGDIALQYGWKVERHLMDDDPVLFNRQPSLHKMSMMAHRVRVMPYSTFRLNLSVTSPYNADFDGDEMNLHVPQSPETRSELSQICAVPLQIVSPQSNKPVMGIVQDTLCGIRKMTLGDIFIEYDQVMNM

SEQ ID NO: 17996 - protein, 446 aa, Candida albicans
ARIRPAPAEYYPDETGEFKQGKEWVLETDGVNLADVMAVPGVDSTRTYSNDFIEVLSVLGIEATRSSLYKEILNVIAFDGSYVNYRHMALLVDVMTSRGHLMAITRHGINRSDTGALMRCSFEETVEILLDAAAAAELDDCKGISENVMLGQMAPLGTGSFDLMVDDRMLQKAPSSMAMDDIADGGGATPYKDYENARDENIDIDAGAGFSPIHIAQMNEGNIGGLTSYGGQPTSPAATSPFSYGYNSITSPGYTSPGYGYSPTSPSYSPTSPSYAPTSPAYSPTSPSYAPTSPAYSPTSPSYAPTSPAYSPTSPAYSPTSPSYSPTSPQYSPTSPSYSPTSPSYSPTSPSYSPTSPAYSPTSPSYSPTSPSYSPTSPQYSPTSPSYSPTSPQYSPTSPSYSPTSPQYSPTSPQYSPTSPQYSPTSPQYSPGSPGYEPEPPKKDEN

SEQ ID NO: 17997 - protein, 244 aa, Candida albicans
GRGSLTRGQAWKNCSWGERLCMKLLVVRGDTPLVKEAQENATLLFQCLLRSRLAARRVIEEFKLNRASFEWVMGEIETQFQKSIVHPGEMVGVVAAQSIGEPATQMTLNTFHYAGVSSKNVTLGVPRLKEILNVAKNIKTPAMTVFLDPEVASDIEKAKIVQSAIEHTTLKNVTSSTEIYYDPDPRTTVIEDDYDTVEAYFAIPDQKVEESIDKQSPWLLRLELDRAKMLDKQLTMAQVAEKIS

SEQ ID NO: 17998 - protein, 721 aa, Candida albicans
  UNSURE (708): Identity of amino acid sequences at the above locations are unknown.
LLFLFINHPSPPPMSHSIPITSLPPPALKKLKLPNGSEEPSEFERELLDITQAVHDSTDQTWDRPPLPSSFEDISFQQLDAEEYHDRGNTYARFFGITQEGHSVLCNVTGFIHYFYCPVPKGFEENLTEFTNYLKATFDGIERVEITSKESIWGYSNNIKTPFFKIFAKNNISKIRSAFQNGQVHNIDPCITYDNINYLSRLMIDCKITGMSWITLPRDKYKIVNNKISTCQIECSIDYRDLISHPPEGEWLKMAPLRILSFDIECAGRKGVFPEAEHDPVIQIANVVQKSGESKPFVRNVFTVNTCSSIIGSQIFEHQREEDMLMHWKEFITKVDPDVIIGYNTANFDIPYVLNRAKALGLNDFPFFGRLKRVKQEIKDAVFSSRAYGTRENKVVNIDGRMQLDLLQFIQREYKLRSYTLNSVSAHFLGEQKEDVQHSIITDLQNGTKETRTRLAVYCLKDAFLPLRLLDKLMCLVNYTEMARVTGVPFSYLLSRGQQIKVISQLFRKCLQEDIVIPNLKSEGSNEEYEGATVIEPERGYYDVPIATLDFSSLYPSIMMAHNLCYTTLLNKNSIKAFGLTEDDYTKTPNGEYFVHSNLRKGILPTILDELLTARKKAKADLKKETDPFKKDVLNGRQLALKISANSVYGFTGATVGKLPCLAISSSVTAFGREMIEKTKNEVQEYYSKKNGHPYDAKVIYGDTDFGXHLQEAPGPLVVKE

SEQ ID NO: 17999 - protein, 159 aa, Candida albicans
QINRTLTQEENMSTYRSKRAIPSAINTPTTVRVHRVNDTTSSEAERILTSFIDASEINISGKGTAETNTTGISGGNESPAIVSQLKRIQRSLRGLPPLMSEEQFTKSNASLEDSERPNKKIKFDESDDNLSTEKVTEDEEDKLNENIEEVVSEDEKAEH

SEQ ID NO: 18000 - protein, 224 aa, Candida albicans
FRMFQIQLDMVLIGPSKVPGKVTQAPNVEEKFCAFHLPTGDMLRAQVAANTALGVEAKKIMDQGGLVSDEIMFNMIISELEHNRECSRGFILDGFPRNIPQAEKLDSMLESRKTPLEKAVELKIDDELLVARITGRLVHPASGRSYHKLFNPPKKDMTDDVTGEPLVQRSDDNEDALKKRLVTYHKQTEPIVAYYQKTGIWSGVDASQKPTKVWSDILKCLGQN

SEQ ID NO: 18001 - protein, 273 aa, Candida albicans
MRQKYIRVKIITDFEKKKTKKKKFRESSNTKLNYILQAIRRIPYFINTNIEMTLNITVLISGSGTNLQALIDAQKNNQLKGQITQVISSSETAYGLKRAQQACIPTKTHVLKTYYKGTTKDQTDVRKQRREQFNVELANLLINGQIQGSDALYTKPDLIVCAGWMLILSPSVLQPLEKAGITIINLHPALPGAFDGTHAIDRCWKAGQDGEITKGGVMIHRVIAEVDRGTPILVKELDLIKGESLEEYEERVHKVEHVAIVFSTRRGASALAN

SEQ ID NO: 18002 - protein, 136 aa, Candida albicans
YNFSTVEEFKQLIDENKFIEWAQFSGNYYGTTIKAVKDVAEQGRICLLDIDMQGVKSVKKTDLNARYLFISPPSIEELKSRLTGRGTETEDSLQKRIAAASDEMEYAQTGAHDKIIVNDDLDKAYAEFKKFIVDEQ

SEQ ID NO: 18003 - protein, 315 aa, Candida albicans
  UNSURE (287): Identity of amino acid sequences at the above locations are unknown.
GGGAIPGSLGRVRLDVQLRLLKSLMHRPEIGTKPKIESSQNLNPFLKPEPELTIVDNYNDDEFKIVFNKFPVVPRHFMLITKEFKSQNTPLSPSELMATYKILQALKNQNQNQNQNQNLDQNTENWFAFYNCGPESGASQPHKHIQFMTLPSREQFKPYAETLFQNKEDDEQQQEPQKIEPKQNKDLPFAHFFIPIVADDVVDEEELPNLFSSILPKTLTELRETETNHISYNFIMTLNYMSMIPRSKGKYGGDENKDEDKDKDKLGINSCGFQGLILCKNQELFDXVKSVGPLQILKDVGLPNSSHKTTTEYDY

SEQ ID NO: 18004 - protein, 886 aa, Candida albicans
SFSFDFFFLPYYIFFISFLFTSQVFLFKSQSTMYVYKRDGRKEPVRFDKITARVQRLCYGLNPNHVEPVAITQKVISGVYQGVTTIELDNLAAEIAATMTTIHPDYAVLAARIAVSNLHKQTTKQYSKVSKDLYEYINPKTGLHSPMISKETYDIIMEHEDELNSAIVYDRDFNYNYFGFKTLERSYLLRINGKVAERPQHLIMRVAVGIHGNDIPRVIETYNLMSQRFFTHGSPCLFNAGTPRPQMSSCFLLAMKDDSIEGIYDTLKSCALISKSAGGIGLHIHNIRSTGAYIAGTNGTSNGIIPMVRVFNNTARYVDQGGNKRPGAFALYLEPWHSDIFDFIDIRKNHGKEEIRARDLFPALWIPDLFMKRVEQNGDWTLFSPNEAPGLADVYGDEFEELYTKYEKENRGRQTIKAQKLWYAILGAQTETGTPFMLYKDSCNNKSNQKNLGIIKSSNLCCEIVEYSAPDEVAVCNLASIALPSFVENDEKSTWYNFDKLHQVTKVVTRNLNRVIDRNHYPVPEAERSNMRHRPIALGVQGLADAFMELRLPFDSQEARELNIQIFETIYHAAVEASIELAKEEGAYETYPGSPASQGLLQFDLWNRKPTELWDWDTLKQDLAKHGMRNSLLVAPMPTASTSQILGNNECFEPYTSNIYSRRVLAGEFQIVNPYLLKDLVDLGVWNDAMKSSIIANNGSIQALPNIPDEIKALYKTVWEISQKHIIDMAADRAAFIDQSQSLNIHIKDPTMGKLTSMHFYGWKKGLKTGMYYLRTQAASAAIQFTIDQKIAETAGHTVANLDKLNIKKYVNKGRVESENTSDAPYKSPSTEPTSLESSVADLKIKDEGEKPAEDKTIEELENDIYSAKVIACAIDNPESCTMCSG

SEQ ID NO: 18005 - protein, 750 aa, Candida albicans
SHLSSRLRDIGWKNRDRKLYLKVPYSFSENVERLRKYRPRKSNSYSPISSAFYKVVKKHGEFLDKVIDKTRDYNLTYFGIKTLESSYLLKIDGEVAELPQYLFMRVAIGIHQNDIDAIAETYDLMSQKYFIHALPTLYNAGSEFNYLSSCFLVAMKDDSIDGIFKTLNEAALISKASGGIGIHVHNIRSNGSYIASTNGNSNGLVPMLRVYNNTARYVDQGGGKRPGAFAIYIEPWHGDIFDILEMRKNHGNEEMRTRDLFYGLWIPDLFMKRVKENSDWTLFSPNEAVGLSDVYGEEFEKLYCKYESEGFGTKVSAHKLWLAILHSQTETGGPYMLYKDACNTKSNQKNIGTIKSSNLCCEIVEYSSPKETAVCNLASLALPTYLKTTEDAIGFDFEKLHSVTKVLTRNLNRVIDVTKYPVETAEYSNKRHRPIALGVQGLADLFAELRLPFDSAMAKTLNIQIFETIYHAALEASVELAMKEGPYETFQGSPASKGILQFDMWNHKPSPMYDWHALKDNIQNFGLRNSLLVAPMPTASTSQILGFNECFEPYTSNLYNRRVLAGEYQIVNKYLIKDLMDLGIWDSAMRNKIIMENGSIQNIPNIPDEIKQLYKTVWELSQKVIIDMAADRGKFVDQLQSMNIHLRNPTIGKLTSCHFYAWEKGLKTGMYYLRTQAASRAIQFTVDAKEAEKVGTKVPQKSLKRKKYMEPQPRKKTAYSTPDSELYDIHDSTPITCNIEDLESCQSCSG

SEQ ID NO: 18006 - protein, 830 aa, Candida albicans
IQNLRNFSKTYSFEIFIEYIPQHNSALTMSLNILVIGNGGREHAIVWRLLQSPTVNHIYVAPGNGGTISESSSSKITNVPISSSPKDFNKLQQFAVENKINLVIPGPEQPLVDGIADIFYAVGIPVFGPSAKAAKMEGSKAFSKEFMDKHNIPTARFQNFTDVAKAKEHIQSIDYKIVLKADGIAAGKGVLIPETTEEALQGLNEIMVDKNFGDAGNEIVIEEFLEGDELSILTITDGYSFYNLPAAQDHKRIGDGDKGLNTGGMGAYAPAPIATQDVLKKINDQIIKPTIDGMRKDGFPMCGVLFTGIMLSPTKEPKVLEYNVRFGDPETQTVLPLLSENTDLAQVMLAAAQHRLDSVTIETKPLYSTTVVMAAGGYPEAYGKGDEITIKKPLPQDTFIFHAGTSVNDQGKIVTSGGRVIASTAIAETLRQSVDKAYVGVNEHVSFNKKYNRKDIAHRAFRDADKAASTSSGSGSGVTYADAGVSVDNGNLLVENIKAKVKSTARPGADSDIGGFGGLFDLKKAGYNTDDTLLVAATDGVGTKLRIAQIMNIHNTVGIDLVAMNVNDLVVQGAEPLIFLDYFATGKLDIEVAAQFVDGVANGCIQAGCALVGGETSEMPGMYDEGHYDTNGTAVGAVLKDKILPQINNMKSGNVLIGLKSDGIHSNGFSLVRKIIEISEYEYQSPAPWKQGSTIGEEVLVPTKIYVKQLLSSINQGLLLGLAHITGGGLVENIPRALPKHLQATVDIKQWQVPEIFKWFGKQGNVPYEDILKTFNLGIGMVLIVEKENVDKVLKNLEESGEKDAVVIGELVERKQGEPGCVVNNIDGLY

SEQ ID NO: 18007 - protein, 143 aa, Candida albicans
RLISLYKYTLRPSYHTYDSLGEDNKNKSVINMASFRFCAECNNMLYPKEDKEGQRLLYACRNCGYTELAENPKVYRHELMTNIGATAGVVEDIGNDPTLPRSDKECPDCGHHECVFFQSQQRRKDTSMILFFVCLNCKHVFQA

SEQ ID NO: 18008 - protein, 504 aa, Candida albicans
LLLLLFFLSMSKFLILSGPKALSDFRINNLIQEIEKKIGQSDIIDKVVGSFTHYISLQQEQGDLTDKQLELLKILLTYDNPLETDNDENSSLNKILIKNSTVIDGESIELPPNTYLIQILPRPGTISPWSSKATDIAQICGLKDQIERIERGLSLLIKTKTGFKLDQNDNDDNNDSGSNSNSIPIETLLTSVFDRMTQLIYFGNNVPQYNDLFDHHSPKPLVTIDIISDLENLIKANKELGLALDQGEIDYLINAFKEIIGRNPTDVELFMFAQVNSEHCRHKIFNADWTIDGTTKELSLFKMIKNTHEKTPQYTISAYSDNAAVFEGHEGYVWTPDFKTKQWKSIKEKVQTLVKVETHNHPTAVSPFAGAATGSGGEIRDEGAVGRGSKSKAGLSGFSVADLNIPTLPQPWERNVGKPNHIASSLDIMLEAPIGSAAFNNEFGRPAINGYFRTLTTEVENSHGETEIRGFHKPIMLAGGMGAIRPDLALKDTKIFTTGLEGTA

SEQ ID NO: 18009 - protein, 205 aa, Candida albicans
VLVPDGLNQFYSMIKLVKNLKNFSKIEMIHLPLVHVMDVNFLIRIADLIPGTENLPTFENHLSEQYEARFVMVEIESSPQKNNSIFLKNMKGSKLPIAVAHGEGRAQFKALQEQKDFQLDVIHYVDNYGKITENYPFNPNGSPNGIAGITNSNGRVLAMMPHPERVCRKESNSWYPIEQGKEWGQYGPWIELFKSAREWVGDNRN

SEQ ID NO: 18010 - protein, 219 aa, Candida albicans
RIRAVFQIKFKDYTKFQQIFLDNGIDENFIQIIGKPKFDSKQLIDISFNGTPIYSSTRGHLQQLWSNTSYHIQKLRDNPITSTQEYDAIKDDNDPGISYQLTYQPNEFKKYSLQQPKVAILREQGVNSQQEMAWCFQQAGFDVYDVTMSDILEGITTLDDFVGIAACGGFSYGDVLGAGAGWAKSVLFHDKARQEFKKFFQDRNDTFAFGACNGCQFFN

SEQ ID NO: 18011 - protein, 384 aa, Candida albicans
LGAKFELRSILSLEPGMSPMEIWCNESQERYVLGVAPENLDLFAKICQRERAPFAVVGVATEEQRLVLTDSLLNSTPIDLEMSVLFGKPPKMSRTAITSNLNLTPFETTNNNLDVSESIDRVLQLPAVGSKNFLITIGDRFITGLVDRDQMVGPWQVPVADVGVTATSLGDTILSTGEAMAMGEKPTLALISASASAKMCVAESLLNIFAADIPSLDHVKLSANWMSAASHEGEGAKLYEAVQAIGMDLCPDLGISIPVGKDSMSMKMKWDDKEVTAPLALTITSFAPVDNTSNTWTPQLQNLDEQQQEETVLVLVDLAASNEAGKSLGGSALAQVYKQVGDSAPTVHSHKILKSFLETLIVLHKQFDILAYHDRSEGGLITTV

SEQ ID NO: 18012 - protein, 298 aa, Candida albicans
FKSVDHNNIQGDELHEAFGAGKLKVVGIIDHHEDEGQFVESQPRIIRTCGSNSSLVFNYFYNEFFKSNTSKFLETQLEAIKLLLGPLLIDTSGMTQKVEEPDTEAFSIYQKALEGDEKFIQLFANSGDKDPYTNYYSTLKAAKKDVSGFKFVDLLRKDYKQFTFDSGDRVGFSSVTKAFKWIVANYSKEEIGKTLIKTLEENNIDLLIIGTHFTRKDNDKYTREFGYYYKKLENEKFNNLHNLAETKLQLNNEVYGADKIVSTVETLSSHGNFKVFNQGNISASRKQVVPIVKEILEN

SEQ ID NO: 18013 - protein, 94 aa, Candida albicans
LILIDTTEMTKIKVLSGEEEDFDSVKIHKLLEEVSFNLGDLDLDQIVESVQRGLPSSLTIEELYTFIAEVIASRVIYHPDYAILAGRIETESFI

SEQ ID NO: 18014 - protein, 151 aa, Candida albicans
KKKTEGSKKQSTNHCTSNRYIQPYYLSIRILHKYRQYTMEIDSHEGPSVTIREAEKDHVNFILKNVDLAVANSMRRTIIAEVPTLAIDLVEIDVNTSVLADEFLSHRLGLIPLVIEGNHNLTYSRDCTCDNYCSKCSVNFTLIPIVLPNSP

SEQ ID NO: 18015 - protein, 357 aa, Candida albicans
KKKKTEGSKKQSTNHCTSNRYIPPYYLSIRILHKYRQYTMEIDSHEGPSVTIREAEKDHVNFILKNVDLAVANSMRRTIIAEVPTLAIDLVEIDVNTSVLADEFLSHRLGLIPLVSEGIDNLTYSRDCTCDNYCSKCSVTLQLIANCATESTMNVYASDLQKMSHNGSKLGDPVIRDPQARGPLICKLRKHQELSLTCIAKKGIAKEHAKWSPTAAIGFEYDPWNKLKHTDYWYEVDAEAEWPKSKNCDWEEAPDPEAPFDYKAKPSTYYFDVETVGNLPPNEVIIKSIETLQTKLAAISIELNKEDVEVNEAAAGGFTSYGRTEYGRTEYGGADGGQTPGGRTPYGDSGFGGAQWG

SEQ ID NO: 18016 - protein, 182 aa, Candida albicans
VGQGHHCGNKNRLSRNHNTNVGDINGGNGDSNIDGNNISNNNDKDINGDRQNKGNNDDNDDDDDDDDDDDDEDDEDMKEDEISNMELAGPNSNEIVHKTLNFLTNFARFKNRSSCETVEKLLNDFSEHCNEPLHPFELAQLGTLECEDPEEAKSLIPSLQNKVSDVQLQTLLTELRKYQTLS

SEQ ID NO: 18017 - protein, 411 aa, Candida albicans
VFKTSTLRTLKKDIPLTMSKNTDNNKPSPKKVTEKSTPIVTKPESDKTVEKASDDSEIDLPEVYKRHREFLAKHVVNRHKLKQEESNEPLLTPDKTRHTIYPIKYPELWQFYKKSLASFWTAEELDLSKDLDDWNNKMNENERFFISRVLAFFAASDGIVNENLVENFCAEVQIPEAKLVYKFQIMMENIHSETYSLLIETYFKDPEEADFLFNAIDNIPFIRKKADWAIRWIQSEDALYAERLVAFAAVEGIFFSGSFAAIFWLKKRGLMPGLTFSNELICRDEGIHTDYACLLFSYLKNKPSSEIIEKIITEAVDIEKEYFSDALPVSLLGMNCDLMCQYVEFVADRLLVAFGNKKYYNVTNPFDFMENISLAGKTNFFEKRVSDYQKAGVMEKVENKNEKTGLFDQDF

SEQ ID NO: 18018 - protein, 360 aa, Candida albicans
RLTQLNNIHLIMSVQETPTKGLTGKISDLDMSNMKGKSLTDKLAADAKLKDEAQTIHEVKQAVASTDKATEEKDDSLKKHQDFLAKHKVHRHKLKQLEAEEPLLVENKRRYVMFPIRYHEIWNFYKKAEASFWTAEEIDLSKDLDDWNNKLNENERYFISRVLAFFAASDGIVGENLIENFSTEVQLPEAKSFYGFQIMMENIHSETYSLLIETYIKDPQEADYLFNAIANIPCIQKKADWAIKWIQDDEALYGERLVAFAAVEGIFFSGSFASIFWLKKRGLMPGLTFSNELICRDEGLHTDFACLLFAHLQNRPSPEIVERIITEAVDVEKEYFTDVLPVSLLGLNCNLMCPYIEFLP

SEQ ID NO: 18019 - protein, 352 aa, Candida albicans
PLNQESSSNTEQLKSSTTPNIPARPQTRPQKQTTTTTTVPTDQDSTTETSLEKPLDNPQDELDELAHEIEKVLSDPVIPPRPQHGSSTKSSETQTEHKEQDFEPAHPAIPQRPTNKKETIQSEVGDHKNGLESKFDLKVNEETPADLVSTDKDKVHIKPSIRNIPSRPQSRNLDSSEVDNTKPSTTASIPARPQRQSTSTQDEYKPQASNTPDIPTRPQTKTEKSVLSEELDKPGDEPLSKDQDNERYTDDSNASKSILETEKAVAQEEKKAKKSDVDNKPSEPTTSTDSSTEPTAPARGFRLPLHMQQGSGPISTSTPVAGSEAELNSLNNSNTFGDGEVTPGNSDTKVNI

SEQ ID NO: 18020 - protein, 695 aa, Candida albicans
SEPKITAFPAEFVEKVPNIEKLVLDKNHLVSLPNELCQLSKLVSLSVHANNLQSLPANIGDLRFLKYLDLHSNNLKSLPDQIWDLCHLTLLNVASNNLTSFPKAPYSVVKRLSSSLVDVHLESSQTLSLADSLLILILSDNRLSDDCFDEISFLIALKSLNVSYNDLIEIPQGTLSRLTRLNELYLSGNELTTLPADDLEVLKSLKLLYMNNNKLVSLPAELSRIANLQHLDVSSNQLKYNISNWPYDWSWHWNKNLKYLNFSGNKRFEIKQSHIKNPETGEDFDSLLVLKQLRVLGLIDVTLTTTNVPEQAVDLRLRTTASEFDNFGYGVSDSLGMRDHVSARDLFVQKFRGKENEMLLCAFDGKHGATNQGHRISLVAKNMFVRNFTKELDEIKNDDEIENALRKAFLNFNKEINGILTAKKNKSFTPVPNMSKEALELNLVDDGNAGCTVSVIYIKDKKLYSANIGDIEALLCRNNGDQFLLTEKHDPTNREEFERIRASGGYVSGGGELDGQLSVSRGVGFFNFLHHTHCGPTIRRFKITNDDDMIILGSKQLWDFISYESAVDIIRKDKNDPMVAAQKLRDFAICYGATDKICVIVLTFGNRQKQAANMYSNYGVDRRRRDKQQVVGGDSNLRKLEQEIEPPIGPLALVFTDIKNSTLLWDSYPAPMRSAIKIHNTIMRRCSPRAGKTAS

SEQ ID NO: 18021 - protein, 235 aa, Candida albicans
  UNSURE (221): Identity of amino acid sequences at the above locations are unknown.
VQVTLFEYSKKITLSRQSYVPWETTTSELLTIVQKKFFLESTTNFQLSVCIGNCVKVLEDFEKPLKIQMGLLLLSGYTEEDKLRMLGREDLSFVCKFVVENIFLRSLTHDEEVLLSRNYVDVNISSLNLKNVPIIFHQHTYEIEKLNVANNPSIYLPLDFIQGCTSLAYVDFSHNGCSKFPNNLLEAPQLTHLNLEMNFLDEIPQRISCLSNLTNLKVRSXFTYEGPTPKYMCRE

SEQ ID NO: 18022 - protein, 423 aa, Candida albicans
TFPKGFYLLKNIKFEASTIVNFNFEKFIHLTSLSLLNIDFAQSRKLEFPLGLKKLEFIDCSISSHILAFPDSLRVLVITRGKWSTKRNANISRLQKLIVYEVQIKDLTEKINSCFGLFHLEVINCNLNNVETLKLSKNLVYLKFINVSLVGVKFPMFPQSLEVINIERNGILQCELNCNCNCNSNSNSKLKTLRIAHNDLTDEFDISSQPVHDVNLEGNNNLTLVLLHDKTKILNVSNTNIQHIIGNGLTKLVLNGCNNNNNNNNKIDWKSFKLSQFVTQLSLQNCQLETFEFESNQEGIELKHLKVLDLSKNKLHLINLVEYENLEDVELSNNELKKLSNDNFPLNIKSINAEKNQIQQVDLQELYNLIWLQISENKLNGIEQIQIPNSLDTLILNGNIFNEINDANFKLSENLRHLELNKC

SEQ ID NO: 18023 - protein, 633 aa, Candida albicans
SSVMSRSQIVALLKEQLDTIKQKKSIKLNSLPSTTKPSELIDTIYEFLTSFDPSLELEKLAIQNSQLIELPSNFHKIASSIKYLDLHQNSISYIPQDFFYGFDSLEILDLASNDLEFLPDSLSSVTTLKVISIKDNSFKYISPQLGELPNLNLIEVSGNPSLLPSNDIIRAFQQQKPDLDWVGELKNYLVANRMLINLKIQEAMEKSSQKRQQVPKDSTPETSQTTSDPVIARSKSGSISTSFSSKASRRMGLIIKKSDENSDGSSKEDANNSLISGAVPDHVTTEGIPHVDSPTDISFQLPKSPPTSTPGTTTPSTQTAPATTSTNKNLGVTLTSSARGRSNTFKEIDRMLEKSESVDTERKSNAYFKRLSTLQELPGDELSEYSQPKKPAAEGKQASGNVSKSNNTAASENSPAKPQQQSKLHTNPVIIRVSRKILFSFSELHSSIRRFTSFCSDKKVTMKMVSYLYSTKSNIDSLVENLEIMEESGDNSEQIVQALHNCIGSFKSIMKLLHENIQSFVGNIEVCFIRMVYLSVFGSLNELQNAYLLLCPKASAKSSSTEMKQKLSINTTTDADEKLYSTIERATNNTPNIFSELIKDNHKGGTLIAQGGLFHPTVASPIKEISPGVCNTR

SEQ ID NO: 18024 - protein, 258 aa, Candida albicans
YMYHLPNNLVQLHLASWEQGKMGVFTQMVKWPLMLTNIIFHNFNINNHTLEFLNFKESRLEEINIRGGNVNKLDADLFPTSVKYLTLREMKIQELSDSFENLENLRRLSLARNQLKMVNPVKLPVSTLQTLDLKQCNVRFISPFLVSMLEEKNKNPKLHVYATENSNISVIDIRTALKLVKGLVLFLNDFDKSLTEISRRSSRLICIGESRDPHFENYEISATEEVVPDYDPDDLYDGSDASLDEEDTGDDTKRRREM

SEQ ID NO: 18025 - protein, 202 aa, Candida albicans
SIADPSSPVVKTLIDAYQGNENAGMTIERELNALEDLGCNYFKIGERKLKGLETPEPITLVFTNRLKLRYDIFQKRLDANHSTRVAGTLPVEIIYGLRTVSLRLENLCSSINNGGNYCSEGFESSSGVISQKMNSSFKDLDLISLLNHVTTRIESCTTTLFLRQQLSQIKGNGGLIETNNSPSLDVIMDEVADIMKTVNELK

SEQ ID NO: 18026 - protein, 126 aa, Candida albicans
PLNMSVVGSLIFCNYCGNLLDSHSSSSEIKCTVCSAAYPKSRFANLKVVTKSSDDAFPSKLKLARSVVKTSLNKDELDEGATIKEKCPKCGNEEMQYHTLQLRSADEGATVFYTCTNCGYRFRTNN

SEQ ID NO: 18027 - protein, 365 aa, Candida albicans
KMNRLLLLQQQQILKTFVSHYFKRNFTTSIMSSYKLVCLGNPLLDLQAKVEKDYLQKYDLTDNDAILADPKHMPIFEELIKRDDLVLVAGGAAQNTARGAQYILPPNSVVYFGSVGKDIYAERLNQANEEYGLTTKYQIQDDIATGKCAALIHNHDRSLVTDLAAANHFTPDHLQKPENWEIVEKAGFYYIGGFHLTVSPPAIKLLGEHASKTNKPLVLNFSAPFIAQFFKQQLDEVLPYVDYVIANESEAAAYAESHDLKTTDVVEIAKEVAKLPKENKQIPRTVIFTQGLEPTITVTYDATKDSFDVQQYPVKELAKEKVVDTNGAGDAFAAGFVASLVEGKDLPKSVDVGQWDFHHGQRNRE

SEQ ID NO: 18028 - protein, 173 aa, Candida albicans
  UNSURE (161): Identity of amino acid sequences at the above locations are unknown.
FYFVMFILSEISDLIRIPPSAFNVPIQHSISDELNKKYANKIIANLGLVITIWDILDIKDGLLKPGDGGSYVEVRFRSIVWKPFRGEILTGWVTECTAKGIKVRMEFFDEIWIPKDFLFENCKYSELEQAWIYLLDENELFIDVNEKIRFRVEEENFHNLXSPRPSHDPIFIC

SEQ ID NO: 18029 - protein, 153 aa, Candida albicans
LIMSDERTFIAIKPDGVQRGLISSILGRFEQRGFKLVGIKLVQPTESLLRTHYEDLQSKPFFPSLLSYMLSGPVLATVWEGKDVVKQGRAILGATNPLQSAPGTIRGDFAIDMGRNVCHGSDSVESANKEIDLWFKKEELVEYKPALFGWIYE

SEQ ID NO: 18030 - protein, 172 aa, Candida albicans
QLLYNIENGKVGGKLVGIITSRDIQFHEDNKSPVSEVMTKDLVVGKKGISLTDGNELLRSSKKGKLPIVDAEGNLVSLISRTDLQKNQDYPNASKSFHSKQLLCGAAIGTIDADRERLDKLVEAGLDVVVLDSSNGSSVFQLNMIKWIKEKYPELQVIAGNVVTREQAALSI

SEQ ID NO: 18031 - protein, 64 aa, Candida albicans
GGIGIIHHNCTSEEQAEMVRKVKKYENGFINDPVVISPEVTVGEVKKMGEVLGFTSFPVTGMFL

SEQ ID NO: 18032 - protein, 115 aa, Candida albicans
FLLSTNPFYFYPLLPIPISPKKKTTTMVFETSKATSYLKDYPKKDGLSVKELIDSTNFGGLTYNDFLILPDVINFPSSAVSLETKLTKKITLKSPFVSSPMDTVTEENMAIHMAL

SEQ ID NO: 18033 - protein, 199 aa, Candida albicans
NYFQTSYITQIMSDRVLEINALAKELKANLKQFPNFPKEGILFEDFLPIFTKPDLFNKLVKAFKLHVGEQKIDYVIGLESRGFLFGPTLALALNAGFVPVRKPGKLPGPTFKVEFQKEYGSDEFEIQQDVIPKGAKVLIVDDILATGGSAFGAGELAKKTGAEIVEYLFVMELDFLKGRDKLDAPVYTLFGGQEEKFTE

SEQ ID NO: 18034 - protein, 84 aa, Candida albicans
TNLNMSDKQHTKTAILSVYDKTGLLDLAKGLVAANVRILASGGTAKLIREAGFPVEDVSSITHAPEMLGGRVKTLHPAVHGGIL

SEQ ID NO: 18035 - protein, 437 aa, Candida albicans
WEMDFHGVCNITAEARNRLALKAFEHTADYDVAISDFFRKQYAENISQLPLRYGANPHQKPAQAFVSEGELPFKVLNGSPGYINLLDALNSWPLVKELSASLNLPAAASFKHVSPAGAAVGLPLTDIEKKIYFVEDIENLSPLANAYARARGADRMSSFGDFIALSNIVDKPTAQIISKEVSDGVIAPGYSEEALELLKKKKNGKYCILQIDPNYNPENLESRQVYGITLQQKRNDAIFKGSSFKEIVSKNKDLTEQGAVDLTIATIALKYTQSNSVCYAKNGMVIGLGAGQQSRIHCTRLAGDKADNWWLRQHPKVLGFKWAKGTKRPEKSNAIDLYVTNQIPTEEPEKSEYESKFAEIPEPLTAEERKEWLSKLSNVALSSDAFFPFPDNVYRAARSGVKFIAAPSGSVMDKAVFAAADANDIVYVENPIRLFHH

SEQ ID NO: 18036 - protein, 210 aa, Candida albicans
RRSCLRLSPVDGSELDIFNKVFVFPMLLNRSHSKGPSQTIKTHHNVGGLLEDMKLKLIEPLRELFKDEVRHLGELLGVPEDLVWRHPFPGPGLAIRVLGEVTKEQVKIAREADAIFIEEIKKAGLYRQISQAFAALLPVKSVGVMGDQRTYEQVIALRAIETLDFMTADWFIFEAAFLKKVASRIVNEVDGVARVTYDITSKPPDTVEWE

SEQ ID NO: 18037 - protein, 328 aa, Candida albicans
FTIMSANIDDVPIEVSKVFDTILVLDFGSQYSHLITRRLREFNVYAEMLPCTQKIAELSWKPKGIILSGGPYSVYAEDAPHVDHDIFKLGVPILGICYGMQELAWINGKGVATGDQREYGPPTLIVEDPECALFKGVDHSQVWMSHGDKLHALPTGFKVVATSDNSPFCGISNESEHIYGIQFHPEVTHTVQGKKLLKNFAVDICQAKTNWSMENFIDTEIARIKKLVGPTAEVIGAVSGGVDSTVGAKIMKEAIGDRFHAIYVDNGVMRKNETESVKKTLNEGLRINLTVVDAGDLSLGRLKGVSDPEKKRQIIGNTFIHVFEEEAA

SEQ ID NO: 18038 - protein, 542 aa, Candida albicans
HLFYKMCGILGIVLAEQNLNVAPELFEGAMFLQHRGQDAAGIATCGSKGRFYQCKGNGMARDVFTQQRMNNLVGNYGICHLRYPTAGSSAGSEAQPFYVNSPYGISLSHNGNLVNSIELRQHLDEVVHRHINTDSDSELLLNIFAAELDKFNKLRVNNGDLFSALTGTMNKIRGAYACVAMLAGYGIIGFRDPNGIRPLLFGERINANDGSKSYMLASESVVLKAHGFNNFKDVKPGEAVIITKTGEYEFKQVVEPKIFAPDIFEYVYFARPDSVLDGVSIYRSRIDMGEKLAHKIKSIMLDNQESEGNEGNEIDVVIPVPDTARTSAFQCAVSLNKPFREGFVKNRYIGRTFIMPNQQERRSSVRRKLNAMDSEFNGKNVLLVDDSIVRGTTSKEIVAMAREAGAKKVFFASCAPPIRFNHIYGIDLADTKALVGFNRDENEIAQVIGADKVIYQDLQDLIDCCKSDIIKNFEVGVFTGEYITGVEDNYLQELEKIRAQNQRLQQNIMKGLSVDACIDSSDLVDVKAEVDISIYNRGDYTE

SEQ ID NO: 18039 - protein, 191 aa, Candida albicans
TRTNKMSLRPNAFKGSNSARFVKNQMTTNYRNTNDYRQQNNRNRQQQQPEDPYVANNPMLNDSIQKKELVERIDHIDSIMGFDRLEHGENDGNKPRKGWLINMHATTIPTDDYLAGYSGVDYYFLDEEGGSFKATLQFDPYFFVDVLPGDHELEVEEWMRKYLETANVKSYSRVIKEDLKLPNPFVFHLRD

SEQ ID NO: 18040 - protein, 612 aa, Candida albicans
TRISTRGEDDGTNLYKLTMAQSVFQEQMSDVDSLLQDSNIMGLYESNIDPVSRAIIDLGNTVKFDDTRVGALGKGLKTGFNTRELIKASSEAYLRKFDMDIVYLLHIVTNSYEFFALFNTWENDCQMFVLKPSANAQELPNNIHKIYREIFESKREKLDKVLNVVNYPAEMSFDVKYYHESAKLFKKLNQVIGKIHESRSNKAFLAIQSPYSSRILNVLNTTDDFPTIKMNISELSLPAVGWQSLISKRVINHYFVLGSWIKNLVAFAKYANVPLCNLQIENIGFLVDIEYARRLSENNIVLWWSPNPLPDLGGFEMDRMVDFDSLAFPTINNPEIYETACLEVEIGTLTINTILTSALINEAEGTDLADENMHFDNNNGASTFAEDSFSSPALSILRSMVKDWWDDALSNNINADSIMNTLVTWVQRNDSMLYDPSLHYHVHNLTSKALLQLISEFKRMGAQVIFANRNKMLIQTSKISVENSYAYGQYILKAARSKPLFNFLDLRIVKYWDILIWMDEFNYGGRSCTEIVNEEMQNLVPENHWHLQKFLPIIFQNEFEDWLVIFLDALTKYKNENLLGKGAQANTPRVTQIVHILERSEKITSSRSRRRG

SEQ ID NO: 18041 - protein, 232 aa, Candida albicans
RRRLKFPDAKIDQIMMISYMIDGEGFLITNREIISEDIDDFEYTPKPEYPGLFTIFNEPDEKHVLKRFFEHIRDVKPTVIATFNGDFFDWPFVENRTRFHDMDMFEEIGFAKDNEGEYKSKYCVHMDCFRWVKRDSYLPQGSQGLKAVTTAKLGYNPTELDPELMTPYAYDKPQLLSEYSVSDAVATYYLYYKYVHPFIFSLCTIIPLNPDEVLRKGTGTLCEMLLSVQAYE

SEQ ID NO: 18042 - protein, 153 aa, Candida albicans
DILLPNKHSDPIERFYEGHLLESETYVGGHVESLEAGVFRSDIPTHFKIDPTAIDELLGNLHNSIKFCIEVENGKKMEDVENFDEIYTQIESSLLELKNNPYRQEKPLIYHVDVASMYPNIMTSNRLQPDSMKSDEDCASCVTAPPRDRKCGG

SEQ ID NO: 18043 - protein, 175 aa, Candida albicans
  UNSURE (29),(171): Identity of amino acid sequences at the above locations are unknown.
TIIQMARALVERIGRPLELDTDGIWCILXKSFPENFNLKCKDGKKIFLEYPCSMLNYLVHERFTNHQYQDLVDPETFKYKTRSDNSIFFEVDGPYKAMILPTSKEEGKGLKKRYAVFNEDGSLAELKGFELKRRGELQLIKNFQSDIFKLFLEGDTLDTCSQACQPTEISXTRYI

SEQ ID NO: 18044 - protein, 174 aa, Candida albicans
WNYYYERLASVVQKIITIPAALQDVKNPVPRVPHPDWLQRKVKNSEDVMQQKSISNFFKKTTKEDIKLKDIEDFGEVDASVPKGKVVKVTSRKRKSGKANMVEDAEEDEKNQAILNGPCPSMTEDYQGFLQYQKAKWKVQQAGRERRRRLFGANSESSQRSTVGLHTSRRRTNI

SEQ ID NO: 18045 - protein, 398 aa, Candida albicans
YLLSVMSSSIKVNSVTEKPVATVGSFFNGLRVSPEVEFDLYKHKKRDDYVLHGETDTLDYNGTSNNENEYVVAVFDPNSKSVELYKTPYISTKVTAKKNRVYKGPKVKSAGIRNVTQRNALGEAFGTKKAKSAITNLEKNRIDSEKLQDIEMDIVDTVKESTRDLPAQEDGVDRPAPLANVDATNVEDIYPLENIIPEKDWQYLRVSSILTAENPLEKLPFTKSEFIAKQLPILILQKNTEKLQMLFYASLLLGVYENRRVKDKQSLMTRLQNIPSEILVDGILDRFAISRATKFGKSKDKSFTIDPYHEDKLLTYLFILLLHINNFTVELVPLSKDLKLKNTRLVGLFRALGAIIKSATVGEAEALGIPKSAVGTYKIATLKVPFKLPELTRRGKRR

SEQ ID NO: 18046 - protein, 433 aa, Candida albicans
TNSRIMCDVVLGSQWGDEGKGKLVDLLCDDIDVCARCQGGNNAGHTIVVGKVKYDFHMLPSGLVNPKCQNLVGSGVVIHVPSFFAELENLEAKGLDCRDRLFVSSRAHLVFDFHQRTDKLKEAELSTNKKSIGTTGKGIGPTYSTKASRSGIRVHHLVNPDPEAWEEFKTRYLRLVESRQKRYGEFEYDPKEELARFEKYRETLRPFVVDSVNFMHEAIAANKKILVEGANALMLDIDFGTYPYVTSSSTGIGGVLTGLGIPPRTIRNVYGVVKAYTTRVGEGPFPTEQLNKVGETLQDVGAEYGVTTGRKRRCGWLDLVVLKYSNLINGYTSLNITKLDVLDKFKEIEVGVAYKLNGKELPSFPEDLIDLAKVEVVYKKFPGWEQDITGIKKYEDLPENAKNYLKFIEDYLQVPIQWVGTGPARDSMLEKKI

SEQ ID NO: 18047 - protein, 357 aa, Candida albicans
NMAQYECSEHMENFLRELPKCEHHVHLEGTLEPSLLFKLAKRNNITLPETFPKKVEECNDRYNRFADLQDFLDHYYIGMGVLITENDFYDLAMDYFTKAHSDGCLHSEVFFDPQGHVERNIDIDVVVQGFNRACKDANTKYGTTNKLIMCLLRHLPAENGLQTIHSASKYYQDGIIHGLGLDSSEKPFPPNLFTECYAHIKDNFPEVGLTAHAGEEGDHTFVSDALNLLKVSRIDHGVNSHQSEELMQRLAEQKTLLSLCPLSNVKLQVVKDVKELPIDKFFQMNVPFSINSDDPAYFGGYILDNYKAVHTRFGFTKDQWKIIALNGIKGSWCDDQRKNELISLVEEVYKKYNIEGC

SEQ ID NO: 18048 - protein, 65 aa, Candida albicans
QFIFKFSIMSAEDIQMEDASNNSEQEQIQEQEYDINKIKILPGSSEDGTSASFQIIDEDHTLGNA

SEQ ID NO: 18049 - protein, 237 aa, Candida albicans
RQKVLLNALAAKIKSLDPDVFIGHRLENISLDVLVHRMNDNNVVTWSALGRRNRRQWPYMINKSNSSYNNSLLIRDVFQGRLLCDIANEMGQSLTMKCQSWDLHEMYDVVCHKKHSPVEINYQNLKYAEDAHLFLMALKENELNVKQTAEIAFATQILSLSKQLTNIAGNAWSHTLSGTRSGINEYILLHEFKRNNYIVPDKEDKTHKNTSYQQEAIVDNADEYATTATSNKKPKYS

SEQ ID NO: 18050 - protein, 139 aa, Candida albicans
TMLSRSARRKTLQQLKEARKTGRNVNVVESDTDDYNEIYDEVDEDTYRQHKRNQLMNDDFIVDDNGEGYVDNGADDWDDASRPNYYSDEENESMGSRKRRKKEDKTTKVAKTSQIRNFFKPMSGSQILLHHGPGSTALT

SEQ ID NO: 18051 - protein, 651 aa, Candida albicans
  UNSURE (628): Identity of amino acid sequences at the above locations are unknown.
VVLPAGRGEDTATSNKKPKYQGGLVFEPEKGLHKNYVLVMDFNSLYPSIIQEFNICFTTVNRDRFNVTHDENKDMPILPERDTESGVLPRLSNTLVSRRREVKKLLKDPKNTPFQKAQYDIKQQALKLTANSMYGCLGYVNSRFYAKPLAMLVTNKGREILMDTRQLAESSSLRVVYGDTDSVMIDTGASSYQEAIKIGEQFKVQVNERYRLLEIDIDNVFKRLLLHAKKKYAAMNASINKATNEETATLEVKGLDMRRREYCQLSKDISTFVLTKILSDLDPETALLEVYDYLDDMKGKIQNNEIPIDKYKINTKLSKDPKSYPNGKSMPQVQVALRLREEGKVIKAGSVITYVITAAKDDGDNSTVAERARAIQELLSKKDPDLKPDANYYLEKQIFAPVERLLERIEGIDMVRVATSLGIDTKRYILRVKNSDANGEILPIESNISDKERFRATSYLVLHCKCGSSFRFGGIMAAETYKVTFNGVCCTKCNYTFPAIKLTSQLESMIRKHIALYYAGWLVCDDPACGITTRQISVYGKRCIGNSGRAMDCKGVMRYRYNDKQLYNQLLYFQSIFDVDKTKRGELRPLVDALEESKDKQLPKLPSGQVEALAEQNRELFGICQEVXQKYLGECGRRYVNMGSIFDFIRN

SEQ ID NO: 18052 - protein, 252 aa, Candida albicans
GTMIFQGRGETDYTMDIDNFEDQPSSPFKLKSEVTPEAETEKENIDPEPTKNVFENPSESLKNQEKVNDNDDEDDSDDDIVYSRKPRAAVVKKNQVDTVSAVKANQLPSSPISKPVYTKFSNHTEKVSKDNIKDTSDSFKMFWFDYAEAENSLLLFGKIMTKESKLVSGVVKVDGICRELSFLPREYRIVDDEEDKSKKLTAIDVLEEIQPLLLANYNLEELRAKPEVNKYAFELADIPKEAEYFKVLAPIQ

SEQ ID NO: 18053 - protein, 252 aa, Candida albicans
LNVVSSPATESRTFGKLGAQDVIEGDGSLRMFWLDYTEVNGSLCLFGKVKNKHTGSHVSAFVKIDNILRKLFFFPREYRYKHGRVTDEEVDMKDVYEEVDEIMSRLKVGMHKIKPCTRKYAFELPDIPKEAEYLKLLYPYDKPALPMETKGETFSHVFGTNTSLFEQFVLWRNVMGPCWLKIEDADFTAVSNASWCKFECQVARPACITPVLDTGNLEPPPLTLMSLAFRTQLNVKENKPEVFTTNVRAPRI

SEQ ID NO: 18054 - protein, 359 aa, Candida albicans
RSSLKKIKHPIHLTSSTTSSNTQLFQPIIMSEMLVSDKARHLYTKMREYPTSKLFDQDELQTLFDIKKGSELMEYLQELVNGKYVKISKMGDQLKFQTVAEEEAKKVSSMSDDEAMIYSYIEASGREGIWTKTIKAKTNLHQHIVQKCLKNLENNRYIKSIKSVKHPTRKIYMLYNLQPSIDVTGGPWFTDSELDTEFIETLLEVCWRFIVGKTMYIKDEEADNADINPLHTTYHNHHPGVNLDQLVEFINNSNITSVELGINDIRSLCDVLIYDDRIEEVGGNQENSGIFKATWQSIIDKGNTILQNNYQDLKNVVSEDCFNYLQQNQSDFSVFQYKSTIQDLQDESDLVYLDSWMNE

SEQ ID NO: 18055 - protein, 107 aa, Candida albicans
RIKIIPDTKVPNAAIVKIEREDHTLANLLRAQLLKDDRVLFAAYKVEHPLFANFVLRIQTEDDYSPREALQNACSGLISELDVIKSKFNDEWALKALLNNTEDDFEY

SEQ ID NO: 18056 - protein, 177 aa, Candida albicans
PPRAMKEVVVDIAPKCIKGLEFGALSAKDIVAQSEVEIQTRDLYDLEKGRVPKEHGALDTKMGISSNAQECSTCHGNLASCHGHFGHIRLALPVFHVGYFKSIISVLQCICKSCAAVLLDEQSKRQYLNDLRKPHIDNLRRMKIIKKIIEQCKKQRRCLKCNHINGVVKKAASGAGP

SEQ ID NO: 18057 - protein, 1256 aa, Candida albicans
RKDIWDEDLDQVFIRNPELEKFAKRIHDDLNPLKTLNLFKQITPQDCELFGLDPAKGGRPEMYIWRYLPAPPVCIRPSVMMDSQSNEDDLTVKLTEIVWTSSMIRAGIVKGISINNLMEQWDYLQLSVAMYINSDSANPALLTGGGGAKSSKPIRAFCQRLKGKQGRFRGNLSGKRVDFSGRTVISPDPNLKIDEVAVPDRVAKVLTYPEKCTRYNKKKLQKLVVNGPDIHPGANYVMKQNEPGKRNLRFGDRVKLAKTLQIGDVVERHIEDGDVVLFNRQPSLHRLSILSHYAKIRPWRTFRLNECVCTPYNADFDGDEMNLHVPQTEEARAEAINLMGVKNNLLTPKSGEPIIAATQDFITGSYLISHKDSFFDRATLVQLLSMMSDADIQFDIPPPTIFKPVMLWTGKQVFSLLIKPNKKSNVVINLDAKNKTFHPPKKGLPNEMSPNDGFVVIRGSKILSGLMDKSTLGDGKKHSVFYTILRDYGPQEAAAAMNRMAKLCARFLGNRGFSIGINDVTPADELKQKKELMVEQAYLKCDQLIDLYNRGKLETQPGCNEEQTLEAKIGGLLSKVREEVGDVCIRELDSLNAPLIMATCGSKGSTLNVSQMVAVVGQQIISGHRVPDGFQDRSLPHFTKNSKTPQSKGFVRNSFFSGLTPPEFLFHAISGREGLVDTAVKTAETGYMSRRLMKSLEDLSSQYDNTVRNSSNGIVQFTYGGDGLDPYDMEGDAKPVNFNRQWDHAYNLTYNVDDASLLPYQIEELVDSVLAPLENKLIRYDNLGNALNDKEKEQKIEYIDQNDGERDFYKSIRDFLTKKSIRLALLREERGLKAYFTAPTEDEIVMDEDAVKVKAIDQLLKISLKAVKTFLEQCLYKYSRARVEPGTAVGAIGAQSIGEPGTQMTLKTFHFAGVASMNVTLGVPRIKEIINASKVISTPIINAVLVNDDDEIAARVAKGRIEKTLLEDVAFYIEDVYKDNLAYLSIKIDLETIDKLQLELNLENIAVAIANAPKLKIAQSDVSVTGKDRINVLVNIKETKTESLRNTVDPKNALFFRMQYLKRALPGVCIKGLPNIFRAVINIKDDGKKELLVEGYGLKDVMNTEGIVGTKTTTNHVLEVNQILGIEAARGSIIKEIDYTMSNHGMSVDPRHIQLLGDVMTYKGEVLGITRFGLSKMRDSVLQLASFEKTTDHLFDAAFFMKNDKIEGVSECIILGQTMLIGTGSFKLVKSSNCEKKALKKKPTLFESCCEVAASA

SEQ ID NO: 18058 - protein, 559 aa, Candida albicans
GGGQLGRMIVEAAHRLNIKTVILDAAKSPAKQINALDDHVDGSFTNYDSIVKLAEKADVLTVEIEHVDVDALIKVQEKFPKVEIYPLPETIRLIQDKYLQKNHLIKHDVAVTESVAVETNTVDDLLHIGEKFGYPYMLKSRTLAYDGRGNFVVKDKSYCEKALEFLKDRPLYAEKWCPFTKELAVMVVRSLEGEVFAYPTVETIHENNICHLVYAPARIPDTLAKKASILAKNAVKSFLGCGIFGVEMFLLENNELLINEIAPRPHNSGHYTIDACVTSQFEAHVRAVTGLPMPKGFTEFSTSITNAIMLNVLGDKATPNKELEICRRALETPHASVYLYGKTTRPERKMGHINVVTSSMQDAESRLSYILGDTTEIPKSLATDKESPLVGIIMGSDSDLPVMAVGARILKQFGVPFELTIVSAHRTPHRMSEYAIEAPKRGLKCIIAGAGGAAHLPGMVAAMTPLPVIGVPVKGSTLDGVDSLHSIVQMPRGIPVATVAINNSTNAALLAIRILGAYDSKWLTEMNQYMLNMETEVLGKAETLEEIGYEDYLTDKLKK

SEQ ID NO: 18059 - protein, 409 aa, Candida albicans
NSRYTWYSLVADGIVEYVDAEEEETIMIAMTPDDVKASKNSVSESEQQKIQLEEQELDPGKRIKPTTSGNTHTYTHCEIHPSMILGVAASIIPFPDHNQSPRNTYQSAMGKQAMGVFLTNYSVRMDTMANILYYPQKPLGTTRSMEYLKFRELPAGQNAIVAIACYSGYNQEDSMIMNQSSIDRGLFRSLFFRSYMDIQKRQGMKALETFEKPTRSDTLRLKHGTYEKLDEDGLIAPGVRVSGEDIIIGKTTPIPADAEELGQRTQYHTKRDASTPLRSTESGIVDQVLLTTNGDGSKFVKVRMRTTKVPQIGDKFASRHGQKGTIGVTYRHEDMPFTAEGIVPDLIINPHAIPSRMTVAHLIECLLSKVSSLSGFEGDASPFTDVTTEQISTLLGHHGYHPRGFEIPV

SEQ ID NO: 18060 - protein, 331 aa, Candida albicans
EDSHLILDHPARHTFEKDHENKRYEITFGKIYIWKPSQTEGDGSTHAVFPQEARFRNLTYSSPLYVDMTSKVFKSDDNKRKDNELEWIQEEPDKDTETKVFLGKVPIMLRSKFCMLRDLAEHEFYELKECPYDMGGYFVINGSEKVLIAQERSAANIVQVFKKAAPSPISHVAEIRSAIEKGSRLISSMQIKLYGRDEKGVSGRTIKATLPYIKEDIPIVIVFRALGVVPDGDILEHICYDANDWQMLEMLKPCVEEGFVIQEREVALDFIGRRGVLGIRREKRIQYAKDILQKELLPNITQEEGFETRKAFFLGHLVNIFHTRRLEGTYL

SEQ ID NO: 18061 - protein, 65 aa, Candida albicans
DPVTSTTFSIINGKMPPKRRRTLLTGAHDAAFNELLKPEYKGKKLTDEINTAKDKWEFTSCIFKS

SEQ ID NO: 18062 - protein, 1060 aa, Candida albicans
VHKSTSKPGVKEVILPPHECRLRDLTYSAPIYVDVEYTRGRKIIRHNDLEIGRMPVMLRSNKCMLEGMSEATMAQVEECPLDPGGYFVVNGTEKVILVQEQLSKNRIIVEADEKKGIVQASVTSSTHERKSKTYVITKNDKIYLKHNSISEDIPIVIILKAAGIVSDLEILQLVCGSDSNYQDLFVVNFEEAARLEVFTQQQALYYVGKRVKTIRRAGAPKLSQLQEGIEAIATTIIAHLTVSDLQFREKALYIATMARRVVMAMHNPKMVDDRDYVGNKRLELAGQLMSLLFEDLFKKFNSDFKANIDKVLKKPSRTSEFDALLSINIHSNNITMGLNRAISTGNWSLKRFKMERAGVTHVLSRLSYISALGMMTRISSQFEKSRKVSGPRALQPSQFGMLCTADTPEGEACGLVKNLALMTHITTDDEEAPVKKLCIALGCEPIFALDSATLHVDGNFGVYLNGTLIGTTRFPVKFVHDFRHLRRVGKVSAFISIYTNTHHQAVHIATDGGRICRPLIIVENGKSKVTAEHLAKLINQEWSFDDFLTHGLVEYLDVNEENDSLIALYEDDITANPGAIVTHLEIEPFTVLGAVAGLIPYPHHNQSPRNTYQCAMGKQAIGAIAYNQFRRIDTLLYFMVYPQQPMVKTKTIELIEYDKLPAGQNATVAVMSYSGYDIEDALVLNKASLDRGFGRCQVVRKNTVQLKKYPNHTQDILAGMRVDENNKPIFQHQALGPDGLGEVGSRIFNGQVFANKCVPTNSGDSTLGAQQEQRAAESHREAPAFYKGPEPSYIDQVMMSVSDNDQALIKVLLRQTRRPELGDKFSSRHGQKGVCGIIVQQEDLPFNDSGISPDIIMNPHGFPSRMTVGKMIELISGKAGVLNGSLEYGTCFGGSKLEDMSKILIEKGFSYSGKDMLYSGITGECLQAYIFFGPIYYQKLKHMVLDKMHARARGPRAVLTRQPTEGRSRDGGLRLGEMERDCVIAYGASQLLLERLMISSDAFEVDVCNKCGLMGYNSWCTTCKSSENVIKMTIPYAAKLLFQELLSMNIAPRLRLGDVF

SEQ ID NO: 18063 - protein, 125 aa, Candida albicans
THLLLLLPPFSFPSQLHNYRLTMSGILFEDMFIVDSTDPGRYNKVCRITGHSSTSKDITITLDINKELFPVQNHDSLTITLASSLGNESSMITSNGSWRPPKPDERSLADDYDYVMYGTVYKFEE

SEQ ID NO: 18064 - protein, 313 aa, Candida albicans
LNINKKKKNSNSFDMSVEVRKRPADNFSLASKRRATVQSTNPKDGNGLSECFKTVSTSLYVSLAPVHLQNPINGIKQQHLDPLIMTYFTKAKGIVVAYSNIKFLENNYDNEDSAYSLAKIEGSSPFTFLWISVDFLCWCPEVGDVLEGDIYMQTPSHIGLLICDTFNASIKKYNIPNTWSFVPNQIDEVSGDDRKTFGHWVDESETKVEGKLQFTIKAIHTTGRIVSVEGTLIRPGEERNAQPVYKERLETKSTGKHMKFADDEVITTTEIAEPDENDELPAYIKDSDDEDSGSDDNKVVNNSDSDEDKIESD

SEQ ID NO: 18065 - protein, 462 aa, Candida albicans
  UNSURE (6),(51): Identity of amino acid sequences at the above locations are unknown.
RVPVNXFCTTLPSFKPFETDARAGGYIKQRFYSGIRPQDIYFHCMAGREGXIDTAVKTSRSGYLQRCLTKQLEGVHVSYDNSVRDADGTLIQFLYGGDAVDTTKQSHMNQFKFCVDNYDALLTKYNPGDMTENIDTDLALSYSKKVRKSLKKQKDVPHYDQVIKYDPVLNVYNPAKYLGSVSEKFQEKLDTYVSKNPTIFAQSKEETKSTGKITEKKFRALMQLKYMRSLINPGEAVGIIASQSIGEPSTQMTLNTFHFAGHGAANVTLGIPRMREIIMTASASIKTPQMTLPILADVNDEQADAFCKSVARVVMSEFVDKVVVTETTSQDVDGSNSRSYVIGLKFYTKEEYETEYDISQEQLEDVITSKFLHALEGQIVKEVKKQKKPDYMPTVGKSAGKTDMETVSGKIKEIDNDDDDEDNEVDEDHDEEQAKQNVKQQVSYEGPDDDEIETMKKILINP

SEQ ID NO: 18066 - protein, 778 aa, Candida albicans
RCGTDEKFCPGHLGHIELPVPVYNPMFFNQLYIFLRSACLYCHKFKLNQLEVHNFECKLHLIQYGLLLECVELDNIMAKSSKSSSVIDVDGEDNDDEEGGGSVDEKSKKDLMKRRELFVKNAIESALKDGRTNHKGVVTASVSEERKATIHEFYKRLLSRPKCTNCGMYSPGFRKDGFTKIFENSLTDKQITNNRVKGLQRPDMIKKNAGNGNGNSSSTGAASDLPNIKHKGGSKYVLSTEVRNILRSLFHKEQAILQKVFHSRPYQHDPISGDLFFKQSVLVPPTRFRLPSKLGDEIHENAQNELLSNIIKTSVLIRDLNERITNMYKEKISGEDKKIIFNRLMNAFVTLQNDVNAFIDSTKNQNAPAGKIPNPGIKQALEKKEGLFRKHMMGKRVNYAARSVISPDPNLETNEIGVPPVFAKKLTYPEPVTSYNASELRQAVINGPDTWPGAIQVQNEDGSLISLIGMTLEQRKAIANQLLTPNGGNSVVGKKVYRHIKNNDVVIMNRQPTLHKASMMGHKVRVLPGEKTLRLHYANTGAYNADFDGDEMNMHFPQNENARAEALNLANTDNQYLTPTSGSPLRGLIQDHISAGVWLTNKDTFFNRETYQQLIYGCIRPEDGHTSKNRIVTVPPAIYKPEMLWTGKQVITTVLLNIKPDNVPGVNLISKNKIKSDYWSESSTENEVIFKNGELLSGILDKSQYGASQFGIVHSLHEVYGPTVAGKALSVLGRLFTNYIMMTAFTCGMDDLRLTDERNTWRKDILKQSGEIGKICNY

SEQ ID NO: 18067 - protein, 158 aa, Candida albicans
NKRRSGDSAGEEIGTSEGVNFRAMWDQDDFINVNGITSNDVYAVLKTYGVEAAKNTIVHEIYRVFDTYGINVSSRHLDLIADMMTREGTYLAFNRQGIDSSTSAFMKMSYETTCQFLTKAVLDGDREELESPSAKIVMGKLSNVGTGSFDVFAQMPRL

SEQ ID NO: 18068 - protein, 320 aa, Candida albicans
RLNELLAFIFIVRDTYKNGNPFHNFRHAVDVLQACFHFLIRLGSLPKFKQFVEDPKLDYTEVHDKHTVLIALQNNSSEEKASLNPIQTLGLLVAALGHDVGHPGTTNDFMIKFSAPTALLYNDRSVLESYHASLFINKVLRICWPDLLTCTIEEKSELTIISLIISSILATDMGEHNEYVNRLKSFKTHNEILNHDNTVKLISALLIKCADISNVTRPLRVSAQWAMVLSREFAEVELLKSVIKKDIDLDFTKYLTYDDVPHELREILEILPDIHKGQIFFINLFAENLFNSVSDLLPQLQYTCDIIMENKLFWLERAKK

SEQ ID NO: 18069 - protein, 274 aa, Candida albicans
  UNSURE (252),(259): Identity of amino acid sequences at the above locations are unknown.
NRKTLIRLSQLAGLLKVNYSDPFYDNQNDVPAKPLVFANQKIVVPLKNELLIPSLEMSQLIKQNTHITKPISQIFSTWQYVPEPPSKREVSKWLKHDEAYTLKKNTKYQFQIEPGVTQSYDYKYSYNSMKISRRPDEFNCLTNFHMELHANPPNSKLTVDPLRDPISLIFYSFDDANNMFRHLNFASGILIFNNTNIDMNLIQRLSHTLNKHIEIFDDELKMITKLVTLVELFDPDILSGYEVNSMSWGYIXERLRDVXGINIMLDLSRGKFKK

SEQ ID NO: 18070 - protein, 459 aa, Candida albicans
ATTSAAAARKCISTYLEEILSIRIKIKQVMKLFKEDAELTKLYNSRQLALKLIANVTYGYTSATFSGRMPNSDIADAIVSTGREILNKSIELIEAGNYGAKVVYGDTDSLFVYFPGKPKTEAFKLGKQIAKTITNYFPDPVKLKFEKVYHPCVLLAKKRYVGFSYEYEDQKTPKFDAKGIETVRRDGIPAQLKMTEKTLRILFETKNLSKVKQYTIDQFYKIIFNKVPIRDFCFAKEVRYGTYKNEKYLPPGAIIAKNMAEEDPRKEPQYRERVPYVVIRDSSKPRIKDRCVTPEDFIKSYETNLPVSLDYEYYITRVLIPPLERIFNLIGIDITGWYRQMPIVMRGSHVAYAEGCLVCGNRLDDSANICLKCLANEQEVIADIILTSRDTEKKLVEVERVCQKCVDNNTSLSMGRFIDQCTDDCVNGDCIVYYNKFKLNYESKQIFTKKDKILQELDW

SEQ ID NO: 18071 - protein, 671 aa, Candida albicans
VFHPVGENEAKEETDELGGYFIVNGIEKLIRMLIVQRRNHPMAIIRPSFGNRGASYTKFGIQIRSVRPDQTSQTNVLHYLNDGNVTFTFSWRKNEFLVPVVMILKALIETNDREIFDGIVGNDTENSFLTDRLELLLRTYKTYNLYSQQETLAYLGDKFRVVFGASPDMSDIEVGKEVLKRIVLVHLPNNADKFRMLLFMIRKLYSLVAGDCAPDNPDATQHQEVLLGGFLYGMIIKEKIEEYLQNIKLQIQSDINRGVGINFDDRKYMTRVFLRINENIGQKLQYFLSTGNLVSQSGLDLQQVSGYTVVAEKINFYRFISHFRMVHRGSFFAELKTTTVRKLLPESWGFLCPVHTPDGSPCGLLNHLSHKCKIATEASDVSQVPKALTQLGVLPADSFAAGPNLCCVQLDGKIVGWTTHEQGRIVADTLRYWKVNGGHGLPLDLEIGYVPPSNKGQYPGLYIFGGHSRMMRPVKYLPLDKEDIVGPFEQVYMNVAVTPEEIENNIHSHVEFTPTNILSILANLTPFSDFNQSPRNMYQCQMGKQTMGTPGTALVHRSDNKLYRLQTGQTPIVKANLYDDYGMDNFPNGMNAIVAVISYTGYDMDDAMIINKSADERGFGYGTVYKTEKVDLSQSRRRGDPITQHFGFGSDEWPEAWKEKLDADGLPLIGV

SEQ ID NO: 18072 - protein, 342 aa, Candida albicans
RRGGTGDPIVAYYDDTLGKTKVKTYHSSEPAYIEEVKLLGDDSNEQEGQQITIKYRITRQPLIGDKFSSRHGQKGVCSRKWPQIDMPFTESGMQPDVIINPHAFPSRMTIGMSVESLAGKAGALHGIAQDSTPWKFNEQDTPADYFGEQLLKAGYNYHGNEPMYSGATGEELRCDIYIGCVYYQRLRHMVNDKFQVRSTGPVNSLTMQPVKGRKRSGGIRVGEMERDALIGHGTSFLLQDRLLNCSDYTQTPVCRSCGSILTTQTSVPRIGSMASIRCRRCAVGLDKYEGYAADSDIWEDGHGKKFVGGDDTTTVAIPFVLKYLDSELSAMGIKMRYNVEPK

SEQ ID NO: 18073 - protein, 96 aa, Candida albicans
RTGELAKKFQKCFPPGVIGIDANGKAYVKDARKDTVSREVLRHPEFDGKVQLGRQRDHFIFNVESTGAMPPAEIFFKSVRLLKNKAEYLRNCPIGQ

SEQ ID NO: 18074 - protein, 260 aa, Candida albicans
KNICMYYITSRHRYSLLFFSSIRHIIDKIPIKKGNSIMSDNNIVGIEYNRVTHTTSTDFAGHQQNGDYSWDIEKFKNKFEIKITNLSERTGTFDLIHIDTSIANAFRRIMIAEVPSVAAETVYMFMNTSVIQDEVLAQRIGLIPWKIDPDKLTWVDETVDINDRFTEDNTIVLSLDVACSKNPHAPKNSTDPRELYKNSHVYAKDFKFEPHGNQEEKFKDTPVVPCDPDILLAKLRPGQEISLRAHCVLGIGSDHAKSSP

SEQ ID NO: 18075 - protein, 731 aa, Candida albicans
KQDALFYLLSTSFSNTTHSITFNMEVTSLPIKLQPSNIRPIAFRILSKKHGLNINTDALAILTETIGYKFGTDWKSVRSQQFLEEVAKVWKIEDRGLFIDGDGLKQVLKDMNSKSSNDTKRAHRTDTLVDITNDGNQNHTHSHQDKQISFEDKNMEHEERDDVPINWQDYFKVVSPNNQPTSIFDKTRKQFDIVFKNNDDKDKKAERGGKLESIVAELVKNLPASIESFNNRYYLLSDRLSRNENFQKKSLISLSALNSFKEGKTDSITGHEISLIKNMLGRDGQKFLIFGLLSKNANDEYTLEDETDHIELNLSQAFKSQGLFYCPGMFLLVEGIYSASGGNSNQDHGYIGGCFYVSNIGHPPSERRETSLDVYGNLDFLGMHRQIAPVTGEKITKISKKFKKRLVLIEKTLYNHKLIFVGTDLYLDDFKVLDGLRNFFQKLENSIIESIEDEEGQMAEGTNIPLALVFTGSFVSKPLSVTNSSVTNITNSESYKSNFDNFTTIVSKYPNIVSRCKIILIPGKNDPWQSTYSLGSSSLNYFPQSSIPKVFINRLEKLLPKGNLVVSWNPTRINYLSQELVVFKDELMTKLKRNDIIFPRDIQEQEELIAQDDQRTNEERINNLIQNKNTHLPSKIKQARKLVKTILDQGNLQPFLKNLKLINLAYDYSLRIEPLPSVIILNDSSFDNFEVTYNGCKVVNITSVVSLNNRKFNYVEYYPGTKRFEFKDLYF

SEQ ID NO: 18076 - protein, 248 aa, Candida albicans
  UNSURE (237): Identity of amino acid sequences at the above locations are unknown.
RQGNMSGGRVVAAKPSAIREGPIDVNAPNCDARRLNPHLSPDPAINNEELDDLDLSLHPRNWIKIVEAFDMPRLTYNVDKKYFELTKSKATLFPQASHKTSMFRDRYNIIHQRLLRNETFQSSLSYLTGHSMKRSSSSFAPTQCYRLTPIANLLGRSGTSHLLLGLLSISPAGDLSLVDLTGSVALDLSHARTIPDDGAWFAPGMVILVDGVYEEEGSVRGSVLGGNSGFGGAVEGXICGCINLRNSV

SEQ ID NO: 18077 - protein, 137 aa, Candida albicans
FQYKTYIMSDYEDNAFNEVAENFEDFDAPDHFSDNEYDDPSANGGDAALKTTDGRTIINGGFGPDDAQAAGQPRKKTTKELAIPKEKRTTTPYMTKYERARILGTRALQISLNAPVLVDIEGETDPLFHIRMAIQFN

SEQ ID NO: 18078 - protein, 144 aa, Candida albicans
ARDPCQLFVDEDVCDGALLKEKTVRSELYHLIKANIIEIQEVPRSADRAASKTFYLFRHKSNSNFNYLKNCLIYDMAEILNRIQDFKLEHKILLEKYKLVEGQEDQYLLDRELKLLNDLQLREIKNLVKFQRIKSLYSLYSLVD

SEQ ID NO: 18079 - protein, 166 aa, Candida albicans
LLSEISNRTKIPTKNIKSAIVSLIQLNCIYYWQEEKDRKFYYSLKETGLLLYVYSGDIINHIKRQYGEDEAEIIQNILIHGHVKIEDYLTQFNHDKSMKIDQENKFLKLFNDNWLIKLQDYHFHSLDDIWHKIFEECLKDTPRSSVTSEIKRVAEAQAKAKVKLNT

SEQ ID NO: 18080 - protein, 176 aa, Candida albicans
FYGGGYLPSQRSIDTKTFRTNAFVNMVRSKIGVLTAIVYDAALRYIENKSPPMDYPLLDIPGLINDPKDVKEYILSIENKLVNEKKITFSARDIQRLLPKDIDFKNSVITPTFAKPKRPLENGSSPTLKKIKLEDGIASSTSTSTSTSSSTSSNGTSIDLNTLEQHLKLLLNGTNT

SEQ ID NO: 18081 - protein, 268 aa, Candida albicans
NSQSDEHHITSFITIKMASNTVNRSIIVLLGGGHASGKKTTALSLKEELLAIVPECHVDVQIIDMNDYTVDGKSSIDSSQFVSNKSAAISINKSNDKLPRLKPSRFQFDKLKTFLLNNLDTPSNEPQKILLVHGLYALYDKEIRHIAHIKAFIDSDSDTRLIRWIRRDVLQNQTDSLEGVINAYLLGARSEMSDFIFPTKEFADVILPRGAEPNAVRLIIDGIMLYLNDKHLTNDTTQFPENILRPNEIGNFQKERFDVQKNKFYELN

SEQ ID NO: 18082 - protein, 245 aa, Candida albicans
RPSRANIAALKRLGVKAIIAFSAVGSLQQEIKPRDFVLPTQIIDRTKGIRPSTFFEKGFVAHAMFGEPFDLKLNKLISDAIPSKGFLEGFDTDGTPVLHTKENTNNGEDLTIICMEGPQFSTRAESRLYRSWGGSVINMSVLPEAKLAREAEIAYQMICMSTDYDSWNESEEPVTVETVVGNLKANSANACKLAAKLIDEFAAKGGEIGKDLQGSMKYAVSTSPHGVKKELLEKMHFLFPGYWEV

SEQ ID NO: 18083 - protein, 199 aa, Candida albicans
TTFPVRVAQLLGISSVVVTNAAGGINPKFKPGDLMVIEDHINFPGLAGYHPLRGPNLSEFGPRFQPLSDAYDYELRKLFLTTARDKLGITRNIYEGTYFFAAGPTFESRAEVRMIKTMGGDAVGMSTVPEVIVARHSGLRVLALSLITNAGVGDKPPSAFDENPPALDEGMASHAEVLEAADEASKDVQRIIEEVINQL

SEQ ID NO: 18084 - protein, 399 aa, Candida albicans
CHGPTFMFSVKTCPLAAGIIHLGATSCFVTDNADLIFLRDAYDVLIPKLVNVIDRLSKFALEYKDLPVLGWTHFQPAQLTTVGKRATLWLQELLWDLRNMVRARNDIGLRGVKGTTGTQASFLSLFHGDHDKVEELDKRVVELLGFDIVYPVTGQTYSRKIDIDVLSPLASFGATAHKFATDIRLLANLKEIEEPFEKSQIGSSAMAYKRNPMRCERVCSLARHLGGLFNDAVQTASVQWFERTLDDSAIRRISLPSAFLTVDILLSTMLNITSGLVVYPKVIERRINSELPFMATENIIMAMVEKGGSRQDCHEEIRVLSHQASAVVKQEGGDNDLIERIKSTEYFKPIWNDLDTLLDPKTFVGRAPQQTEKFVKNDVANALKPFEKYITTENVALKV

SEQ ID NO: 18085 - protein, 98 aa, Candida albicans
HTTIIMSEYDKYSTPLSSRYASEEMSKIFSLRNRFSTWRKLWLNLAMAEKEVGLSVITDEAIEQMKQHLEITDKEIQDAAVEEAKVRHDVMGPRSCFR

SEQ ID NO: 18086 - protein, 472 aa, Candida albicans
KQKKKKLYSSHPHRTNSTTHTTKQTNMRDLIVLGGSSHHNLTKSICRSLTLEQGLVDSRKFSNGEISIEVKNSVREKDVFIIQSGCGHVNDNFLELLITIAACKTASAKRVTAVLPLFPYSRQPDIPYLANATGAPSISTKKEEYTFESAPATPNPLSKSSSEKSFLSLASSSIVSENKAATTGVNNISSGNRIKLPVPKKYTPKLIHTNASATNFLPQVDAYGKTESGYKQWISPNGTLIANLLTTAGADRVITMDLHDPQFQGFFNIPVDNLYSKPILKHYILNFIPNYKDCVIVSPDSGGAKRATAIADSLGCPFALIHKERRAKLPKNPPLTSMSNSHSHNHYNSQHKPTMVATTMLVGDVAGKVCVLVDDLVDTSYTITRAAKLLKDQGAEYVYALVTHGIFSGDAINRIQQSAIDKLVVTNSTPQSEHVEILGDRMEVLDVSRVFAESIRRINNGESVSMLFDHGW

SEQ ID NO: 18087 - protein, 211 aa, Candida albicans
DTDDVTYRAWWVKKDKTNDAINLDESIATIKNYIQKGEIIADNDLKVEEETEEEKKLPIVGILGFSQGAAFGGVVAHKCHELFETDPLKFVVLYSGFKLDTSKKAGNDKYDEYDPQTEEEVKSGGFKYLHVLGELDTVVAEDRGYSLYEHTKSSADMVKHPGGHFVPNSKMYVDNVANWIEAHQNGSQLKSEAPEDDIDSLLDMMDNFGKA

SEQ ID NO: 18088 - protein, 273 aa, Candida albicans
TKFSHSYVTSNSSVMSKKILCLPGYLQNGSTFAAKSSGIRKILTKKLDCQLDYVDPYHSIESWREFSFPIAANEEESDKTWASIVEKGNNVRWFEHKAPGVNLGLDESVNYLVDYIKQNGPYDGIIGFSQGAAMAEIMTNTIRKLLPSHPDFKISLFISGFFLTEPISDDHSEGNRQRINDITDLEEYKSQVQISPDMAKYFTPPQDLNTQVLMVYGDDDNIVAPVRSKYASTFYKSVHMFPHEGAHYVPNKKDFLEPIVKLFDKTLNEKPML

SEQ ID NO: 18089 - protein, 399 aa, Candida albicans
RLLNTEVALLSRSTDLFRRNSTLTKFLSFYAQTNGVDYLNEVLLPVIKELVDNDVQFEVEKQDNSDTADLFILYLSRIIDLIVNSTDKLPHAFKLVSKAIYDSVSNKFPEAALTAVSSFVFLRFLCPAIISPEQHFKLPINNPKVKRSLMQLVKVLQNMANGTLTSIKWPAIAGKTEELNFYNQKIDGFLKIISTDVTTENQSAELYKPEKPLTSLRYLHKFIYHYFAKIRYNFLFQHSWRCNYLLHDKAVKFKKFDYLVMQMGQPNPGVKLQMSSKLKLLDTNNLDEEEIKLNDFMTKMSIKFSDTPPDAIDVIHSSIFKDGTPAVVVNLKKLSGRPHDFEYLAYKLIETASQVWDNKFYLVYDFTEYYYYIETVTIEYANLIANRGTKLLFNNCPKI

SEQ ID NO: 18090 - protein, 744 aa, Candida albicans
IMDGGFKFEKRDVWLGNLFNILLKLIWEFVRTHASNVPFPADATNFVVTVSAHLAKTFPQMTYRFFKAFFDNFDRIDRETRFTSILYLSPWIQNIYEYVFLNDENGADKTADLLRLFCRLTSIYKDRIPFINDYIWSKLFQEARLVSTLVEEVVAFAIDSKNDNPDWTFIIAVICPSIEVCGEVTSRLLQRINKVVTTDSSIALQSKLFEISVLIKICSSLFFNSYNLAKTYLAELIFFVTLFIDNPVLDVGEDLQKLLMTAIQSFLHKPNLTEAQRAEIDKAIAYFSTPRAKMIFGTSRDVTKRNDAAQAFNKITNIEQFADYLNVFIKAFALHGDRTNWRARWSSNTIDVAFNNYSVFQDRAFLMVGILSKEGISDSNACRTIKLVSNGELNSIDITICVAVAVARILDGLPDSSILPPILIWPQLCFTLLNHAVLYPSGLENVIASITKIMRLGPNYLDIIFEQQQYLEPDLSKFQERHGYIITKENFGVHIFFILGQGLRISQYRHLAIACIKRYFKQRYLMREGKTMDGKFITNNTYAYIFYLYLCCDAKEVEDYLKELEIDRSFISLDDNQKIPKLLIDLLFDNTEVSKILMIHVGFLFCDIQGVDISFKARFIQIYLYMLKNNRELALLVYHIIKPTLMHDLLNTVSVEVVKNISEIVEIVSQCTDYDPEYHKNVVDDILILKKITILKTLRHLKPLSETIDENQIFKPEFDSDIKPIQSMLYRAACSYISGSKLED

SEQ ID NO: 18091 - protein, 1283 aa, Candida albicans
ELLIPQMSDSIMKDDHFIFIQALAKRIESLLPNHTGRSIEEVELDQQFSITRKLLLENNSKDPRTVTYILVTFASILKTINTEFTNNKLKYRDDKSRNSILLICKLLADVLKVSWDRESTIVDDKDFLSNYSKFYYYDTPNRIESSVVSDLVDTFVNMISSSVVRKVVSLVRNEQTLTTLIVAKEESEILREDQLMTKEEETELVIGKIDFYLDTIIRYIATANPEDYYDVLKAKIFRYSQRDATIPLPVLQTYLPLLKFIFFAKVNSVTIVDDTLKALPCIRSNTWKQVYLHFLASSIKAQSFSRTLDYNVLVDLNDTHQTQVARSLFDISFSLFSDESSTNLFNSPFVLIWFFVICLEDVIEVSSDKPLNKLKLTFNKRLKFIMSQLKESSNASSLGSFDSFIHLFHLGARLQAYNQLWHPIYKFSMKFLDEIHQNLIKFGEVRKDDLLVDDDLLFRYDLLTVNFYLAAILINSDKYIRIVINNYKQNQEDLRFNKIFVKIIKGLSEIQTAKKSFFATMKQVTPTLRLMVYGASKILYQYEIRRSINQISQGSINGSSDASTASYIDNEQNSDEVTAATQEAFSRIKTSLDHYTADLFDTDLKKLNSSKNFTTSSSSVLSTSTYRFRVVNGAEELLSDIFRIFAAAPEFYFNDEKLMSKKVYETKPLSESLPPIIRFCHDAIIPIRLAFKSKWIIQGDTRLLDSTKELSLKMVEPTTSLIDIRTDLSVFANFQICCCIIYVTCEACLSISLLNPKFKSCFLFLNSFLQKRTYFNKFVIENPILTNPDTRVYLGFCGDIIHSVEKVLLLSLCTHDILFYNYALQGIDWYLDEVETNKPFYPSEDVRDTLVDTFQKILEDKAVFTGFVSLHKRHRNILRNSKPTKSLYQTWVTIYHRWVRILDTKSSLGNDKTLILRHFTGFLVSTSGCFLSGSLVSEELAANTWPTAPISEFFDKCIELLTSPDMVIQMIIKEALASESQAEVYCLTARKLMETATHYFENNKSDEIAVFLDRAIIVMTSMINVKSEGALYLSTLLPEICQDFIKFINAIDDPCERFKLQLRFCKLGCALESDRTNAGLNGAYKLRNLYSRASLEWLEPAVFYDSALEENIKADDSSSVKTNKEVELLHLALDFAVECSILLRGQVENLLLEVPDGIKEDEINKYKDLSFSVYFSLFYKVIQKYTKATPTNREKHKHHIIIDNILQSITNILQYDSQIGMRFILPMGYHESKKIRSIFLNVFSKMLVHQSKISNREEYPDKLINELTDQFEILYSTAAGNQP

SEQ ID NO: 18092 - protein, 412 aa, Candida albicans
FYFRIEYTPLVDENGQPIPKAPRKPKRKVAVMLGYCGTGYNGMQVQNDPNVKTIEKDIYDAMATAGAISAENAVDLKKSGFQRAARTDKGVHAAGNVISLKMIIEDPEIINKINDLLPKQIRIWGIQRTTKGFDCRKCCSSRIYEYLLPTFSLLPPKPKSVLSELVKEKKLENPDLFEDDQEGIDWWENVKSKILASGITQEQIDSITSSYDEQQQQRQQQQQQQADEEERDVSELSFTKLIKQIKTIENQSRRSYRISSSRLQHFREVMKQYEGTHNFHNFTVGKPFKDTSANRFMIKTIVSDPFVIEGTEWISIKIHGQSFMLHQIRKMIAMAALVVRLSLPCGIINNFFQSTKINIPKAPALGLLLENPVFDGYNIKLTKSDYEPIDFTKFDKEMNEFKMKFIFDRTGA

SEQ ID NO: 18093 - protein, 172 aa, Candida albicans
KSHFNSSSLSIDIIVFPNSIMASHASCIFCKIIKGEIPSFKLIETAKTYSFLDIQPIAEAHFLIIHKHHGAKLHNIPDDYLSDILPVVKKLTKVLKLDENNTPEGEGYNVLQNNGRIAHQVVDHVHFHLIPKKDEATGLGVGWPAEATDFDKLGKLHEKLKEELAKVDNEKL

SEQ ID NO: 18094 - protein, 217 aa, Candida albicans
SCVSCRYKCTSIFFSPKYFQCYYFFFRSLISSTNKATMTSQEIYFYRFLVSKQVFYKSRYTYALVNLKPLVPGHVLVVPLRTNVLRFGDLSPEESVDYMHTLQLIHKFIQKVYKADSLNLAIQDGPESGQSVPHLHTHIIPRHKGDGYGDLIHTMLESKDLEREYQEFFQRKSQYQIDQMTKKNEFSKGDEERVARSESVMSEEAVWLARELEKFTV

SEQ ID NO: 18095 - protein, 326 aa, Candida albicans
QVIMKYVVVSGGVISGIGKGVLASSTGLLFKTLGLRVTSIKIDPYMNIDAGTMSPLEHGECFVLDDGGEIDLDLGNYERYLYIPLTRNHDITTGKIYSHVIEKERNGDYLGKTVQVVPHITNAIQDWIERVARIPVDDTGLEPEVCIVELGGTVGDIESAPFVEALRQFQFRVGNENFALIHVSLVPVIHGEQKTKPTQAAIKDLRSLGLTPDMIACRCQEELEHATIEKIGMFCHVGPEQVIAVHDVNSTYHVPLLLKQQKVMNYLTKRLAIGEIDKQSLAKGEALLSKWRHLTSSHDKSFETVTIALVGKYIIYTIHTYQLSSR

SEQ ID NO: 18096 - protein, 273 aa, Candida albicans
NCHYCISWKVYHLHDSYLSVIKSLEHASMRCNRRLKIEWVESSDLEEDTKKENLSKYHKAWHFVCQADGILVPGGFGSRGIEGMVAAAKYARENNVPYLGVCLGLQIAVIEFVRSVLGVSHSTSMEFDSNIEEKDASVVYMPDVDQVKLGGTMRLGIHQTKFVQDSEWSNLRKLYGGADAVYERHRHRYEVNPLLIDDIEKRGLKFIGKDETGKRMEMIELKDHKFFVGTQYHPECLSKVLDPSRPFLGLVAAAAGILEDVLSRDDLNFEGEF

SEQ ID NO: 18097 - protein, 88 aa, Candida albicans
QTKDMTVNTKTYSERAETHASPVAQRLFRLMELKKTNLCASIDVDTTKEFLELIDKLGPYVCLIKNHIDIINDFSYESPIEPLLKLSR

SEQ ID NO: 18098 - protein, 80 aa, Candida albicans
NMGEQEEGFDWLIITPGVGLDDKGDGLGQQYRTVDEVVSTGTDIIIVGRGLFGKGRDPDIEGKRYRDAGWNAYLKKTGQL

SEQ ID NO: 18099 - protein, 218 aa, Candida albicans
MSVAKAVSKNVILLPQTNQLIGLYSIIRDQRTKRGDFVFYSDRIIRLLVEEGLNQLPVEEAIIKCHGGYEYKGAKFLGKICGVSIVRAGESMEMGLRDCCRSVRIGKILIQRDEETALPKLFYEKLPEDISERYVFLLDPMLATGGSAMMAVEVLLARGVKMDRILFLNLLAAPEGIKAFQDKYPDVKIITGGIDEKLDENKYIVPGLGDFGDRYYCI

SEQ ID NO: 18100 - protein, 357 aa, Candida albicans
NRKDEKKNCRTRVSTNTYPTMLIGISGTLSSGKTEVARYLTFQGFKLISFKQEGHESDATTPEEDEVSHQITDLTVDADYKMEVFKHFDDLSALDNYVTVNWQDNFVISHIQDMNMLKALQKRPFFLHISIDAPVYLRYQRSKLKNNFTLEQFVDKNDQLLFNVANPLIEINNQAQVKIINTSTSIKDLFIKLSELNLLNGSRLRPTWDSYFMRLADLAALRSNCMKRRVGCVIVRENRVVATGYNGTPRHLTNCNEGGCSRCNKGQGSGALLATCLCLHAEENALLEAGRDRIRGESVLYCNTCPCLTCSIKIVQSGIREVVYAQSYSMDLQSHKVMSEANIILRQFHPPKDGIFI

SEQ ID NO: 18101 - protein, 529 aa, Candida albicans
TRFFHFVANSHITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIAPGMGIKEAVPLLLTAVKAGKLTIGDIVSKFHDNPAKIFNLPKQDAQVGLDLDRFATVEPVYLEFSKLRLRGAVERVSFHNETVVLDGSVLSQIALGKNEVVPRSRFGSTAGIPESPRLGNKRVSFSSDMRRPSLAPETPEPQPAIFEKLGSELVSQPIAGSLGEIAALSDYIRHNNTFLRNNIISVKDITRSDLHSLFTVAQEMRLAVERQGVLDLLQGRVLATMFYEPSTRTSTSFDAAMQRLGGRVVAVDHGSSSVKKGETLQDTIRTLSCYSDAIVLRHPSEESADIAAKYSPVPIINA

SEQ ID NO: 18102 - protein, 342 aa, Candida albicans
LPYLFDITMAQLSVPITPPMESTGDVLMTLETQDGIALQGYSFGAAKPAAGEVVFQTGMVGYPESITDPSYEGQILVITYPLVGNYGVPDRELLDEDYEPALPKYFESNKIHIAGLVVAHYTEEYSHWLAKSSLGKWLQEQGIPAIYGVDTRSLTKRLREKGSTLGRLAIQNSDYKSEEIISQSKSNPQNWKKFFNVPEFDDPNVKNLVAKVSTDKPILYTPKKTNENIKLGKNGKPIRILAVDVGMKYNQIRCFVRRGVELLVVPWDYDFTTEEYDGLFISNGPGDPAVMDKTVERLQKILKEGKTPVFGICLGHQLLARATGASTLKLKFGNCGRNPTDW

SEQ ID NO: 18103 - protein, 1405 aa, Candida albicans
TKLNSPGGKLAENRAAHLKVDVKKVLVLGSGGLSIGQAGEFDYSGSQAIKALKEEGIYTVLINPNIATIQTSKGLADKVYFLPVTPEFVRKVIKHERPDGIYCTFGGQTALSVGIALKDEFEGLGVKVLGTQIDTVITTEDRELFASAMAEINEKCARSEACNTVKEAVDAANAIGYPLIVRAAYALGGLGSGFADNEEELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYCVVKIPRWDLKKFTRVSALLSSSMKSVGEVMAIGRTFEEAIQKAIRSTDYHNLGFNKTAALMSIDIDQELQTPSDQRLFAIANALSDGYSVDKVWKLTNIDKWFLNKLDGLIKFGNKIASYGAKEDVPMSILRQAKQLGFEDRQIAKFLGSNEVAIRRLRKDAGIIPFVKQIDTVAAEFPAFTNYLYVTYNADSSDVKFDDNGVIVLGSGVYRIGSSVEFDWCAVRAIRTLRENNVKTVMINYNPETVSTDYDEADRLYFEPINLERVLDIYDLEQSSGVIISMGGQTSNNIALPLYRQNVKILGTSPEMIDSAENRYKFSRMLDRIGVDQPAWKELTSVDEAEDFAEKVGYPVLVRPSYVLSGAAMNTVYSKDDLASYLGQAVDVSPDYPVVITKYIENAKEIEMDAVAKDGKMIMHVVSEHVENAGVHSGDATLIVPPQDLDPETVRRIVEATAKIGKALDITGPYNIQFIAKDNDIKVIECNVRASRSFPFVSKVVGVDLIEMATKAMLDLPIVPYPSERLPEDYCAVKVPQFSFSRLAGADPVLGVEMASTGEVATFGKNKYEAYLKSLISTGFKLPKKNILFSIGSFKEKQELLPSIAKLHELGYKIFATAGTADFIKEHGIPVHYLEVLSKDEDQKSEYNLSQHLANNLIDLYVNLPSANRFRRPASYMSKGYESRRMAVDYAVPLVTNVKNAKLLVEAIARNISLEVSNRDAQTSHGTAILPGLINITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIVPGMGIKEAVPLLLTAVKAGKLTIGDIVSKFHDNPAKIFNLPKQDAQVVLDLDRFATVEPVYPEFSKLRLRGAVERVSFHNESSPRGWTETRCE

SEQ ID NO: 18104 - protein, 60 aa, Candida albicans
VDNKILSNAKQHMCVMHPLPRTNEIREEVDFDQRAAYFRQMRHGLFIRMALLAMVIGVDF

SEQ ID NO: 18105 - protein, 251 aa, Candida albicans
ILFCFSFSNSYLIVYPTSLLLLGGVDKMARGQLILIEGLDRSGKSTQASILSTKLSPSKLIKFPDRSTPIGKLINEYLTNKSFTLSDQAAHLLFLANRWELSQQIQDLLNQGYFIILDRYIYSGIAYTLAKNDFHDETISQGKNKQQLNNIDWLLSPDKGLPKPDLTLFLTLDLEEISKRKGWGDERYELQQFQAKVKQCFLEILDTNKDPTIRIVDVGGKTIDQVTTQLWEIIETNKNHELINDSIQFIT

SEQ ID NO: 18106 - protein, 365 aa, Candida albicans
LNPTIPTMSDIELGITADMHVHLRDGSMCELITPTVRTGGIAISYVMPNLVPPITTKQQVVNYHTKLSKLAPQTTFLMSFYLSKDLTPELIEECADLIHGVKCYPAGVTTNSKYGVDPNDFSSFYPLFEAMQKHGIVLNIHGEKPGTSEEDEINVINAEPKFLPALKKLHADFPRLKIILEHCTTSDAVETVRELNSNYKPGDELFVGATITAHHLYLIIDNWAGNPINFCKPVAKFQKDRKALVDAATSGEPWFFFGSDSAPHPIHAKQTHVGVCAGVYTQSHAIAYVAEIFDKANKLDNLKKFVSDNGIKFYGLSDEILKKHKNESVWLVKRDNQVPEIIGNGDVEVVPFKAGETLKYAIEWR

SEQ ID NO: 18107 - protein, 211 aa, Candida albicans
LPHYYGGFVQFRSEDSCSFLLPFFSSHVEQHCYKHKQTTMASYKSSFLQLALDSQALKFGKFTLKSGRESPYFFNLGLFNTGKLLSNLATSYAEAIIASGLKFDILFGPAYKGIPLAAITVAKLAELDPINYGDIGYSFNRKEKKDHGEGGSIVGCNLKDKKILIIDDVITAGTAINEAFEIIGNEQSQVVGCIIALDTQQTTANDSTKSA

SEQ ID NO: 18108 - protein, 577 aa, Candida albicans
ILSHLEELDSFPLTKANIIFLLNSFTYTSVSNMPLHPKSRRRSSRISPLPDEDSLSFINSSVENLDQSPFESIDDLVEDVNKYDLKSPSDEQRQQLQQELQTQNLKHKPSFTSTPKASYIPPWTEPYIIGIAGNSGSGKTSISQKIIQDINQPWTVLLSFDNFYQPLTLEQSKLAFANNYDFDCPDSLDFDLLVETIGNLKKGGKTTIPVYSFTSHNRTSKTNTIYGANVIIVEGLYALHDQQLLDMMDLKIYVDTDLDICLARRLTRDILYRGRDLGGAMQQWEKFVKPNAVKFINPTVQNADLVIPRGLYNSIAINLMIKHIKNQLALKSRNHLQRLKKLGVNIKFDIDKFNIKLLQNTNQVKGINSILFDTSTSRNDFIFYFNRMCGLLIELAQEFMTNYTNVDIDTGKGIYHGKKLLQNQYNAVNIIRSGDCFMASIKKSFPEISIGKLLIQSDSTTGEPQLHFERLPHKLSDKIMLFDSQIISGAGAIMAIQVLLDHHVKEQDIILITYLSTEIGIRRIVNVFPKVKIVVGKLSSMEDSNSNNKVWYNNEGFLDSHWHFRNRFIDSLYFGTE

SEQ ID NO: 18109 - protein, 289 aa, Candida albicans
FSFIVENKFKSLQMTVSPNTAEQAYLDLCKRIIDEGEHRPDRTGTGTKSLFAPPQLRFDLSNDTFPLLTTKKVFSKGIIHELLWFVAGSTDAKILSEKGVKIWEGNGSREFLDKLGLTHRREGDLGPVYGFQWRHFGAEYKDCDSDYTGQGFDQLQDVIKKLKTNPYDRRIIMSAWNPPDFAKMALPPCHVFCQFYVNFPTSLPDPNNPKQAKTAKPKLSCLLYQRSCDMGLGVPFNIASYALLTKMIAHVVDMDCGEFHHTLGDAHVYFGHINALKEQFERILNNFPN

SEQ ID NO: 18110 - protein, 347 aa, Candida albicans
SINQEDYKMSTNKITFLLNWEAAPYHIPVYLANIKGYFKDENLDIAILEPSNPSDVTELVGSGKVDMGLKAMVHTLAAKARGLPVTSIGSLLDEPFTGICYLEGSGITSDFQSLKGKRIGYVGEFGKIQVDELTKHYGMTPDDYVAVRCGMNVAKYILEGTIDCGIGIECIQQVELEEALKEQGKDSNDAKMLRIDKLAELGCCCFCTILYIANDKFIAENSQAVKKFLKAIKRATDYMLAHPREAWAEYGNFKPTMQTDLNTKKFQRCYAYFSESLYNVHRDWRKVNNYGKRLDILPENYVPNYTNEYLSWPEPKEVDDPEKAQDLMLKHQEECKTCGGYKRLVLA

SEQ ID NO: 18111 - protein, 65 aa, Candida albicans
KEVKQVEELTITLKVFKKRFRTFIETSMPVVDYFDKQGKVVKVRCDQPIDVVANQVKDALKTRGI

SEQ ID NO: 18112 - protein, 186 aa, Candida albicans
AMFSRQVLAGKQIVSTFAKQKAVSQCIKRFNSSKTNSTPPPKYSKGKLLAVLGTLAIGSTIAASFYNKETPKSAFEPNESGDKPEFAEGKVSVIFVLGGPGSGKGTQSDKLVKEKGFVHLSAGDLLRAEQNRPGSKYGELIAKYIREGEIVPQEVTVALLKQAIKENYEQGKTKFLVDGLPQKDGL

SEQ ID NO: 18113 - protein, 137 aa, Candida albicans
HTCCPGYSEGGIPIGSCIISSDGTVLGQGHNERIQKHSAILHGEMSALENAGRLPGKTYKDCTIYTTLSPCSMCTGAILLYGFKRVVMGENVNFLGNEKLLIENGVEVVNLNDQECIDLMAKFIKEKPQDWNEDIGE

SEQ ID NO: 18114 - protein, 60 aa, Candida albicans
RYILELDEVDDGAEIQEALLEITGQRTVPNVFIGGQHIGGNSDVQALNSIDNLNNKFKPA

SEQ ID NO: 18115 - protein, 193 aa, Candida albicans
SHTIKKILLSIKVKDAILTDSTNTILISIQLLKENPHMDYFQTEKTTETRQQRQQKKRPVRNSIICTLSLSYQPNFVMSLLIGWLSSWFQNEPITPELKKEIESNINSHKVLVYSKSYCPYCTSTKTLLQSLNQDYKVIELDQIPKGSAIQNGLQELTGQRTVPNVFINGKHIGGNSDIQALHSQGKLKPLFG

SEQ ID NO: 18116 - protein, 494 aa, Candida albicans
TSCIAKISMEKLQILTERQQTELNHAIIQYLQPLCQQDNHVLLDQLSKLLNIDQSTQESNNVEKVDNYLEKRWSTVLRLQKKIIDLENEISNLNNIINSTNSDNNGIILSKDKINWIPKGAVKQSYQCENIVTTVKLHPNLPLVLNGCNDGNLYIWNISNDDNTIPEKMIKAHTRAINKICFTYKKPYYLATCSSDLTIKIWDEKFNHIRTLNGHEHTVSSIQFSPVDNSILYSVSRDKNIRVWDIFQGISLKSFVGHSEWCRDLDIILLDTYGDFVLTCSNDQLARLSHANSGAGVAMIVGHSHVVETVKFLPSLQANKILDEYITKNTEQFPTIPLELLKDKTYNQLGFKYCITASRDNTIKLWLIPPPTIAPHRPPLPSKYNNSQSWLIAELKGHLSWVKSLCVHPNGKFIISGSDDKTIKFWDLSGLLETGYVNVVKTIIGHDGFINDIDFARLKEASDVSEEDLLKQVEKRMRCLFISGSADNSIKLWN

SEQ ID NO: 18117 - protein, 196 aa, Candida albicans
KIFFLVLTIIFYLIVHNPRLNMLENSLLSTSRFINKSSSSLSPGLLLNNFRGNFQQSRFISTELKDALDKAVTTSPVVLFMKGTPEFPQCGFSRATIQILGQQGVDPEKFAAYNVLEDSELREGIKEYSSWPTIPQLYVNGEFIGGCDIITSMAQNGELAELLEELNALIPEENEPTTSEENQETVQSANIKPNRN

SEQ ID NO: 18118 - protein, 153 aa, Candida albicans
RMRGLSALWGSINPSSPSILDNEEFDKSDKLELAQELESELKENLDSAEASWSTINYWILRFFPYLSHKYSIMPKWFNNKTSTEANNDEKVTVLCCNRVGVEEDVVYAGSSCILQFNNHGKYNDATDLTNESVELIGNLDQINESILIKEIDL

SEQ ID NO: 18119 - protein, 1004 aa, Candida albicans
KLKKLFPEKFQSWKNDYYQSKLHFSIITEEGKSDLIEMTKHYIEGLQWVLYYYYRGCPSWNWYYRYHYAPRISDISLGLEELINEKTDLKFELSHPFKPFEQLMAVLPARSKKLMPVVYRPLMTDEKSPIINFYPHEVDIDMNGKTASWEAVVLLDFVDEKKLIEALKPIESKLTPEEKQRNSYGHAIKFIHNPQIDHVFSSPLPGFFHDIEHDQCYEEEFKLPKIENLKIGFIKGAKTGKDLLAGFPTLSTIPFTSELALNEVKIFNFPSRSESMILNVEDVWSDLTVAQFAQSFVNKLVYSKWPFLRECRVVKVVSEENKFESIKTNTGLKKVVTNELSVEDKKSFRSEVSNLKVTWDKFKGVKLGEINALVYVKPVNGLIRNHKGAYVKTYSKDVDVYPLQLIVREVTNKDQRYLTRPPLPIDQVFPIDSQVVFLGDMAYGSPAKIVGYNEDKTKLGVKIFKIQLTAEPNIGKKRLTIEKNEIKYYPSFEVAKTLRLNPLLLSKITSQFMVQDSSKGKVNIGLELKFESKRQKVLGYTRKLSNGKFWEFSPLAINLINTYKTKFPGLFKKLVNNVSGSNFPTVDEILSLEELKEIRSWLKEVKSELIPVSLESESFTKFSYQAIEQYMDNYLSMNQIPTINKDIKGVPREAILNANESYQLLSDQRFELGDRIIYVQDFGKVPILSKGTVASILTVGSKTSLGVIFDQPLLSGNNMNGKLNSNRGLIIDSSLVLNLTNKQFVYHSHASKNRKKLTDEEKIAKLKAIEAKKNQKQQQQQKEQQTKQKQVEQQKQKGANELLSLLKKKLDMNSTTTTSTTDGDCKKTEEKDDDKNNGNEDERVDPNAIKQIYGHIYSNVMNQGNVRPPPPPPTGPGHPQQFPYGMPIPPPGAPMHPGYIPVVPGNPLPPSFYQQYPPNGQQFVNSQPPPPPPPPPSQQQQPQVAESTSDEKSKNDNKHNVNGRGRGGSRGRGGYRGRGGVRGGRGGNKSSHQNQPKDKVKQES

SEQ ID NO: 18120 - protein, 402 aa, Candida albicans
HIKITGIPKFFRFISERWPLISQLIDENQIPEFDNLYLDMNSILHTCTHSNDNTITRLLDDQMYAAIFNYIEHLFQIIKPQKTFYMAIDGVAPRAKMNQQRARRFRTAYEAEINLKKAIENGEEIPKEDPFDSNSITPGTEFMANLTNNLKYFIHKKITEDSSWANIEIILSGHEVPGEGEHKIMEYIRSIRSQDDYNPNLRHCIYGLDADLIMLGLVTHDPHFALLREEVTFGPQRKVGPKDLHDQKFYLLHLSLLREYLSLEFQEIENQLNFEYDFDRILDDFILIMYVIGNDFLPNLHDLFINKGAFPLLIAAFKQTLLESDGYINENGKINLVRLNIYIKILSKFEFENFEKHEVDVEWFNKKLDDISISGEKKRQRIGKLLILQEHLLPKGTNPPIR

SEQ ID NO: 18121 - protein, 125 aa, Candida albicans
KMELYSPEGLRIDGRRWNELRRFECRINTHPNSSDGSSYVEQGNTKVMCTVQGPIEPALRSQQHSERANIEVNLNIATFSTFERKKRSRNERRLVELKTTLEKTFEESVMINLSRDPSPRDSRAA

SEQ ID NO: 18122 - protein, 400 aa, Candida albicans
IKRGSCQPRRVKTNSKKIQRSKRRGKRIEEIIIDNTLLSTENMTIELDKRRNELHVLNVKAWEGDFTYETVSKLDSSLKKNSTFIKKVKSISNESSLSILKDIQTLSIEKYLSEVLTSLTEALSKVSKSDDILAAMEIVSALHQRFTSQFSPMLLVNIMTAMSNPGPTQVMDEKEETARISRQKNLSKLTMEFYLIGIFTNLKMCSKDTIPDEILVKYGKSASEPIILVVLKDLLNYKIKLGNTLVIVQSFLKRFHHIIYDSNNELLQFEVRNVLQLIFTIYTRAIFETLVELKKRVHQVTEKSKKASIRTGRILEEKQIELENVTKLFEKFKSTSEFVSSILDIPLPYELQQHDQDKEEEEPTNTVVEVVKSKSMNEDDLNGVWEDVKEKNFYTVIPLV

SEQ ID NO: 18123 - protein, 292 aa, Candida albicans
WLNNLKSIFIDTDIPSKKKAQNRAVELKKRNDINKDLLGVFITFLQYYLFCKEKPLPVELDFKLNDLFAKYKSIPTVKRYDTLQEIGKRLQELIQRKREAESYLDNSDEALVVDDDDDDEDVAEDYDNTDDIDLDEDEGDEEDEDDEDDESEEDNDEESEREDDTSDIENNGVSEEDRMRLEAEKKFMDDLDKEYQKILIDSYDKSSSQTSSNRKKLLMPTPRKIFVEKNQVTPSTDKSKVSFGLLTRKGKTTDIKQLQLPSDTKFAESVLKEKEHQRQDRERIMKLVSNME

SEQ ID NO: 18124 - protein, 251 aa, Candida albicans
  UNSURE (20): Identity of amino acid sequences at the above locations are unknown.
ILAFDLLFAENESLLLDDDXGQFSYFLNLVVKVITADVKLFRDCFNNELAVMDSKTKITLVKDNNWNISTYKSLLLSVIQKFFKLNLATEAFDDREQMQNYYSSIDNCLQILHLLVTGNENDFGDLLMFLIQISLKLSKTDTVSPIIEAVQSKFLQCIFYYLERATELRLNLNLLHVEEQNKNPLLINFICLGILKSESPILLEKWMSLLIKSLYLFGESVFSVLLVLNDTLIKKIDNLFDQFSTWSSPRG

SEQ ID NO: 18125 - protein, 302 aa, Candida albicans
LACLKKFLIYGKEDLKNNSELSSLFFKIFQIVTAGASEDMGYTDLVESFEYAQTFILSLEEVSNGYIPSFLECVLSNYPSGDKKLVKSTFVVNSNNVIIASLIYDTNNTMALLQQSQMLMPFLQKWFEIIPHLERVYDLKLSVLACMSLIRLDLDQQTLASISNNLASMLKKLPDAIQTLEKKRKNFGELSGSNYQLEGEWPEDEFEDEEYDEDDEGEGEEYSNIVNSEDLNLHKTGGFFDIKEDEVYEDPLSTTPLDAVNIFAVVKQFIQELQMNNNQKFNSTFGQMNEDDQKIILDIMNV

SEQ ID NO: 18126 - protein, 403 aa, Candida albicans
  UNSURE (197): Identity of amino acid sequences at the above locations are unknown.
DKFSPVAGQVDNLLFTFVYPELLQDCASKTPWLTARACDTIAMFHDHQYTDMKILQDIFQSVVTCFSNDAQFPIQLTAADALSTLVKEDSVSQLVADQAPQLMGILLEKSKQYESDILTNVMDIFVEKFAKNLEPYAVELGSKLVEQFIKIASEILETNGSGHTDKEIQAAGILNTLTTLVISMSNAPNVALQLESXLKDLINFIFENAMIVFLTEVIEILESILFVRPEVSPVIWNIFKVAIESFETYAYEYFDSFQPFFESIINKGFEQPDITIADERVQALMNVCFTILKDEDTDPVFAHLAFENIELTVLALNQRFASFLPQFLPEIFDIFTKLESQDAFDGYMLHHLSILKILSACIYVDPAVTVQFILSKGFWWTFTSCGLSTAPTFKVCTVANCKF

SEQ ID NO: 18127 - protein, 540 aa, Candida albicans
LGMGLLDKRVNYCNWENLEDHLYTGMLCFAEITRKYKWVGNEDRQNKLYPIIEQAFPHLLSIGGVILNTEMTELRAEILKLILKLYKFVTYYDLPEPLRSKDAVISWGEFHGSVINMTPPSYVLGTNILEQEKLFLQISKCYKWAIANIYRLFIRYASTKNLTKKYDYKSFHQLFLNDFIPHFITQFLSIIEEYCQGKRWLSTTALYQLLECLSHCIVEKSTWSLIKPYFETLVTHLVYPIICPDDQILEIYEEDPQEYINLSFDQTSEYDSPENAALGFIATALYKKPKTTLPCISTFIYQQLTELQQQPEETLEIAKKKEGALRILGSISGNLPKDATIEPMLASLVVPCFASKFEFLQARTIEVVSQFCDVPFSNQETLSAIIHGILRNFDNSEASLPVLFESALSIQAFMVKDEFKQVLSNIVLPTMSKLLDLSNEIDNDAISVVMQDCVENFSEQLQPFGVDLMGKLVQQFLKLAHEINEASQADVDDFDGNYDDQGDNAMAALRFINTMITVLLSFENSPEICIKLGKTLFSSD

SEQ ID NO: 18128 - protein, 173 aa, Candida albicans
LSIMDSNLILECFAGTLQADPNLRNQAESKLKELSVSPGFLGACLDVIDLSSSPVQAKKAAAVYFKNRFIRYWEAKDSQYKIDQDEKPIVKERILPVIINADYNIKQQLIPALKLLVALDFDNWGWDYWINGSIIATGKTWKIIFILVCSALRRSPESINGSVMKIDKINCIQ

SEQ ID NO: 18129 - protein, 444 aa, Candida albicans
KMDKQTLLAALTGTLASDQQIRKHSEQQLHAFEQQPGFTAYLLDLITDATENQPGVKTAAAIFFKNRVVNYWVVPENKQHTAFYLSETEKSSIKEKLVSTLFATYKIQQIRLQLSTALNTILSYDKWDELTNIIQKLLSDESNIDHVFTGLICLYEYTKNYRWAGFELNNFVNPILEEITQKLFPQLENLANKSIESDNKVADEMLYLIIKIFKFTSYSSLPTYFQDSNNLGKWCQIHVLIISKPLPKDVLEEDHIESRNSHPRVKTVKWCFANMNRLLSRHGGGYLTKSKETNQFAQMFISNFVPELLNAYWKIIESWSNKTAWLSEISLYHMISFLEQIIETPAWSLISDKLDAIIRHVILPTLVATPETVELYEDDADEYIRRFFDINREQSTSDAASINFIYRLFNKKFKLNNRMVVQLLMKILLNRTIIPKSSEHRPEN

SEQ ID NO: 18130 - protein, 485 aa, Candida albicans
ETKIICMRNTIYKHSSIVTAMSNTLKIAIEGCCHGELNDIYNSIPDIESLDLLLICGDFQSLRNKCDLQSLNVPLKYQRMADFHEYYSGKRKAPVLTIFIGGNHECSSYLQELKYGGWVAPNIYYLGEFGSIWYKGLQITGWSGIFNYHTFIANNIEMEKLPFDSRTIRSVYHQKLANFLKMYMMNHDMDIVLSHDWPVGIEKYGNVKRLLKLKPFFRDDIQRGQLGSPLNKFLIHYLRPRYWFSGHLHVKFEARIVDLVRSTDKKKSATTVDLITESNKEEISLDMDDEEEEEGGNVREVSFEEKFYFKQHLNPAKRPKNDLTPERDVCEHATEFLALDKCGKRRQFLDIKTIEVHNTSHPSFINAGKLYYSKRSIAINKVVEKYLNDNRQDFTELNTKQILSNPQQFPLVNELMPIIENDFKSMQKNITDEDFFMVPENFQTIAPTDDEHTESKLKYYPNNQTLEYCEKFGIPKLVLSKESDQ

SEQ ID NO: 18131 - protein, 413 aa, Candida albicans
QPHTIDRHISNYILNMSLELSSNESEDNFRDELVDISGQVSKKPINIDSRQVRLILDHTAFVRGIGNIKRWFNEEYINSNTTRSNEIINLNIYIPTYTLHEFDFVKKGTSISATNAREAIRFIDNYLENEVEMNSDKIQYNLILESPQDNVPSWNKCNHYKVHSPKIKEFPNYKTKFDSSLIGQIPNVNEDSEFNENFDNALTFNQRNKLNDIQYENSASYQNAIANSDNLAEMPVRLRYLIRSCIYKRFIETKKPKIKNEIEDWKLVTEDPITKIWAKSYGIDCLNVNEAELLIFQNYDVNLFRLYNPYVNDGDNFDPSTNILQNTIDTTLYSYSSVQDEPVTSNYRGKNNRGRNNRGRRGNKRRERERWPLSTDAVVSEERNESGTGFIKKEKFGAINYAPRGQGELWRPG

SEQ ID NO: 18132 - protein, 384 aa, Candida albicans
LFHNFDKSNDDIEDFNSTASNIISTRDNGLINDGNGSETDTINQYNEQELLNQSQDEQYTSDHPIEQAVHSYATHDTDEDSEQHYEHACAYCGIHNPNSVIKCNTCNKWFCNAKTNSSSSHIVTHLIMSRHNQVSLHEESELGDTTLECYNCGNKNVFILGFVSAKQESVVVILCRLPCARSKDVNWDTSEWQALIEDRQFLSWLAPPPTEDDLIEARLITPQQISKLEAQWRLNRAATINDIDNNKEAEQEVLPILMRYNDAFQYQRSFGPLVKLEGDYDKNLKESQALEHIQVKWALGLNNRHLASFTLSTFETSDLKVAVGDEIILRYSGNQGEPWEGHGYILRLPNAYQEEFTLELNPSKIIPPTQLTTSSTIGDGPIRI

SEQ ID NO: 18133 - protein, 178 aa, Candida albicans
VILGNPRSLCRNRLWNHLLIHFREKGCLVDGPLDNLQLSMVQLNTNNMRPTTSAFSNNNGNNYSNGRQRRGKFGVASTINSVTDFDSASILSYDNSAIVHKSGHNGNNNNNNIKEEMWPALNGRQQVFDGDNSLSANFYNKLNKIDKNYGGGRYTNDGNNIEDDIKSITSTFAAGLNF

SEQ ID NO: 18134 - protein, 106 aa, Candida albicans
AADAGLKQSLFERLVFLGHVHIRLEVQYRMHPCLSEFPSNMFYEGSLQYGVTSDDRLIEESTFTLDQYIDTPMMFWANYGREELSASGNSYLNRVEAMYVEVFTRR

SEQ ID NO: 18135 - protein, 197 aa, Candida albicans
TNAVRTVLQRPLSLIQGPPGTGNTVTSATIIYHLSKLNKQKILVCAPSNVAVDHLAAKLDLLGLNVVRLTAKSREDVESSVSHLALHNLVNSNAKGELKKLIKLKNQVGELSVADTNNYLKLSRSSEMKVLNKAEVVCCTSVGAADRRLSQFRFKTVLIDESTQDSEPEVLIPIVKGAKQVILVGDHRLLGPVILDK

SEQ ID NO: 18136 - protein, 96 aa, Candida albicans
LVWTIMPYYAVARGREVGIYSSWRECRPQVYCCKGARYRKFENLIEAKEYCENDGRYYIYPVYVDGACRNNGRENAKGGYGVYYGHEFSTAVQIIL

SEQ ID NO: 18137 - protein, 240 aa, Candida albicans
ILNIYSIMPYYAVVNGREEGVFSSWQDCRPHVFAYKGAHFRKFENRNEAEEYYQNDGDYFIYPIYVDGACRYNGCPHAEAGYGVYYGDGDSRNVSVPLDDVDPDGIIPTNQRAELWAMNHALRNIWNELQEDTEDGKAVIYSDSIYAIKCLTKWPNKWTQNGWLNVHGQTISNYDLVTKNYELYEWINDEYDDRGWGELDLIHVKGHSGNDGNEEADNLANLAADRYGYQSSSSSSGSYY

SEQ ID NO: 18138 - protein, 319 aa, Candida albicans
FFNFLLYPFLHPSFFRLIQFFKISRRLFKSIQTDMPYYAVAKGSKTGVYSNWGDCKEQVHGYSGASYKKFSTAAEANAFVQSGGKSGSSSSYSSGGRSSGGISGSSRSSGGYSGGYSGGYSGGYSGGYSGGSSKRSSSSSTSSSSTTTNRVYVDGASRGNGQTSKAPSGYGVYYGPNDSRNAAVPLDRVDKNTSYKPTNQRAELHGVKHALKNIHNDLQLGKATGKTEIHSDSKYAIQSVNEWSSNWAKNGWKNSKGETVANKDLIHETVALKNSINKTYQDKNWGNLEFVHVKGHAGDPGNEAADRLANQGADQYGKK

SEQ ID NO: 18139 - protein, 252 aa, Candida albicans
QMSSSCVVLVYASVCVLACRVEFKSWFASQYPPQTLFNRHRSWRRTKYKQNKTKRVSFPSHHNININKSKLFFSTNNNNKNYLHYPVLPLHFTMGVNGLLQILREIQDPCSLERYRGQTLAIDTYGWLHRALVSCAEELCLGKPTRNYITAILNKIQMLNHFGITPYFVFDGASLPTKQETNRERQLKRQEAKELAEKYIAANNRKLAYKQFMKAAYVTSQMAKSVMCELDNLSIPNIFVAPSSPRAGRIRD

SEQ ID NO: 18140 - protein, 273 aa, Candida albicans
FHFLQPSNISPITMLSILSIAALLIATVQAADFSSSCPIDSPISCSSNGDTSNSCCYENPGGIILFTQFWDYNPASGPADSFTIHSIWNDYCSGGYPQFCDTSLEIDSTGSTIESIVVDQFGDQTLYDNMNKYWTDINGNNKKFWAHEFNKHGTCLNTLNPSCYSNYKQNENVYDYYSLVYQLFQKLPTYQWLVSAGIKPSTTATYTLSQIQSALKSKFGAEVYIACDSNNAINEVWYFYNIKGSILQQNYLPIDTVSKTNCPSSGIKFPPKR

SEQ ID NO: 18141 - protein, 348 aa, Candida albicans
HSFGTIIQQLGPDNLFTQHGLWGNMCSYGYPQFCDPSLEINPNGEIIRSIIVDQFGDEELYNNMSYSWKDYHGKDSSFWAHEYNKHGTCFSTIKPSCYLSNTPKNQNLYDFFRIAIGLFNKLPTYDWLAEAGIVPTNSKTYSLSEIQSALNDKFGANVFIKCDYNHAINEIWYYHHVKGSLLQHNFLPIDSVAHTNCPSTGIKYPPKGKIAHPTLTTKTTTGTSTTIHNPTGIPARSYVHLSGKSGCLISNGKWYTSGTCATYHFKKTIDDSNIEIRSSKGICGINGNEEFTCSRAVSGGTDFQIKDGKIGYQDKFDWCFGSTTGSGSTAQTSVKLADGSCDSFQLLI

SEQ ID NO: 18142 - protein, 96 aa, Candida albicans
KINIMVIKMKYSILAILAHLLTNIKATQEVFTLSDLPPDSCPIDSPISCSKNAQELENVNSCCYESPAGVILLTQFWDYNPATGARQFVYSTWIMG

SEQ ID NO: 18143 - protein, 332 aa, Candida albicans
VTNYNHNMLSQSFLIALAVIPVTLASPYYNPYFGKYFHGQRTSGDSSSSGNFYPVKDCSTFIDQNPETSWSCHNKSPVSAANSCCFEENGIILLTQFWDYNTTLLEIAVNGSTSDIVEAELKSKLDTVYNDLSRTFTIHGTWDDFCNGSYPQYCNKSLEVSDEKDNLTHILVDQFKEVELYNIMSKYWIDTIASNVDSSASTALWEHEYNKHGTCMTTLSPSCFTSQNYTRFENVVNFYKKTVEIWSQLDTFEFLAAAGIYPTVSRKYKLSQVQEALQKAHGAEVYVGCLNNSISEIWYFYNLQGSILTGTYKPIDTTTNTKCKDEVWYIPK

SEQ ID NO: 18144 - protein, 220 aa, Candida albicans
RGNTRAVVDYSSNYFQTRYDLAVKMIKDGNAYCDDTPVDTMREQRMVGDASARRERSVEENLRIFTEEMKNGTEEGLKNCLRAKIDYKAPNKALRDPVIYRCNLTPHHRTGTEWKMYPIYDFCVPVVDSIEGVTHALRTNEYRDRNPQYEWMQKTLGLRPVAIWDFGRVNFVRTLLSKRKLQWFVDKNYVSNWDDPRFPTVKGVRRRGMTVERLRNFIIS

SEQ ID NO: 18145 - protein, 210 aa, Candida albicans
RQDIDPVAPRFTAVDAKNVVSVKLLNGPKEPYTESKPKHKKNPEVGNKDVIFADQVLIDQEDADLTEGEEVTFMDWGNIIVSKVNKEGDIVKSVEANLHLEGDFRKTSKKITWLAYTKDKVEIDMVDFDHLITKDKLDENDNFEDFITPETEFHTKGFADLNVGKLKAGDIIQFERKGYFRVDKPSEEGKPAVLYTIPDGKAVSRYGAKK

SEQ ID NO: 18146 - protein, 222 aa, Candida albicans
SYTSPFLSFYLYYNYLTKLEPKMSFKLSVAGKAQNVPYPVLIAVNFINSSDVDVSIPIEFVDDKTVDSKDSIKLVTPGGETFIDQLDALDYLSQTLPELLPERSKSQEWIKFALTKLYVKNFKELAVDLEKLDQHLNFRSFIVGYQYSLADIAIWGVLRANALMGSVIKNGVYANISRWYNLLADDKRFEGSVELMTKSLAEVRKAAKSAKTLHHAAGRTHA

SEQ ID NO: 18147 - protein, 297 aa, Candida albicans
SPGITRSCTPSLRPAAPMFKGFLVDQDVRWNVVSGAVDDRTFIEKGQEPYSGYHLFGGLDIDAQDKLRINNHQINQQGDLLDLYTKDGKPIQRVPKSRYDSIDNYLNDNYYDTKYFQDEYNDLNAPINEQVYQRLIDEGKLDKYMANHFAHLFIRDPLVIFSERINQDNNLENDHFENIQSTNWQTLRFKPPALYTKDTDLTTKPGWRVEFRPMEIQLTDFENAAYSSFITLLSKAILKFQPNFYIPLLKVEINMKLAHKVDSTLKDKFWFRSFELWNIDPQEFDDYGFEWFDGNFF

SEQ ID NO: 18148 - protein, 202 aa, Candida albicans
MVTNNQNGHVNNNNNNDKKTKNDPIIVNVSTTTTNGTNSGSGITETNGTMLPKGCEGKTVEEINDVDDNGIDQRYTICQLINGSGKFPGFIKLVIKLIATDLVPQALNNSTTSKEQLIEELIRLRSYLYLLATRANGEIPTTAHWVRNKVLQHQDYKQDSKVSEKITFDLIDDSIKITELKDRQLIEGFLGADITEYLMGSK

SEQ ID NO: 18149 - protein, 176 aa, Candida albicans
FKKRNHCIIMGLLSIGTPLSWDESKKYNNHVRTNGITQLINIFKQHGHRENDVFLWGDEVEYMLVDFDKTNKTARLSIDKDYIINDLNDPDKLLPIAEKQDVSYHPEYGRFMVEATPAKPYNGNLLLDYLYIEKNMIIRRQLCEDNLPSHIKLLTLTTFPRMGCNIFTSPPSKPNV

SEQ ID NO: 18150 - protein, 165 aa, Candida albicans
GVCEKNFHLPKPGQGLLFGGDLTNDKLGKVAANLTGLGYKFYTASEPVAQYLKQNNFVNEPVEIIEFPKTDKRALREIFQDKEIGAVFNLAKARAEDLLDEDYVMRRNAIDFAIPLFNEPNTSLLFSQCLKEKIGHKVSFDEIPHKVEIPDEVKRWSEFIGGKPV

SEQ ID NO: 18151 - protein, 420 aa, Candida albicans
  UNSURE (37): Identity of amino acid sequences at the above locations are unknown.
FVVFRIIFLEMMTVKAAITQQFKITKKSILFVHKHSXSSSSLLKQKEQLRYAGADLLKNFTDEHAHKLVDVSKVLVIGSGGLSIGQAGEFDYSGSQAIKALKEANKQSILINPNIATNQTSHALADEIYYLPVTPEYITYIIERERPDGILLTFGGQTGLNVGVKLDKMGVFERYGVKVLGTPIKTLETSEDRDLFAQALKEIDIPIAESIAVETVDDALNAAKEVGYPIIVRSAYSLGGLGSGFAANEKELRNLAAQSLSLAPQILVEKSLKGWKEVEYEVVRDRVGNCITVCNMENFDPLGIHTGDSIVVAPSQTLSDEEYHMLRTAAIKIIRHLRVVGECNVQYALQPDGLDFRVIEVNARLSRSSALASKATGYPLAYTAAKIALGHTLPELPNPVTKTTTANFEPSLGLFGYKNS

SEQ ID NO: 18152 - protein, 304 aa, Candida albicans
DYLVTKIPRWDLSKFQHVKRDIGSAMKSVGEVMAIGRNFEESFQKAIRQIDPSYIGFQGDHFDNLDEALANPTDRRWLAVGQALLYENYTVDQVHELTKIDRWFLHKLMNIVNMYRELEANGHLSIINHDLMSRAKKLGFSDKQIGLCVGADELEVRRVRKELGIIPFVKKIDTLAAEFPANTNYLYTTYNATSSDIDFNDKGTMVLGSGVYRIGSSVEFDWCAVSTARALRANGHKTIMINYNPETVSTDFDEVDRLYFEELSLERVLDIYELEHAQGVVVSVGGQLPQNIALSLQNQGCNVL

SEQ ID NO: 18153 - protein, 188 aa, Candida albicans
TNPEDIDKAEDRHKFSQILDSIGVDQPAWKELTSVKEAEEFANEVGFPVLVRPSYVLSGAAMSVINNKSELDAKLSNAAKVSRDYPVVISKFIQGAQEIDVDGVANDGEVLVHAISEHVENAGVHSGDATLVLPPQGLSPILLDRLKVIADKVAAAWKITGPFNMQIIKNDQNGTLNDETCELKIIEC

SEQ ID NO: 18154 - protein, 352 aa, Candida albicans
KEKKNSSCKKKIVDGITNIQQLVINKKMSTKTDISTEELVSLFSKAGFEEKKSAEIVKNKKVASALYNILGSNFPKTDDKKLSLLHQLAIHESKNGKVPNHDFIIDGIQKGDLKTALQVTEGIKYLQNNATVDKEKFDEASGVGIEITPEEAKVEISKYLDSIKTDLESKRYSILPKVLGEVKTQPSLKWAPLNLFKPILDEEFLARLGPKDERDVKKKEKKAKTPANAAATKKQDTGSEPERSMFFEGFLGDLHKPGEEPQMYPELLEEHKKFICDKVYTRFPPEPNGFLHIGHSKAIMVNFGYAQFNKGNCYLRFDDTNPEAEEEVYFDPRLHHGDALSMHDPRLMSRGI

SEQ ID NO: 18155 - protein, 367 aa, Candida albicans
IASAGENYDFTHCLVDSFENITHSLCTTEFVLSRESYEWLCDALHVYRPAQREYGRLNLTGTIMSKRKIAKLVNEGYVRGWDDPRLYTLEGIKRRGVPPGAILSFINTLGVTTSTTNIQTVRFESAVRNYLDQTTPRLMMVLHPIEVVIDNLDESFSLDVEIPYKPGKDEKSMGYRKLTFSKHIYIDENDVRAEPADKEFYRLAPGQPVGLMRVPFNISFKSIEEKDGKKIVHVNYDESVKAKPKTYIQWIPKDTAVHIKEVRIYNQLFKSENPSAHPESYLKDINPDSEEVLRNAVVEEILKDIVAKSPMNIEIPGSAFHIKGNKGNNTVRFQALREGYFCLDKDSKEDGLILNRIVSLKEDAAKK

SEQ ID NO: 18156 - protein, 139 aa, Candida albicans
SFPFPMLSATKRYLATAAAAAATNTTTTSKAFTNTTSQLGRATLTIKDGPVFNGYSFGANRNVSGEAVFTTSLVGYPESMTDPSYRGQILCFTQPLIGNYGVPSSTAKDQFNLLKYMESPKVQCIGILVADAALKYSHW

SEQ ID NO: 18157 - protein, 241 aa, Candida albicans
DEDTRNLVSYLRDKGSSLGRITIGEEYDADEDAAFEDPGAINLVHKVTTKAPFHIACPPQYSKGIHIAVLDCGAKENILRCLVERGASLTVFPYDYPIDKIANKFDGIFISNGPGDPTHCSTTVNNLKKIITNHQDLPIFGICLGHQLLALASGAKTIKLKYGNRAHNIPAIDLITGNCHITSQNHGYAVDANTLSENWQPYFTNLNDLSNESMIHKYQPIFSTQFHPEAKGGPLDYSFLI

SEQ ID NO: 18158 - protein, 483 aa, Candida albicans
YDADLPALVAEYGSGGVASAKTTAKYGAKVLLIESNFKKFGGTCVNVGCVPKKVMWYTADLAHKKHDLYAYGLDKEPDSIKYGDFDWAKLKHKRDAYVTRLNGIYENNLKREKVDYAYGFAKFINSEGEVEVTLLGDQELPFLDEGKTYKKGEKLVFSADKTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVDVKINDKQQIVADEYQVTNNPKIFSLGDVVGKVELTPVAIAAGRRLSNRLFGGPEFAKDKLDYNNIPSVIFSHPEAGSIGLSTKEAIEKYGEENLKIYQSKFTAMYYAMMDDQKDKSPTVYKIICAGPEEKVVGLHIVGDSSAEILQGFGVAIKMGATKKDFDNCVAIHPTSAEELVTMT

SEQ ID NO: 18159 - protein, 298 aa, Candida albicans
  UNSURE (276): Identity of amino acid sequences at the above locations are unknown.
PQMRSFHGGVKTVHNDDPDDVTESSFKRFLCDTPFPDDEVDGDKDQFEGLELKNWGESTKPRIGPTHELYFLDGKLIAISILDFLPSGVSSIYFIWDPGYAHLSLGTLSGLKEMQMCDKLNYSWYYLGYYIEDCVKMKYKLKFGGELLDLCNEVYFPLEIVDPYIKNGRLFVIGEKDDEYDSELEIESLGAPLDYKDSDFYEKKLVNIAEDIYGDEKVEADAKKAKQILKVKYQIDLKDSQKRLPNVVPGMIPHLANSPNGLIWVTLMKISLLKYXWGEKMFEYSLEQLNGERENNRG

SEQ ID NO: 18160 - protein, 242 aa, Candida albicans
  UNSURE (6),(7): Identity of amino acid sequences at the above locations are unknown.
PPPLVXXQTLFLPVWLKSDADKAHVNTKQRVTEVVMHELAHQWFGDLVTMEFWDGLWLNEGFATWMSWYACNSLYPDWKVWESYVSDSLQHALTLDALRASHPIEVPVKRADEINQIFDAISYSKGSSLLRMISKWLGEDVFVKGVSNYLKKHKWGNTKTSDLWEALSEASGEDVVKVMDIWTKNIGFPIVKVKDIGNGDIQVTQNPFLATGDVKESQNKTLFPVILGIENHFTVLKNLWVF

SEQ ID NO: 18161 - protein, 190 aa, Candida albicans
NTIPLEEAWLCDIDETVIEVSKKYLPNMAKSYDDPRTRVHIGDGFKFLEEYKNQFDVIITDSSDPEGPAESLFQKPYFQLLKDALTEKGVITTQAENMWIHMDIISKLKKDCNEIFPVAEYAYTMIPTYPSGSIGFMVCSKDPNANVSKPIRFDWSDEFVAKNLKYYNKKIHEAAFVLPTWADQVLNKKD

SEQ ID NO: 18162 - protein, 151 aa, Candida albicans
  UNSURE (147): Identity of amino acid sequences at the above locations are unknown.
VEKSSLYIFSSYLNNFFFLNIYQFTMAQELTHPAIKDGWFAEISDTMWPGQAMSLKVEKVLHVEKSKYQDVLVFKSTTYGNVLVLDNCIQVTERDEFSYQEMITHLALNSHPNPKKALVIGGGDGGVLREILKPESIQEDLPHNRHXRTIS

SEQ ID NO: 18163 - protein, 347 aa, Candida albicans
FNNMSPSTQQQVHELNQSQSNDSSSIGLRLNDNNIQPIEIELSSFKHDSITFHKQDSSYWFYEKLKQSFPGQSFGLQVEKILYHTKSSFQDILIFKSTNFGNVLVLNGIIQCTEKDEFAYQELITHLPIMSHPSPKKVLVIGGGDCGVIRELIKHVNDQTIQEITMVEIDDMVIKLLTKFLPEMAKYHNHPKVNLIIGDGFEFLKNSSKEKKYDVIITDSSDPDDGPAEEFFQINYFKLLLNALNEKGIVIMQSLENIWLNLPYLKELKSKAATVFSNVKYCQCYMPSYTSGQLGLIIATMDTGKDLVNPLRKFDHDKELKLFKYYNQHIHTNSFVLPTWADDYLNN

SEQ ID NO: 18164 - protein, 331 aa, Candida albicans
LLSLIPNFNGNPAHFFFLLFASLCFASVRSNQYKFSTKFFILFLSKLFFSTRDKSLIMKDYTITVLGCGVMGTAVTSAILKSKFDPYPKKIIACTIPSQEQSLKETFADQPLVHVSAGVENNNKAVTEADVIILGCKPYMYEGIYEEVKESLTGKQLLISLLAGTTIKELSIFTPYVAKVMTNTPARFGCGTAAIAFAPEVSEESQELVMKLIDTVGMTVKIPEKNMDIATSLIGSGPAFCLLMMESMIDGAVRMGMPYDVASVAAAKVMEGTARMVLETGEHPAALKSKVCTPGGTTIGGLLTMEDRGLRSAIARGVEEAANISASFAKK

SEQ ID NO: 18165 - protein, 181 aa, Candida albicans
SKMGLLIQNKISQIIRQRMDEIQFEEVSLSLISHKELWKLTNRWDQEEIFKLVGDEYLLVPTAEEEITNYVKKQFLESYKNFPLALYQINPKFRNEKRPRGGLLRGKEFLMKDAYSFDLNESEAMKTYEKVVGAYHKIFQDLGIPYVKAEADSGDIGGSLSHEWHYLNSSGEDTGPECDVS

SEQ ID NO: 18166 - protein, 500 aa, Candida albicans
QGKKKKILSLKNFSSFSSSVLYITAIKNNQLIMSQQQDKQPSENKLWGGRFTGATDPLMDLYNASLPYDKVMYDADLTGTKVYTQGLNKLGLITTEELHLIHQGLEQIRQEWHDNKFIIKAGDEDIHTANERRLGEIIGKNISGKVHTGRSRNDQVATDMRIFVRESLLNLSKILHQFITAILERAHKEIDVLMPGYTHLQKAQPIRWAHWLSSYATYFTEDYKRLQEIITRVNQSPLGSGALAGHPYGIDREFLAKGLGFDGVIGNSLTAVSDRDFVVESLFWSTLFMNHISRFSEDLIIYSSGEFGFIKLADAYSTGSSLMPQKKNPDSLELLRGKSGRVFGQLSGFLMSIKSIPSTYNKDMQEDKEPLFDALTTVEHSILIATGVISTLLIDKQNMEKALTMDMLATDLADYLVRKGVPFRETHHISGECVRKAEEEKLSGIDQLSFEQFQQIDSRFEKDVMETFDFEASVERRDAIGGTAKSAVLKQLENLKSILS

SEQ ID NO: 18167 - protein, 693 aa, Candida albicans
YGMALEQSLAQLSLATVASPENGKALPTKSLIFKPKTAKTATPIPLFVFALQDTTTPSNLIAKSAGVKEPRLAKDDLVEEFFKTTTKEVSIANLSKELAGKIKIVIDDNVLKAAKNEELLKLSTQSSAAVLSAKTVVEFLQSTGIEIIEVDFSAEPTQAPASASPGGSGAAASSKKEKKDDAKLEDAKLIGITVDKEKDFSSWYTQVVTKGEMLDYYDVSGCYILRPNSYFVWETIQDWFNARIKKLGVQNTYFPMFVSQRVLEKEKDHIEGFAPEVAWVTRAGNSELDEHIAIRPTSETVMYPYYAKWIRSHRDLPLKLNQWNSVVRWEFKHPQPFLRTREFLWQEGHTAHLTKDAAANEVLQILDYYAGVYEELLAVPVVKGKKTENEKFAGGDYTTTVEGFIAATGRGIQGGTSHHLGTNFSKMFNISVENPEGSEKPRIFAYQNSWGLSTRVIGVMIMTHSDNKGLVLPPRIAQYQAVVIPVGLTSKSTDAQRKEINEGAEKIEQSLRANGIRVTGDYREIYNPGWKFADWELKGVPLRFEFGPKDLAGNQVTIVRRNDGKKYTVKLDELDTEVPKLLDQMHDDLLTKAKQEFDEHRVKVDEWKDFVPTLNKKNVILSPWCGDADCEDDIKDSSAKKDDGEEEEVDEKAPSMGGKSVSIPFEQPELKEGQKCVKWDRKAVTYCMFGRSY

SEQ ID NO: 18168 - protein, 353 aa, Candida albicans
VLYITFHIMMSSVRTITTTRLLSTTPIKATASSQTPRHLINIAQLTNDEFSSLINKAYQFKQLVKSDKPSIENHQKLLGKLVALLFTKRSTRTRISTEGAASFFGAQPMFLGKDDIQLGVNESMYDTTKVISSMTSCIFARVNKHQDILDLCQHSSVPIVNSLCDKYHPLQAIADLLTIKEQFGDNLKGLKLTWIGDANNVINDLSIACLKLGINVSISIPKDITFDQDVVEIAEKLAKEQNLTFEIVNDPIIALNNANIVVTDTWISMGEEEQKLAKLKQFQGYQITQEMCKLGKVNSNWKFMHCLPRHQEEVADDVFYSDNSVVFEEAENRLYAAMAVIDGFVINKGDLLK

SEQ ID NO: 18169 - protein, 424 aa, Candida albicans
ITIPISNQECFYVRPSATKPISTITTTTTAKTTRIQHQSYLTMVAPALIYSNHELSTAIDSTHAFEGPEKLLEIWFYESKELSPINLRDIKFDTWIEILNLVHCEVLSKVSSNLCDAFLLSESSLFVFPHKIILKTCGTTTTLACLDLLFETVNKELLQNEGLKATFQSKNIYQIFYSRRSFMFPDRQIHVHGNWQEEVKLLNQYFNNGKSYIVGNNTNWHLYVGGNGKTKNPVASTTTTTTTPVVNDCTLEIIMTQLSLEASQQFYTTRKPGDTAIDSNHDLGHDLGQEILKQTGLNELFKFKKQPTMPGLSSSPIKEIHDGFAFTPCGFSSNSINESNYYTIHVTPEPGWSYASFETNMIGDYKAIVDKCINVFQPGQFMVTFLTNTDMEKFECCLDDYKVNHREELDVEDYKLYFVEIVRQ

SEQ ID NO: 18170 - protein, 338 aa, Candida albicans
  UNSURE (2): Identity of amino acid sequences at the above locations are unknown.
LXRIIACLDVRTNDDGDLVVTKGDQYNVREQLSSSSTNESAEEDSSQVRNLGKPVELATKYYNQGADEITFLNITSFRNSPLKDLPMLQVLKKAAETIFVPLTVGGGIKDLYDPETGKTVPAVDVAHLYFQSGADKISIGSDAVTIAENYYANNGEITGLSSIETISSKFGNQAVVISVDPKRKYIKDPTTETTTMQTIKITDPSQYGPNGEQYCYYQVTSQGGRKIHELGALELCLACEKLGAGEILLNSIDHDGSNKGFNLQLLQQIKSQVSIPVIASSGAGNPQHFQQVFEMDCGIDAALGAGLFHRGEYTVNQVKKYLQQEAKMDVRLDEDLEL

SEQ ID NO: 18171 - protein, 214 aa, Candida albicans
  UNSURE (14): Identity of amino acid sequences at the above locations are unknown.
QNDTQALCSIDMPXGPFEVLVIADSNADADFVASDLLSQAEHGVDSQVILIGVGLSDEKLNEFQAAVERQAKVLPRKDIVAKCLAHSYILLAKTYKEAFDLSNQYAPEHLILQIDDAPSYVPDLIENAGSVFVGALSPESCGDYSSGTNHTLPTYGYARQYSGVNTATFQKFITSQEVTEKGLQNIGKAVMELARVEGLEAHRRAVDDSNGDHG

SEQ ID NO: 18172 - protein, 183 aa, Candida albicans
  UNSURE (169): Identity of amino acid sequences at the above locations are unknown.
DRFPSGCQYKILGPGNQFVTAAKMYVQNDTQALCSIDMPAGPSEVLVIADSNADADFVASDLLSQAEHGVDSQVILIGVGLSDEKLNEFQAAVERQAKVLPRKDIVAKCLAHSYILLAKTYKEAFDLSNQYAPEHLILQIDDAPSYVPDLIENAGSVFVGALSPEKFPXGFLGVITQVGRTIL

SEQ ID NO: 18173 - protein, 200 aa, Candida albicans
RQNYVPVIPSTKLTVKRQEENKISISAVFVSTLTTDRPDGLYTTLITTPSPSYTALGIVYSSKDSIIAAIEEKVGVYQSRKRRDELWYKGKTSGATQKLVKLSKDCDSDVIQFMVEPRTGYGFCHRETKFTCFGDDIADSPARGLPKLDSTLQDRLENAPEGSYTKRLFDDEKLLIAKLKEELDELIEAKSKEEIAWAVC

SEQ ID NO: 18174 - protein, 162 aa, Candida albicans
  UNSURE (152): Identity of amino acid sequences at the above locations are unknown.
LRLNQRKKLPGQCADLVYFAMVWCIKHGVRLADIEKNLDVKSLKVSRRKGDAKPQYQEAPVNSSYKLEIVSVDDAAAVERAMTRPVQKTADIMKLVLPIIEKVKSDGDKALIELTSKFDGVKLDAPVLQAPFPADLMDISEDMKAAIDLSMXNIQKFHAAQF

SEQ ID NO: 18175 - protein, 132 aa, Candida albicans
ELTHFDYYATIEIFYFFLVKIFPTQLLLLLNHQLPIMDLVNHLPDRLLFAVPKKGRLYEKCCNLLSGADIQFRRSNRLDIALSTNLPIALIFLPAADIPVFVGEGNCDLGITGLEQIKKTEQFDNIEDWLDL

SEQ ID NO: 18176 - protein, 156 aa, Candida albicans
VVEDRYVGGSVEASCALGVADAIVDLVESGETMKAAGLKAIETILETSAHLISSKKSKFPEMVNIIVQRLQGVLAAQEYVLCNYNAPKSIQAKCLTITPGRRAATVSTLDKHSDDEEDWVAISSMVNRKEIGNVMDELKKAGATDILVLEISNCRV

SEQ ID NO: 18177 - protein, 318 aa, Candida albicans
MHTHHSHSGDYVSHAVDTLNDMVELYYKKGFQIICLTEHMPRLDNKYLYPEEIDKSYTIDNLNGDFTRYLNHARDLQLKYATKDKSSSGNMKIIIGFEVEGINIDHINYSQELLNKVQMSVGSVHFVNEIPIDFNKELWLKARESTKSKTTRELYNDYFELQYKVITQLKPTVVGHFDLIRLLQPEDDIDPTTGKLTKDVNLEIDWPDIWQLVIRNIKFVKLYGGLFELNSSALRKGWDTPYPKRDIANAIIEYGDSRFCLSDDAHSLSQVGIFYSKAWEYVESLGMENIYHLDLDDNGEVVISSKKIQELNNSLFWK

SEQ ID NO: 18178 - protein, 158 aa, Candida albicans
LKFHRHFSFLFWLALTILSLLTMFDISAIIRPNILTLEPYRCARDDFKTGILLDANENTHGPALPSPDANEAALELNRYPDPHQHELKQQIIQFREQHPNKYATEKLSIENLCLGVGSDESIDMLLRCVCVPGKDKMLICPPTYGMYFFDHGLENPAL

SEQ ID NO: 18179 - protein, 107 aa, Candida albicans
WIIMFPKLLNMRELVLEKLLSLKYVGRNIGGLDSNFILIEILDKDGKPSNDVAKKLYNTLATDNSVVVRYRGSELNCVGGLRISIGTAEENKQLLTKFESVLNEINK

SEQ ID NO: 18180 - protein, 143 aa, Candida albicans
EIFKLGETGISIGKLEGDAKFSQVNTNIILFHEEYTITDIPKDRQILQYSISSNKKGSNKFREILPKIKIDLPCTILCDTGRDLSVGMALVLLCLNFDLNWCPTTTPPTVTKTLIKQHLSKISQICKVNPSRSTLQSVNTFLF

SEQ ID NO: 18181 - protein, 71 aa, Candida albicans
ECSCGPSSRVVKNVPLNDRLDTCDFKSTDGHTNVWSFSLRRLNLHLLPIISEHGGVVILDSTRRGKLMPDA

SEQ ID NO: 18182 - protein, 136 aa, Candida albicans
LKTIPIWCAVSNSVIYGTGDWLRTPSSMVSKSEHNSIDKLIPSFVASVIQIKLLEGFKLYKPLIPSWYYPGASLNSNLVESAYNICCISASRKLDVHNRIDITTGTGTISCDCIQGSADDHELLVPSSLCNGKYGA

SEQ ID NO: 18183 - protein, 514 aa, Candida albicans
KKKSLQKNFHHISMIKRLLMTATKPKKGKAQDFVLKTPKGTKDWADKDMVLREAIFGTLSTLFKKHGGVTIDTPVFELREILTGKYGEDSKLIYNLEDQGGELTSLRYDLTVPFARFVACNNIASIKRYHIAKVYRRDQPAMTKGRMREFYQCDFDIAGNYDTMVPDSEILALLCDGLNGLGIQDFKVKLNHRKILDGIFQACGVKEEDVRKISSAVDKLDKSPWEVVKKEMVVEKGQPEEVADKIGEFVKHNGSIREVLEYLQSSEILKSNDSAQKGIEEMQILADYVDAFDITQYLSFDLSLARGLDYYTGLIYEAVTAASAPPENATELKAKSKDDDASAYVGVGSIAAGGRYDNLVGMFSNGKSIPCVGVSFGVERLFSIIKNRANLNNISANHTDVFVMAFGGGEGWNGFLKERMEITNKLWKAGINAEYLYKSKANIRKQFDAAEKAGAKLAVILGKEEYPQGQLRIKVLGQGEENEGELVTKDELLAAVQAKLSSDIDDISRIIKGL

SEQ ID NO: 18184 - protein, 358 aa, Candida albicans
RGHSSRVVSHKRIIIDVDFRIRVRRDHIVQDSLQYIKTNSDNLKKSLRVQFANEPGVDAGGLKKEWFLLLTKEIFHPQSGMFHNVDDSNFLWFNIIPVENPDMYYLFGAILGLAIYNSTILDLQFPIALYKILLKRGLDRDDYRKLYPVSYKNLINLKSMSNKEILDLDLTFEVSYSDMFGKNHTTELVTNGANIQVTKSNLEEYIDKYTGFFMKDGIAKQVDAFITGFNNVIGRNALSLFLPEEIQLLLCGNDDHRIDVDVLKSVTKYIGWRSSEKAVDSKIITWFWDHFEQMSNNERKKLLIFITGSKPIPAPGLQKPPFQNSLPNNGPESPRITIGHTCFTEFGFNHLRPKEKPW

SEQ ID NO: 18185 - protein, 233 aa, Candida albicans
IMAPNISTSRSNNNTTTINVKVVAAESLYKRDVFRQPDPFAVLTVDGSQTKTTITAKKTLNPYWNETFNFQAKEDSILVIQVFDQKKFKKKDQGFLGVINVRIGDVIDLSLNSSEETITRDLKKSNENLAVSGKIIVVISHNRNSNGGGVTTATTRGTGASSSNNIATITSGVNNLRIGSATSSANSTAHASSDATVGANGSGPTCSLHPIGQGHPEIAATPWRSSWCSWSSI

SEQ ID NO: 18186 - protein, 89 aa, Candida albicans
DKDTQKLRPPHGGAAGAAGAAFRQYSSFEDQYGRLPPGWERRTDNFGRTYYVDHNSRTTTWQRPALHQSETERGQQRQSEVHHGHGRSA

SEQ ID NO: 18187 - protein, 464 aa, Candida albicans
  UNSURE (23),(25): Identity of amino acid sequences at the above locations are unknown.
GRPYFVNHNIGTTTWVIPGRPHXFXTFGPNTSIQQQPVSQLGPLLSGWEMRLTNTARVYFVDHNTKTTTWDDPRLPSSLDQNVPQYKRDFRRKVIYFRSQPALRILPGQCHIKVRRDHIFEDSYQEIMRQTPEDLKKRLMIKFDGEEGLDYGGVSREFFFLLSHDMFNPFYCLFEYSSHDNYTLQINPNSGINPEHLNYFKFIGRVVGLGVFHRRFLDAFFVGALYKMMLHKKVVLQDMEGVDAEFYRSLKWILDNDITGILDSTFSAEEESFGEIVEVDLKPGGRDIEVTEENKHEYVELITEWRISKRVEEQFKAFIDGFNELIPQELVNVFDERELELLIGGLAEIDCEDWKKHTDYRGYQENDQVIQWFWKCINEWDSEQKARLLQFTTGTSRIPVNGFKDLQGSDGPRRFTIEKAGEANQLPKSHTCFNRVDLPPYTDYESLKQKLTLAVEETVGFGQE

SEQ ID NO: 18188 - protein, 111 aa, Candida albicans
IIDLIPNGRNIPVTEENKNEYVKKVVEYRLQTSVEEQMENFLIGFHEIIPKDLVAIFDEKELQLLISGVARILMFPNGQNPTFLQQLISSVRSKYKWSWRTVQSIGTGRYN

SEQ ID NO: 18189 - protein, 154 aa, Candida albicans
REFHDGSFSLKLGSIGTKSQFFVQLKPDGLIGEMLFFHTFKASPQQLRLDIVADIRNINSMSMPASKAGMIILGGGLITHHICNACLMRNGADYAVYINTGQEFDGSDAGARPDEAISWGKIKAEAKSVKVYADVSLVFPLIVAATFASEKPQN

SEQ ID NO: 18190 - protein, 210 aa, Candida albicans
PKMVEKKNFQFLTINSWHLYHNSTFQLIMSGSGKLPGLASDAVLKQSIPVPEDFQEVKGIDYSQDNAYNMRAKDLIKSMSTMGFQASSLSQACDIIDNMRSWRGKHKDTLEEHEQTGEFDDEGYQKTTIFMGYTSNLISSGLRDTLRYLVQHKMVSAIVASAGGVEEDLLKVLAPTYMGDFTLPGKGLRDQGMNRIGNLLVRIRPRGLKS

SEQ ID NO: 18191 - protein, 508 aa, Candida albicans
SEKKKCSDLNEYSEVGIYCSVFFFHLPRFFFHAKFPIYYSFFFYPFFYIFPLILLLSTSLVNKQVTHIAMAETELKNLQECKTIGIIGLGDMGYLYAKRFSDAGWKVVGCDREDLYETTKAKFADEKFEILRNGHFVSRISDYIIYSVEAENIEKIVSIYGPSTKFGAIVGGQTSCKAPEIAAFEKHLPEDNEIISLHSLHGPKVNTTGQPLVLIKHRATDKSFEFVEALVSCLNSKQVYLTAKEHDRITADTQAVTHAAFLSMGVAWKLVNQYPWETPRWIGGIENAKINISLRIFSNKWHVYAGLAITNPSAHDQVLQYSKSTTELFTLMIQGKKKELTERLTKAKQFVFKYITNHHDLLLDDNILQKFSLSKTPPEGKQPNSHLSLLAIVDSWYNLGIVPYDHIICSTPLFRIFLGVTEYVFCTPGYLEESIDVAVNDTSFRQDDLNFTIAAQTWSNIISFGNFELYKREFEDTQNFFQPMFQEANAIGNEMIKTILERVKEREC

SEQ ID NO: 18192 - protein, 370 aa, Candida albicans
MSKTPVPTEYDDTRILGYDPLVPPALLQHEIKASAESLDVVIKGRYDSAQILKGNDDRCIVIVGPCSIHDPPQALEYGKRLKKLADELKDDLVIIMRAYLEKPRTTVGWKGLINDPDVDNSFDINRGLKISRQLYSDLTSVVGLPIGSEMLDTISPQYFSDFLSFGAIGARTTESQLHRELASGLSFPIGFKNGTDGGLAVALDAVQASSKGHHFMGVTKNGMAAITTTKGNDCCFIILRGGKKITNYDVESVKAAKEAIAKCTDPSIKLMVDCSHDNSRKDYRNQPQVLDSVAEQISNGEDSIIGVMIESNIHEGKQPMPPAGSGKEALKYGVSITDGCVSWETTVEMLTKLSQAVQTRRSLKKQKVSN

SEQ ID NO: 18193 - protein, 179 aa, Candida albicans
QQSFILLVRGYDPLTPPDLLQHEYPLTPESQNIIVEGRNAACDILNGKDDRLIIVIGPCSIHDPQAALDYCERLYQASEKHKGELLIVMKAYLEKPRTSVGWKGLINDPDIDGTFHINKGLRIARKLFVQLTSKLPIAGEMLDTISPQFLSDIFSVGAIGARTTESQLHRELASGLSFP

SEQ ID NO: 18194 - protein, 144 aa, Candida albicans
GGDPKWVPIWARDTRGVFSIPKVYPKEAWFRNKVDGFPGTLKKIQRNPPKVPQIVVAQVPGGEKSKRGLMMEGKNKGGKTRCSTQGTRGKDAWKYRVSITEACIGWETTGEVLEVLSQCCQNQKIFIVDYVIIFLLISTNNDIK

SEQ ID NO: 18195 - protein, 276 aa, Candida albicans
SSCRLARKRIEIRGIDIEDLKTPEISKRGVSSYDDHRVAMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLKRSFVNYFKLIMVLKD

SEQ ID NO: 18196 - protein, 267 aa, Candida albicans
TSSADPGSPVVKTQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKLSSNGLVVGAGGTSRAAIYALHQMGCAKIYLVNRTAAKLEELVKSFPKDYNLEIVETEQQADKASKVLLAVSCIPADKPLD

SEQ ID NO: 18197 - protein, 421 aa, Candida albicans
  UNSURE (39): Identity of amino acid sequences at the above locations are unknown.
VAYGLPVSIDDKEFLKKVGPKRHYVEIDILLKKMAIDKXNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTEEYTYHIPKGTYKNPSEYVIESDASSATYPLAFAAMTGTSCTIPNIGSSSLQGDAKFAVDVSKPMGCKVEQTTTSTTVTGPPRSHLKPLPHVDMEPMTDAFLTASVVAAVAKGGSSTS

SEQ ID NO: 18198 - protein, 380 aa, Candida albicans
  UNSURE (12): Identity of amino acid sequences at the above locations are unknown.
LSAYPSSPVGEXNKRIPLVLRNMTTSSKNALTPYLKKLVVEPPTLEPKDLSEALELIFSDIPSDIQTAAFLSCLRLRGLDQEADYIAAAVTTVLHFAKTIPPELVDSKGYIDIVGTGGDGQNTFNVSTSSAIVAAGMGLPVCKHGGKASTSSSGSGDLLKSLGVDLSHVNEVTTPEIVKKSKFCFIFAPSFHPGMGLVAHIRSQLGVLTIFNILGPLINPIPLRARVLGVYSEKLGESYAQAASILAKKNETHEKTMVVFGEVVLDEISPIGYTKTWTIDKSGKIERNRISPKDFGLPEHDLSTVKSGTPQQNAEILSHILNQDNDEFKVKQDSNNHPLVDYILMNSAAVAVVSGIADNWVDGAPCLHLREMPDRDYVGE

SEQ ID NO: 18199 - protein, 301 aa, Candida albicans
RNCSKKQGPIKLGQNFISNIGQEGYEKHVTILEEHILEGDIIQAVLSQRIARPTSLHPFNICRHLRTVNPSPYLFYIDLLDFQIIGASPELLVQSDTKGRIVTHPIAGTMPRGKTNEEDEENAEILRASLKDRAEHIMLVDLARNDVNRVCQPTTNKVDKLLTIQRFSHVMHLVSEVSGTLREDQTRFDAFRSIFPAGTVSGAPKVKAMELIAELEKEKRGVYAGAVGHWGYDGKTMDTCIALRTMVYKDGVAYLQAGGGIVFDSDEYDEYIETMNKMKANNNTIVEAEKIWANKVGQLEG

SEQ ID NO: 18200 - protein, 216 aa, Candida albicans
KSKTNRITMQSQLVQPTIETLKKTIDANSSLKESPNVYPVYKYVPYNDITIHQAYLKLANLNDSNRTESFLFESSVKGDTVDRYSFIGIQPTKIIKTGDDPKQFADEFCNVDPITVLEKELSKYKQAPLPGLPKFNGGATGYISYDCIKYFEPKTKRPMKDVLGLPEAVLMFCDLVVAFDHVYQRFQIIYNIKIDDNRGTINEDIEDSAPRAKYPH

SEQ ID NO: 18201 - protein, 314 aa, Candida albicans
  UNSURE (281),(284),(287),(294),(300),(301),(309),(311),(312),(313),(314): Identity of amino acid sequences at the above locations are unknown.
RVIGKREFHKYNKPNFKFFFWPKGKNGFFPKFEMIRWVLTKEAEQYFQKWCQPQNFKVFDEVLKALEGLTISQLKEKLGPMGAVGQGKAFKYKWLSKDGDKLIAQVEKLPEDVVLNELKTISETGTLNDKKELTELKKRKLVTLTKIVGYKIEKGPKFALEIVNLETDITSDMVLNHTWKDAQFKPYNFNSEGVYPNSGALHPLDKVREEFRQIFFSMGFTEMPSNQYVETGFWNFDTLFVPQQHPARDLQDTFYLKDPKKAGEPEDKQYWENIKQVHQEXKYXSIXYRYPSKXEESLRXXLRTHTTFXSXXXX

SEQ ID NO: 18202 - protein, 359 aa, Candida albicans
  UNSURE (12): Identity of amino acid sequences at the above locations are unknown.
HAAFLSPGGRVXMSLTEADIQPQLTRIRPGQSKLSTPRDEKDLVEIQSGTENGLTLGSPIGMIVRNKDHRPGDYSETDLYPRPSHADWTYIQKYGTKSSSGGGRSSARETIGRVAAGAIAEKILAKVNNVEIVAFVSAIGEISMNKSPQDAKFQELLNTITREQVDGVGPIRCPDANVREEMVKVIEKYRDAKDSIGGVVTCVIRNCPIGLGEPCFDKLEAKLAHAMLSLPATKGFEFGSGFEGIKIPGSKHNDAFYYDENFGRLRTETNNSGGIQGGISNGENIYFSVAFKSAATISQEQETATYDGKSGVLAARGRHDPSVTPRAVPIVEAMTALVLCDEYMIQQARTSTRLLVQDN

SEQ ID NO: 18203 - protein, 96 aa, Candida albicans
YGDKILVESFPFFFLIMSTLFAVEKKKILKNLFLNISTSVIKDKSITTSNNMSSFGTLFKVTTYGESHCKSVGCIVDGCSPGVHHFVDDCTKIMAE

SEQ ID NO: 18204 - protein, 547 aa, Candida albicans
RPATCNDRLKILGEIADSFIYVVSKMGTTGASTKVSTGIQELCDRVRKYAGPDTPLAVGFGVSTREHFLTVGEVADGVVIGSKIITLIGDSKPGERGKVAYDYVQSILGNDFKPNYPKTFERNNNNQAKETKPVLEENHKYNPRFGDFGGQYVPEALHTCLAELEKGFEDAVADPEFWKEFRDLYSYIGRPSSLHKAERLSEHAGGAQIWLKREDLNHTGSHKINNALAQVLIAKRLGKKKIIAETGAGQHGVATATACAKFGLECTVFMGAEDTRRQALNVFRMKILGANVVPVKNGTQTLRDATSEAFRFWVSNLETTHYVVGSAIGPHPYPTLVRTFQSVIGQETKEQFKALNNGKLPNAVVACVGGGSNSTGMFSPFENDKEVKLLGVEAGGDGLDTERHSATLTAGIPGVFHGVKTYVLQDNDGQVHDTHSVSAGLDYPGVGPELAYWKSIGRAEFVAATDAQALEGFRLLSQLEGIIPALESSHAIYGAVELAKTMSKDQHIVINVSGRGDKDVQSVAEVLPKLGEQIGWDLRFEEDPSKV

SEQ ID NO: 18205 - protein, 346 aa, Candida albicans
IITNYSTHDQKRILFFIINSFFNLFCLIYLISMTVITDPVEQYNLITKGLQETLNGQIIKDVLEKENRPVKIYWGTAPTGKPHCGYFVPMIKLAHFLKAGCEVTVLLADLHAFLDNMKAPLEVVKYRAKYYEFVVKAILKSINVPIERLKFVVGSSYQKGGDYVMDLFKLSNIVSQNDAKRAGADVVKQVANPLLSGLIYPLMQAIDEEHLGVDAQFGGVDQRKIFVLAEENLPSIGYKKRAHLMNPMVPGLGQGGKMSASDPNSKIDIIEEPKVVKKKVNSAYCAPGELKDNGLIAFIEYVIQPIAELKTGVEGAFKLDIDRPEKYGGPLSYDSIEQLKADFVDG

SEQ ID NO: 18206 - protein, 107 aa, Candida albicans
RVNFQPGRAYYGKLAPPELKLGVADKINELLAPIRAEFESSEEFQVAQKNGYPVEKPKQEKKKKVKKIGTRYPGTVSGGDSADTPANSNDGEKAEEKKSAEEKPTTE

SEQ ID NO: 18207 - protein, 349 aa, Candida albicans
  UNSURE (345): Identity of amino acid sequences at the above locations are unknown.
KKNFLAQYIQDPTKFIHLGNTQAMTTDRSSKRHVLMIDNYDSFTWNLYQYLHQSPKCGKVDVYRNDKITISQIENEIKPDIIFISPGPGHPLTDSGISRDIIKYFLGKIPIFGVCMGQECIFDVFGGDVSYAGEIVHGKTTTIKHDGKGMFENVPQSVAVTRYHSLAGSSKSLPDVLEVTAVTETQPEVIMGVRHKKYTIEGVQFHPESILTESGQLMIDNLLGVYGGTWEENDAIKTGKSIKINNKNGGENILQKIYKQREIDYKLIEKLPGKSFENLQIELDLDLAPPLINFYDRLKYTQSNLKETIILSEFKRASPSKGDININAHPANQALTYSTNGCSTXSVLT

SEQ ID NO: 18208 - protein, 94 aa, Candida albicans
GGQLRIPLIIGVNNRNLTTFDVDLNTTSNLVKQAKTSDRKGDVLVLALSGISSVDDVKKYKYEDNVDGFLIGESLMRAEEKGEAGKFLHDLCTC

SEQ ID NO: 18209 - protein, 240 aa, Candida albicans
RGTSSPGVNTIISEHNNETRVCPNITPRTAKAEISYINSCVGLDYSGEEISKLLKKMSLDATPSTEERDILDVKIPITRSDILHQCDIMEDVAIGYGYDNLKKTKPKAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVSKTSGFEMVQRLL

SEQ ID NO: 18210 - protein, 85 aa, Candida albicans
KIMQTMRTPWLENPSKDQRRRYWIEEDQDYPTFFPGRGAKIYFRNADNAEAKAIGSIGVLHPEVMNNFDIPYAASSVEINAEVFL

SEQ ID NO: 18211 - protein, 269 aa, Candida albicans
LYTSTMPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVNLDERAYDSFIALQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSR

SEQ ID NO: 18212 - protein, 266 aa, Candida albicans
MKQKVDYAVVPFENFTIGQVVSTYDLLRDWYFQTSTPPKFRIIAEQFVSIHHNLLTNASKIEDIKTIYSHPQVWTQVNKFLQSLPQQITKIDVGSTSKAAEIVSQDTITTSGSSSAAISSYMSSELYKLPILKEGIEDNQSNTTRFLILGYDSPISPPPPPASNNDDDNSKRNTTIVSSIMFTLNHDDPGALCDVLVKFKEYGITLTSINSRPANLKPWQYVFFVEMIGDIHQEGLVEKIKEPCLELVILGVFQRSWRYNNNSNDQ

SEQ ID NO: 18213 - protein, 315 aa, Candida albicans
TDQAKKIYYYFCCRPKISSIFFFFNSPILWNILHNKAITIPTETTPAMDFMKPETVLDLANIRQALVRMEDTIVFDLIERSQFFSSPSVYEKNKYNIPNFDGTFLEWALLQLEVAHSQIRRYEAPDETPFFPDQLKTPILPPINYPKILAKYSDEINVNSEIMKFYVDEIVPQVSCGQGDQKENLGSASTCDIECLQAISRRIHFGKFVAEAKYQSDKPLYIKLILDKDVKGIENSITNSAVEQKILERLIVKAESYGVDPSLKFGQNVQSKVKPEVIAKLYKDWIIPLTKKVEIDYLLRRLEDEDVELVEKYKK

SEQ ID NO: 18214 - protein, 426 aa, Candida albicans
VSPMTKQFTIVIKLGTSSLVDEVTREPRIANMSLIVETMVRLRRQGHKIVIVSSGAIACGMKQVGLEEKPANLSAVQALASIGQVRLIRTFDDLFRQLEQPIAQILLTRNDIMDFTQYKNAQNTLNELMDMGIIPIVNENDTLSVSEIKFGDNDSLSAITAGIIHADYLFLMTDVECLYTDNPRTNPDAQPILVVDKIDDLHVKTDTESGAGSKVGTGGMTTKLIAADLATNAGVTTIITLSSQPYYIIDIVAHIQAHADTLSVENQRLALQKDIQQGKIPLHTRFLSKPQDTLIKSDRRFWLLHGLKTKGALVIDQGCFQALTRRNRAGLLPVGILHVVGNFHQSECVSIKVVPDKNGAIDDAVEVGHCRVNYLAPEITLIKGHKSSEIEAILGYADSEYVAHRDNLAFPPVMPPSTDSLISDSL

SEQ ID NO: 18215 - protein, 283 aa, Candida albicans
VKLLIKLYKLKLMFLRDAIQLIPSREDVADLLNQDKYIDLVIPRGSNELVRNIKSNTKIPVLGHADGICSIYVDEKFDIIKAKKIIVDSKTNYPAGCNAVEQLLINSHIPQQQIIEILQILIAAKVTIHVTPEIKQIISSGDNININIKGDDYIKDVEADSFDKEYLSFDISVKLVDNVDEAIKHINEHSSKHTECIITEDKAIAEKFLKSIDSAGIYWNASTRFADGFRYGFGTEVGISTNKIHARGPVGLEGLMSYQYQLKGDGRFHPRRSRRSSTITVGG

SEQ ID NO: 18216 - protein, 109 aa, Candida albicans
LVNHSTPPPLHSSYSPQIIPNMTAETIAKAANSAFASLKTLTNDQRSLALQKIHDALLTNKDKILESNKLDMENAQSQNLSSSLIKRLDLSNPGKYDLHHGAGRSDDCV

SEQ ID NO: 18217 - protein, 320 aa, Candida albicans
EAKGTQEKPYATPAFALYTHPDAKVFVYKQSEEDAEKFEYVEISASALKKAKKGVEGLKKKAEKQAKLEEQKKQQQATAKLAELDLSSIEEDKSLPSAQKIKIRQLKDHLDTRVLVQGWVHRLRVQKGLAFITLRDGTGYLQCVLTGDLAKAKQTQELTIESTVAIKGVISKLPEGKTAPGGVELKADHYQIIALAPGGDESFTNKVQENADPNLLLDQRHLALRGESLSAVMKVRAAYLAAIRRFFTEEGLTEVTPPCMVQNQVEGGSTLFKLDYYGEEAYLTQSSQLYLETCLASLGDVYCIQESLSADKSHTRKTFK

SEQ ID NO: 18218 - protein, 217 aa, Candida albicans
VTILILEAEWVFITFEDLLTHLEKLLSKTIQYVLEDPVAGPIVKQLNPDFKAPKAPFKRMEYIEALDWLNEHGIPNEDGEKFKFGDDIAEAAERKMTDTINEPILLTRFPAEIKSFYMQRCKDDPRVTESVDVLMPNVGEITGGSMRIDNYDELMAALKRENLNLDSYYWFTDVRKYGSAPHGGYGIGLERQLAYMLNRYTVRDCSLYPRFTGRCKP

SEQ ID NO: 18219 - protein, 187 aa, Candida albicans
RPVFLESCPCRKTFPVGEFKIPKDGKMVKLHFKEGIAMLREAGKEVDDFEDLSTENEKLLGKLVREKYDTDFNILDKFPLAVRPLYTMPDSEDPRYSNYYDFFMRGEEILSGAQRIHDPKLLTQRMKEHEVDPNVPGLNDYVEAFTYGCPPHAGGGIGLERVVMLLLDLKNIRRASLFPRDPKRLRP

SEQ ID NO: 18220 - protein, 406 aa, Candida albicans
KNSHLVIKYTPCIEVFNLSVSHILDFKSLLFIFITLHIFFFALVIVKSLHNITVSKHTHSYFFRLEIFFFLYNFSFRKLLIFYYRFQLPTQMSVEKKVEELSIGENPAASIANESAPATTATNSNNVEGEEVVLGEDGQPLSKKALKKLLKEKEKAAKKAEREAQLAKEKAAREAEAANDPAKENYGKLPLINSSTRNADEKRILFKDLSVANDGETVTFRARVHKTRQQGATMVFLTLRQQSELIQALLKTNKDTDATAVSKQMVKWTGSINLESIVLVEGKVAKVEEKIKSATVQDVEILISKIYTIQETPEQLPLLIEDASRSEKESEELGLPGVNLDTRLDARVIDLRTPTNQAIFKIQSGVCQLFREFLIKKGFTEIHTPKIIGAASEGGSHVFEIIYRRP

SEQ ID NO: 18221 - protein, 123 aa, Candida albicans
KTLDVVNNWLNDKENASSFLVAHVPITANAKTITEAINLIIKQDKTKSIYLLTGETDKVAHGCYVSDEAIAKGINDNELAKAVSEYIGGKAGGKGNIVQGMGDKPQGINTAIEEVTKLFKEKL

SEQ ID NO: 18222 - protein, 99 aa, Candida albicans
  UNSURE (6),(46): Identity of amino acid sequences at the above locations are unknown.
RSSDYXKNQVLLKVLEELLLFTGHDAHNVQKFDMEFEQDIDNASSXPFGVAKESKSKELGVALKKLSISVLDKQRLTEKFNKLDKSIRDNLKAKQKEET

SEQ ID NO: 18223 - protein, 484 aa, Candida albicans
MSHESRHLRDIFFFSRIFFYSLSFFFFFPTLHSRSYSSYLTPTLILLIRYMIKTLLRRMSSNTTIPTPNGSNHWTASKVRSTFLDYFKKQQHTYVPSSSVVPHNDPTLLFANAGMNQYKPIFLGTVDPASDFASLKRAANSQKCIRAGGKHNDLEDVGRDSYHHTFFEMLGNWSFGDYFKKEAIDYSWELLTKVYGLQEDRLYVTYFGGDEKQGLEPDLEAKNFWLKVGVPEDHILPGSVEDNFWEMGDQGPCGPCSEIHYDRIGGRNASALVNMDDPNVLEVWNVVFIQYNREADGNLRTLPNKHIDTGMGFERLVSILQNKYSNYDTDVFLPIFDKIREITGVRPYTGKFGNEDKDGIDTAYRVIADHVRTLTFAICDGGVPNNEGRGYVLRRILRRGSRYVRKYMNYPIGGFFQQLVDVVIEQNKEIFPEISSGAQDLKEILNEEELSFAKTLDRGEKLFEQYDILASKIFTTSMDGSDEC

SEQ ID NO: 18224 - protein, 176 aa, Candida albicans
  UNSURE (167),(169),(170): Identity of amino acid sequences at the above locations are unknown.
DAIPKTNDEFKYGLENVKAKVVGIYDGSKFVDSIEDPSIQYGILLDKTPFYAEQGGQEYDTGKLVIDGKLEFNVANVQVYAGYVLHTGNIVDGKLNVGDEIIATYDELRRWPIRNNHTGTHILNFALREVLGDGVDQKGSLVAPEKLRFDFSHKQAVTAKELEQIGXIXXSVPQGS

SEQ ID NO: 18225 - protein, 147 aa, Candida albicans
IVEYGSNFFIKKQKVKKFCSSLKNQRVIFQVLYYSDVSTIQFIRYFHRSVSRVMSASRTNIPFSRDSLEQTLKRRFFFAPSFEIYGGVAGLFDFGPPGCAFQNNVIDAWRKHFILEEDMLEVEATMLTPHDVLKTSGHVDRFSDWMC

SEQ ID NO: 18226 - protein, 462 aa, Candida albicans
RFVLLAACWTLSVLSHLVEEVLESRLKGDKLARGVKIVEEEDEDKKKRKKKVKEIKNVKLEDEVVKEYESILAQIDGFSGPQLGELIVKYDITNPSTGGKLEPPVEFNLMFDTAIGPSGNLKGYLRPETAQGQFLNFNKLLEFNNDKMPFASASIGKSFRNEIAPRAGLLRVREFLMAEIEHYVDPESKSHPKFEDVKDIKLKFLPKNVQESGSTELIEESIGKAVSSGMVDNETLGYFIARIYLFLVKIGVDTNRLRFRQHMSNEMAHYASDCWDAELETSYGWIECVGCADRSAYDLSVHSARTGEKLVARQTLAEPRTVENFEIEIAKKKFGPKFRKDAGTVEKWLTSRTQCELEELGKELSEKGKIVVQIKGVEGDVELDGDLIKIDKVKRTEHVREFVPNVIEPSFGIGRILYSIFEHQFWCRPDDADRGVLSLPPLVAPSFHTGDCQVQRLSLPNA

SEQ ID NO: 18227 - protein, 373 aa, Candida albicans
IKLSSAFVPKKPIVVVTSGDRDIKWNSHNQSPNLLPLKLNLMKEPSITTTFVEVTDKLPTKPPCRVFFKNEYEQPSGSFKLRGMGHLVGQSIDVARKLGKSNVAVFSSSGGNAGLAAAYASQFFGVSCTVVLPESSKPTVIEKLKSLGADVIIHGKHWGEADNYLTDFVIKNLDKTVYPVYCHPFDDPLLWEGHSKIITEIIDQKQLPNFDKVKGVICSVGGGGLYNGIVEGLENHKEIPVLAIETKQAATFHEAVKEGKVVHLQKVQTLATSLASPYLSSKALANYIERPTVLAEIDDLDAVKGVVDVYDHFGYMVEPACGASVASVMHRQDLLNKFGTLSPDDIIIVVICGGSAINKYIIDEYRSLLEKDS

SEQ ID NO: 18228 - protein, 387 aa, Candida albicans
FVLINWVLLQYSFFFVLSFIQQFHLNVCYNLDFNMSTSMDLQPYTKLSQPYIQTSLTEVTNILPTKPPCRIFFKNELEQPSGSFKLRGIGHLVHKSIENALKNHLNKTIHVFASSGGNAGLAAAYLAQFYKVKCTVVLPIISKPVVQEKLKSYGARIVLFGNTINEADQHLKNLMSSIDLDSIYPVYCHPFNNPLIWNGHSSLVDEVSQQLDSKDRKLLKGMVCSFGGGGLYNGIYQGMVKNQIRGDILLIETLQAPTLTQSLEADEVITLKSVNSLATSLACSYTTEQSLKYYKDQSLVKSQVELIDDIYSLRACVAFEKCFGKVVEPACGAAMAVVYNKIDLLYKNFKYLQPEDIVVIVVCGGSCTTGSDLKGFEKMIQKSEIKL

SEQ ID NO: 18229 - protein, 177 aa, Candida albicans
LDMPSSSQVYRSTRSSQPEELSFEDVVMTGLAPDGGLYLPSAIPQLPKDFLSKWTDLSFNELAFEILRLYINENEIPNADLKDLITRSYSTFRSSEVTPLKKLDDNLYILELFHGPTYAFKDVALQFVGNLFEYFLTRRNAQKDLTKQPRDIITVVGATSGDTGSAAIYGSRGKKDV

SEQ ID NO: 18230 - protein, 100 aa, Candida albicans
  UNSURE (100): Identity of amino acid sequences at the above locations are unknown.
LDMPSSSQVYRSTRSSQPEELSFEDVVMTGLAPDGGLYLPSAIPQLPKDFLSKWADLSFNELAFEILRLYINENEIPNADLKDLITRSYSTFRFSEGSHX

SEQ ID NO: 18231 - protein, 356 aa, Candida albicans
NSAWVARSFSASLANCGKKDVSVLILYPTGRISPIQEEQMTTVEDENVHTLSVNGTFDDCQDIVKLVFGDKEFNDKYHVGAVNSINWARILAQQTYYFYSYFQLQKQAKTTNKVRFVVPSGNFGDILAGYYAYRMGLPVDKLIIATNENDILDRFIKSGEYAKEQEVGVKATYSPAMDILISSNFERLLWYLIRDNAPEVNKSDEKAGQLLNDWMKQLKEQGKFKVPAEVIDAARQVFDSQRVDNDTTVQTIKQVYDKSADKYVIDPHTAVGVTTSYSFIAKDTEPTQYISLSTAHPAKFSEVVNKALDSFDGYSFDKDVLPAELKALSSKEKRIKLIDEASVEKVKQAIKDELKF

SEQ ID NO: 18232 - protein, 358 aa, Candida albicans
KNFFVPRNNHHTNLNQTHHHNPLSYILDTMLDINAFLVEKGGDPEIIKASQKKRGDSVELVDEIIAEYKEWVKLRFDLDEHNKKLNSVQKEIGKRFKAKEDAKDLIAEKEKLSNEKKEIIEKEAEADKNLRSKINQVGNIVHESVVDSQDEENNELVRTWTPENYKKPEQIAAATGAPAKLSHHEVLLRLDGYDPERGVRIVGHRGYFLRNYGVFLNQALINYGLLFLSSKGYVPLQAPVMMNKEVMAKTAQLSQFDEELYKVIDGEDEKYLIATSEQPISAYHAGEWFESPAEQLPVRYAGYSSCFRRETGSHGKDAWGIFRVHAFEKIEQFVLTEPEKSWEEFDRMIGCSEEFIIH

SEQ ID NO: 18233 - protein, 258 aa, Candida albicans
ISERLIIFQSKRNTLFLVLLFFFSLNKRQYQFITMSVKKAGVLGATGSVGQRFILLLSKHPEFEIHALGASSRSAGKKYKDAASWKQTETLPETEQDIVVQECKPEGNFLECDVVFSGLDADVAGDIEKSFVEAGLAVVSNAKNYRREKDVPLVVPIVNPEHIDVVENKVKQAVSKGGKKPGFIICISNCSTAGLVAPLKPLVEKFGPIDALTTTTLQAISGAGFSTGVSGMDILHNIVPYITGEEDKLEWETHKILG

SEQ ID NO: 18234 - protein, 107 aa, Candida albicans
  UNSURE (57): Identity of amino acid sequences at the above locations are unknown.
IISLRFANRPAPSVEDVKQCLREYECAASKLGCHSAPKQTIHVLDQPDRPQPRLDRXRDSGYGVSVGRIREDSLLDFKMVVLSHNTIIGAAGAGILIAEILKAKNII

SEQ ID NO: 18235 - protein, 548 aa, Candida albicans
NYLSMSQSPTNVPRSYNSVLDLKLASPTNSASGATGGWIVQKFGGTSVGKFPENIVDNIVKVYSQTNRVAVVCSARSSQTKSEGTTSRLLRSADLAENDKDYQPLLNAIEEDHVTNAERIQLEEIKQELIKDTKQEIEHVRELLHACQIIGEISPRSLDSIMAVGEKLSCLFMTALMKDHGLNAVYINLQDVIPLSYDFQKGFDDSFYQFLSQEIGKRVLQCDKEREEEEDVIPVLTGYFGVVPGGLLNGVGRGYTDLCAALAAVALQADELQIWKEVDGIFTADPRKVPNARLLDSVTPEEAAELTYYGSEVIHPFTMEQVIRAKIPIRIKNVENPTGKGTIIYPDNIGRRSEATPPHPPAAFEQLAMSSLLQRKRSATAITAKQDIVVINIHSNKKTLSHGFLAHVFTTLDKYKLVVDLISTSEVHVSMALLIQLDQESQLKHALVDLRKMGTVDVTKKMTIVSLVGKQMVNFIGIAGNMFKVLADEKINIEMISQGANEINISAVINEKDTIRALKSIHAKLLEGGSAIGDSLAVDTRLEALKLL

SEQ ID NO: 18236 - protein, 211 aa, Candida albicans
HYTTMSSPQQIVNSFQQALNLSGSPNAVFTSPTQSFLSQYVPSKPAKALKPFKTGDIKILLLENVNQTAINIFKNQGYQVEFYKSSLPEDELLEKIKDVHAIGIRSKTKLTEKILKAAKNLVVIGCFCIGTNQVDLEFAAKSGIAVFNSPFSNSRSVAELVIAEIITLARQLGDRSIELHTGTWNKVSAKCWEIRGKTLGIVGYGHIGSQL

SEQ ID NO: 18237 - protein, 60 aa, Candida albicans
RRKLSAISYPIITLKKQFSDSQGDIAYLMADISDVDISDIQSLYEQLEQTPYKIATRLLY

SEQ ID NO: 18238 - protein, 518 aa, Candida albicans
EKKKKPNKTTTSLYLSLNNRQPMTYTNKPPALKEDILELIGNTPLVKLNKIPQSLGIKAKVYAKVELFNAGGSIKDRIAKNMVLEAEKQGKIKPGYTLIEPTSGNTGIGLALVGAVRGYRTIITLPEKMSNEKVSVLKALGAEIIRTPTEAAWDSPESHIGVAKKLEKEIPNSIILDQYGNPANPDAHYYGTGYEIWEQTEGKITHLVAGAGTGGTITGISKYLKEKNSKIHVTGADPKGSILAEPESLNNSTEGYLVEGIGYDFIPDVLNRKYVDDWIKTDDAESFKLARRIIREEGILVGGSSGSALQAALQVAKDLTEDDTVVVVFPDSIRSYLSKFADDEWLISNGFEVEDSPGANKADEFLNGKTIKDLVAGKAPVVTVTLSDTVAKTFDLLQSNGFDQLPVLNNSGRLVGLITLSKILKSLSTKKIQTTNSISSIIIDFRKLADFEKSFTITKKSGFTKRSYEPIKLDTPLAALNKFFETNSNAIITDDELKPVQIVTKVDLLSYLTKNASF

SEQ ID NO: 18239 - protein, 200 aa, Candida albicans
LQVMPTLKTRSRQITTRAMNGELDFNQSLAERVLLLKGIDASSIWDELKLKIQVTNGVPELCKALKKLNIIMGVCSGGFIPLAEFLKEKLGLDYAFANTLGIDDSNRLNGTTVGPIVNGEKKAELLLDIAKKHKIDPLDAVAVGDGANDLKMMFVAGFGIAWNAKPKVQKQAPACLNTKSLSDILYIMGYNDKEIKELID

SEQ ID NO: 18240 - protein, 246 aa, Candida albicans
  UNSURE (1),(240): Identity of amino acid sequences at the above locations are unknown.
XGAPRGSLKQSLSNLHVNPISPDPEKVTESGIVHTIFNHQTNPLPTGTPKLVATIIYKSANPVHPHLHPDSSPNANRLPSPMVPVGSAPTDDIEKLPREHPAPEPEPLDHLYGPFVSQQCLTNFLQIMESLSTPYQRMNTSHRCLDQDDQPRVVEVTLSPPPNPEYLSFEDLRKHESIWRFEREWNVEVVLQKESVFRRHKRLVVFDMDSTLIQNEVIDEIAKFVGVEKEVSVRLHHARXAGSALT

SEQ ID NO: 18241 - protein, 95 aa, Candida albicans
KNMTSKRGCQEEVPGGELTSCSNCGDYQSRRLGIRYNDDQEGRLKHVSTLNGTCMAVPRVIVALIEQNFNAEKNEISIPEVLQPFMDGKDKIVPN

SEQ ID NO: 18242 - protein, 431 aa, Candida albicans
PSCDGNVSMLCTGNRIILVQFSTVSARKKMTYTLHYSTNRSNIKARLSSMLNTIRRYISTGKNSSTLLRAQIDINDILSRPKEYESSIHRRQLPQELIENINFITSNRPLQAQLFSQINDMKKERTILAERLKSHVGDLQQFKERLKQLKCELKPLEKQVKTIQEKIYAKAESLPNVIDVTVPTDPLIEEVVQFINCQSEEDAKVSNSSAVHDHKEIGVNFNILDFSVASRVSGPSWYYLIGDGALLEQALIQYALSKARRRGYLMLTPPSIVKSEIVGACGFKPNDQNNEKQIYELKGEHKSLTGTAEIPLAAFHSSTVFPSGTQFPIKYVGVSRAYRAEAGASGKDTKGLYRVHEFTKVELFHFTTKEKAAQELEDLKDMQVEIVTELGLSAKLLNMPSSDLGAPAMKKYDIEAWMPGRGSWGRAHKLF

SEQ ID NO: 18243 - protein, 397 aa, Candida albicans
WFLSTGYLRGLFKQKQKIFQSAFFFQQQQQPTELLPNLVHMSVTSFKIKVPASSANIGPGFDVLGIGLQLYLTITVTIDPSIDTSSDPHHALLSYEGDGKVPFESNENLITQTALYVMRCNGIKDFPRGTHIHVNNPIPLGRGLGSLASAIVAGVYLRNEMGNLKLHKYRLLDYRLMIERHPDNIAAAMLGGFIGSYLNELSSEDSQLTTVPLDYILPKVKNGELITPQDKIVSQQPPNNIGQYVEYKWNKKIKCLTIIPNFELSTDLSRSVLPKNYQLPDIVYNLQRIAILTTALTQDPPNHKVIYQSMKDKLHQPYRFGLIPGLNTVLQKITPESYPGLCGICLSGAGPTILCLATDGFEKIANDVIEIFKQEGIECDSKLLDLAYDGATVEYGS

SEQ ID NO: 18244 - protein, 103 aa, Candida albicans
LSTMSEVADKVKDLSLKDKKKKPTNPLYLDPQPEFIEERIKLFDELKAQYGEEISKKEKLPIKITLRDGTIKEGTAYETSPMDIANSIGKSFAERTSYCQSRR

SEQ ID NO: 18245 - protein, 271 aa, Candida albicans
TVQATVFCLNREKDHIVNCHGVLPILGLSTETSFRGALSGLTRVSRFQQDDAHIFCTTDQIGTEIAGVFDFLKKMYGIFGFEFKMELSTRPEKYVGDLDTWNSAEKKLEQALNDFLGEGKWELNPGDGAFYGPKIDIMISDALKRWFQCATIQLDFQLPQRFELEYKSDKGPNTRPVMIHRAILGSVERMTAILTEHYKGKWPFWLSPRQILIVPVGPKYYDYAQKLQKKLNDDYFFYCDVDVSGNTLPKKIRTGQMYNYNFIFIVKSPPP

SEQ ID NO: 18246 - protein, 355 aa, Candida albicans
PKSGTVSRWDMPTSHRKEMYSWEFWNFEHPEGKAVLWHSSAHILGEACACHYGVNLSHGPPTEDGFFYDMSINNGETFVTQADFGNLEQVATKAIKEKQKFERLEMTKEQLLKMFHYNKYKVKFISDKIPDGTSTTVYRCGPLIDLCVGPHIPHSGRIKAFKVLKNSSSYFLGDATNDSLQRVYGISFPDKKLMTEHLKFLAEAAERDHRKIGREQELFIFNEMSPGSAMWLPHGARIYNTLVDTLRTEYRKRGYEEVITPNMYSTKLWETSGHWQNYKENMFSFEVEKETFGLKPMNCPGHCILFKSRERSYRELPWRVADFGVIHRNEFSRRVIWVDESQSFPTGRCPYFLYH

SEQ ID NO: 18247 - protein, 360 aa, Candida albicans
NMSKSVNVAIIGSGVVGSSYLSQLNNLKSNIAFNVIYLAKTSEEALYSKDYSPVDLSTYETAPTQPTLSLDDLVKFIKGAKKPTVLVDNTSSPAIANYYPTFIKESISIATPNKKAFSSDLKEWKEILQTAELPGAGLVYHECTVGAALPIISPLKDLIATGDKVDKIEGIFSGTLSYIFNEFSKTEKSDVKFSDVVKKAKELGYTEPDPRDDLNGLDVARKVTILARISGLEVEGPTSFPVESLIPKELECVESVAEFMEKLPNYDADIQKVKDEAFAENKVLRFVGKVDLNTNKVSVEIGKYGFDHPFASLKGSDNVVSIKTGRYPNPLIVQGAGAGAEITAHGVLADTIKIAERIAN

SEQ ID NO: 18248 - protein, 398 aa, Candida albicans
YQHRSNMSEQRTLDREEPNYFGAGPSLLPTSVLQQAAYDLISYEGDNIGIGEISHRSKPAIKVIDDTKENLTKLLNIPDTHEVFFMQGGRTTGFSSIAYNLIANYAKITGKKGKAAYAVTGSWSKKASEEAQRLGFDVNIVVNTKGENFGTIPPYSEWKPIGEDVSYLYVCDNETVHGVEFTNIPGTDYLPEGVELVADMSSNILSKEIDVSKYGLIMAGAQKNIGLAGLTIYIIKKSLLDQASDDELRSLNIPLSPIAFHYPTVVKNNSAYNTIPIFTCHILKLVTDKLIADGGIKNTEQINKKKATILYEALESYPDFYKLPVFNSQVRSNMNVVFRLPNEDLEAKFIAEAAKRNLAGLKGHRSVGGMRASIYNAVTLKSVQSLVDLVNDFAKANA

SEQ ID NO: 18249 - protein, 193 aa, Candida albicans
INLLLLSLKPHPALSIMIRTLLRPTSLRLVTPTFRSFSTFSTRFQLIDKDSHAYKYLYEKTPVVTKFTEDHEWVHLYDDDSAFVGITQYAAQALGDVTFVDLPEVGDHLELNETLGSVESVKSSADVYSPVDGEVVGVNLKLESEPGILNHDPTKGGWIVHIKLDDPTQVTKSETLMSEEQYKKFLEEEEEGH

SEQ ID NO: 18250 - protein, 428 aa, Candida albicans
  UNSURE (415),(416),(427): Identity of amino acid sequences at the above locations are unknown.
NLSAVLPPRGEDIESSKKVLGTLSNPNLVKTEAYINGKWVPSSSGETFTVTNPALYPNPESELATMQSMSEEDFNSAIESADIAFNKFKKTTGRYRSELLLKLYNLMISNKDDLAKLVVLENGKPYADALGEVNYAASFFQWFSEEAPRIYGDIIPSANGTNRILTFKQPIGVCGILTPWNFPLAMITRKLGAAIATGCTAVIKPASETPLSATALAFLAEEAGFPPGVINVLPSADASGLGKYLTEHPLIKKVSFTGSTPVGKILMNQSASTLKKLSFELGGNAPFIAFDDVDVDKAVNGAIASKFRSSGQTCVCANTIFVHEKIYDEFDKKFVDKLRNETVLGNPLAYGVTHGPVIHDRSMKKVRQHIEDAVDKGATILLGGSKRPDLGENVHDLTVLGDVTTEMLITRQNTXXPRDDSRPQISXR

SEQ ID NO: 18251 - protein, 487 aa, Candida albicans
VVKTNLFQNKPFINGQWYDSKSTSTFKVYDPATQELIIELPDQTPQEIDEAIAITHKAFQTYQRTPVYERAKWLRKMYELMTENLQDLATLITWENGKCLADALGEIKYAASYFEWFSEECKRNYGHTIQPLNQNNKVITYKQPVGPVGLLCPFNFPSAMGARKAAPALAAGCTCILKPDGQTPLSSLALAYLAQQAGFPDGCFNVVLTSVTNTPMCGLKFCQSPKLKKISFTGSTNVGKLLMQQSSSTLKKLSMELGGNAPIIVFNDCNLDLAVDQSITSKFRSLGQTCVCANRIYVEKGVYDEFCNKFVEKVNQFKIGNGFEPGVTHGCLINTKAIEKVEDHVQDAVEKGAKLIVEGGRLPQLGENFYSPSVVKDVTQDMKVVKEETFGPLAAIIPFDSKEQVLQWCNDTPYGLASYIFSENLNTVWYMSEFLENGMVSVNTGLFTDAALPFGGVKESGFGREGSLYGMDDYTVIKSITLGNVYN

SEQ ID NO: 18252 - protein, 268 aa, Candida albicans
MYLRSIFKSTIRKMHIESIPMRWGHGDNYAYLVVDTPTKQAWLIDSAQPDEVLEYFKKHKTDFNLKAIVNTHHHYDHSDGNPFFHKKYPDLPIIAGKDSPLVTYTPSDKETLELGEDLTITALHTPCHTQDSICYFVQDKKTNEKAVFTGDTLFISGCGRFFEGTGKEMNYSLNQVLAKLPKETKVYPGHEYTKSNVKFSQTVLSNEAIKELAEYCKSHEHTTGKFTIGDELQFNPFMKLTDPQVINSTGLTLPDEIMDKLRTMKNNM

SEQ ID NO: 18253 - protein, 192 aa, Candida albicans
YNMASDGTGGMYGSPTLAGSRPGALVVGCWATLINIGKQGYTKFCYDIVLASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 18254 - protein, 421 aa, Candida albicans
NIIMLELNSITIPRNFTEFQLTALKIYYQLKILFLATYCTQGSLGLNGSVCLARDIFVGYVVYTQLLKLYRVLRGYGIIDSIRRLYLYVSSIVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGSSPRGWKVARL

SEQ ID NO: 18255 - protein, 390 aa, Candida albicans
NFHSIMTTSKETFLFTSESVGEGHPDKICDQVSDAILDACLAVDPLSKVACETAAKTGMIMVFGEITTKAQLDYQKIIRDTIKHIGYDDSEKGFDYKTCNVLVAIEQQSPDIAQGLHYEKALEELGAGDQGIMFGYATDETDEKLPLTILLAHKLNAALASARRSGSLPWLRPDTKTQVTIEYEKDGGAVIPKRVDTIVISTQHAEEITTENLRKEIIEHIIKQVIPEHLLDDKTIYHIQPSGRFVIGGPQGDAGLTGRKIIVDTYGGWGAHGGGAFSGKDFSKVDRSAAYAARWVAKSLVTAGLAKRALVQFSYAIGVAEPTSIYIDTYGTSKLSTEALVEIIKNNFDLRPGVIVKELDLARPIYFKTASYGHFTNQENSWEQPKKLKF

SEQ ID NO: 18256 - protein, 88 aa, Candida albicans
EFFGRSFGKVKVARARTGPFKQGIFVGNLGQWIKAEGPVISSFKRICQANHQHKTHIFFRGTYAAVPLDQLVVGLEKFGKAVRAEFGL

SEQ ID NO: 18257 - protein, 400 aa, Candida albicans
FLFLFEFFFYIFISHSTAIMTSDTKPQAKDLTHLLSNESKARQTSPLKGIFKYYKQPGITFLGGGLPLSDYFPFEKVTADIPTPSFSGGIGAPIEGENKTTIEVFKKAADNVPDQIELARSLQYGSTFGLPEFLQFIKEHTDMVHKVPYENWDVIVSVGNTEAWDSTLRTFCSKGDTILVEEYTFSSALESANGQGVNTVPVTMDEFGIIPEKLEELMSRWVGNKPKFLYTICTGQNPTGSSLSAERRKQIYDIACKYDFLIIEDEPYYFLQMETYTKDKAAREGKAVHDHDEFLKALVPSFISLDVEGRVVRLDSFSKVLAPGLRLGWIVGQKDLLERYVRLHEVSVQNPSGLSEALANALLRKWGHSGYLDWLIGLRAEYTHQRDVVFTHAGRQEPSS

SEQ ID NO: 18258 - protein, 507 aa, Candida albicans
RLCYTKDMSDPTHLISKRAAGRTSVHFTNAPSDKPPANFKPHEKPLALSYGMPNHGFFPIDSIDVNLVDYPFQKITTPSTTSSTAEEEPPSSSLNGSENGHQTKTPPSSIHTPQSTVHISRHTTDPKLIDLARGLQYAAVEGHAPLLQFARDFIIRTHKPNYDDWNVFITTGASDGLNKAADVFLDDGDVILVEEFTFSPFLRFLDNAGAKAVPVKINFDNDSDGIDLTQFVDLLENWEKHYPNLPKPKALYTIATGQNPTGFTQSLEFRKKIYDLAVKYDFAIIEDDPYGYLTLPKYEKPNIGGSGSGNNELKNDLEIDDYLKNHLTPSYLELDTTGTVLRVETFSKLFAPGLRLGFIVGHKKVIDAVKNYSDVVNRGALGLTQTIVNNVIQENFKGVDGWLEWILKMRLNYSYRKDLLLYSIFESQAYKKGYVDVIDPKAGMFVTFKINLPKDVDVLQKMKLLLWKLISYGILVVPGYNMTVDLEFSKDRSNFFRLCYALANNDE

SEQ ID NO: 18259 - protein, 207 aa, Candida albicans
SVVKNCSVGEIAEDAIETAKYICEEYYGLFEAPEIQLIAPQQDINFMYVPGHLIHMLFETLKNSLRATIEFHTPKLKQKLIDEDPNLKFDEIDINDLKFPPIKVIILEGTEDIAIKISDEGGGIPRSSLPLIWTYLYTTVNETPKLEPEYDQTSFKAPMAGFGYGLPISRLYAQYFGGDLKLISMEGYGTDVYLHLNRLSSSNEPLP

SEQ ID NO: 18260 - protein, 137 aa, Candida albicans
  UNSURE (8),(9): Identity of amino acid sequences at the above locations are unknown.
LLVDLTKXXKRSDYHINQTPEYFYQFKGTMCLKVVDDGEFKDIFINEGDSFLLPPNVPHNPCRYENTIGIVVEQDRPAGVNDKVRWYCQKCQTVIHEVEFYLTDLGTQIKEAIVKFDADLDARTCKNCGTVNSSRRD

SEQ ID NO: 18261 - protein, 489 aa, Candida albicans
NLCKGRTKVFSRLFLRFRKAIRVRDKTGNVIKISFLLHHFLFYIFFFSPMTIPNIEEFDVFPNSGFLPSKLPLERLPQEYYQPWENIVNNLPSLILTKRIRAIIDKLPVLETTHLTSDEEYRRAYQILGFLAHAYIWGTDTPTDKLPSQIATPWIKVSDHLGLPPIATYASLCLWNFKQIMPSDDIWDLDNLTTINTFTGSIDESWFYLVSVYFEHKGALAITTGLDAIKCAYDNNTKGLVENLQQLAEAIDSLGSVLMKMEEMCDPHVFYFRIRPYLAGWKNMTEVGLKGVYYGEEKTVRNYAGGSNAQSSLIQFLDILLGVKHYSTGERPLPFKASTGVGAENGFMNEMREYMPGNHQKFLSKIQEITNINQYVLDHKDSHPELVLSYDACLAMLKLFRDKHIQIVTRYVVLQAKKTEKMGSSSTLRSGLARKKKEERGTGGTSLLPFLKQCRDETGDPAAGNWGQRILSDGVMRLKFSKPNGINED

SEQ ID NO: 18262 - protein, 221 aa, Candida albicans
HDWREDFAAWVSHKNLNSGPGAMVGIFVHEKYTLENKASSFVPRLAGWWGNNSQERFKMLEEFDPINSALSYRQSNPSVLDVVAVKSSLEVYAKVGGVSKLREKSVALTQFLQDLLTNSKYYIPQSSTSNSKFGFKILTPLNPAERGCQLSIMFQPHFDEKDKNVMERVNAYLHDHAIICDERRPDVIRLAPLPLYNTFEETFIAVQRLFEALDNISKEYM

SEQ ID NO: 18263 - protein, 298 aa, Candida albicans
FLDCKALQLTELLLRPNGVFFFSTIRNYLPHNTGYQLFLLFPIFFFNSISPVIPPTTPTPFYYQMSLAEAKKLDKNFPTFKNEFAIPTFGSLGIKNNKYESSTESIYLCGNSLGLMPKNTKKAINDELNAWVERGVESHFNHPDKLLTPWVDIDLPLLPLIAPIVGAKENEVAVMGSLTANLNALLIHFYKPEGKRTKILFEKQAFPSDYYAFLNIVKLFGYDEKHLIQLEVQPGETYIKTERIIKAIDENLDELALVCFPGIQYYTGQFFKIEEITKYAKEKSPHIFSPLGPTPPIY

SEQ ID NO: 18264 - protein, 515 aa, Candida albicans
SACLRWRKKRFLNKSVQKFPVLNKSRFKFSPSHSLNFFSSQFVHFLLLYSYIDNNILNLSILTTIMSSAPATNYKVADISLAAFGRKDIELSENEMPGLMYIRKKYGPSQPLKGARIAGCLHMTIQTAVLIETLVALGAEVTWSSCNIFSTQDHAAAAIAAAGVPVFAWKGETEEEYQWCIEQQLFAFKDGKKLNLILDDGGDLTSLVHEKYPEMLEDCYGLSEETTTGVHHLYKSLRDGKLKVPAINVNDSVTKSKFDNLYGCRESLVDGIKRATDVMIAGKVAIVAGFGDVGKGCAMALHGMGARVIVTEIDPINALQAAVSGYQVAPMDEVASIGQIFVTTTGCRDIITGKHFEQMPEHAIVCNIGHFDIEIDVAWLIANAESVVNIKPQVDRYLMKNGRHVILLADGRLVNLGCATGHSSFVMSCSFSNQVLAQIALFNADNKEFREKFPEFAKTGPFDVGVHLLPKVLDETVARCHLDHLGAKLTTLTETQAEYLGIPEESPYKADIYRY

SEQ ID NO: 18265 - protein, 769 aa, Candida albicans
PKMVQSSVLGFPRIGGQRELKKITEAYWSGKATVEELLAKGKELREHNWKLQQKAGVDIIPSNDFSYYDQVLDLSLLFNAIPERYTKFDLAPIDVLFAMGRGLQKKATETQAAVDVTALEMVKWFDSNYHYVRPTFSHSTEFKLNTAAGIKPVDEFNEAKALGVQTRPVILGPVSYLYLGKADKDSLDLEPISLLPKILPVYKELLQKLKEAGAEQVQIDEPVLVLDLPEAVQSKFKEAYDALVGADVPELILTTYFGDVRPNLKAIENLPVAGFHFDFVRVPEQLDEVASILKDGQTLSAGVVDGRNIWKTDFAKASAVVQKAIEQVGKDKVVVATSSSLLHTPVDLESETKLDAVIKDWFSFATQKLDEVVVIAKNVSGEDVSKQLEANAASIKARSESSITNDPKVQERLTTINEALATRKAAFPERLTEQKAKYNLPLFPTTTIGSFPQTKDIRINRNKFAKGQITAEEYEAFINKEIETVVRFQEEIGLDVLVHGEPERNDMVQYFGEQLNGFAFTTNGWVQSYGSRYVRPPIIVGDVSRPKAMTVKESVYAQSITSKPMKGMLTGPVTILRWSFPRDDVSGKIQALQLGLALRDEVNDLEGAGITVIQVDEPAIREGLPLRAGKERSDYLNWAAQSFRVATSGVENSTQIHSHFCYSDLDPNHIKALDADVVSIEFSKKDDPNYIQEFSEYPNHIGLGLFDIHSPRIPSKQEFVSRIEEILKVYPASKFWVNPDCGLKTRGWPEVKESLTNMVEAAKEFRAKY

SEQ ID NO: 18266 - protein, 318 aa, Candida albicans
KDTTTRFYMYGLNAPIGYVSITANYFKDSNTDDYLKWWKNPENVDLYQFMGKDNVPFHTVVFPASQIGTGDKWTKLHHLSTTEYLQYENGKFSKSRGVGVFGNNAKETGVSPSVWRYYLASNRPETQDAHFSWDEFVAKNNSELLANLGNFVNRIVKFVIAKYNGVIPKFDTKNIPDYDKFENDINSLLASYIDNMENVNLRKGLELAMAISSRGNQFLQDNKLDNSLYANQPAKSDAVVAVAINLVYLVSAIIYPFMPETTVKIDQILNAPALSITNKFELVLLPGHCIGKAQYLFTRIDDKKIDEWRKLYGGQQKK

SEQ ID NO: 18267 - protein, 270 aa, Candida albicans
SDERNILITSALPYVNNVPHLGNIIGSVLSADIYSRYAKNRNYNTLFICGTDEYGTATETKALEEKVTPQQLCDKYHAIHKEVYDWFDIGFDYFGRTTTSLQTEIAQDIFLKLHNKGYLEEKTTEQLYCEHHKSFLADRFVEGTCPKCDYEDARGDQCDKCGNLLDPLELINPRCKVDGNTPVVKESTHIYLKLNDLEEPLKEWVLDSSAKGAWSRNSKNITDSWIKIGLEPRCITRDLIWGYTVPLKGYDNKVLYVWFECPYWLCVHNC

SEQ ID NO: 18268 - protein, 175 aa, Candida albicans
TTTHQTTIMSLEVYGAKGNTLLALTNNLKLSIALAAFEPKVELTLNEVESNLSLKDKKSGFELIEPNAIVKYLAKDFTTTEAIKFEEQVLYSAIKSNKKDELAKITDLPKFAKEELTPSQIIVFASLYPAFKDTKENEWFSKFSQLPEVATGIKNALAITPVEREKETNTGQAKC

SEQ ID NO: 18269 - protein, 156 aa, Candida albicans
VKTETFTLLIQKHTINTELEHSILSSQFASTSFSLFFYPYMNLRFFLPKRIIRMSSTTTTSAAKKPTVKQPQWYQPENKNNSKPTLKIYNSLTRSKNEFYPNKPGHITWYSCGPTVYDHSHMGHARNYVSTDICRRILQDYFGYNIKFVQNVTDID

SEQ ID NO: 18270 - protein, 74 aa, Candida albicans
CKERKLKSWPKMNINHSDLFKDTSLYSEWDEQGLLTKDAKGEEISKSMKKKLTIQYQQQEKLYKEYLKTVEEAK

SEQ ID NO: 18271 - protein, 383 aa, Candida albicans
QPWSKGDMNLINDGEGSLSVSNTKRNASDFALWKASKPGEPAWDSKWGKGRPGWHIECSVMASDITGENMDIHSGGIDLCFLHHDNVLAQSEAYFDNKQWVNYFMHNGHLHIQGQKMSKSLKNFITIDEALNDFSARQLRLVFPLNAWEKPLDFKDSLISEVKSIESTFSKFFTNVRALNSDYKHKTENGGYVSRKITDIEKQLFNDLEQAQDEVDAAFNDNLSSGQAIRVLQDLISKSNNYIQLTSTGQTELRIEVLIQVTNWIVKILEILGFEARSDRLGWIDESEQTSTNGSSTEDVALPYVKALAQFRDSVRSLAINKAELNEFLKASDAIRSLLIGLGVSLDDRPDGTSLVKFLNAQEKQNLLDQQEAKLRLVAEKEK

SEQ ID NO: 18272 - protein, 115 aa, Candida albicans
VKRGSLQPSGEDVREFLDSIKDVAMPHLDKEFGATVTDPQVCRKLPSYWEKRYNEDMARLNVLPPSVTTRVSEYMPDIIEFVDKIVTNGYAYKTDDGSVYFDTVKYEHSQHDYAT

SEQ ID NO: 18273 - protein, 397 aa, Candida albicans
QNLTMILKTSSLLRSAVQPRQWLRYTSTVAPLEASKLIVEKTSNPKPKLPKDKLVFGKTFTDHMLEIEWTKEKGWHTPKISPYHNLSLDPSTIVFHYAFELFEGMKAYKDTNGNIRTFRGDKNMIRMNKSAERIALPTFDGEELQKLIDKLLLLDKDFVPEGKGYSLYLRPTLIGTTASLGVGTPDRALLFVIASPVGPYYSSGFKPVSLEATDYAVRAWPGGVGDKKLGANYAPCVKPQLEAAQRGFHQNLWLFGEEGYVTEVGTMNCFVAFENDDGTKELVTAPLDGTILEGVTRDSILELARERLPSDEWTVSERKYTIYEIEEKANKGQLIEAFGAGTAAVVSPINNIGFRGKNIKVPVALGNSGELTATVAEWIRKIQYGEEEFKNWSRVAK

SEQ ID NO: 18274 - protein, 215 aa, Candida albicans
VSVHQLKHYIFLLLHVLSIFQWCFKPVSLEATDYAVRAWPKVVGSYKLGANYVSCIEPQMEAAKRGHSQNLWLFGEEGYITEVGAMNVFFAFKNADGTKELVTPPLDGMILPGVTRDSTLELAKSKLPSDWTVNERKLTIHEVKERAAKGELVEAFGTGTAAIVSPIDNIEFQGEQIKVPVSAGSSGEIALKINDWIKAIQYGDESFKNWSRVAQ

SEQ ID NO: 18275 - protein, 335 aa, Candida albicans
ARDFPATVVEESCHQSLLMIHGRMESNVPEIAGMYFKDADNVIIKKLLEEGILLVNTQVKHSYPFCWRSDTPLMYRTVPAWFVRIGEVIPEMLDNVEKTNWVPSNIKDKRFSNWIANARDWNISRNRYWGTPIPLWVSDDFEEMVCVGSIQELRELSGRDDITDIHRESIDSITIPSKKGKGQLKRIEEVFDCWFESGSMPYASKHYPFENEKKFLDAFPANFISEGLDQTRGWFYTLTVLGTHLFKTAPYQNVIVTGIVLAADGKKMSKRLKNYPDPTLVLEKYGADALRLYLINSPVLRAETLKFKEEGVKEIVSQCVVAMVQLPTIFLREVA

SEQ ID NO: 18276 - protein, 208 aa, Candida albicans
KKKRLQNFFLLFRLLVIYTSTSWYFTDMSLQESNNNIPQGAFSFPKEEEAVIKHWDDVNAFQRTLELTEDLPPFAFFDGPPFATGTPHYGHILASTVKDIIPRYATMNGYHVERRFGWDTHGLPVEHEIDKKLNITSKEDVYAMGIDKYNAECRAIVMRYADEWRRTIKRLGRWIDMDNDYKTLYPEFMESVWWAFKECLHHGSKSAS

SEQ ID NO: 18277 - protein, 379 aa, Candida albicans
NQYPKNMSVKTKTITVLPGDHVGTEIVNEAIKVLKAIEAATPYQKIQFDFKHHLIGGAAIDATGVPLPDDALESAKSSDAVLLGAVGGPKWGTGTVRPEQGLLKIRKELNLYANIRPCNFASDSLLELSPLKAEVVKGTNLIIVRELVGGIYFGERQEQEESEDKKTAWDTEKYTVDEVTRITRMAAFMALQHNPPLPIWSLDKANVLASSRLWRKTVDKVISEEFPALSVQHQLIDSAAMILIQNPTKLNGIIITSNMFGDIISDEASVIPGSLGLLPSASLASLPDTNTAFGLYEPCHGSAPDLPANKVNPIATILSAASMLRLSLDCVKEAEALEEAVKQVLDSGIRTADLRGTSSTTEVGDAIAETVTKILKQNT

SEQ ID NO: 18278 - protein, 293 aa, Candida albicans
LLLYIKYPYPINKDNYFTMAPKTLYDKVFEDHIVHKDDSGSYLLYIDRHLVHEVTSPQAFEGLKNAGRSVRRTDCTLATVDHNIPTISRANFKNVDSFIEQDDSRLQVKTLEQNVKDFDVTYFGMTDDRQGIVHVVGPEQGFTLPGTTVVCGDSHTSTHGAFGSLAFGIGTSEVEHVLATQTIIQAKSKNMRITIDGDLSEGITSKDLVLHVIGVIGTAGGTGCVIEFAGKAIENLSMEARMSICNMAIEAGARAGMIKPDDTTFNYIKGRPLAPKGQEWEKAMKYWKTLHTD

SEQ ID NO: 18279 - protein, 361 aa, Candida albicans
RMCLGMNPDILDPEERCASTSNRNFEGRQGALSRTHLMSPAMAAAAAIKGHFTDIREFDYATQDEPQIQIAHEIEDKELQEAVYEHEKEYIEDTPETQAERLEDIPKDEPEFKRARTEIDNSAAGTPSIDNSFKVLTGITAPLYKANVDTDAIIPKQFLKTIKRTGLKDGLFYELRFVKGENGKDVETDFVLNTEPYRKAEILLVTGDNFGCGSSREHAPWALKDFGIKSIIAPSFGDIFYNNSFKNFLLPIRIPQEIIESKLVPVVTSGHRLTIDLPNQQIRDGETDEVLIEHFDVEEFRKHCLVNGLDDIGLTLQKEEYIKEYEAKRRIKFSFLEGGSKLIKPIKGTKKSIYGNRAQEW

SEQ ID NO: 18280 - protein, 235 aa, Candida albicans
KKYREGESLCEREKKKIFHFLSHSCNHNPLLFPTNYKIMSGPVTFEKTFRRDALIDIEKKYQKVWAEEKVFEVDAPTFEECPIEDVEQVQEAHPKFFATMAYPYMNGVLHAGHAFTLSKVEFATGFQRMNGKRALFPLGFHCTGMPIKAAADKIKREVELFGSDLSKAPADDEDAEESQQPAKTETKREDVTKFSSKKSKAAAKQGRAKFQYEIMMQLGIPREVFTTRLPKSALN

SEQ ID NO: 18281 - protein, 900 aa, Candida albicans
EFFPPLCQKDVTAFGARVDWRRSMITTDANPYYDAFVRWQINRLRDVGKIKFGERYTIYSEKDGQACLDHDRQSGEGVGPQEYVGIKIRLTDVAPQAQELFKKENLDVKENKVYLVAATLRPETMYGQTCCFVSPKIDYGVFDAGNGDYFITTERAFKNMSFQNLTPKRGYYKPLFTINGKTLIGSRIDAPYAVNKNLRVLPMETVLATKGTGVVTCVPSDSPDDFVTTRDLANKPEYYGIEKDWVQTDIVPIVHTEKYGDKCADLLVNDLKILSPKDSVQLANAKELAYKEGFYNGTMLIGKYKGDKVEDAKPKVKQDLIDEGLAFVYNEPESQVISRSGDDCCVSLEDQWYIDYGEEVWLGEALECLKNMETYSKETRHGFEGVLAWMKNWAVTRKFGLGTKLPWDPQYLVESLSDSTVYMAYYTIDRFLHSDYYGKKAGKFDIKPEQMTDEVFDYIFTRRDDVETDIPKEQLKEMRREFEYFYPLDVRVSGKDLIPNHLTFFIYTHVALFPKRFWPRGVRANGHLLLNNAKMSKSTGNFMTLEQIIEKFGADASRIAMADAGDTVEDANFDEANANAAILRLTTLKDWCEEEVKNQDKLRIGDYDSFFDAAFENEMNDLIEKTYQQYTLSNYKQALKSGLFDFQIARDIYRESVNTTGIGMHKDLVLKYIEYQALMLAPIAPHFAEYLYREVLGKNGSVQTSKFPRASKPVSKAILDALEYVRSLTRSIREAEGQALKKKKGKSDVDGSKPISLTVLVSNTFPEWQDNYIELVRELFEQNKLDDNNVIRQKVGKDMKRGMPYIHQIKTRLATEDADTVFNRKLTFDEIDTLKNVVEIVKNAPYSLKVEKLEILSFNNGETKGKNIISGEDNIELNFKGKIMENAVPGEPGIFIKNVE

SEQ ID NO: 18282 - protein, 153 aa, Candida albicans
LIVGHVTGHPRIQFNDFLGCLQAYGYEIYPVEYPVWTSALERFVTEESKESALFPLLHFVLDNLPQDTKAPELDDSNAAKSLKQDSKYTGEDFSAGKGVDLDQTGVYISYLIKIGFLPKPTGTGEKKLPEVEISDESLKLISGGAGARGSAAK

SEQ ID NO: 18283 - protein, 507 aa, Candida albicans
LKTFKADVDDSIEEANDPIVKGLVAYRELIKDIKGYLKKKLASYAIPTIIVPLVKLPLNPNGKVDKPKLPFPDTAQLAAVAKLSVSSHDAQAAEEENLTKLEEQIRDLWLDVLPNRPATISKDDSFFDLGGHSILGTRMIFELRKKLNVEIPLGVIFKNPTVEQFAKEVEKVIKGGQDFQLADEGKTIQEENKDVADSQSENLNYAEDAKELSKSALLESYSSLKQLPSGSINVFVTGATGFSGSFIVRDLLTARNKNLDIKVYAHVRASSKEAGLQRLRQTGITYGIWDENWAEKIEIVLGDLSKEKFGLDNSQWLDLTNNIDVIIHNGAFVHWVYPYSQLRDANVIGTINVLNMAGEGKAKFFSFVSSTSALDTDYFVNLSDELLAQGKNGISEADDLQGSAKGLGNGYGQSKWAAEYIIRRAGERGLKGCITRPGYVTGFSKTGASNTDDFLLRMLKGSAELGLYPDITNNVNMVPVDHVARVVTATALNPPSTEELTVSTHAR

SEQ ID NO: 18284 - protein, 89 aa, Candida albicans
KPGREHGWLKPIDRMYRSGDLGRYLPDGNVECRGRADDQVKIRGFRIELGEIDTHLSQHPLVRENVTLVRRDKNEEPTLISYIVPKDSP

SEQ ID NO: 18285 - protein, 679 aa, Candida albicans
QPSINSTTMTDFWLNYLDNPTLSVLPHDFLKPANNKSVEGTYTFNIDNGSTDFKFGLAVFAALVYRLTGDEDIVIATDESANTPEFIVRLNLTPELTFQELVSKITKEYENSISQINYKALSEVSHRIKEAKGLDENPGLFRLSYQHAHSNQQLNTTVEGSIRDLAIYTDGTKFTIYYNALLYSHERIVIFGEQFAQYLTTVSNDTNTVITKVNLITDFQKKNLPDPTIDLDWSGYRGAIQDIFMDNANKHPDRTCVVETESFLDSNSKTRSFTYQQINQASNVVGNYLKETGIKKGDIVMIYAYRGVDLMIAVMGVLKAGATFSVIDPAYPPARQNIYLSVAKPKGLIGLEKAGTLDQLVVDYIGSELDVISTIPQLKVQDDGTLVGGKLEGADNDCLNDYQKFKDQPTGVIVGPDSNPTLSFTSGSEGIPKGVLGRHYSLAYYFPWMAKRFGLSEKDKFTMLSGIAHDPIQRDMFTPLFLGAQLLVPTADDIGTPGKLADWMAKYGATVTHLTPAMGQLLSAQATTAIPSLHHAFFVGDILTKRDCLRLQSLAENVFIVNMYGTTETQRSVSYFEIKSRKADPTYLKNLKDVMPAGTGMHNVQLLVVNRNDRSQTCGVGEVGEIYVRAAGLAEGYRGLPDLNAAKFITNWYVNPDKWIEQDEANKNSSENLGENMAG

SEQ ID NO: 18286 - protein, 607 aa, Candida albicans
DSFSIYRPTPTIIMSEEVDKVAEQVQKTYLDDVTGEQVSKTELKKRQKQRAIEAKKAAKAAATPAKTTTKKKDELADLNPNQFFEIRSRQISELREKNNADPSAFNPYPHKFNVTTKIPEFVEKYAHLQRGETLKDVTVSVSGRIMTKRESGSKLKFYVLKGDGVEVQIMAQAQDAPSVEAFESMHEILRRGDIIGVTGYPGKTAPAKGGEGELSVFATKVQLLTPCLHMLPTEHYGFKDQEARYRKRYLDLIMNDSSRERFRVRSKIIQYIRKFLDNRDFVEVETPILNVIAGGATAKPFTTHHNDLNMEMFMRIAPELFLKELVVGGMDRVYEIGRQFRNEGIDMTHNPEFTTCEFYQAYADVYDLMDMTELMFSEMVKEITGDYVIKYHPEGPSGKEMTLDFSRPWKRVNMIEELEKVYNVKFPAGDQLHTAETGEFLKKVLKDNNLECSPPLTNARMLDKLVGELEDASINPTFIFGHPQMMSPLAKKDRNIPGLCERFEVFVATKEICNAYTELNDPFDQRARFEEQARQKAQGDDEAQMVDETFCNALEYGLPPTAGWGCGIDRLAMFLTDSNTIREVLLFPTLKPDALVLKGEEPLKDEN

SEQ ID NO: 18287 - protein, 388 aa, Candida albicans
LTHILIMSKSPVILHLRAETKPLEARAALTPSTTKQLLDAGFEIYVEESSQSTFDIKEYEAVGAKIVPEGSWKTAPKERIIFGLKELPENETFPLIHEHIQFAHCYKDQAGWQDVLKRFPQGNGILYDLEFLENDQGRRVAAFGFYAGFAGAAIGVLDWSFKQLNGNTKGTKSERERGELPGVTPYPNENELIKDVKIELEKALTKNGGQYPKCLVIGALGRCGSGAIDLFKKIGIPDDNIAKWDMAETAKGGPFQEIVDLDIFINCIYLSKPIPPFINKEILNNENRKLTTIVDVSADTTNPHNPIPVYEIATVFNEPTVEVKLDKGPKLSVCSIDHLPSLLPREASEFFAKDLMPSLLELPNRDTSPVWVRAKQLFDKHVARLDKE

SEQ ID NO: 18288 - protein, 453 aa, Candida albicans
PIQFNQILKMVKKVLLLGSGFVAKPTVDILSEQPDIEVTVACRTLSKAKELAGDKAQAISLDVTDAAQLDEQVAKHDLVISLIPYTFHVNVVKSAIKNKKNVVTTSYINPQLKALEKEIEEAGITVMNEIGLDPGIDHLYAVKTIEEVHKAGGKIVSFLSYCGGLPAPENSDNPLGYKFSWSSRGVLLALRNQAKYWLDGKVIDISSEDLMASAKPYFIYPGYALVCYPNRDSTTYKELYNIPEAQTVIRGTLRFQGFPEFIKVFVDLGFLKDEPMEIFSKPGPWNKALAELVGAKSSSEQDIIDKINQLTKFKSPEDQERILAGFRWLGLFSENQITPRGNPLDTLCATLEELMQYEKGERDLVILQHKFGIEWANGTKETRTSTLVDYGDPNGYSSMAKLVGVPCAVATKQILSGELSKKGLLAPMSSDINDSIMKELKDKYDIYLVEKTI

SEQ ID NO: 18289 - protein, 459 aa, Candida albicans
FFFFSIIIILMKSRIALTLRRFISTRPRLFTTYTTGQPTYETRPHIITQPGDLTPGISAMEYYQRRLKLSTHLPSKSLAIIIGNTTQFSSGSVFYDFQQDNDLYYLTGWLEPDSIVAIEKKGDNGEDDVVLHMLVPPKDPKKELWEGPKSGLEGAYNIFNADLVEDISQAPSYLKQLIKQNDYIYWDKKFNLKQNEGLRQFFNFSTNHRHHQGINEIIENSKKSVQKLSPIVAKLRVIKSDAEVSVMKRACEISSVAINRAMATVGSDDPINSENTLARYLEYQFVKGGCEKNAYIPVVASGSNALCLHYTRNDDLIKKNELIFIDAGGKLGGYCADISRAWPNSTDGFTDAQRDIYEVVLATNKKCITLCSESLGYSFHDIHEVSVNTLKHELKNLPGFGDVTFSDISRIYYPHYVGHNVGLDLHDIPSVSNRLPLKTKPSHYHRARMVYTTGRTKTL

SEQ ID NO: 18290 - protein, 77 aa, Candida albicans
ICMTYHPYPTVCPLKQNQVITIEPGWYIPQDGPKHYRGIGLRIEDNVVVGKTHRDIINLTSGCKKEVSDIEALVRGG

SEQ ID NO: 18291 - protein, 164 aa, Candida albicans
DIHLQAHNVLIQGFLELGIFNSKYSAKKLFAAKATARFFPHGLGHVLGMDTHDVGGRANYSDPDPLLCYLRIRPKLEPNMVVTNEPGCYFSPFLLEEVLNNPEQAKFINTDVLDKYWYVGGVRIEDDVLITPTGYEIFTKITKDPAEISKIVKAGLAKKFHNIV

SEQ ID NO: 18292 - protein, 177 aa, Candida albicans
TTLNLPGHPLIMNIRQQITQFLSLAYVFSSAFMLWKTLSVIANSHSPIVVVLSGSMEPAFQRGDILFLWNRDHQQKVGDIVVYEIDGKSIPIVHRVLREHHNLEKQLLLTKGDNNAVDDLSLYAKKQQYLNQKQDLVGTVKGYLPFIGYVTILISENVYFKYGMLGLLGLSSLFSNE

SEQ ID NO: 18293 - protein, 316 aa, Candida albicans
MTVSNTIKILRTVQQVRQWRAQCFLRNESVGFVPTMGALHAGHCSLINQSIKENDKTVVSIFVNPSQFAPHEDLDNYPRTLDHDLQILQTNNNNNNNNKIVDAVFVPKVSEMYPSGISLDIDKQRGAFVTVHGSSEQLEGITRPQFFRGVATVVTKLLNIVQPTNIYFGQKDAQQCVVIQNLVKDLIINTNVRIMPTLRESNGLAMSSRNQYLSQEMKDKSSLIYQGLKTGENYYLNHSKDSGDKVSANEILQQIKPIISSDPDFDIEYIAVSHPETLEDLDYVVPGTGAIVSTAVKVPKENSDEKARLIDNIILH

SEQ ID NO: 18294 - protein, 179 aa, Candida albicans
TYNYQQSSMGNELLSTARIYTFKIPDAYNNVIDFDQFKNKVILIVNVASLCGFTPQYKELQLLYEKYHERGLEILGFPCNQFGNQEPLQEEEIVESCRRNFGVSFPIMKKTKVNIDCDGHESESNKYLKSGKPGEVGFKGVRWNFEKFIVNRKGEVVARFNSLITPLQLEGFIEQLLSE

SEQ ID NO: 18295 - protein, 93 aa, Candida albicans
PTEFLFPPSILIAMSDFYEFAPNDIKGTPYSFKKLQGKVVLIVNVASKCGFTPQYKGLPDLKPKFADQPVEILRIPCNQFGHQEPGTIEKIEK

SEQ ID NO: 18296 - protein, 232 aa, Candida albicans
ALNMVKSNVELAWETMEDTFLEIQNKFHQIYKPIDTGKPDEDDETTKKESLDITDDSTLSVSPITQLLYLARLKFYDLTPLDNLKSPFPFKNLRGKVVLIVNVASRCGFSFQYNGLEQLNKRFANDDFVLLGVPCNQFLWQEPGTNDQIVTKCKKKYDVSFQILDKINVNGEQADPVYKFLKAQKEGLWGTNRVKWNFEKFLIDKNGRVVERYSTFTRPVAITPRIEQLLES

SEQ ID NO: 18297 - protein, 192 aa, Candida albicans
IVFLFPSFCLPSLSLYYYFITKYSIITYLHKMSQFYELAPKDAKGEPYPFEQLKGKVVLIVNVASKCGFTPQYKGLEELNKKFADQPVQILGFPCNQFGHQEPGSNEEIGSFCSLNYGVTFPVLDKIEVNGDNTDPVYKYLKSQKSGVLGLTRIKWNFEKFLIDQNGKVIERFSSLTSPESIGTKIEELLKK

SEQ ID NO: 18298 - protein, 157 aa, Candida albicans
TVIFGSEWAQVEIINRLLNQGDKIDNDDGNGDNNDNNDKVDYSNFIIRITCLFAITSLIPVIDYKVLIDKVLPFINGLINDSVPNIRFNVAKSYLILVESLINKKKSGQLSETNDQELKKFIDSQVLSNLQKLENDDDVDVRFYSIKSIKGINEILT

SEQ ID NO: 18299 - protein, 367 aa, Candida albicans
VMKKLMGFSLTLIQNLSQGNWFLKKIAACGLYQSVIIRVDATTRQNLLKLYFKLVTDDYPMVRRASATNLPRLIDLLTEFTEHNPNDVNKITNEDWEIISKMFQHLITDDQDLVKFLSVDVLISILEFFGKIHEYSFNADFLSSALKLIQDESWRVRYTAADRFSKIARNFTNNELDLFQLIDPFISLMKDHEGEVRKAIAKQLPVFCQLLVKFPLTKATVLNKIVPVANELSQDPQENVRASLASTITELSPILEKQATIDKLLPVFLIMLKDEFPDVRLNIISNLSVVNETIGINLLSTNLLPAITELAQDHKWRVRLAIIEYIPKLAKQLGESFFNEELLSLCMSWLWDPVYAIREAAVNNLKE

SEQ ID NO: 18300 - protein, 148 aa, Candida albicans
NKRNFKSNTGIMNNFSDDLYPLALLMDELKHDDVSNRVEAMQKLDTIAIALGPERTRKELLPFLNDVAQDDEEEVFAVLANKLGEFIPLIGGHQYSEPLISILTILASMEEPLVRDKAIDSLNKISLELSDEEINGIFSDINTKFESR

SEQ ID NO: 18301 - protein, 251 aa, Candida albicans
  UNSURE (170),(171): Identity of amino acid sequences at the above locations are unknown.
LGSDMAFPGCVKIDYRSDEFVVLACDGIWDCLTSQKCVECVRRGIYERKLLSIICEEIMDLCCAPTSDGSGIGCDNMSIAIVALLDYTKNETLDQWYEKIISRVEQQQQQKNDPNSLNKYGPISQPYNELYKEMYGEYYDIGQQGQGGNGRSNIGSGNGSGRGSGASGSXXGGGASINGNSIFGRSGYDDEDDDDDEEKNIERRRRDQDESHLNGGAISLQKLLASNAITNENGVIYLDTSSAQSLLAHFG

SEQ ID NO: 18302 - protein, 99 aa, Candida albicans
PLSIVSMGQLLSHPIEEKELDYKSYTNLTYCIGSMQGYRMTMEDAHDVKINEHENLAVFGIFDGHGGKNCSQYLAEHLPKLVFTKLNNLHHAVDDPTCI

SEQ ID NO: 18303 - protein, 168 aa, Candida albicans
  UNSURE (5),(9): Identity of amino acid sequences at the above locations are unknown.
RDATXSIPXGMIDLKDVFDILKNSFFKIDKDLSHHANMVNCGSTATVVTIIANYIVVANTGDSRCIVSRNGHAKPLSFDHKPSNMGERVRIENSNGYILNNRINEVLALSRAFGDFKFKLPYLSSSRNKYIKENQKLLGDKLITLPPELFQVTVEPDIMLYDMQKLDS

SEQ ID NO: 18304 - protein, 268 aa, Candida albicans
LNNKVCVGNILDFHQIQEKNDNQFKLVIYCEDYQNEECYDEFPTLQDLQYIWQDYMLGNHIHHTYMIKIPSLGFRNNKSIDEYELIMILNLLKLIERISRVNKVFIGCYDGFTHSTNLLVLVMQLLGKVIIEESIFQLTETENVKLFFSNPGIVGGDLQFLRELEPFVDYLNKHLIQEFPTIIDMNNLDLDSIHRYYCINPIAKPPLYQDDWFVVKTNNSKHDINLPSRILANVYLGSSMHGGSLTILQTYKFTHLISIDELPIGGTH

SEQ ID NO: 18305 - protein, 734 aa, Candida albicans
GFHKYNLAKRSFFVHQRQQLQQKLDNSSTNTSNTNFQDYMNHNELFTDYHLSRPDDIRFLMCINDESLPVNLHNTVKLTEILTKIDVSKSEIKEIIKKIWLNDKNGIETETETETETDSSFIELLVTDCIKLNVLPIFLNLDPERGISLRNFQIQVAKLSSCSDFIIYGIDELKIQSITRILWLAQRYERQQREIEIKESRKGNQQQQTYNIFVLKNDLTQCYEKLPPSTTIMNTIQSFAKYLKIDTSGLFYKPINQYLLNDYNLPLYEKIETAKMSSATKIYQNVWIGNFWDYQSMLNYLSENKPVETSKENLRDYYCQPSNSITTSTTTTTTTTTTTNSQLSLPQPKANWKLFIRCHSEASFPDLQDLNQLLFKYTISSHEQSDEIHHLEFPPLGSIGIGDCKKENLQLIINTCKLIYLYSSTTTKNPSSGLNSLIYCTDGYTELSLLVFCYLMYSLNISLDEAILELHLTYGRPFYIFPSDVIILKKLQPLLRKFSPTTKSSNNNNSMNRQIDWANLEILSSQEINELLLGSPKESSQQNTRLGFISPNEDEDEDEDDEDEDEQDIDNDSSSGSSDYSFNEIDWVNEVEGSIPSKILPHIYLGSLKHALCLSILNKLGIQKIISVGESLPWLNGYIFQRHNDITINQSTDGNIETYTITPKKKTNLVAHSHHITSVDTVLKVNNLEDDGIDELSQRLPQILKFINDQYEINQGQVKILIHCRVGVSRSATV

SEQ ID NO: 18306 - protein, 198 aa, Candida albicans
KLKIYEFEFNLKNLKSIPQELLNKWSSSSSSSMGLPHKNFKSLIYIHDFKDDGRDSLMELLIDAPPAIQDKILLGSTTNINNPTNNYTNANNNNNKTLIHCKIGVSRSATLVIAHLMKTYRLGFLQSYFLVRVQRFNIIIQPNLKLFYELYLFDQWLGLKDFYINHQFKHYNWETICHLINQLNQIYINPKSITLSSS

SEQ ID NO: 18307 - protein, 373 aa, Candida albicans
SRVTMFQFIPFPISFTKMNISKKPITAVTTGLTAITSNESRKENSDSSSSKKSTPAVLTISSHKQREDFNELNEIESHRIVEGLNNAATSIWSISAGISRVNRKRNRYTNVTPWDRTRVKLPVVDGSFSDYINASHIHLKTTASKISNRYIACQGPLEHTTHHFWAMCFNELEKQKNDVVVVVMVTPLVENGMVKCDRYWPELHETWDFTSKNAEDGIKYEKLTLTNIGENHKELEDYLITELELKSPTKSKKVYHYYYYKWADAKVPPSIEPLIALSRSVYKINQPLIESGKPLVPIVHCSAGVGRSGTFMAFDHLFRDADKFRNLVHEDRIASKDLVYQSVCQLRNQRMMTVQTVYQYCFLYEAARTIYKR

SEQ ID NO: 18308 - protein, 107 aa, Candida albicans
APIWQLRGEDPRRAGFTFGQDISEQFNHTNDLSLIARAHQLVMEGFSWSHHENVVTIFSAPNYCYRCGNQAAIMEVDEQHNRQFLQYDPSVRPGEPTVTRKTPDYFL

SEQ ID NO: 18309 - protein, 271 aa, Candida albicans
  UNSURE (267): Identity of amino acid sequences at the above locations are unknown.
TIMDLDTDVPMEDVEEQQQQQEQSLSKQSATKSLTNPQGTGATATSSAQQQRKDLDGSSINQLDVWIEKLSKCEPLSETDVKKLCDMAVEVLQFEENVQPVQVPVTICGDVHGQFHDLMELFKIGGPCPDTNYLFMGDYVDRGYYSVETVSYLVCMKVRFPNRITILRGNHESRQITQVYGFYDECLRKYGSATVWKLFTDLFDYFPITALVDNKVFCWHGGLSPMIETIDQVRELNRIQEFPPKGQCVNCWWSESNDKRGWWYSPXKNGF

SEQ ID NO: 18310 - protein, 318 aa, Candida albicans
IQQIMGERGPDQWLEQIKNCISLSESDMKQLCELVKELLMEESNIQPVQSPVTVCGDIHGQFHDLLELFRTAGGLPSDDNQTNFIFLGDYVDRGYFSLETFTLLMVLKVKYPHRITLVRGNHESRQITQVYGFYEECLTKYGSTTVWKYCCQVFDFLTLAAIIDGKILCVHGGLSPEIRMLDQIRVLSRAQEVPHEGGFCDLVWSDPDNIDTWAVSPRGAGWLFGSKVSREFNHINNLQLIARAHQLVMEGFRYHFKEKDVVTVWSAPNYCYRCGNVASVMQVDEDLEPNFKIFSAVQDGDLSVKNNANKQQRSDYFL

SEQ ID NO: 18311 - protein, 185 aa, Candida albicans
LTGKYQVAPILMASTDTDNSKTVSSSTSSPSTPTKTATTKTTATPPIQSSLEVPSLANNSNGSSSTSTSSTNASLTGANDSNYDPFAGLSFRVGVAENKNTTFRNKMEDVHTYIANFAERVDWGYFAIFDGHAGKDTARWCGNNLHTLLEEEIDRNSDEGSPPPTPIRGKDDLRGRYVPVFCSSR

SEQ ID NO: 18312 - protein, 386 aa, Candida albicans
LTGKHQVAPIVMASTDTNNSKTVSSSTSSPSTPTKTATTKTTATPPIQSSLEVPSLANNSNGSSSTSTSSTNASLTGANDSNYDPFAGLSFRVGVAENKNTTFRNKMEDVHTYIANFAERVDWGYFAIFDGHAGKDTARWCGNNLHTLLEEEIDRNSDEGSPPPTPITGKDDLREDLYKCFVKADELIEKSGQGKSGCTAAVAVLRWESDNEEPVSHTKSQDGGKFDFKPTKNHKRLLYTSNVGDLRIVLCRAGQAYRLSYDHKATDTHEINRIEDNGGLVLKNRVNGVLAVTRSLGDTYMKLLVIGVPFTTATEITADDEFIIIACDGLWDVVSDKHACKLAAESFKQGYSPLQVAKKLCQFAIELSTTDNVTVMVVQLDNDVFS

SEQ ID NO: 18313 - protein, 184 aa, Candida albicans
RTIENIKQCKHIPEGDVEELCTKVIELLIEEANIQHIDTPVTICGDIHGQLHDLITLFKTGGELPDTQYLFLGDFVDRGFYSFESFLLLISLKLRYPDRITLIRGNHESRQITTVYGFYDECLRKYGSINVWRYCCEVFDYLSLGAIVGGSQGVFCIHGGLSPEIDTVDQIRVLDRKKEVPHEG

SEQ ID NO: 18314 - protein, 418 aa, Candida albicans
LIPIHLLITDSAVAGNPLANGHKTINGQISVDVNKKPVGAIGEALKLLGYTVGLVVITSVGDVTPCVWVSHAESRSDQDLIVEQMVGQTHPMGPVADLIIGGGRDWFIGLDQGGKRRDNRSLIEEVQKNGTWTYVGDRAGFDSLDKGKNVSLPLLGLFAKDNYPYRIDRKDSEYPNLVEQTQVALNALTEHTKDNDKGFFLMVESSRIDHSGHENCVQAHAQEALEYDQVINLVHNYTKNADVDTVVVATADHETGGLVLNQKTPNDFKVVFNATHSGEYLAKQILTYKEQDKLADFVKETVIEQGLGLTNYTDEEVTRLVNIAQKNSTTTATTLGVAIANLTSSRAKAYWGSLDHTSVDVDLYAFSNADYLQQKVTNVREGLAGFHENTDFSVFIKSIEDIDLDKATELVANVRTKY

SEQ ID NO: 18315 - protein, 249 aa, Candida albicans
DNLFIATYSIMGLSNDQSPLLGGDSLTCWNKKQSGIKRNLSYLLNIITIGIIAYLCIFAKHSDNDDNTGPLLNPQKKKNIVMMVTDGMGPASLSAARSFRQFRDKLAINDILTLDKYLIGSSRTRSSSSLVTDSAAGATAFSCALKSYNGAIGVTPDKTPCGTVLEALKLQGYYTGLVVTTRITDATPAAFSSHVDYRFQEDLIAQHQLGEYPFGRAVDLILGGGRCHFLPTSEGGCRADNRNLIRVQR

SEQ ID NO: 18316 - protein, 316 aa, Candida albicans
LEYSDKWQYVGDRVLFDQLQGGKNVSLPLLGLLANTDIPYDIERKDSEYPSLAEQVQVALTALSEATRDSEQGFFLLIEGSRIDHASHHNDPAAHVREVLAYDRAFEEVIKFIDNSEIETVAISTSDHETGGLVVARQVSELYPDYLWYPEVLLNSTHSGDYLSHKVVHYKEKDNTKKFTNFIKHEILEKDLGISDYTAKDVDLIIEKANNAGELLYVLNNIVSIRAQIGWTTHGHSAVDVNIYAHTNSPAIKSKLLSHKAYDGLSGNHENIEIGAFIEYITGSDLNQVTQLIKKTEHSPDNNKAKVDDIFHANVL

SEQ ID NO: 18317 - protein, 599 aa, Candida albicans
MINPRNLRLIIAVIGLVGIFAFFASSQHSLVDRTALQVNKPAADSPHVPPPAAAAAPVSPPPPSQQQKQQEGSQKQLNDENSDEKNTLQGTSYSGTKPPYEKVDGKSNKILADKLDTTKNSKPNQQQQQNTQKGASEEKSAQNKITTPEEVSMDNGKCNDIDYVVMIDAGSTGSRVHVYEFNTCVKPPQLLSEEFEMLKPGLSSFDTDTVGAAKSLDPLLEVALKKVPKNKQSCTPVAVKATAGLRLLGETKSKAILDEVRSHLEKDYPFAVVSEDGISIMDGKDEGVYAWVTANYLLGNIGGKEKLPTAAVFDLGGGSTQIVFEPDYKVDEVPVDGETKYHFTFGDNQYTLYQFSHLGYGLMQGRNKVNQLVLKNKLSELNLQKYTKKEVKGAKATVDVSNPCIPPGVVAKDVQVELGEDEFYVVNMKGPSSKDSTVAGGSQCRYLAEKVLNKDAECTSKPCSFNGVHQPSLTRTFNKNSDMYVFSYFYDRTNPIGMPSSFSVEELKDLSKLVCQGETFWKDILLDDHVKNLNEEPQWCLDLSLITAMLHTGYDIPLHRELKTANTIDNNQLGWCLGASLPLLDKNNAKWTCRIDKTD

SEQ ID NO: 18318 - protein, 541 aa, Candida albicans
IVRNSLMVKKLNVLIYDHNSNYDFISFNLYHTILKFNQFINHFNISYLEGGFYPLKNDIEKYHHLIDDSDISNNNNNIGNFSTMNNSKLQHRKAKSLSGLTLPMITKTTPNNNNNTTSTTTITNNNNINQLSSSINNSFLQSIHKKSNGNDEPILEELRNYQLKIPQSLQNIPNWLHNVHLYENFEKLENFEKTSINNIFNSSSSTTTTTTTTTTTTSKLGSPIGKFGNNNNSNNDDDNDNDIISPCCMSCQKIEFNVPRGIEYGYKNRYKNIWPYDHSRVKLTASTNNNNNNNNNNHNPPSSPSSCSSSSFIDDYFNGNFINTNSIIPNNQFTYIATQKPLSSTISDFWNIINHENIQIIINLDYEPINYFNYKEFIKLIKPIPEKTDNTKKVYLINEKIYYIQYLSWPDFSIPQDYQSFLNLINLKNEITAKYDLNKKILVHCSAGCGRTGVFITLDSLIQGIINKDNDKDKDKPEVDGEVDGEVDGVVFDVYKSSKDLIYKLIQHQRKQRISMVQNYNQFIACYEICLQPQGLEGTAL

SEQ ID NO: 18319 - protein, 96 aa, Candida albicans
AFSLDRANSQQKQEGNSWNQGDGNKENASPTNVDINEGEIIPKISCGIEFGHKNRYMDIYLYDHSRVELGHVNKANDNDQVPVFENYINASLIEPP

SEQ ID NO: 18320 - protein, 130 aa, Candida albicans
KYSNNNNNQIKNRYIATQGPLDETMGDLWKMVVQFKIPLIVSLTDSIENGVTKCAPFWQSGIYKSYKDAIKVSLIEENKLDESLILRKFNVDCNSASSSSSNPGEYDCESQFDNSPRVFFTHRRWKEPHL

SEQ ID NO: 18321 - protein, 173 aa, Candida albicans
SRPRGEDPLCNEHKAFPFPATTSTPGTPAAPALPSSTPPQKPSTNQPSPHLEKQKTSSLDESLKAIQQQQKKRINSIPLLNYRPKIEGLSDRFKYPRRIEMGAQAALSKNIVLDIRPSAQYSKAHIKDSINLCLPSTLLKRATFSFERSVDALGERQRDRFADFFNRISETSS

SEQ ID NO: 18322 - protein, 302 aa, Candida albicans
FERFEKVRRRRRKKKHLWVNNTNNNSNNNRFNSVSVSISISISISIMGQILSQPVVEKHSDEHKDKYLAYGISCMQGWRINMEDAHATILNLYDLPLKKSLSSNSEQDEDEEDEEEEADSQDSTTTNTTKSHQQQNQKEDLQQNNDKQNLQQDIKDGDNDTQMSDSDENHHHAAPQQQHIAFFGVYDGHGGEKAAIFTGEKLHHLIKETKEFKQKDYINALKQGFLNCDQEILKDFYMRDDDSGCAATSAIITPDLIVCGNAGDSRTIMSTNGFAKALSFDHKPSNEGEKARSLHHGARRPA

SEQ ID NO: 18323 - protein, 319 aa, Candida albicans
  UNSURE (16): Identity of amino acid sequences at the above locations are unknown.
PPHRMSFPFPWWNRHXGKRVTLTENEIRFLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRFNIKLWKTFTDCFNCLPIAAIIDEKIFTMHGGLSPDLNSMEQIRRVMRPTDIPDVGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPADKKPRYAPANVANNRPGANQRKPKKAVK

SEQ ID NO: 18324 - protein, 433 aa, Candida albicans
HYILTIPFTDRIYLGAYDHHKRDTEDLAYFTVEDALPYNAFYMDFGPLNIGHLYRFAVLLHKKLNEDSTQGKGLVIYSSTSPKERANLACLLCCYMILLQNWAPHQVLQPIAQITPPLQAFRDAGYSSADYEITIQDVVYAMWRAKERGMIDLAKFDLDEYEQYERVDQGDFNVISKDFIAFASPQQSKRGGLNEPFQKVLEYFVENNVQLVVRLNSHLYDAKEFTKRNIKHIDMIFDDGTCPTLEYVQKFIGAAECIINKGGKIAVHCKAGLGRTGCLIGAHLIYTHGFTANECIAYMRMIRPGMVVGPQQHWLYLHHDDFRSWRHTMIVDNRPDPLIGNLFPLCSYEDYKQRLKEAKRKERLQLQQQLTSPLADSSVINTPIRRRKVSGALASKIQTVVPIESPGQPRKYFEDSEDIDEVEMVNNSDDENN

SEQ ID NO: 18325 - protein, 131 aa, Candida albicans
SWPSCRGRRTVDRKAGLGRTGCLIGAYLIYRYGFTANEIIAFMRFMRPGMVVGPQQHWLHLNQGSFREWWFEDSMKEKLAQMQPAPITPGRGSTMQRANNGPIATPPNNSHSKRSALGEIDHNEGAGTQSE

SEQ ID NO: 18326 - protein, 360 aa, Candida albicans
TIKLWKIQERQIKLVSENNLNGLTHLPSTDIGISSLKLPQLQLHDKLISAQPKKIYANAHAYHINSISVNSDLETYLIADDLRINLWNLGIADQSFNIVDIKPANMEELTEVITSAEFHPSQCNLFMYSSSKGTIKLSDMRSNSLCDSHAKIFEEYLDPLSHNFFTEITSSISDVKFSHDGRYIASRDYMTVKIWDLAMENKPLKTIDVHEHLRERLCDTYENDAIFDKFEVQFGGDNKSVMTGSYNNQFVIYPNAVNKGGNDKPKSVFKNNTNKRKKNGYRGRDDDDDEDNNNDDDDDDDDDDDDEDNQFDKEVPVSKNSPSSQLDYYDDDDEPEKITLQADKSAFTSSSLRTAGSELS

SEQ ID NO: 18327 - protein, 445 aa, Candida albicans
  UNSURE (220),(239): Identity of amino acid sequences at the above locations are unknown.
DINFLKAYYRKGVSLMAILNHKQALENFKFILKKLPNDKLTLENYKQCTNYLKRQAFEKAIAGNDDNESIFNKIDYQSIQIEKSWSGPELNITTTTTTNTTTTNTTTTTTVGDNNKNKKSDVIVNIEGLDHDYLKYMIKLFKNGGKLPKRHVFAIIAKVYEILKQENTMTEISLLHSQIDFNNDNDDTINNPHGKGKGKSDQIIGGKKLTVVGDTHGQFXDLLNLFDKFGHVTQDHIYXFNGDVVDRGSWSCEVALYLYVLKILYPKSIFINRGNHETNDMNKTYGFNDECEFKYSKKIFEAFNQSFGALPLACLINQTYLCMHGGLFCNDKVTLKDIKSINRFHSNGSSQPPKEGLAMELLWTDPQEINGSSPSKRGIGMQFGPDITERFCLSNKIRKIIRSHEVRMNGIENEQNGRLMTVFSAPNYCDYNWELYYTSGAGRIP

SEQ ID NO: 18328 - protein, 174 aa, Candida albicans
IDNYLNRQTFQIIIIIFINFKVTMSKIYSLSDLKFIKPKTLKSWFTNGSSPHGKFCVVDVRDSDFVGGHIKGCYHYPAANFHYTLNELYQKIYQNKIQDIVFHCALSQVRGPSSTLKFLRGIDDITDSKVKSYFNDDNIRVYVLHGGFTKWQEEYGNDKEVTEAYDQEIWEFGS

SEQ ID NO: 18329 - protein, 268 aa, Candida albicans
NCHHRLLLPPTHITNIIKTCYSTIYPTNKPLQTMIEGSTKGESDIPLYLFTYNCNKRVIDANVFKSKVSQSLPPKDNPSHLYVFALQEFCTILDGSFKASANQQLIAYNELLQVMLFEEYGTDHFQTIAINHTGAVGLIIITPYPLKFQNVRLANTSCGYGYSSMKGGVGVRLRYYPEGKYGDNSVELSFAGIHLNAYEGEYYYLQRNANLLRIVRSLDFGDGYGLIKPNNHVFILGDLNYRTTKEYKKTSVVAQNLLFLHHERARTA

SEQ ID NO: 18330 - protein, 350 aa, Candida albicans
ILISEIRPNGKERFWVCCKKRNKYMVMWSGQLGGVALYFFVKESQVKYVSNVECSFKKTGLGGVSANKGGIAVSFKFSDTTICFVSAHLAAGLSNIEERHQNYKALIKGIQFSKNRRIQNHDAVIWLGDFNYRIDLTNDQVKPMILQKLYAKIFECDQLNKQMANGESFPFFSEQEINFPPTYKFDKGTKVYDTSEKQRIPAWTDRILFLSRQNLIEPLLYNSCQNLTFSDHRPVYATFKITVKIINHTIKKNLSDEIYKNYKDSHNGIFDILVKSFDNKELNEGKDASLPPPSSDKQKWWLEGGKAAKIIIPGLEDDNMVMNPWRPINPFEKSNEPEFVSKNDLEAIQN

SEQ ID NO: 18331 - protein, 359 aa, Candida albicans
IICKLWFCALIESREKKKLNLKNRNNTAFDDLQHKLLMLVKRILGGLYLSSIDPIFKEIDLKSEYGITHILSVVPGTMKESYFSDYEWKQIEITDEETTNVIQYFPESYAFIESALFQNSNDKKHQSCVLVHCSQGVSRSATFIIAYLMQKYHLSIDQALHAVKRKCPGAEPNPGFMNQLKLYNEMGFKIDESNQKYNEILKSNSLKTDPTGRSLRDMIMEKSGSPKEVKEELLYELRCKRCRQILASSVHIENHDIPESDSRQSSFIKTAPNSRRIISVERASLICSHYFFKEPVKWMKQELDKAEMEGKFLCPKCSSKVGGYSWRGSRCSCGKWMVPAIHLQEAKVDYIKRESTLRN

SEQ ID NO: 18332 - protein, 204 aa, Candida albicans
CAGMSIHNYTTPNRILYYNYQYIRLQQLLTKMGANASILDGFIEDTNFSIEEIDRLRKRFMKLDKDGSGQIDKQEFLSIPGISSNPLATRLMDVFDKDGDGSIDFEEFITGLSAFSGKSDNLNKLRFAFNIYDIDRDGYIGNGELFIVMKMMVGKNLKDEELQQIVDKTLMEADLDGDGKLNFEEFKNAVNTDTIANTLTLNMF

SEQ ID NO: 18333 - protein, 295 aa, Candida albicans
LSSSTMDSFDAANQLLQMLRSLSPQLQHLSKAVYFALKNSDKEDYLLPTILDVINDKQLPTSIKANILQFVDLLINESLSLDKYKQAYVQGLKDNLPLIITQVSDNKSNLYSTYLSLFNISQHFKMDCHGCVSQFDSNMLTDKDIDLIKRNEEFTKSDINDDEPLVRAWKILLQCKHECQFERAKLLEHSEYIDDIVDEDLLFSIREKSNPSTTLLSKRQILVRMEDDREAHKRSKENFWVVNRDKEKGNHITEDEFVNHYWNKFQPLNDQENKEFLNSLQELNVIVENSYKDKY

SEQ ID NO: 18334 - protein, 267 aa, Candida albicans
RLMTFQPAGEDTSENPILIRRNTNETLQTPNFSDTLSPHLHLQQQQQQPGSPLSTSMNGNTISRTSTNHSIISTTSHKSSLQQSNLPLKKETTTSSLSTNSNTIDIDSLIDKLLNAGFSGKRTKNVCLKNTEIELICASAREIFLSQPSLLELAPPVKVVGDVHGQYHDLIRIFSKCGFPPKTNYLFLGDYVDRGKQSLETILLLLCYKIKYPENFFLLRGNHECANVTRVYGFYDECKRRCNIKTWKLFIDTFNVFNHGSWTDPRL

SEQ ID NO: 18335 - protein, 118 aa, Candida albicans
NDLLWSDPADNINEWEDNERGVSYVFYKVAINKFLSKFNFDLVCRAHMVVEDGYEFFNDRTLVTVFSAPNYCGEFDNWGAVMGVLEDLLCSFELLDPLDSAALKQVMKKEKQERKKST

SEQ ID NO: 18336 - protein, 194 aa, Candida albicans
SNKTRLPVETNELKYVLAKSRQIFLDQPTLLRLSPPVKIVGDIHGQFHDLIRIFNCCGYPPHSNYLFLGDYVDRGEKSLETILLLLCYKIKYPENFFMLRGNHESANITKIYGFYDECKRRLPNHKLWKNFIDVFNALHIAAVINEKIFCVHGGLSPDLNNFDQIENIKRHTDVPDKGLLADLLWSHPDAPFKS

SEQ ID NO: 18337 - protein, 369 aa, Candida albicans
RQCDRMCNYDNYPLLTYPDIAILEGGYKNFYENYPQWCDPQGYVEMKNLRHKKLCESNLDKVRKDNKLTRAKSYQFGIQHRRGGSTGGLFGNYNYYVMNSSDQQFWSSSTSNTAHHRSSSSSGFINNMHSGASSYHHRSQSFVTINNEKIIKRQRSTPKVSNSPTKPTSSTVSPDKPIPLANIHRLTRANTISSDQTLFSNKLVSSPMISPLAASFEQSSIGMSSSELSVNTQDFQPPTTSFRNSTHNFNNMNRRRKSLSSNFSSCSINSITSSVADSDYAGSVDSALTEPYTSSSPILDSADYFDNGAKRQNLIAMPISKGQPSLLTSSSSSSSIHRKHASKLGSNIQASLANPPSLPPPPPPTTTTD

SEQ ID NO: 18338 - protein, 172 aa, Candida albicans
SVVPSSRVVKNKKMVDRIILIGDIHGHYIEFRKLLTKINYNKHKDHLIVLGDFISKGPDSFKTLDYLINNNIDCVLGNHEYYILQNYATFHGLDQPNFSSSESQPIAVKDSFNDDPEFLLAKKLEPHHVKYINNCSIIKKLGYVPNPKGKKKNKVGDGADYSQGIAVHAGIR

SEQ ID NO: 18339 - protein, 158 aa, Candida albicans
PPCDHMLFIKSLIRSIIASPKNQYYDSSTNLKLDLSYITPQLIVTSAPVTNYIESWYRYPLNDLLQFLNSNYGSNWHIFNFRGESPGYDDSLVYRKVSHYPFPDHYPPTMNIIINCIDEIDNLLQVFGDKTNVVAVLHCKAGKGRSGTLCCAYLIYQK

SEQ ID NO: 18340 - protein, 352 aa, Candida albicans
  UNSURE (256),(261): Identity of amino acid sequences at the above locations are unknown.
AMRLYLIEKPRTFVITTNTHALIIRHPSPTYKHSGIKGLVSGHSKDKDQNKDTKVLVEFVLKEYLDLSLYRDITPKHGGLLGLLGLLNVKGKTFIGFITRDEWTASATVTDRIYKITDTEFYCINNDEYDYLLDKEYENMSHQERERLRYPAASVQRLLSSGAFYYSKQFDMTSNIQERGFVSSDYKLIADSSFFKSFMWNGFMTEELIETRKRMSPAEQKIIDKSGLLIIVIRSYAKTVNTTVGGCEALMTLISXQSCAXERTLFGDWGSDGECYVSNYLESEIIIYTEKFCLSYVNVPGNVPMYWEFGKPFFNQKLYLQPNGEANCFPSFLLKPSHGTPVPTFPISFPLH

SEQ ID NO: 18341 - protein, 138 aa, Candida albicans
PAAYSMKLLYKEHPRTLVLYSDTFSLSFRIKSSKELDSKKPTVNVDLIPNTNITKEQGYRTLIRRDVFGCLGLIYVEDQIYLAIITGALTNVARPIENETVDKIYSVDFVSLNNDDWDFVELDSSGYPIVVNEEQDDD

SEQ ID NO: 18342 - protein, 818 aa, Candida albicans
YSNDFDLTSLLQNRGVSSPDTRINSIDHYKPEYMWNSFLMDELIHFRSNLDTYNQLILDDNRFLTTVIRGFAKTTPIGSNGDSLTIISKQSWKRAGTRYNTRGIDDNGNVANFVETEYIYYNPSKSSIFTFTQIRGSVPTFWEQDSSLMNPKITLTRSTQATQPVFNKHFGDILQSYGVCHIVDLLSKTKSSEVQISQRYQQLYNHCDKKEEIDYTAFDFHHETKIAGGFAGATKILPYLQDSLNLFGWFTYDMNRQEVITRQDGIFRVNCLDCLDRTNLIEQVICRSVLENILTNQGIYNNRMAFEGMIQKHNTLWADNGDAISQIYTGTNALKSSFSRSGKMNFAGALSDVTKSVSRMYQNTFVDGKKQLTIDILVGVDGRNSCKVKVYNPASEYIKSKLKEQENSFTSFENVKIFTGTYNVNAFNPLMTKNIDLTSWLFPSSVQNGDGSLPDMYAIGLQELIELNASSILNADGSRALQWSQLLNEQLNSFQMDEEYVLLRTESIATMALFLYVKKSKVSYVTRVAGSSKKTGLGGMAANKGACGIRCLFGTTSFAFVTCHLADGTLAVTERYNDYSTIMQGLVFPRNYYIKDHDHVIWFGDLNYRIDIPNLECRQLVANGAYKELLENDQLTRERRDRGAFNEFKEGLVKFPPTYKFDKYTNDYDTSEKQRTPSWTDRVLFLSDKKLTTTNPLKLLKYDSAIDVLYSDHKAVYASFETTAKIINEQIKKNKLNEIILSLSFKKITPSPSPSPAPLTTSSTTTTTTTMSRTSSLTRSSTSILTPTPVSAGGTTDLIHGLGQTTTTTLSLAVVTTR

SEQ ID NO: 18343 - protein, 306 aa, Candida albicans
GEDDIGYKVLYTRIPIASSRIKKIGYSGQNPYDIVSLLSNSIIDFGALFYDSKPNSFIGKQLGVFRINSFDSLNKANFLSKIISQEVIDLAFRDIGLELDRELYVKHAQLWEENDLWISKLTLNFASTSDKLHTSHNSIKSSFVKSHITKKYFGGVVESKPNEIAMLKLLGRLQDQSPVTMFNPIHNYVNKELNKRAKDFTSKLDLSVYASTFNVNGSVYEGDIDKWIYPEENDYDLIFIGLQEIVVLNAGQMVNTDFRNKTQWERKILGVLQKTEQIHGDVEWSIRRGCLVFFCERVTSQICFQC

SEQ ID NO: 18344 - protein, 260 aa, Candida albicans
MTVPFKIPISDLDYCLEQLLDHKPPKILPPETIQQLCHTLKTELLQTPNIISLQSPISVVGDIHGQYHDLLEIFQIGGSPPQTNYLFLGDYVDRGYYSVETISLLLVLKLRYPERVFLIRGNHESRTITTNYGFYTEVLNKYQGSADVWTFITDLFDYLPLGATIDGKIFACHGGLSPSCQQLDQIRAVDRFREIPHDGIMADLVWSDPDVAILDFKLSPRGAGYLFGNDVIDKFCQDNNLVQMIRAHHSSPRSRRPALI

SEQ ID NO: 18345 - protein, 110 aa, Candida albicans
AIKRASMLSKQLSDSIVQTAKSGTLTKDDKSPVTIGDFALQAIINHAIKLNFPNDEIVGEEDSQELQENNSLADQVLSLIIKIQKETSGYKDIGSSTLSMGQYRTNISAY

SEQ ID NO: 18346 - protein, 291 aa, Candida albicans
MKTLFISTLFILLVSLLFTYKPLTTRLNLFTRFISMSHSTHPYQKELEVATLAVKRASLLTKQLSDSIVQTAKSGTLTKDDKSPVTIGDFALQAIINHAIKLNFPNDEIVGEEDSRELQENTGLADQMLQLITKIQKETSGYNDIVGTLTDKNEVYQSIDFGNSQGGLKGRFWALDPIDGTKGFLRGDQFAVCLALIEDGKVVLGVIGCPNLLEDIVSNEEHSGVVGGLYSAVKGVGSFYSDLFKEGAEPLSQQKRIKMQNHTNPSQLKVVRGVEKVILRILSHHAAGRPQ

SEQ ID NO: 18347 - protein, 399 aa, Candida albicans
MKTLFISTLSILLVSLLFTYKPLTTKLNLFTRFISMSHTTHPYQKELEVATLAVKRASLLTKQLSDSIVQTARSGTLTKDDKSPVTIGDFALQAIINHAIKLNFPSDEIVGEEDSQELQENSSLADQVLSLIIKIQQETSVYNDVVGTLTDKNKVFQSIDYGNSQGGLKGRFWALDPIDGTKGFLRGDQFAVCLALIEHGKVVLGVIGCPNLLENIVSNEEHSGVVGGLYSAVKRVGSFYSELFKEGAEPLSQQKPIKMQNHTNPSQLKVVEGVEKGHSSHSTQAEIKAKLGFDLATVAKQTVNLDSQVKYCVLASGQADIYLRLPVSDTYRENIWDHAAGYILIYVSGGQVVDVTGAPLNYGNGRTLDSKGVIAANKEIFDMVIDAVTEIRKSSTPRV

SEQ ID NO: 18348 - protein, 230 aa, Candida albicans
RRRVRQGRFGPLDPIDGTKGFLRGDQFAVCLALIEDGKVVLGVIGCPNLLENIVSNDEHSGVVGGLYSAVKGVGSFYSELFKEGAEPLSQQKRIKMQNQTDPSQLKVVEGVEKGHSSHSTQTEIKAKLGFDPTTVAKQTINLDSQVKYCVLASGQADIYLRLPVNETYREKIWDHAAGNILIYESGGQVGDVTGAPLNFGNGKTLDSKGVIAANQGIFDNVIDAVTEVRK

SEQ ID NO: 18349 - protein, 112 aa, Candida albicans
HLPILIYRFFGVIWSCNLLNIRIEKHLKNSIYFTEATTITPLDMASAEELKDQGNKAFALKEYKKAAKIYRDAIQIDTYNPILYSNRAQCFLHLQDYDRAYKDGVSGINLNH

SEQ ID NO: 18350 - protein, 388 aa, Candida albicans
  UNSURE (148),(164): Identity of amino acid sequences at the above locations are unknown.
RTRVHRQKRIKNKLMAIEQFITKGDDALKSKDYLGAISYYSQAIKENPQAFSPYLKRSTAYQKLKNNDKAKADISSAFSIATEKGKRVDIGLCYFKLGLVYYQEKKVKLSLTQFEKAVEYDCKEPTLFMWKAKAEYDLKNHPEWNVEXDKEEDDDIDLVLGVEXEYTQSMANTEKDKSHEPKIVELDANEESSEKKSNQESTSSAPAAQATTQAPKSTNVDVINKIAPLNVKFRDDWYQSNEEVIITIYAKKVNEEKLKVEFDTNSVCISFPSAAASEYKYYLDPLFAEIVPSESKYKVYSTKLEITLKKKDANKWPELEKQAVEGVTDNQDKDKKVDPSELVYPTSSKKKINWNNFKIDDDDITKKAMKMTFSGKYSKMLTKILEER

SEQ ID NO: 18351 - protein, 403 aa, Candida albicans
EEEKAIFISYVSSSFFFCQQKGDKRGEQKKSSFRNSIFQIHRQHVSKTLFPTSTNPYFLMSSTITNKDIALSIIDFLKQSVAKKEVAEDYAESMDVAIDCIADAFEVNKEDDSKTLKDVFHGKSLSELLKSSVSFSSTSEKSESVPAAKEVDADTKAKADELKVQGNRAMALKDYPEAIAKYSEAIGLDPSNVVYLSNRAAAHSSSQKHDKAVEDAEKAIKLDPNFCKAYSRLGLAKYALGDAKGAMEAYKKGLEVEGETKSDAMRKGYETAKKRVEEELENSISTTDKSGESSGSSESATGAGAGAGAGAGGLPDMSSFLGGGGGMPNLAEMMNNPQIMQAAQEMMSNPAAMQNLFSNPAVKQMAQQMGLGGENGPDLSNIMNNPMFNQFMGGRENQGDKPE

SEQ ID NO: 18352 - protein, 332 aa, Candida albicans
KRPSLTEDVIMGLLRYWPKVNSPKEVMFLNEIEDIFEVMEPNEFIKIQIPLFAQLSKCISSPHFQVSEKVLCYWSNEYFLTLITENAEVVLPIIFASLYELTNATQAGIENGIMNQKLAQFPNATTDANGNLIDNGLVLQDLQQGIAPSMNNPSHPHYNIFQVHASINNNNNNNGNNNNNNDGSINNPDSMNIHTDSNGNEMSDEEYYDLFTGMGGGNGGPGGANPNNPLGDDFGGAFDDGTGGLLQHNSATSNWNRSIHSLAYGALKVFMDHNPILYDHCTVLYHQSLAEQKQREANRKEGWKRVEELVRQIKNKKNLELQQPQHPASGVI

SEQ ID NO: 18353 - protein, 368 aa, Candida albicans
  UNSURE (1),(16),(18),(62): Identity of amino acid sequences at the above locations are unknown.
XYLSQPNDNNPSTFCXFXTTGTGTGAAFALSPGSSTPLNASANAHTSNVPSILVSVPAPSFXLNHPITPTPTSPNSSLGFHNQFEGKATHSQHSAQPHYSQLTPNIASPGKENIDIDLIVTPKRHSSSRFEPTSSDRYQEIVKLPNFDEVLPEEQIQLFIQKIDQCNTMFDFSDPTFDIRGKEIKRITLQELIGFISNNRFTYTDEMYKHVVTMFKKNLFRPIPPPVNPIGDIYDPDEDEPVSELAWPHMQAIYEFFLRFIELPDFQHQVAKQYIDHEFILRILELFDSEDPRERDCLKTTLHRIYGKFLSLRSFIRKSINNVFLQFVYETERFNGIGELLEILGSIINGFALPLKEVFTTGLDGPAL

SEQ ID NO: 18354 - protein, 431 aa, Candida albicans
VKDMSFVLAAKPRFVYLTNKQLQTIGKRLLTQSAKSSFKSSQCLLSEPNTMIKTASPKKNQQQYRKSVALVSGVIIVGSYIVFNQSNYFNLDTLPLNLPPPQQSKKLLQDNQKKYFSTSTSSLHQKDSISHQQHKEGIFLLNEEQVSTKLRQFEESYTVNRGKGVTRYDICQLPSNSPIEDDRAEEIVQVPILQDNNIKTSTDWMFFGVFDGHGGWTTSSKLRDQLIGYVINELGTIYKPVQGEENLRYVPNSATIDQAMKNGFLKLDHELVNKNIEKLLTDGNKAKAAELLMPALSGSCALLSFYDTNSQMLKVAVTGDSRAILGSFKDNHWTVRQLSIDQTGANPSEVARIISEHPNEPKVIRNGRVLGSLEPTRAFGDCRYKLPAVIQERIYKQFFGRPLPNQLKSPPYVTAEPSSLTGAGTTALRLR

SEQ ID NO: 18355 - protein, 485 aa, Candida albicans
  UNSURE (422),(483): Identity of amino acid sequences at the above locations are unknown.
TSFILLAYQSINQSINRSMSATITEKETAVSTTTATPKSIRPLSYTNLLANSSNYLKHGSSSESLDSQVSNASTIKFTASSVSPTISPSPQTPQVQPQSQVQSQVRKKIQIPNYYVPPKVNIAPSISITESNDATNTTETIARPSLIRKKSGEIVKSSLKLSSLLQRSLSTPQLSTMGNKGSTRKSVRFASRLANVKTFDGCDSPSTVSLANSPCTSPPCEFESGFEDVDVDDDVYTFLKNKPNRRLRLGFEWNWDKLINSSSSSSDDDENEDDYWSTPKQFSKPNKFLPNSGFVSGTTAKTITTTGFNSNSLNSSTSAPSKEYRLTSHNIPKMINSRESIVWLPSAYVLKTDGKTFLYGLVNVQNLAFEKKVFLKLTLNNWKTSVIFGGQSVINYFKSIDNKIDQFKFKISLDDLISSHGXNVQLQMCIKYQVNDTEYWEYNFGKNYPFQLTRIDRKVLQHINSSYSVGDSKNVSTTTYTAXKI

SEQ ID NO: 18356 - protein, 432 aa, Candida albicans
SITYKFDYFYLDGVFSNTKNDTPPVFSPEEMSDYKLVRKKSGELVKPSLKSPLYYHKKRSLSLPSTPTYKQVHFGGSTDVRYFHKKDRPAAISASNSPKLSPADDDDGYDYSDDDDGYDNDSCDSDPESIDLNNKIFGFDEGQRQRQRQQGLHSKTDTKYPKKLEGLIDWQLRLTNFPPLSYLKKIETGVPVFLEKIFISGDRKYLLGHVAVRNLAFEKHITIRYSLDNWMTVIELPTNYIEERPEVLKLNDYDRFGFKIPLNSLFHSLKFSTNSSTDSLDASSNEDDGTSTHERTYQLCIKYETNNQEFWDNNASKNYEVKLVRSFKQMPDVTKPFIRKNIGVVGTKIQDHARKPRYSNSYLKRVASDSAIATTMNSKSTAEPTATELATYGLDSPSESSIADSNSGLSNFSEISDFVKNNYYLSSPLLSS

SEQ ID NO: 18357 - protein, 123 aa, Candida albicans
PEGRRILDIHNKVFSWTKVRQGLIKMYMVEVFNKFPVLQHFWCGEVLYPWKDHQGNDLPVNEKEETELDKPPETTLNSTTTTTTTTKVSSSTSKIPFTPAPWANTTTTHAVPRNTRNTRNPRS

SEQ ID NO: 18358 - protein, 375 aa, Candida albicans
TWKKELPVFFLVTTICNMSYITPTKRIFTPEDLSKWVGSPTYNTVLDFIVELQSSVTGKSNDSSYETSLIIDKLSKLLSKVDNLITLHPAHDSVSRFGKIEFRDFYSDLSSKAEEYISEITATAIQETSAYFIESWGNSTRIDYGSGHELNFICFLLCLKELGQITSADYEGLVLKVFTQYMSIMRKLQKEYWLEPAGSHGVWGLDDYHFLPFLFGAAQLSTHPHMKPKLIHNDELVEMYSTKYMYFECINFINKIKTIPNHQGKLSLRWHLPMLDDISAAKNWDKIREGMVKMYKVEVLGKLPIMQHFMFGSLLKCPEGIPEHTDENGHGENPEDHCGHAHVNTWGDCCGIKIPSGIAASESLKHERKGNIPFD

SEQ ID NO: 18359 - protein, 170 aa, Candida albicans
SIDLPAACSITIPLRPLIEPTTTTTTRENKIGPSHGNVEILIELFQYLNKLIDETPPLKGPTRFGNFACRDWHDKIDIIPILKKFKFPQELSSSNNSSSKSNIDGFLLESSYYLLNSFGSKIRLDYGTGHELSFLAFIGSLIEFKILNHPTTTEEINGKEILIIFANYYD

SEQ ID NO: 18360 - protein, 178 aa, Candida albicans
  UNSURE (168),(169): Identity of amino acid sequences at the above locations are unknown.
SPLMTLYYLQEDTLSEAMYNNVKLDHYFNKLPKSSEENNINDQTNQLIVSAAPELEDSPAAEWKLLRTLAGAHQGWIRAIALDEITNKWYVTGLADSTIKIWDFENNSLKAVLTGHVLGIRSLCISKRHPYLFSGGEDKSLRCWDLERSNSDAGCQIRSYHGHLGGVXXNFLLACTLS

SEQ ID NO: 18361 - protein, 211 aa, Candida albicans
FSIGLHPELDVLFSGGKDCVVRVWDIRSRVEAMTLLGHTNDITSIETDYNDPQVITSSMDGTIRLWDLRKLKTELLITNHSKSIRSMKSHPKEATFVSGDSNGEIKQWLLPKGELLNEFGTSQLLPNQRDNSRIINTLAINPVTNTLFSGYDDGKLEFYNYTTGNLQQSGQSPSLAGPEQSAIYASTFDMSGLRLLTCHGDKSIRIWGTSY

SEQ ID NO: 18362 - protein, 176 aa, Candida albicans
LKVKQGTGLFDLSSTINKVTNLIIFFLKIRCRSPMAEAIFKHQVEIQGYSPFFKRIDSFGTSGWHIGETPDSRSSKTCKKHNVPVSHHAQQINSSDFKDFDYVIGMDESNVANLRHLKPRDSKTVVELFGHWKTSDEFKTIVDDPYYGGIDGFEYNYKQICHFTDEFLKQEIGSLD

SEQ ID NO: 18363 - protein, 88 aa, Candida albicans
GNIKSTTTQIENQNILFGFRFFVQTVSNGSSGWFVNDSHNVQTSNGTSIFGSLSLGIIEVSWDSDNSIFNSGTQETFSGFLHFTQDHR

SEQ ID NO: 18364 - protein, 64 aa, Candida albicans
SIGNSGSSRFIDNSQNVQTSNSTGIFSSLSLSIVEISWNSDNGMSNFFAKVIFSNTLHFTQNHR

SEQ ID NO: 18365 - protein, 370 aa, Candida albicans
LKDFSILDKQSPAHNDFVVDTFTTPTTSMIQSLAQTTLGDAVYNEDLKTIELEQKVAELTGKEAGLYCVSGTLSNQIAIRTNLYQPPFSVLCDYRAHVYVHEAGGLSTLSQAMAQPINPKNGIHLTLEDDILPNFIIDDGEIHGAPTKLICLENTLHGMIFPIEEIKKISKFCQQNNVKLHLDGARIWNASAETGISLKEYCSYFDSVSLCLSKTLGAPIGTVLVSDKKFILKANHFKKQNGGGIRQSGLLASMAIIAIDENFSKLKQTHIWAKELGKLCDENGIILEHPVQTNFVFIDIAANKINPEKLIKISDKYNVKIYSGRIAFHYQISQESFENAKKVVLEVIQYAKDHPYEEKTNFKFYTSENK

SEQ ID NO: 18366 - protein, 411 aa, Candida albicans
AFGLLFWFNRLITFFPFSFPFPFFLHLYDTYYSAHHINMTADEEETFTTFNEFRSDTFTVPTRAMVEDGFMNATFGDSVYQEDETTLRLESKMCEITGKPAALFCVSGTMSNQIGLRANLVQPPYSILCDYRAHVFLHEAGGLATLSQAMVHPVRPSNGNYLTFEDVLANVTYDDGDIHAAPTKVISLENTLHGIIIPIEEIRKISEFCRENDIRLHLDGARLWNASVATGISIKEYCSYFDSVSLCLSKSLGAPIGSVLVGDEKFIRKANHFKKQSGGGIRQAGIMSAMAIHAIDYNLSKLELSHNYAKQIGDFCQEHGIKLESPVDTSLVFLDLKANKMDPNRLVELGRTKYNVKLMGQRIACHFQLSQESVDNVKKCILECFEYHQKHPHKDDGRNNKKMYSFDAIKK

SEQ ID NO: 18367 - protein, 259 aa, Candida albicans
AVPSSPVVKILDIEGTVCPITFVKDTLFPYFIEKLPRILDKFQYPLSNTSASSDDQVLNILKQLPDNITKSSESIYKHFKNLVDQDIKDPILKSLQGLIWKQGYEKNELQAPIYQDSIEFIESFPTKSSTNNKIYIYSSGSIKAQILLFGHVKSTTTTITNEVIDLNPKLNGYFDITTAGFKNQSNSYKKILQEINKSSTPKSVLFLSDNINEVNAAIEAGMKSYIVIRPGNPPIDDDDDGNDDKINHKIIYSLDELDL

SEQ ID NO: 18368 - protein, 410 aa, Candida albicans
QINNNIMSPKKSYSLETELVLNKSGDQYNASVPPLYQSATFKQPSLSNMGEYDYTRSGNPTRTHLQNHIAKIMKAEHAFAVSSGMGCLDVITRLLKPGDEVIAGDDLYGGTHRLLTYLSKKGDIVAHHYDTTNTELIKSKINNKTKMIFLESPTNPLIKVVDVKSIADHAHKANRDIVVVFDNTMMSPVLMTPLDLGVDIQYESATKYLNGHHDIMAGVIATRSSSLAEQLYYIINSTGCGLSPFDCWLLSRGLKTLAIRVEKQQQNCIRIAKFLENIGFKVRYPGLKSHPQYELHSSMCSGYGAVLSFETGSVRLLEKIVENTDIFGIAVSFGCVNSLISMPCKMSHASIDAKTREEREFPEDLIRLCIGIENCDDLIDDLTKALLRSGAVKVNDRDELYNAVGIQPKL

SEQ ID NO: 18369 - protein, 183 aa, Candida albicans
TCGSLMNIKLFRHLPKSITRSIIMSKFSPPINRNMVELDRSFFYKEVPLLAAYFPNPKFLGQFVKSCQNDILYVQTVKHIISMDDSKAILLRDDVKLISDLNPETQLKINEFGIILKPYTLKLDYSFWKSEEILKSILPENLIDDVPSGFSQAGHLAHINLRDEYKPFGKLIGQVILDKNPLV

SEQ ID NO: 18370 - protein, 81 aa, Candida albicans
RLVSEDKAKRLPSKLKLFHHATSLGGTESLIEWRAMSDDHISKKLLRVSIGLEDPRDLLADFVHGLGGDDDLVKQIENLEI

SEQ ID NO: 18371 - protein, 207 aa, Candida albicans
TLFLFSFFLYLFSLYLFSLFPFSFPTVTLSIMTRLATDSIHGGDHLKRVIDVINPIHISTTYSYSNNPDELVPGGLTDPNTLVYSRENHPNAAQIEAIIEKITGYPAVIYNSGLGAFNGLITYVNPKTMAFGQIYHGVHGIADIWTRNFGLKQIGIDDNFDGVLQKGDLVHLETPVNPYGTNLDILKYAERAHAQVSPPDWPDTRLC

SEQ ID NO: 18372 - protein, 140 aa, Candida albicans
IWGMEYKEQIVDSRVYGMFREPEILDVVVAPNLYGDILSDGAAALVVSLGVVPSANVGDNFAIGEPCHGSAPDIEGKGISNPVATIRSTALMLEFMGYPEAAATIYQAVDANLAEDKIKTPDLGGNSTTQEVIDDIIRRF

SEQ ID NO: 18373 - protein, 124 aa, Candida albicans
RNNSRLKKKFINQKLQQFFNSLLLLFVVSLNCHYYLQMLAARSSIRRCFSTSSTTLKSLKIGLIPGDGIGREVIPAGKAVLENLPAKHDLQFEFVNLDAGFELFKKTGTALPDETVDVLKKECD

SEQ ID NO: 18374 - protein, 591 aa, Candida albicans
HTQTFIPTPTSMSKLKTLNRQFISNLETHKVTTDAKRNLILSILKSTTTKREAKNYLTKYQNQFDFNDDLDFNKSIKIKNEQLSLTNRDSQRELFINRFLNQLNPFINVYDKEDVKLQKVPLRLAIFKIKFTKITIKQWKGIAETFKRLITLGISPIIMLDYDHLPLDSYKNNELYMINQGNKMLNYLGHPEEESDLKVTLLRSLFTSHKGVPTLDSLELILIPLYQGIIPIIQPIVYNADLSKQEFLASDKLLLGLSSALIEKRTTDLLSIEKIVMIDPIGGIPSIERHQTSHVFINLSQEYSDILSELFIGHIEPKYRDTHVDNLNTMNNVLSYINEKSGNDETTGIITTPEIMSINIDQLNPIIYNVLTDRAIISSSLPSTTNRTPHLSTTIIKKGVEVQIFDVDNYDKDLTMQNLFDDKLVNKEKLIDLLNDSFGKSLDVGPYLDRINKNIATVVIVGDYDGAAIITWEYSKGEKIAYLDKFAIAKKNQGLPGLADVIFKIILQSHPFELIWRSRKNNPVNKWYFERCCGCMSAPDSQWKIFYTGEVFDKKIDRFKRKLRHQNGVVDIDRKLQQYSEICEGITPSFK

SEQ ID NO: 18375 - protein, 801 aa, Candida albicans
GQFAVSLAKNLGISHVAIHKYSSLLSAHGIQLADIVIEKQSPASFTYSLENFAAIDNKIKYLITSAQKDCEEQNLLGFKTRLEILLNMRYVGSDTHLLIPVTKGEYDADKKFITRHKNEFGFNLDRKVLVDDVQVLLHVESDDKEKYNPYQEFAKLENKNSYLAPSKIQKNIYFETEGWLESSVYFLPDLQKGLVIKGPSIIIDNTQTILVEPRSKAAILTDHILIEVEQEKKPELSRTTIDPIQLSVFGHRFMSVAEQMGRTLQQTAISTNIKERLDFSCAIFDSNGDLIANAPHIPIHLGSMSYAVKAQIELWKGKLQHGDVLVSNHPKAGGSHLPDITVITPVLDESNNPLFWTASRGHHADIGSIAAGSMPPNSKTIYDEGAAIITHKLCDKGVFDEEGVIKILVEEPAKYPGGSGTRTLSDNISDLKAQVAANYKGITLLNRMVDEFTFEVIDLYMTGIQSTAEVSVRSLLKLAYKKFGGNKLKGVDYLDDGTAIALTVDIDPETGSALFDFSESGDEVYGNLNAPRAILYSAVLYVLRCLISTDIPLNNGCLRPIEFSTREGSIVNPSYDAAVVGGNVETTQRIVDVMLKTFQAAAGSQGTCNNFTFGTNDSTKGISFGYYETICGGSGAGPTWDGQSVVQCHTTNTRMTDTELFEKRYPVLVHEYSVRQNSGGSGFHKGGDGVVRDIEFLYPLEVSCLMERRSLAPYGLLGGGEGARGINYWYQKLDDGGYRKKSLGGKCTVKVGTGDRIVIKTPGGGGFGELLSGELNFPVESSHPSVLTGSVGVRAITQQTN

SEQ ID NO: 18376 - protein, 403 aa, Candida albicans
NGYYSSHKRIIGTERCQSVTCDYKRVQGCIVYCNQTRLHIFDLTAKNLGHLYYQVLEIDERVTFAGFSEGGGENLKVNVESDSELRESVTGDIVRVIKEPDYTKVTADLQEIYRQGEIKTIALSLLHAYAYPQHEAKVAEIAKKIGFEVSVSHELQPMLGFVNRTSSTVADAYLSPVINEYVRNFGAGFEGGLDAFGNKLLFMQSNGGLCPWYKFTGLKAILSGPAGGMVGFGVTCYDDISKKATIGFDAGGTSTDVSRYAGNLEHIYETVVSEINLQTPQLDISTVAAGGGSMLFWKNGMFVTGPESAGSDPGPACYRKGGPLTVTDANLFLNRLLPDFFPNIFGPTQDQPLDYELTAEKFRALTDEINQDEAEERIILNTERFASWVLKVTIESLAERSGS

SEQ ID NO: 18377 - protein, 140 aa, Candida albicans
HKHCWKTKSKTNPRKPIRSAMSQTKKGIQIAIDRGGTFCDVIAKIPGQPDYVFKLLSVDPQNYKDAPVEGIRRVLEKATNKKIPKGKKLSLELIQSIRMGTTVATNALLERKGAKVLLVTTKGFKDVLFIAIKQDFIFLI

SEQ ID NO: 18378 - protein, 86 aa, Candida albicans
TLLENISKTNPRKPIRSAMSQTKKGIQIAIDRGGTFCDVIAKIPGQPDYVFKLLSVDPQNYKDAPVEGIRRVFEKASRHQAVKGQR

SEQ ID NO: 18379 - protein, 557 aa, Candida albicans
RRIASPDNGKKKYPKAQKISIKSSSATTMTSETVIAPSLSTAQNDGTFTYDKVKSTAKERKHLNLKNPLDANEIKSKIWNYYSLSELIQYLGQKENDDFKYKRITLQFPDNLICDSATIVHELQRELNIVPQANQDTGESNTAQRVWILADTSYSACCVDEVAAEHVRSDLVVHFGDACLNEIDKLQAVFVLGKPTLDVDAIVKQIKTAYSTEQKVVLMSDAPHTYLLPEIAKQLPDYDILIADLPKTSRAKIIGYTPPPTGHKKFNRVFNTDTVEFGEYELFHITSPESPRLLQLTTNFASVTTYDPISGTVSTGPFPNLMRRYKYVHQARMAGTVGILVNTLSLANTKILLNTIKEKIKEAGKKHYIFVVGKPNVAKLANFESVDIWCILGCDHQGIIIDQINEYYKPIVTPYELLLGLSDELSWTGKWVVDYKSVLEEYGNEVIQQNEDPDTDEDLPPVFDPVTGRYVSTSKPLRQINHLMVTSSEQGGVDDHDNQLVKRFSNAVAIKGMVSTSAIHLQNRHWTGLGSDYTEDENAAGALVEDGRKGIARGYDI

SEQ ID NO: 18380 - protein, 83 aa, Candida albicans
KCVYGRKKIVLEKLFNLSSQLSFTKQTMLYLIGLGLSYESDITVRGLETVKKCKRVYLEAYTSILMAANQESLEKFYGREIIL

SEQ ID NO: 18381 - protein, 328 aa, Candida albicans
AENVYREEKKIVLEKLFNLSSQLSFTKQTMLYLIGLGLSYESDITVRGLETVKKCKRVYLEAYTSILMAANQESLEKFYGREIILADRELVETGSDDILKDADKEDVAFLVVGDPFGATTHTDLVIRARELGIKVETIHNASVMNAVGACGLQLYQFGQTVSLVFFTDSWKPDSFYGKIMENRKIGLHTLLLLDIKVKEQSIENMARGRLIYEPPRYMDIATAAQQLLEIESIRQEQAYTPNTPCVAISRLGSPTQTFKAGTLQELSEYDSGEPLHSLVMLGRQVHELELEYLYQFVDDKEKFKKFVEQDQEFFKPAPYVPPEDVDSE

SEQ ID NO: 18382 - protein, 682 aa, Candida albicans
HYSMCGILLKVSNKPLDIPSCIPQPLRQTDNDQKTNCNQHQQQHQQWETLDKAIIESFLNKGSELKPLTNQQIYKLNNLSHLRELNNQLSKLKNNVKRLSSDLEYQRQEQIKQLQTEIDLISKDDDDDDNDGLEIDRQKGEGEDDLDQLIYNISNRGPDYLNFSQFNTTTNNGDEFHFQTFLAILSLRQPFTRQPIFKDQFVLQFNGELYNQECLQINDTQFIIDKLHEHLQVNDNRNNAILSTLKSLNGEFAIILIDLLENKIYFGRDSIGKRSLCYKLSGGVKNKQLIISSVSNKGFIDCENIIYEYNLGYNTLAKHKLHELPSHANIESGAIKDEEQLVKNLYDELKKSIWKRQDSIHPLIEDNNQESKLAVLFSGGLDCTIIANIICQLFMEQNTTTKTPIDLLTVGFDNPRTNQKSNESPDRKLAIKSWFHLNKQFPLLNLQLIEINVDYKSWLLHKSRVKKLMYPYNTEMDLSIAIAFYFASSCLKSITSKTILRDKQIDWDTFIQSPNKYITKIENYESKAKVLFSGLGADELFAGYSRHEAIFNKKENITNDNTNLLYEELQESLNYDISIIHQRNLSRDDRVISCWGKELRYPYLDENFIDWVIQNIPPQLKFKYKYEYSTTTTTTTPPTTTTPTVSTKKSNKNKLTFISTRKYILRQLANCLHQHGLEGHRS

SEQ ID NO: 18383 - protein, 440 aa, Candida albicans
KMHKVTKFAIRHLSDKASRFVPKAGVYPKGYAVGGIHCGVKKDGKSLDLAILQNTFGKNASAAGVFTVNKFKAAPVQVSKKILKEKLGSGINSFVINSGNANAVTGAQGMKDAEDMVLVTDSVLENPTNSSLVMSTGVIGNNLPIDKILGGIPKLASQHLGNTHQHWIDCATAICTTDTFPKLVTKRFSIGDDTYTLAGLCKGAGMICPNMATLLGFFVTDAPVTPSALQQILKYAVDRSFNSITVDGDMSTNDTIVAMANGAAGGEVIDNTSSCAERYSRLQAEIVDFAQQLAQLVVRDGEGATKFITIRVKDALSYKDAKSIASSIANSSLFKTAMYGKDANWGRILCAIGYADVTSANSVIPEKTSVKFVPVDGSEHLNLLVNGEPEQVDEERASEILQNEDLIVEINLGTNGGQSADFWTCDLSHEYVTINGDYRS

SEQ ID NO: 18384 - protein, 187 aa, Candida albicans
ILYKMVLSKHIDALRLESQILKKTPQAQLRKEAFIDAYDSHKNIPQFEIPQNSSNEQLIYKYLSQELALDGIPTLNLASFVNTYVDDTSARLIQDNLTKNLADNDEYPSLIDIQTRCISILSNLWHAPGKVDKVTGNRVTNSIGTATTGSSEAIMLAGLALKKRWQLKRKAEGKSTDNPNIFMATCA

SEQ ID NO: 18385 - protein, 389 aa, Candida albicans
PPPSYADAVPHGEDFDVENRLIPVTEESGHLIDVSKIKENIDENTIGIFVIMGSTFTGAFEPVEEISKLLDEVEKERGLDIRIHVDGASGGFVAPFIFPHLKWDFAVPRVDSINTSGHKFGLTSVGLGWVIWKDADLLPKELRFSLDYLGGVEETFGLNFSRPGFPVITQYYNFLSLGRQGYAKIFDGCMTNARLLSRFLEESKYFDVVSVIHHKLSDSEKKAQFTREVDDKKLDSKLYTINEEFKPGLPVVAFRFSKEVRDKYPELPQELLSTLLRKRGYIIPNYHLPPSENDKEILRVVVRNSLSLNLLERLIQDITDATELLIKAADSIADYVSTSGEHTDVENRERIHKLLAAIASGGVAEVKEEKHKKDNHQGSKNKKSYRGTC

SEQ ID NO: 18386 - protein, 179 aa, Candida albicans
EPLPTEEEKSANPVVKLVAHNYKDVLEQTDKDVFVKYYAPWCGHCKKLAPTWEELAEIFGSNKDDAKVVVADIDHTNNDVDVPYNIEGYPTLLMFPANGKVDEKTGIREPIVFEGPRELDTLIEFIKEKGALNVDGAELKAKLDEQKATKEDEEVEEEKEEEEEEAPVEDKENVEHDEL

SEQ ID NO: 18387 - protein, 255 aa, Candida albicans
SIPLILQHSNMKFWTYSTKVLATLLAVVSITHASGPTDGDAVADPNSAVVKLTSENFASFIEENPLILAEFFAPWCGYCKMLGPEYSKAADSLNESHPKIKLAQIDCTEDEALCMEHGIRGYPTLKIIRDGDSKTAEDYQGPREAAGIADYMIKQSLPAVQFPETFEELDTLIDSQTKPFVLQINPTEDGNATFNKVVNQKRKDYVFINVEDKQIIKDLNKKFKNVDITGKKPSYLVVQPKQLFSPRAGKSAIPA

SEQ ID NO: 18388 - protein, 226 aa, Candida albicans
KKHIMKLSILSLLGFLTTAAVGVVGSEINPLEPQIIADQVTNGEHKRQSDDESNSQLKSQSKMDVPPTLSMKEFDKLTREKLVLVEFFSPYCHHCKEFAPTWKETYIKFVTEYPDLNIEMKQVNCIESGDLCEREHIDFYPNILLYAPAVDKDGKKTGKLKNIDSFPRNLDRNVENIIKYLREATAEFDSGAINLPSSSQLLDVDTMSKLIFFTTQCRIHAYVTHK

SEQ ID NO: 18389 - protein, 434 aa, Candida albicans
HASSTIVAPAGTVEDKVFQNSQFEVVSARGITEVMEYTRVLSHEPIAQFYPLKSKITVVFYYDIDKVTEEDEKILPHLLKTIQESPFNIQLHKGKHKKIEENVLTMGQNLIEYINYDENDKYEFDKSIQVLTTLTTKPTILVFKDNSLIADVYQSLSPEDMKTYDKVESFINSIQYPLYGQLTPQLAPYYFKNNEKYQDHKVVVLFTDLLDLKGTDNQLYKLSLAAHEYHHLKQKYYFDRFKQSNQVSAATVEKLQEQNQEIIDALKELQHVIPELWENDQFLFTFIDLPNAYKQFRGVKGWRLNPNNYQVGDVVVLSKDNRYYWNKDTQGNKLTNEPKELKKVLMSLLAKDDKLKAAIVGSPYGGVLGFMDYVHDYGVWGYIGFFLSIYTTGFLVLRLGRRSSRRWLFKRPSSSTPSSGGGGIIGNNFTPKKD

SEQ ID NO: 18390 - protein, 412 aa, Candida albicans
VKKNGGIELKYCHQFFRKLICCSTPKLTRSFTIISQLLKRNMSENTPDSQLIAEFVSITNSSTYLAEQYLLRNSNDLVEAVEDFYANNEPSQKSETKKSSSSNAKGSGVRTFRDLNDEDDDEEDDKTNTNFFTGGEKSGLQVEDPNKDKDNDRSIIDQIFQKAREQMQQPDDRPSASQNDQPSPIKFSGKGFKLGDGNEPSQVVEDPNASAKKFRPSKVTREITFWKQGFTVGDGPLHRYDDPRNASVLQELNQGRVPMSILDVEFGQDVDVSVYKKTDEDWTPPKRKIGGYHGAGHRLGSPVPGEVLVNNEASSQPDIKTETEISKPKDGGEGDSTVQIRFANGKRTSHKFNSSDSILKVYEFVKNHEYNSEPTRPFTLSHAFPVKPIEESSDITISDAKLKNAVIVQRWK

SEQ ID NO: 18391 - protein, 62 aa, Candida albicans
VLLVSLRKNRRKKLKNSLHKKDNKGYDQSLAQSLDIITAKSKWTDRDAKSIYEWLEANEYTK

SEQ ID NO: 18392 - protein, 308 aa, Candida albicans
LNINIKCLRSLATISFLKNPKLKLRDIVIFLLLISSMTRQSLLTPTKTDYSDAHGNSEGAQQYKEKWIKIKHQRDENGNLKYPWDFEVVHGFFVQSDMSTDDFGFNHTFQNMGRKKSWEDIKAELIQLNNEAPDNVQYKLIFLARHGHSTQTQIVELEGLHLWHEKNCKLTGNDQFTWAPDSELTEIGLEQAKENREFWKSELLLGAPIPSKFHTSPLQRACSTLVITWHDLKPVETKPIVCEKLREKIGKNLSDKRSTRSEIHEKFGDTYGFITERFQKGRFFFTEDKRKLGRNILFRLNRIFIRFV

SEQ ID NO: 18393 - protein, 325 aa, Candida albicans
FSFVLLLSFFFNFWISIYQLLHLTTMSKNIPNQADVVDAKISDTDRQQYEELFLKYYGGNNTKPHWEFFIVPGIFKQSLPETDATKFDTIKEHFGVICGWDEVIAQLNELNSQVDSNEIQYKLLFLARHGQGFHNVKHNENPQLWDDYWSHLNTDGKIVWGPDPELTELGIEQAKDNNIAWTKEIENNINKNKNLIIPTKFFTSPFRRSVDTLINTWDNIIDLKEIKPLIQEYWRETIGDHTCDKRSTRSIIAEKYESLGFIIEPGFEEEDNYWKPDWRESVAEQAIRQNKGLQQLFNENHKDQIVRTTIHSGSILAARGWKFRV

SEQ ID NO: 18394 - protein, 331 aa, Candida albicans
FGKTMVQTNLAMLVPFLIATTLAFPQVILASSSYELPKFTSSSKYFGQSDTDIDVSKVNVSDNFGLINKYSWKDVIDSLSDNEKLFYIQRHGEGWHNIAPQNFSSADWDCYWQLQPGRDGVVWEDAELTPNGVQQIEKLSHQIQTTKNLPWPVKYFTSPLRRTLQTWELTWKDLKHETPLIKELARETYGIQTESKRHNKTYIHTNWPIFEFEKGFTEDDELWKPNKRETGQHRKYRAAALLTGIFDQTSTDDKVISLVSHSGLIGSILEVVGHRDYPIATGSLIPVIIHKKKKKTITYDLDKPDKTYADICPSPPALISGAPSHYSTIAE

SEQ ID NO: 18395 - protein, 345 aa, Candida albicans
FTISRGEFHLNKKPILFVAYRPGKNYNITNMQQFLTLGALWTLFNVATTISLPKYSSSQTYFAQSDPNIPVSQVDDTNNFGLKSQYSWDDVVSNLASNEKLFFLQRHGQGWHNVAPSNFSRVDWNCYWAEQSGRDGVVWEDAELTPKGVQQIQNLHQRIKDTPDFPQPEKFFVSPLRRTLQTWNITWNGLPHKTPLIKEFAREIYGIDSESKRHNKTFIHNYVPSFEFESGFTEQDENWSPDKSESDQHCDYRAAVLLQDIFNDSPDEKVISVVLHSGIIYCLLDVVGHRYFPMATGGAIPVVIAIENYNTDYPLNDAWDTFKDWCPNPPALISGTATSTATGSA

SEQ ID NO: 18396 - protein, 314 aa, Candida albicans
KTLFNKKMSLLIPTPRDRHDAHGDLEEDNAYYNLLIKEQNSTNNRYIWKFKPVKGFFKQTDEQTDDMAFRYTEQKLGRLDDWEKIVADLQQLNRDSPDNEIYKLIFLARHGQAKSNVASQKYSKEEWMRKWRFLGTDGELTWGPDADLTELGLKQAAENHQCWKQQLLEGAPYPKRFYVSPLQRLIKTHNITWPNTKPIVLENLRETIGLHLCHKRSNKSSLKEKFPNLVFEDGFTEEDLLFDKYLPRKEHLHEQFLRINGVLQDIFNSDEEDILCITSHAGTIRAFITVLGHRKFTIPTGGMIPVVIKATRTS

SEQ ID NO: 18397 - protein, 1241 aa, Candida albicans
ISSITPMNQHQDQSSMPNGKQQHEVTELSSPPEIPHITANMIPLSNIIKYYTQEAYKQLTTAIENLSMNVNEESDIKRKKYFLNVIINLRQDFIKVYTLIKWASISKDVSKFIDLLNWFRIQEFHFENLIFQLNALTGYNAAKLPNSDIITALEVLYHGRPKLPSYNYIKSDNLSPQKILETLNDLNLVLMTRFALMDNIPKRFDYEIKDGRAYIRVSNEFEVSITVGNDLIIDNPEEYYKSPFYFIDFKFLFGANPESGLITFNDDKISTKLPTSLHKKLEKLVNQTLLTRGLQGLYELLHKYSNSFKIYLLAKQFQTLLINSRWRGNFQINYQTNKSLIVINYWSQHYLSRNWKSFIELGIDSHSNLNYRWFKNGQYCFGDQGNNELDKIFHLQRRNSNNGVTTSSNTISTSAMIAGIRRSTELSNETAIVDDNDNDNNDTNNTGETENEDLNVDLILNVVVNQHAKSIMSEIYSQLLTRFSETDVSMVSPHQLLLQISPKKSTVFAINPLTGFFYFIDPTPIQTYITKKINSPPPPTLSQVSIKQSFIPESDMISYVIDQIIQLRLEVFNKEVNTKLATTAWINNGIIKLSDHELSKLTQFLIQNEEQEGDDNEEDSSTNTRLDSVLQSFKVQFYRRKNWPSSWFLINMISGVTTKSFWWVARIKSISGDWKIQWAQIIKFHGDNAKQELSPNESKVFDKPKRTVDCSIESEQLNYEFFKILSTLSSNLILDHMILEELQVRSIKFIKLDWETIDDNKIFLKFKQNHDISLKRKNSHNINIDVNVDVADNTSTTTNTKYIRAPKLKYESMFLIYNDKLLPIYNSATILFLKIELVESNKMYLKLFGNLRNLQIKNTSEDIQKLHLNIDEANQYFEIDNTVDLSTVINEPKTLLLNLIFNTLNKLNSLIKILDQLNKSNVTVLDNSMDNITINIKDKYNDNNDKLIIIKLPEQATDSIQLLMKNGSTTTTDEIDLRNNNILEFELILKFLNQYLRESKLNNHNRQQISIIKIIQYLTEINPILQSTKAINQQLAELKRINSTNNNNNAKRRSILKLSNGLYKLYFNLNIISLTHLQLVFFMNSNTGSNLKKIQRDKIMINLSLIKFDRFSKPNGNFQDSTNGHLIKISFKDSLINENLKFKNLFEIIFKNINELLITKSKQIKSLNQTENQQQQQPLKQEDNSDSAIIKKESQSIEDDLLDFGEYDNDIKPQQQEPQQMKKKIQRLHQKKMKQLDLMIY

SEQ ID NO: 18398 - protein, 663 aa, Candida albicans
FIMADAKVETHEFTAEISQLMSLIINTVYSNKEIFLRELISNASDALDKIRYQALSDPSQLESEPELFIRIIPQKDQKVLEIRDSGIGMTKADLVNNLGTIAKSGTKSFMEALSAGADVSMIGQFGVGFYSLFLVADHVQVISKHNDDEQYVWESNAGGKFTVTLDETNERLGRGTMLRLFLKEDQLEYLEEKRIKEVVKKHSEFVAYPIQLVVTKEVEKEVPETEEEDKAAEEDDKKPKLEEVKDEEDEKKEKKTKTVKEEVTETEELNKTKPLWTRNPSDITQDEYNAFYKSISNDWEDPLAVKHFSVEGQLEFRAILFVPKRAPFDAFESKKKKNNIKLYVRRVFITDDAEELIPEWLSFIKGVVDSEDLPLNLSREMLQQNKILKVIRKNIVKKMIETFNEISEDQEQFNQFYTAFSKNIKLGIHEDAQNRQSLAKLLRFYSTKSSEEMTSLSDYVTRMPEHQKNIYYITGESIKAVEKSPFLDALKAKNFEVLFMVDPIDEYAMTQLKEFEDKKLVDITKDFELEESDEEKAARVKEIKEYEPLTKALKDILGDQVEKVVVSYKLVDAPAAIRTGQFGWSANMERIMKAQALRDTTMSSYMSSKKTFEISPSSPIIKELKKKVETDGAEDKTVKDLTTLLFDTALLTSFLHHGGWKDP

SEQ ID NO: 18399 - protein, 332 aa, Candida albicans
LIIFYYRFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQQQQLQQHPHQPIIDQQY

SEQ ID NO: 18400 - protein, 176 aa, Candida albicans
  UNSURE (5),(10): Identity of amino acid sequences at the above locations are unknown.
NEWIXVVVMXTILDCQPIVEIYNKIEDVVGPGVDDEKKKDIAVVKKDEQEKGQTTENQQELSQQQLQQQVQQQLQQLQQQVQQQLQQQLDIPEKQSLLKSLTNFWADRAATLWDPLNYPLESHEHTFADSEVIVREDEPSSLVAFCLSSNDYKQKIKNAFEKNKMGDSGILNLNLH

SEQ ID NO: 18401 - protein, 333 aa, Candida albicans
  UNSURE (326),(328): Identity of amino acid sequences at the above locations are unknown.
HQKDSFSSNDDKPSTKSHPSSESIFKHITKEQQQNQNQADQGEEGDEQHEHDYIPANFDLNQPLRRYAVPLQLKESPEEQLLHKFAENNKIYERLMNSQPESVSASVSISGTSTESEPDSGSNIESPPQPPQPRQLRLKNPTNCSKSKETNYNKHLKPLYQLKKPLLTPAVLRPAYTNDHENLSPPTIIPPPTSSYTIIIPNSDYFHSNGGGGLPNCTNEPVHDHWKDNGLTSNCMWCVKPFHNPIVSMICDGPRRHHCRFCGLIFCADCLVNKTILIDHEARFVIPILLLTNSNETETKTNKLQQFFSNSKVCKKCGMIYDNLIXRXLNHNK

SEQ ID NO: 18402 - protein, 454 aa, Candida albicans
VLRIIQAQQSVYITHLVSRLFSMEPDIIVVGDSVSGLAEKLFEDAGITVISNVKPQVIERISRYTKADIFQSVNDLFFKKGKLGLCENFAVKRYKYQNQIKTFVFFTGCDIHLGFTISIRGGNTNLLNNVKYAAETLMPGYINARFEKSFLDNLLLFYVKPTENPKIVDIQQKLQEIRDNTIEGDENGKLHDLKLDPAEVVNYVKLFSERKLSLSPPVEYSLPNPLARTIYTYYAVHQFAQQNAKIQKLSSVDDIKEEWLTELKIDYKLEELPGKEANLINILKFASEAHLKLLINEYQARVRIWSNCMKYPSYQLYPICHRNIHLLHSTVSIKHATPCSGPAIIVIDYYTDNDKCFGLFLDQAFHESLKVCGECGETYLDHYKSYVHGKAKVDLIIEKYDIQCLNNGEMQGKNQRVMWSYCKECNYETPIIAMSDETYYLSIGKFCELNFYGE

SEQ ID NO: 18403 - protein, 848 aa, Candida albicans
  UNSURE (844): Identity of amino acid sequences at the above locations are unknown.
LGFVIMIGSPPDTPNDMSNSKRKLPLLERIPSHTNNSDDEDLYDKGVVDYVSFPTIPDPEVENTKSITGLLTKTLRKVTTNASTLVQNYSQNYTSPKPNVLDTSPFTNRVSELKATAIGSDASPVPKNDEIVDTPISMDLSTKTDTRLRVKEDTSKRITRSSSPLDLKGDAQGNKLEIMNPIIKSETNRTPIDKVSIVTNETSTGATFKPQQSKQPPSTSTPALSLRQNLIDEVHTPRVTSDNKTLRISTMQFPRMQSMANSTTSSVVNVTALASVDIDNVTNDKSNVESKPTHKKESSIDLKSKDKGLQNKISSIFNNLPNDIELSDDSADELDSTHNEGSENSATPQSDIAYIENRSDSNLSSISKMNNHLQFELSARYGDSVAKSAPIKAESKHSATFTPSFGQSPTVSTFHAIQNKDVSANKQKSLNTPSTLLDNARSIIHQNIEAVASSASSIIASKRRKKKKPTKTSENPLKNGGIPKKYWMNDAFVSDCLNCFRPFTAFRRKHHCRFCGQIFCSDCTLFISYNQHRDERNNTKNSAKKPYNDKLRVCKPCYSDVIIYLSDDSSSANDSDGEKVISAEEIEVPKTKAEDLLVPNHPLSRIRSMSMGSNRDSSRTDSLSRKPLLKDNNNLENSLSTSHSSSPSRSNNNQFIYPDESIKVHPRQAPRMAIPTTRTGEAVEIPLMRHSLMNSSILKTSGAPYSSNMNSLPQTFHQSNSQFYHNHHLLPEHPQYGQRQNLVQQHQPQGGHFHNHYHNTYSNLHSQYNNSAGISESGNTNKTRIKSHLSPTLSNANLTSRSLDNLGSINNSFMTRTPSFNMRVLSGSSRDPSRSRRVFYRPAXIHIL

SEQ ID NO: 18404 - protein, 321 aa, Candida albicans
GINGGGGGTNNSVNNNNNDDNINPLESILTRNKSNHLKYQFIDGNTNLSCKIFYSEQFEALRKACGNDDNFIQSLSRCVKWQSSGGKSGSSFLKTLDNRYILKELSKLELESFVSIAPFYFKYISQSMFNTLTTAIAKIFGFYQVQIKNTTTGKIFRMDFLIMENLFYNHKTTRIFDLKGSMRNRHVQQTGKENEVLLDENMIEYIYESPVFVGQQLKKLLRGCLFNDTSFLSAMDVMDYSLVIGIDDSSKKLYLGIIDWLRTFTWDKKVENWVKGNNLIGGNKRGKDPTIVTPKQYRIRFREAMERYILEAPDIWYEGSK

SEQ ID NO: 18405 - protein, 225 aa, Candida albicans
  UNSURE (7): Identity of amino acid sequences at the above locations are unknown.
TRIFLPXGSRLKRKSKVKAQPIFDSKPIVEIYNKIEDVVGPGVDDEKKKDIAVVKKDEQEKGQTKENQQELSQQQLQQQVQQQLQQQLDIPEKQSLLKSLTNFWADRAATLWDPLNYPLESHEHTFADSEVIVREDEPSSLVAFCLSSNDYKQKIKNAFEKNRMGDSGILNLNLQENKPHNDKPGVELEVGNSGITTESASIVTSVGDTKLEESSINNSSNAKAG

SEQ ID NO: 18406 - protein, 628 aa, Candida albicans
EKVANKNVQVTINSNLAVFAKDNLDFSRAHMDIINNLTGLALRKLEFLDRGETYIVYSTYDRLKLGYLAKSHNLQILSCGMFTDNLDLKTSRKLFKSSIEIRDVMLDPDLGLTVFEFGSLLVYKDESIGPSLTRAFTSVIANPKLDPHYCLKASKAVGLGTKKLPQDTVVTTIYSLTNLLFVTNEGLLLPSKSTKRFNTGLSGGDNLSGREAFASPMSSRRTSFTSFSQAFSKGANSSEFDENDYRKVCENAVTGIIEVCEKCNDESVPALTCTILSQKVSKIDSPIGPLILKGLSSCAPFLPEREFVILIRLLNKISFDALEKKNMVLMGYLTESKVLLAEKLKVSNPLFTVYLHELLQAINSKGDVQQLEHHRSHNEISEVGDQIAIYLKPLAALLPDVHLGEKPLEIKSTVTINLFRNIWFNMVVHGYNINSKNTKTFRNELERIAYNSPPLASELSWDRTETSIELNTVLRRGSSNHNIKDHRHYLGNIFEVHRSLSYPKLMFLSAAVFVESLRVRNGNCSDSLLYFTDPTFKISGVDKYLGHISFKIVKDFIQLINTGANKQFSADHIAEQLTTMLIYCCYPVPEMQDAAMQCCDLLISRVPSSLCHKKSLFASSPRGWQDQP

SEQ ID NO: 18407 - protein, 712 aa, Candida albicans
RSQLSWRSSFVTEIMNKLPLRTDEETDFAFQAIREKVYYIKARLVPGDNGGFDYPTNDEIMKLLSEIAGLTLLSDVNNAELIRYLVEIPFTMFVPLIMITASGVWFAVMKDKPQLSVLLLSEIAKKWEESIQLRKGVFSQEFDLVHPEFEKMEYAPSNRVLVNKEADIAQKNFAPHLEIIRLFASNFEATLNQLDHLLKIFTRFVEVGLENLKIASYHPLSRLVRFELVKFSFELLQYHIKLGSRSSKYLSELILDGALTWFRQRSTYPFGGNKLKFKSELILLKEVAKFVTGLNNFQLELIDMKAKILLYFMDDEICKFTVWLHSMNPSDTSGTYVNQQIGGQHLKFAYEIDPILAVNLAMRYKLKSLDELLQQLIIKDPLPAISYPDAVQFFIGINAGTHMPSYHLLFWAPLAPIDSITLFLPPFGSNSYILQYTMRSLESHDVNLTFFYVPQIVQSLRFDYKGYVERFIVETAKVSQLFAHQIIWNMLANSYKDEDSQEPDDLKPTLDRIQQTMLKSFSAHDLKFYEKEFGFFNEVTSISGKLKPYIKKSKAEKKEKIDEEMALIKVEPGVYLPSNPDGVVIDINRKLGTPLQSHAKAPFMATFKIKKELVDYDEQGHKQSFEIEKWQSAIFKVGDDCRQDVLALQLISMFRTIWSNAGLDLYVFPYRVTATAPGCGVIDVLPNSTSRDMLGREAVNGLYEYFITKFGP

SEQ ID NO: 18408 - protein, 352 aa, Candida albicans
  UNSURE (344): Identity of amino acid sequences at the above locations are unknown.
RKCGSFQPPWLKTDAITPVISDDDSKVSNRIQESQRLKTKYSKKKISAALQLDDSENYTTDEEELGYVQTLSRPKIREMKYTEVEENLKINTIIRSKKNRSKTTVNSISFFSDTDQSALMEEYNRSAQSLPELVRTRSRLDLYSSESEAALGTSRNSAELIISKKKFMGSEVKTRPYKELLKILQVNYSKKETSFIMSLQNISLRLSLVPKVARLSALRAELSIINESILPSEIDIPQLLPVTSNKNKKFHKILKLNINEACVLNSAERVPYLLLIEYLSDEIDFNPFSDQNQKIINDCIRKPEVKPNDQISGDDDTSVVSLIQEEMFLDNNASENYNEDGDLXFTRRRDQM

SEQ ID NO: 18409 - protein, 174 aa, Candida albicans
  UNSURE (139): Identity of amino acid sequences at the above locations are unknown.
TMSADITETPNKQLLEQIRSPLFSLFNCIYELKNHTDSIGIQHELVKKLYSFPYEDLQFFIPQFVQLLVTYDSESMALEEFIITYSSRYPHFSLIVFWNLQAYIFELKNEPESRSFQAVRNLITKIQNIMSNADQQTVXAPQFKENFFLLWSYAVVLHHQYFCRLFQIYCLPMN

SEQ ID NO: 18410 - protein, 283 aa, Candida albicans
GHLENWDLCSVIVKNGDDLPQEAYACLLINLISNIWKKHKVDFWTKRMKILITSANAGLVETITNAMSIHSIKKSLTELSIDNGENAKGRIFTLKDYFQKLYGLVDSLKYVKAQENFAISLASYSIICYVLQIKDRHNGNIMLDHEGHIIHIDFGFLLSNSPGSVGFEAAPFKLTSEYVEVLGGLESKAYLKFVDTCKNCFKALRKEWGQIVSIVELMQKGSSLPCFNNGDNTSVLLQQRLQLHLSDEEIDSFIEVYLIEKSVGSMYTRLYDQFQMITQGIYS

SEQ ID NO: 18411 - protein, 312 aa, Candida albicans
LNVSADLHSVVKTEDWNTKKQRIKKSSAYGHLKNWDLCSVIAKNGDDLPQEAFACQLISMISNIWKKNNIPVWTKRMKILITSANTGLVETITNAMSIHSIKKSFTEHSIKSGENSKGKIFTLLDYFHSVFGLPNSTSFRTAQQNFAKSLAAYSIICYVLQIKDRHNGNIMVDGDGHIIHIDFGFLLSNSPGSVGFEAAPFKLTVEYVELLGGVDSEIYSQFVYLCKQCFKSLRDNSEEIIEIVELMQKDSTLPCFNNGENTSVLLKQRLQLQLNDEDTDQFVENFLIGKSLGSMYTRLYDQFQMITQGIYS

SEQ ID NO: 18412 - protein, 172 aa, Candida albicans
RTWIFGPPCVKTNDNMGVHHQLVQKLYSYSYDELEFFIPQFIQLLVNFETDSMALEDFLLHYCNQFPHFSLIVFWYLQAFLFELRNEPKSYSFQTVRKFINKLQNILFNVETSFHIRGPEFRENMQPALILCGSVASAFSSPLVNEYALPIVRSQGKQQKSFVFKLASFQKS

SEQ ID NO: 18413 - protein, 185 aa, Candida albicans
NVNEASVLNSAERVPFLLFIEYLSDEIDFNPTTEYNQRIIARKKMNGATSMTVKKIHSFSEVADGNFEKENKIKSSTPETVSNIIYNENTEEADLSEMPLDRKTTVSSDSFSPEMLVTPYITEQLKLSNFPSLNTKEVSTKVLADQMRIAAVMLQQLDSFGKANSEQSFLIKNRIVESMIALQDQ

SEQ ID NO: 18414 - protein, 451 aa, Candida albicans
TTKQTKKRAQIFLSHHIFFFPPVMSIIDEYESLEVIGKGSFGTVRRVRHKDGQILVRKEIEYTSMTSQERNHIISELRILRELDHPHIVKYYRHDHIPEKKMIHIYMEYCEGGDLAKVIKNFRASKSRIPEEFVWQVLVQVLLALYRCHYGVDAEKVNLFKTALEPKYANSIIHRDIKPDNIFVGSCIKLGDFGLAKMLSANDFAKTYVGTPYYMSPEVLLDDPYSPVCDIWSLGCVLYELCTLEPPFKAKSHLQLQAKIKRGVIEEVPDFYSLQLRTLIRLCITVDPEERPTCFDLIDSLAVRFLRKEMELKEMNENLEEYKKQLLKRSKELKETSKELDEYKQELVRKSEELSKREKYLDEEFELRKQAIELESKEIRMEYQREFNLVVEQEVKRRLEQRKPHGPRPLEDVSPRSPLKERNRPRVTDALERLHLEKRHTPEFEYISKYR

SEQ ID NO: 18415 - protein, 401 aa, Candida albicans
RNRRFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRLHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFYWNVFKSKPILE

SEQ ID NO: 18416 - protein, 191 aa, Candida albicans
GILRLVIMGLCKEDMWHKSTTSTFCGTPEFMAPEIVAGKAYDRSVDWWAFGVLLFQMLLCQSPFKGDDEDDIFNAIENDEVKYPINLSRQTVLVLQALLTKDPSQRLGSGPKDAEEIMEHPYFHDVNFDDVLNCRIPAPYIPEVQSEHDYSNFDKEFTSETPRLTPVETVLTSEMQEQFRGFSHISDNATI

SEQ ID NO: 18417 - protein, 373 aa, Candida albicans
EMKKSTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQEYMPLDLHNIIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQEALEHPYLNSYHEQLDEPVTLPIPIEEFDFDIDKKNLDTNDLKKQIFEIVMS

SEQ ID NO: 18418 - protein, 155 aa, Candida albicans
PRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPLNLLLNSNCGLKISVL

SEQ ID NO: 18419 - protein, 298 aa, Candida albicans
YLLSNNIIKLTMIDIFDMEDEVSTLTSQLHTKIVISPAPSSSTQELNYKLIDAIDEETIANEKEKEEEEDDDYDDEDDDYLPQGYQPQISSRPIKINNNSNRQRRKSSIVSSYEVNITNSYVSSSLIIDRSPGIVSSGGGEGGGGESINNSKFVSSVISPPRLSDFEPIKVLGKGSYGKVLLVRQVSTGRLFAQKQLKKASLIINQQEQETDDDDEEEEVVVAGVKIHEKNYQRTLNEKQILELVNHPNIVKLFYAFQDNNKLYLILEYLQGGELFHHLAMEKFMSEKDQVIILHKCY

SEQ ID NO: 18420 - protein, 289 aa, Candida albicans
KRSSYYIAQMLLGIRYLHLKLKVIYRDLKPENCLLNSFGNLVLTDFGLSKIAADNEDGTTKNHSITGTVQYMAPEILQGDPYDFAVDYWSLGCVAFDLLTGSPPFTGTNPKKILEKMKSIKKNLKFPFYLSLDAKDFLRKLLQVNPEKRINLDDEEIFQKFKQHRFFRYIDWNHLENLHHHQEREEGAEELSFPKATKNGQQQKMYMPPILPVITDPILAENFDSEFTEMDFTPPLPPPPPPPPPPIIISQLQQQTRLSSSGNNTSDILNIQGFSYTNPKFIDYSLHNK

SEQ ID NO: 18421 - protein, 209 aa, Candida albicans
FTFSPATPPLPPLPMGHLPKLPEGTVLQVGKHKVTVVKYLSEGGFAHIYKVTIDPLENESDIACLKRVIVPDKNGLNELRKEVDVMKTLRHSRNIVKYYDSHAERLENGTYQVLVLMELCPNGSLLDYMNKHIKTKLTEPQILKIMLDICQGIYEMHKLKLVHRDIKIENVLIDSKNQFQLCDFGSTAIPTMPVFTYGKPGRTPQLRLK

SEQ ID NO: 18422 - protein, 535 aa, Candida albicans
EPVIPEMGNLYRGIPMDEKADIWALGCFLYKLCYYTTPFEANGDIAILHASFQFPPYPEYSGDLKNLIIIMLQENPLFRPNIVQVLILVCKLMSIDFAKLKLKDFYNAGPYNFQALHEYQVHKQNELLRQKQLYYQQHALANSEAGLTKEPPVAAGDSLPADGKELASTESQPEHHAKPAATPSIDSQLSPEIKSTTLGVPSTLTSGSSRESLAGFSLEDDLAEIEGLEDAEQRYPSLEEIEVPIQKSTEPLRLTSIKTSHSDAVSTKGIDVHAVDADQLPKPSKEAEKLADVIFSTTESPATEKGDTDADFYDLLQRVEHLHVDTDPVGSAKNPFPYAKSLAAAKEDGNYEQPETHKKNNPWGNYNSTLDNFAFSLPPALPDIKQVPVSTEPVFLENPKLAKPECNLIDLEVGLESSSASPSLRYLKSNNISEVSLIDMDDSQLKTGETKVAANSAFKKRVGSSTHNPSQFSLQEEVIDFASDDENPDNGSHMSRLKIRSSLKKPSKGRRSGEHKRTESSSTDSKKRLSFFGGN

SEQ ID NO: 18423 - protein, 382 aa, Candida albicans
WCSCRSYTVFGCYCGKGFGLCQKRFKNTNNALIILVSPEDASQSFSNLSLTKDQLDLKFKEITILLLTDSESPVKISLLNNILPLCQFFGQDKTNDIILPHLISYLNDTDQELRLAFLSSVLQMGPFIGVLSFEQYILPLLVQTIGDGEQFVVLKVLEIFNMFVKERLINPRTEFNALDVYKELLLNSINLLLHPNEWIRQSVINLIISVSANLTDADKYCFLYPLIKRFLSYDLSIIDWNTLYPCLTKPLTKQIYDLAITWSLNSTSKSLFWQQKNFSMLTTKQSGNNITKKMKKLISFNKDMGKSVYLPQMMSELTFANGSNQKSNLTIPLSLEDKQWLLKLKSIGLDDKSLWKILALRDYIYHVGRSPMSSPRGWKDPR

SEQ ID NO: 18424 - protein, 458 aa, Candida albicans
ISIRTGIDIQWNSRRKILGSNAEETVSIRTSSRRGSNSLILPQLERVTASVQTVEANVMGEMETHNSGVNKDGWFNDSNTSHKVFSVSNSKIIVSHIKHTYTGENPYILNFLKNPKFQPNLSDFEEFGKTIIKHQYLQQQQQQQNQNQQQLKTIDMLPPMNVLVASFRSSDKDNRLEEINALAVCPTSEFFVTGSSTGSLKVWDSLKMEKLVTVKNANLSIELNSSVCSITFLPNRFVVIVTTNDGTIRLFRIDFMRNSKSKKIVRYLKMHLIRKYIHGNDHDGSGNCNGTKKYHRLIEQIKFLQDNYIIGVDVTVQKIIMLDIITMTILSELQHPLIYGIINTFIVYKDYWLLVGTDKGVLTLWDLRFKIIVKSWHVINNENNERLGSINNLELLSNSIKLFETKNDGVSSGGSSSAYFALSGNDDISIWELPSLECKAILKTSNAVMNSSTIMHTH

SEQ ID NO: 18425 - protein, 351 aa, Candida albicans
MGQKLSLLAPSAPTVAVSSYVDALHNYQYVEVINNSRFLKTIKAIDKTTGNLVIIKLLIKPASPNYSIQLQQVIELMVKQSSLLYPFKNALPWHRLIETDRAGYVVRQMIKTNLYDRLSIRPFLEPIEKLFITYQILKIINEIHSLNIHHGDLKLENFLITSWNWLLLSDFSNLLKPTYIPEDNPNQYSFYFDTSGRRLCYIAPERFYNSQDHPKHILNFNDDGLFTMKNSVTDAMDLFSTGCVIAELYNDGEPTFTLSQLFKFMKNEYTPDLSGIYNKDIVTIIGKLIKLDPNERSSAREILDENKGTCFPEFFYSFLYDFMEMLNNQENFVLNANNANILHYGSWQEPR

SEQ ID NO: 18426 - protein, 330 aa, Candida albicans
NTHIPSQDQHLLQMVELSDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGANMIKRFMNQLIRGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPNEEIWPDVNYLPDFKSSFPQWKKKPLSEAVPSLDANGIDLLDQMLVYDPSRRISAKRALIHPYFNDNDDRDHNNYNEDNIGIDKHQNMQ

SEQ ID NO: 18427 - protein, 643 aa, Candida albicans
HLLFFHRLLITYIMGVLGKIFSLSSNLAQLEHQQKQQQQQQPPPLTKLLLKQSPPQPPPPVKTKPSPSNGTTVPDEDDEILSQVENDIVTPLRQIKQPQPQHPTSVNTPTVNSVRSNNSSPRLIKTRSVSPSNGLSSSTTSPMLLELLEDKLKNHQIASPTGSSTQPVAISSNDKPSTGRPSPTVSRTSSFRTPPSRATSVKTRSNAVSSTNVSGSSTNTNPVNNLPRFVMLESGNHDHHLRSAKRQEKLSNMLKDLLGAKKSRGTTKSAVPDIFQGAMQSSTSQLLQQQQQQPQPVKPPTLFAGLVNSVKNSTSPYHQPGTTDVVCSTPLSAATGTSANGIDCRSFAEKYGRCQEVVGRGSFGVVRISHKKLDSTSTTEKLFAVKEFKRKPNESEKKYNRRLTSEFCISSSLKHNNIIDTLDLLKDAKGDYCEVMEFCSGGDLYTLIIAAGKLEYAEADCFFKQLIRGVNYMHDMGVAHRDLKPENLLLTQNGVLKITDFGNSECFKMAWENEIQYSDGICGSSPYIAPEEYNQESFDPRCVDIWSCGVIYMAMRTGRQLWKLADPKKDEFFEEYLVKRKESSGYEPIESLKRARCRNVIYSILDPKPERRITGKQILSSEWGREIKVCEAGEGHLNELGKQ

SEQ ID NO: 18428 - protein, 347 aa, Candida albicans
TTSIMSTAAVATKPSVTSKPATKQVLNYTKEKKVGEGTYAVVYLGKQISTKRQIAIKEIKTGLFKDGLDMSALREVKYLQELKHPNVIELVDVFSATNNLNLVLEFLPCDLEVLIKDKSIVFKSADIKSWLLMTLRGIHHCHRNFILHRDLKPNNLLLAPDGQLKIADFGLARALVNPNEDLSSNVVTRWYRAPELLFGARHYTGAVDIWSIGIIFAELMLRIPYLPGKDDVDQLDVTFRAYGTPTEQIWPNVSSLPMYNALHVYPPPSRQELRNRFSAATEKALDLLISMTQLDPSRRCDSTLALLHDYFTESPRPTDPKKLPKKSSPEKRENEDEQNNGSKRKHV

SEQ ID NO: 18429 - protein, 102 aa, Candida albicans
RGLKGNLDLPSPKLVNFRINLSLLGELKIYQPLYGGLLLNGPPEILKPNCRKYSTKVDLWSRGVLLYVCLVGFPPFSDELVPPNMKEQILTGQYAFYSPYWG

SEQ ID NO: 18430 - protein, 381 aa, Candida albicans
ATTTPGSKTFEDLRSKRKRRFGKLLGPPKRGTDFVQESTPIGDELSPKIESKFNITPQHKLLSEIIPKAPSLERFSPLLKKNHSSIDAEDTITKRIEARRREQMEQEFVKKEKENELAELKIKKLEQIAALQSPYEEHKSKEFQEPKQSRMPLREIPVNSAVDVFRKPKAPKSAISPSPNVQSNSMIPPAQPVFRNTLQDFPKPPQQPQASSQNQQQVLPSAPIPPKAHYDRPQHSGNKRALIINDKLYEKLELIGKGGSSKVYRVRSLNNNCVYALKKVELGQFEDVSGFKGEIDLLTKLKSCERVVTLVDYATTESSLYLIMEKGDLDLAEVLQYKLKLDAPLDLNFVKYHTIEMFKCIKDVHDAGIVHSDLKPANFLY

SEQ ID NO: 18431 - protein, 211 aa, Candida albicans
PPFMVHAWRRRDLKAANFLFVRGMLKIIDFGIANAVPDHTINVYRENQIGTPNYMAPEAICESNYTSARIWKVGKPSDIWSIGCILYQFIYGKAPFAGYSGNQKLMAITNPHIKISFPSSGIGNTPVPVSAIELMKNCLHRDPNDRWTIEQCLTCDFLLPKIVSENFIREVVHQSINYGYNSRISGDGMTSDRYDALVDSVMKQIQNLNYS

SEQ ID NO: 18432 - protein, 459 aa, Candida albicans
IEKRCSTANLLRLQQSLSNSTFIRNSNLSKSYKHNETTEVANNNLHDTTFSQTTETEEFVTPNQLDEQLEVAGRGGRGVVVEEEQREEEEEEEEVTLEVLENMQKLETNFPILATDYRLIDKIGEGTFSTVYKAESLTGKIRLGSDIWKSPPLKRNKRNILNFQQSRKKNPIVALKQIYVTSSPNRIFNELHLLYMLSGNSRVAPLLDVLRFQDQIVAILPYYNHCDFREFYRDLPVKGIKKYLWELFQALDYIHGKGVIHRDLKPTNFLYDPFRGKGVLVDFGLAERENISKNTKPETSTTSSSGTATTTTTATTTTTTTTTTTTNSSTASSSAISTACPCLNKDQKLINRTHTKRLNVKGAYPKNDNRPPRRANRAGTRGFRAPEVLFKCTNQSTKIDIWSAGIIGFSILLRKFPIFNSPTDTDAILKLAWIFGYDKMAKCAELHGCGLEISMPGNS

SEQ ID NO: 18433 - protein, 166 aa, Candida albicans
RKLATQKMSISSTASTSTTTFYPTSNRTSIDTTATSINNDYVNTNKPTRLSTTSSLFTIDSELNDLYPELPSNFKLIELLGEGAFSSVYKAIDISKNNMIVAIKIINKINLNLKQLQNIINEINILKQINYHHHPNIIELLGVIDGINQTFLILEYCDGGEILIKY

SEQ ID NO: 18434 - protein, 105 aa, Candida albicans
NELGEKFVKPVYTIREGISDIEKMKINEDFTKRHDDYKDHKYLMELLYGCFKMDPSKRLSAREILQLPFFHEILQISEDDTQDEFMQQNQTQTQEEEEEDEVILS

SEQ ID NO: 18435 - protein, 391 aa, Candida albicans
  UNSURE (37),(70): Identity of amino acid sequences at the above locations are unknown.
NRNCFTFNKGSGIGTMKPKIASALIMYLINIPDNHHXNHSNSNIQVPTVVHGNQQKGLLLPPPFIPNPNXMRPAPTPTGVDQPPAKQKPLPAPKQPQPQQQQQQQQQQQFHRKSIGDWNFVKTIGAGSMGKVKLAQHNATHEICAVKIIPRAAKLYQRAHANDPPPQTTQEAAQRHKEFEKEVARDRRTIREGALGRLLYHPFICRLYEMVPMTNHYYMLFEYIEGGQMLDYIVAHGSLKERHARKFARGIASALDYCHRNNVVHRDLKIENIMINEKGDIKIIDFGLSNLYAPKNLLKTYCGSLYFAAPELLSAKPYIGPEVDVWSFGVVLYVLVCGKVPFDDQSVSVLHEKIKKGNVEYPAFLSRECVSLLSRMLVVDPTKRASLDQVC

SEQ ID NO: 18436 - protein, 204 aa, Candida albicans
RRVADELTSILTSVEYQMSCENWYKITETGREYASSQNAQILPDPTGGFHPLVSIYYLVDEMRKRKKAKEEALKAQRRAQVPTIAVPTPKQQQQQQPQPAQPQPQPQPEVSQPLPEPKPVPPEEIINPAVATQAQANMTAPKIVETFSETPQRTLDPSKQSVDEKPSAPGPSIAVPEQAHTTSVPSSFVKTQTSIDEDQLSIPD

SEQ ID NO: 18437 - protein, 410 aa, Candida albicans
LREVVKIWKQMNIKTSMIFNPLGNNNSKYSIHGIMFQAVFKPDRSTRYTRVVTGGRYDSLIESFSNVTTTTKQITPHGVGFSLSTSLLFILMKTLISRGKSKLDLVNKWKGNRCKVLISSTQQQFLSQVGYQLVSKFWNKNISADITSVAAKTQDEIFQNGNSEGAIWIVIIRLLPTTIGNSFSSLNGGSGGSSSSTTTTSTSIRRSKKSGSGFKPLKLRNIITGKDIDLDYDEVIDYLVTELLEDSEHEENDQDNGTMTNSTTLLTSSSLSSKTNQEEELLNGPIDSVEIDQKIIVVKNDAPRSRKNKRDKWESENDAKLAGQQCIKNLSGGPVVVIDARDEILDMISITSIHQQDEWIRKVVYTTNNFPKSFAMNIYNTLIKEFNKGSIWCILVSSRTQHTTIVDLRR

SEQ ID NO: 18438 - protein, 350 aa, Candida albicans
FYFYHAFRFTTNYGRYARDFEEIGKLVRGGFGEVVKARSRMEGIFYAVKKIKHRADKLDSLLSEVLSLARLNHQYIVRYYGTWVEELEDTSAIPSNSTSAIASDDEEEEEEEDDTEGDFGDDDLELTFSSRVGRSSSVLPSYDNSFQVDYISTSFDPRIEFDESSEEDDQNEDDDPFVFANSTDDISNNETEDRSKSDSKEVSVKKPKDVVNSSKNASPKSILYIQMEFCENNTLLNLIEQGLPNNPDEYWRLFRQLLEAVSYIHREGFIHRDLKPMNIFIDRSNNIKVGDFGLAKNSQFSSVVLTNNQVEAKDNELSTVVGTLFYTANEVATGQYDEKVDMYSLGIIFL

SEQ ID NO: 18439 - protein, 264 aa, Candida albicans
YITIMPETSITLDLEHRQQDEISSISSIYGDIFKDITPTGLVWNKKPSPHFQVFLSSSNNPDRPTVSITLDIEFTPTYPLSPPKVKLLNARNLLKINIAKLEKKCKDLIKEYPEQEVSFTIISELIFMLDEIQTTTEKVLSLEEERELRLRNERRALEEKEAKQKKDEELARKKQNKELNEQIQKIQGEFDDDFTDDQDLDMSTTNDNNNSLIPLDKDQFFIFENAMEATIPNTRRKFKFRAILGFIRYNQKGSSPRGWQDPRL

SEQ ID NO: 18440 - protein, 214 aa, Candida albicans
IMILKFVLVQHNFYKVVGYPLDIKIKLFQEALKSLADPASRWQQQVREALFNQPYLLAKDLMFDKQNEHNSHNKHVELDTSNDYLLFDKIMKELTKIFTNHGAIENLNTNLVLPKAPSQSRELVYDFLDRSGAVLTLPYDLTLPTARFLSKTDMTIPKTFRHEFVYRPNVRGIGIPDRYSAVNFDIAGGLEVNKATLFAHDAECLKVIDEIVNT

SEQ ID NO: 18441 - protein, 418 aa, Candida albicans
  UNSURE (17),(18),(19),(20),(21),(22),(24): Identity of amino acid sequences at the above locations are unknown.
YKNIEKKKSEQTQTQVXXXXXXHXHNHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKNISENIESFLSQSPPPSPSS

SEQ ID NO: 18442 - protein, 145 aa, Candida albicans
QAPPARKKLKTRWHFGIRSRSYPLDVMGEIYRALKNLGAEWAKPTEEELWTIRVRWKYDTSAQFECGSAPNLMKMQIQLFQLEPNNYLVDFKFDGWELAHGNAGTDSPQSHRQQDLDEVGSFSAYPFLHLATRLIMELAVNSQSG

SEQ ID NO: 18443 - protein, 430 aa, Candida albicans
  UNSURE (425): Identity of amino acid sequences at the above locations are unknown.
YEILLAVNYSHNQGKIHRDLKSQNILISKTGDIKLTDFGVSTQLSSNFSKRNTTVGTPYWMAPEVIVNNNGGHSYKADIWSLGCCCYEMFTGKPPLQSKYPPMRALRLISKCQKNQDFIKLIELNELDISWEFKDFLHQCFIEDPKLRASASKLLKHKFITKHIHDKDKIKLLKKLITKKQLWNQQNHIVKTQNYYVPTEIYNNQLKWNMDDQNGNENQQTELTKESGDQHTGNTIKFDISSLMLNNDLEDDIEEDVEDDAHEERKSSPSSEPNDDIIGFFKNDFNNILTKIFNKIDNRNQLSRLQYDQLVEMNNLMGQLITNDNGGTNNNRKILLFQYLKYLIKELLKEKNSHINRLILPSSILHNTGTNGITTNISGNTLVNNNNHVTNMTNFTTNGILSSTTSTTTVNHNRTTSHTWTKFDXLESSL

SEQ ID NO: 18444 - protein, 364 aa, Candida albicans
GKFGVGYLFRIVQRFKKSYVEKLLVNSIHRVWLVCRIYTKELKEHGDFQLADFLLTELGQVKLVIFGVSTEITMTKMKKNTFVGTPFWMAPEVITRAKLIEGNVKNCVNSNGNYNGGNTGYNEKADICSTGITTIELVTGSPPLSQYDPLKILFDIPKKRPPLLSGIDFSDNIKSFVKHCLIKEPDKRSSATALLQHKFFKACVTEDVQARLINLISLKIANDDHRAGYKPRFRISGKLDNGKENLEAPIEWEFTNTLIQQQKTTPRLPLLEEVDEFIDDSSSNYPSNVLEQNNMTSLKLISTKQHVTSRKCELLFNCLHMVQLRGKDEYTRCQVEKFIDSVCDFEEKNPGFCNAIVEELEKHI

SEQ ID NO: 18445 - protein, 300 aa, Candida albicans
EYPKVINIVEREKRKGPGKFFDDIVIHLNINHHLPLLTNPQLKSPSKSHNKRNSTNPTVGVKENLLLSPSKLLKRLSMRLSSSNLNKRNSVIPNDIKVIISEPQPQPQPQPQQLLLPRLPLQEYEEKSATTIQSQLIPYLETVALPNGKSILIPSSQSQDEYPSPTLSLTPPYLTSPSNSNSSSCYSLQQQPSKSSTSMIASNLPPLENQKLNKSLSNSTNDGKKPTPNEVVEITPKKQSRRRRNKSHSISAFISPRKLASEYHNRVKSSWRNSLTPSTHSQLSQPIPYLQYRNSTHDEE

SEQ ID NO: 18446 - protein, 304 aa, Candida albicans
IGDYYLGENCINNISMKIKREISIMKQCIHPNIVKLYQVIDDLRFDKILWILEYCQYGEIDWKRYNHYREKYRKIDTESTRGNTNSIPQTRLTLNKILRDIINGLEYLHDYKHIIHRDLKPSNLLINQDNTVKISDFGVSLLLENNANDAKELAKIMGTPAFYAPELCQFVNNRFSMVTNEDHAGNKIKISYNIDIWSLGVTLYCLLFNNLPFNGNNEFEMCKNIVKSELQFPLIKHSSKVTENDIQELKCLKDLIKKILVKDPDERISLKEIKVHPFTTFDLSELEKKKFFKFNQNIFKAQDF

SEQ ID NO: 18447 - protein, 1425 aa, Candida albicans
FKDNCERKKNYHRQYSIMSTSLLHQELSTEKGQSCPPIPDSNPLNPKSPALRTTSNSTILNSPIETINVNTSSKSNISGESTINGSAYSNSTTVVQPEVFGEAHTTTSTHNSASTRTERNEFPNSHLHQHQQESRNNGESNTPMTSPKHFPTDDLRHSLFYKAGSAAHHKSATSSKQSSTTSLKDGLNNANTYHFQNTFLDNNVMSDLEESPVPNERNPIQDTGLGPRSHATKFGVQSTTSLPTTILQSRLPNSNKSSFFPFKSYTSSPVKETKHVFLEYDPITRRKVLNTYEILREIGKGEHGKVKLARDLINNELVAIKIVNRKSRKERLSLRMRKNSSAPVINEYELKVKREIAIMKKCRHKHIVALREVLDDLNSLKIYLVLEYMEKGEIKWKKLQSDVAKPTANKCYDANDNEIPCCGNGRMQQRQQSLLTDEDLLSNEFSPNLTFKQSRKIFRDVLLGLEYLHMQGIVHRDIKPANLLVSADNIVKISDFGVSFATSLAENDEGYLVNELDLAKTAGTPAFFAPELCQFDDETATEKLSSSTESMAPPKIDYKIDIWALGVTLYCLLFGKVPFNADTEYDLFQVIVKEPLKFPNSIKAFNPPATVTEEEFELAKDLLSKMLDKNNRTRIEIQDIKEHPFTLMDLDNDVDGLHELFHLNGDNPVEPLSFDLDEHDIVLKDEVDNAVIGVGARIKRSLVRAIRAGGLKDGEIRNKFAALQLEHSRSENSEESSSGYSNYSSSTRLLGYQNGQNYSMILSEGLPVSSATPPPALLAAQQKRSSLLLPKSGGNSEQNNPHFPWSLAHQIPDTSSRSTWSSSTSMAFQNHFSFAGMRESGKSLLHDMIESNSNNSSRRGSSAGITVSEAHQIETQRNVGGDLYLKNQSVVETFKGIQLQDDKRRRSSIFSLHSQIGTNSNKSSLSHELTPTQTGLGASTQQQHQHYSTNYSNIAAPIPVPAHRKQSTSDNEQDIKAPLLHQEKNVMGKPYLKIGPISIAREDEKSADDHPDSSIISLPLSESFASLDSINDDYLSRKYEEYTNNRKENSKSEGNVPVILLRRKSSLSESDLTRHVQLKDPFGKFKPDGSEIAEKFKAFNLGNLMKTGGKFALAEHNSSDSQQIKGNNYQSSDDGIAPKAIVPAISYSSSDSYSSCSSSSFDDEDESDDDEENLTLAFQSKVAPISRANFLSLTGRAKSHDSNLPTLRQNREKGRQLNPEFQGPIIFHDGLPEFEDVPDGLINSNPIGNNNVNGNSAFNSGYSYYDNVNPTVVSSNVSTATLTMGMAPSESVETNVEAPAQENAVKVSSPLNPHKNTLSRSDILKDLKKNTSISFGEILFNDQFNNHYKKDPVYSPFPSAKHLDNDQETIVKESASKFHEHRPTYYRSNSVTIGLLHRSTHREDDDDVLQTGNDLEQLITKEKQG

SEQ ID NO: 18448 - protein, 95 aa, Candida albicans
KKENTYTTTVPWLIMDTNKLAIVLDPKSNRKIINHRYKIIKKIGQGQYGKVLLGEDVTTTVTSTEKNKSTTISTYVAIKTINRIDKSRLLLVKNC

SEQ ID NO: 18449 - protein, 303 aa, Candida albicans
STGGIRDDQVIKPISKGAFGSVFLGKRKLTGDYVAIKCLKKRDMIAKNQVLNVKSERAVMMRQSDSPYVAQLYSSFQSRDYLYLVMEYLNGGDCANLLKTLGVIGVDWTPRYIAEIIVGVDDLHNRGIIHRDLKPDNILIDKNGHLKLTDFGLSRLGVVGRQQTQQHRKSSTNEQGIELFRSMLLEESNQKKVNPGIGTPFSLSPSLEQSRVSFNSQQQQQQQQQMGVPAGNAPSVSSLAAGENFVLSSTSPTLAYLESFNSLSSVSTPTGATQQQQQQQPPPKPFVKSSNGRSGSSGFDSPI

SEQ ID NO: 18450 - protein, 286 aa, Candida albicans
LITTFTSLYQFFPPILYINMSNTPNKSTPEPESTVFHGSIFEHPHLHHSVSERSISPRHVSKESQNHNHNHQQQQQASNSLNFSDQVSGYDYPSATIEEQIDLRLASSNNPTIVMELDLDGNIRYLSKNWEYIVGTNIKKIVNRHISKIIIGNNDDDSQVFNIAIDAMTREDISYKVKFITATNHTQRNKDGEEVYNDLNDLLLSRSHDDEQSGILTPHNSMEDMAKNDNIPVNNYFEKQQQQQQQQQQQQQQHLELSQQEPEKIDTSDTSSTFLHNRAWTDPCGR

SEQ ID NO: 18451 - protein, 385 aa, Candida albicans
  UNSURE (16): Identity of amino acid sequences at the above locations are unknown.
CLNFFMDIRHFMLILXVKVFNNILLGKIDWPELTPEEDMKFCPPDAKDLINKLLVMNPEERLGFNGADEIKNHPYFKNIHWDTLFEEPAPFTPMLDDPELTDYFDSRGAMMTQFPKEEDLQLLLLLQLLDGETKPEENENEKDIVVTTNTRSSSTGHIIHRQKSLDRNSSISSNDSGSLSLPGSSSINNITPTTTKKERRSSKLADPSEFGSFHFRNLAVLERQNKDVINRLKTEHLEHRGSFSTSSSSESTPTGRLRGFSFGNAGNSGSSSSGGGGGGGGVGTSGSPFKRPISPPSFNANQSSGLGLPVITTSSGAMGIINTTNPVNITTTSTNHNHHNTFNTVGGLGIGTATATTAAATTATTTTGSIRSASPHRLFESPNIP

SEQ ID NO: 18452 - protein, 243 aa, Candida albicans
HERIPSATSAYSSGDEIMISPLLMIHHDDRNHHSKSSSLPYLQTITKQPSFLYLNHNHIIRDFSSPNSSDLEDTTKSNALLRVQRRRESSRMSTELLLGTNTGGGGGAGGGTTSSNNSSVIVADLDVLYCEPISVIRHSVVKLLEKAGCIVVSVTDGEELIKRATSQVKFDLIFTGLKISKVDAIDAVKLIKFTSGKNRNTPIIGITENKNKIDDDITTSSTFDYIIEPNLEAISKVCRILRS

SEQ ID NO: 18453 - protein, 190 aa, Candida albicans
YKGLPLPNMSDYPSPKLANKILTKNFQSKNKHALMFSKKFPFGILQRIVELCDEALLVNPPSTNEDNILAFSPGSEKALNVVMSSSFLETSDVAIKQLIEDTQELINDKMETLSRLVSILQFLEKIKHEVDTLVLCTVRETVEKIKNQTILESRECTPINNDSLISINEEVVPSTLETWLSHRPLEGRTS

SEQ ID NO: 18454 - protein, 345 aa, Candida albicans
SNNYKLMKLSDYYIDKELIYNSAISDIYTAIDKFNNLPVCLKIVDEDFSLPPHSIHREVLILKTLKPHPNIIEYFNDLKICDDIILVTKLYRYDLSQLIEITKYCKRTTRFIYGINGNLVSNQYTLANEIEEKDIKLWLKSMSSGLEFIHSQGIIHRDIKPSNIFFARDDITQPIIGDFDICYDLKLPPKDEPPMAKYIDVSTGIYKAPELILGITNYEYEIDIWSLGIILTGLYSENFQSVLVKDDKELTNDSHVSDLYLLNQIFENFGTPNLTDFEDELFCDEYNNENLHFKKFNLQKYPRRDWDIILPRCNDDFMKDIFTKMIRYDRSSRITSKEILQLMLD

SEQ ID NO: 18455 - protein, 261 aa, Candida albicans
  UNSURE (255): Identity of amino acid sequences at the above locations are unknown.
NEFDLGSVSNLDEQILDKLELIAHIANAVNLYADVKFSQIIPSPPSSDGIEDDTEMLPPKIIHMISQEGIGLYIKTLSLLGRAMDIAGQWWFEKYDAVHGERPSFETTVRINQIVQWIREKYNISLERLEFLKSKSDFTAEETIEDNEPNGTTRVQQAIFAAALGIARETALKELLRNSTDIECSYVTSIYMLLAILEDLEESDRQEVKKIIEKINSRLKNFMGEMMILLSCFLARYHLSQDTNISSKKYSFYVXKYIYIY

SEQ ID NO: 18456 - protein, 411 aa, Candida albicans
ISCLFDMIPQSNPTAQRRSGDAQNTNNVAPNSVATTTDTALTASTQSGSSSNSANKKLEYICVYKIGPEIGKGSFATVYKCIDTTNNKAVAIKSVYRSKLKSKKLLENLEIEIQILKSMKHPHIVGLLDYKQTTSYFHLVMDYCSMGDLSYFIRRRNNLVKSHPVISSLLHRYPSPEGSHGLNEVLVLHFLRQLSSALQFLRDKSLVHRDIKPQNLLLCPPVHSKQEFIDGEFVGMWELPILKIADFGFARFLPSTSMAETLCGSPLYMAPEILRYEKYNAKADLWSVGAVLYEMTVGKPPFKAGNHIELLKNIEKANDKIKFPSAAQVPEPLKQLIRSLLKYNPTERISFNEFFNDSLITCDLDDNDQPLETSQMDENLFISEYISPIAPAERIKFFKEQKKNDSVVKKP

SEQ ID NO: 18457 - protein, 263 aa, Candida albicans
  UNSURE (21): Identity of amino acid sequences at the above locations are unknown.
ENVSISINAMMDINTIYRSSXPTYNNPQQQQQQQQQHQSQNNLFNKENITPLNSPTKSILHNSPQQAKSSTSPQHLYNKLVNANYNGNSPQPGIQQQQNNRALQNNINQLQPPLNKRYKLTEAEFYAKANSARTKRLTSIAQLYFLDYYCDMFDYVINRRERTAIVEKNLLTDPMYKNDITKQQFEWKNYIGRERALLRKRRLKPKHKDFEMITQMGQGGYGQVFLSRKRDTTEICALKILNKTLLVKLDETRTVLTDKRNFN

SEQ ID NO: 18458 - protein, 292 aa, Candida albicans
MIFKGHIKFNDFGLAAGTVCNDRIESMKIKLQNLQNLNDFNDDSNNDNHHYQVLSSLIYERQKIFKQSQQQQQQQNFNNTTANSIVGSPDYMALEVLEGKNYNYTIDYWSLGCMLFEALCGYPPFSGSKQDDTYYNLTHWKTALRRPQTKDGRYVFSDRTWNLIIKLIASPNNRLQNFKQVQQQSYFSDIKDWGNLRQKTPPFTPQLDNEEDAGYFDDFEDDEMMMKYKDVFARQEQNEQLLEKSNTTTTTTTTTTTKNGKRFSPGSKFNDNFIGFTFKHKSNPNYAFFPTN

SEQ ID NO: 18459 - protein, 480 aa, Candida albicans
  UNSURE (13),(14): Identity of amino acid sequences at the above locations are unknown.
SPYTLSCRLLREXXVGLLELLAISRRSERQKQQKQTLINHPTVVDEDTRTITLALNNSSTIKSRDMDPTITMNGNLAYNELQGIYNELGYGYNFDDEDEKVQEPTVTNYDGYVTETINPPTTNANLIPTQVDSPQIDQVATPPTDREEEFDDRVLSSPFVEQPVANTQPVDPFDIGLQESFLDNLSIPMSTYSGYYDKSTTKVDRIRKFREITNKNQTINRGSLLAIIDYCGQELYCLLHELGQGGYGFVYLIEAGSTGKLKALKIETPSSRWEFYILHQVHRRLIGEAGYKQRYFIRAEALYYFQDESFLILDYCSQSTLLDVVNNYKNKGSSLEECLVIFFTVELLKALEALHSVGILHGDLKADNCMVRFEPINESDWSERYDRSGKFGWSHKSITLIDFGRAVDMTLFSLGTRFVSSFKADEQDCPQMNEGTPWSYEADYYGLATIIHTLLFGSYIKIKKDGSELKVFTTGLTGPH

SEQ ID NO: 18460 - protein, 268 aa, Candida albicans
DLSACPASPVVKTKCTDVLHYKNDPRYLKIWLEYTNYSDSPRDIYVYLAKKEIGNQLALYYEEFARYLEAQKKYTDANQIYELGIQSNAFPLKRLQKSYENFKERLQLEMSSVSTTSDLVREALKVKRGSSVEPGAHVDHGPIAKKPRLEVFKDDDDQNQSVLHLIFGASLNDDIKLNSTKQRIKENTISATAWKGRVLKQKVPTPPNSSGGKIQVFRDFEPLAFQAKKLICYDEKGRAYTLIENPGKKSERVLVYMDLIYPDESQEV

SEQ ID NO: 18461 - protein, 410 aa, Candida albicans
VKTARLQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSLHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINLKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 18462 - protein, 540 aa, Candida albicans
NPKKKIFFCSLLVVLFKLSLEQQFYKEPISIMDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDGAMFNNYCNDHQ

SEQ ID NO: 18463 - protein, 387 aa, Candida albicans
TMHLFYFISYIISILLVSIIASPRLERITTKYLSPQQQQQQQRRDQAYNPATPTNNIYTSASLQPLAERSLDDWDLNNIILLSDINGSLHCVNRDDGNLIWSLPIDEPLVKIQSNIKDKSAAHNILWFVEPYQDGTLYYFTPKFGLNKLPTSIKDLVMESPFTLSGDDKIYTGTRKTSLYNINIHTGEIKSSFGNTDECPIPRSTLPPETAFNADDTIMIGKTTYELSIHSKSNSDVMWNVTYSQWVPNNIDNDLILQNQQSLDKIYFTPFHDRSLLAINKDIGTPIWISKLPGLPVSIFDVFSNSAKTNDYLLLPHPLKVLNDLQSNDINHQSMVFVNKTLSTSSNSQDHLNDQWVAMSFRNYPTLIKSAPISKYPEVFTTGVDDP

SEQ ID NO: 18464 - protein, 267 aa, Candida albicans
RSSIHSNSNSNGNGNGSGNGATNGSVSNSATSGKRLTKAIDIFSLGCVFYYILTGGYHPFGDRYLREGNIIKGEYDLSLLMEKCPNDRYESIDLISKIISHDPSQRPNTGKILKHPLFWSFSKRLEFLLKVSDRFEIEKRDPPSPLLLKLEEHAKAVHNGNWHKLLNDDEFMDNLGKYRKYSPEKLMDLLRAMRNKYHHYNDMPESLQLKMAPLPDGFYKYFNDKFPKLLMEIYYVVEKNFRNEHVFQKILLVDIGPVVSISFQFKF

SEQ ID NO: 18465 - protein, 176 aa, Candida albicans
KRWSFQPRGEDQEDQQQNDESVVDEEIIPTKSLIPPSSLPAIKSRKKLQIENNLVISDKILGYGSHGTVVFQGTFENRPVAVKRMLLDFYDIANHEVRLLQESDDHPNVVRYFCSQSSESEKFLYIALELCLCTLEDIIEKPQNMPNLCIPKRNDILYQLTSGLHYLHSLKIVHRD

SEQ ID NO: 18466 - protein, 638 aa, Candida albicans
SYDASKIDIWSVGVILLTLVFHKNPFQVANYSDKRFIQFVNNIEALFDIFSTMSGDLFSVLRFSLTIDPDNRDLKGFLDELMLLRYFTIDEEYWASEYDDDGDLEEERVGGEGEENEGYYDDDDDDDHDEEEDLEEFGFFDDYEDKLSVSPQKLVEIKATPVTPVTPISNEPMTNQKLEINPAPQVYVYKSSLLKSPVDMTPPIPHNRRADALLSTNTDLKPIPIHGTAGFKFHRNTRKPLNVASYTQNSYMNNRFNNTGSSGFNANYNSNSYNNNNNYNSKFNREDFFTPKSVFNHYLDKYGEQKFGKQSAFADGYKKHSPPQRYKKRTWKKNNNHKRKTGYQQQQHVYNSQYPHPTNNDSHNHHRGKRKSRLYSTSKLKRNVINGNTNGNINGNGGGGNNLTSNYPSLHHGSTMSQIVNGSVNGNVGSNISNSGKYIPPYLRSPAYQKSPAIEPLTEDLDHLNLNNDYDEVFHLEGDFDMARNGDNDDQYDSHIDDVGNGPHDYHLNVAGDFPHKRNPKPDVGFMHQHHPTATTITSGVNGQVQAQGQTHGRRNSTSFSTSWMLNTNRRAGAIFGNELPLASNNTNSLPNQTNSVNGGGINTNSNGKYVPPFRRNSVSSSHGTANGTVFPTGGNPR

SEQ ID NO: 18467 - protein, 105 aa, Candida albicans
LLLFLLYQFHLAMEQFERYDKGELLRDRYLKVNDISEGSYGLVSVAKDTRNNDCLVAVKFIYPVDYKKDHQLLETTSRPSSSPAKMRNNGHNKYESESSPRVEIP

SEQ ID NO: 18468 - protein, 687 aa, Candida albicans
TYVSYCGLMQMNAGSLYKRTEVIGRGKFGVVYKAQNKQTKQIVAIKVLNLDTEEDEVIDVQQEIQFLSELKNVPNITHYYGCILNDTKLWIIMDYCAGGSLRTLLKAGVLEERYVAVIVRELLMTLSAVHKLGVIHRDLKAANVLISKEGNVQLCDFGVAAKITANSTKRTTMAGTPYWMAPEVIRTGDTYNSKADIWSLGITIYEIATGNPPYCDKDASWAMQLISKLTPPRLEGREFSQALKECIALCLDENPEERPSADDLMKCKLVKIYKNHPTSILKEVISRYLLWRDRNSSRDSVFINLENEQEDSVDEIVNKNLDGGYHNQQQQHQQQQQQNDHQDHDGHNNQIQVKWDFDSLSSREYIMENDIDLDKVNQQYNNNFDTQQGNTYSTLPTLKAPTTKNNTLAATNQNSMTALKNNSKSTTEVPKSLQMLFEDNSGEQEDLAPPKSNVNIMERMESPTIEIPDMDSLSQLPCASTTNTTNHPQLNKPPALYHSQSASGNLESRFFSLNTSPKDNGGSTGGNNGINRPRKKTISNTGGTANAQFQQTSSAVPHTPPYTTPASVRTPSPKPPSSVNLLNATSMSKTGSPSKMKALQSSSNPLLQPINMKLENMNAGITGGTGSHPPMQAPPQLITQQSLPVLPTSSSTSASVSTSTTTTTTATSTTSGGMAVFTYGGWKDPRL

SEQ ID NO: 18469 - protein, 131 aa, Candida albicans
LFLFYSSTEIVQPNLIILMNYTRVNSSEELEVYEEVGRGGFGVLYRGIIKSTNQEVAIKQIDLEKDLTDLIEINKEIQIISECHCQQITSYMGSFVKNYKLWVIMEFIDGGSIFELLKPRPIDDEKIVGFI

SEQ ID NO: 18470 - protein, 189 aa, Candida albicans
ARFRPAPVGEENNVNQFGINPAQAASMPVSMTPVTEKDHSQLFPNINNDESLEKTNNGSGNSRSHQNSLLSQKKSLASSSSHNLSSLGFSNGNNSAPTTAAASTAPPPPPTMFANRGSSNSVLQLQANFSLNGGGATNNGNPTFSVFPTIPNINGDIFSDTVSKQKLVNELDVMITLFNQGLEVLEEIL

SEQ ID NO: 18471 - protein, 610 aa, Candida albicans
WVINMIYIPIFHVKINVFLVSVNPNSTTNNNNTQQHHDSDLFIEVGRNNSYDASSSTINNTSYIKIFLFSELKKEQVLQRPQEDLELVLNSDIELDDNIIPETPTKKLLLPNQHHQHHLPLYTQSKSPLLKFDTEKDGRRNLSIVLDKSNATKREISEPPSTPINMSFAKNSFKKPMNNAERGDDPDSIIAQRIDIMPSLDEADSVSVYPSKIDEHLIEKFGMKNIKYIGSGAFSIAFECLFNNEKFAIKRTKKPLIGKLEKQTIKREIEALRVLTSIKEDEATNMQEQEEGKEYLVYFIEAWDFNNYYYIMTEFCEGGTLFDFLEENKHYKIDEFRIWKILIEILNGLKFIHLKNYLHLDLKPANIFITFEGSLKIGDFGLATKLPILEKDFDLEGDRNYIAPELINDKIYTPFADIFSLGLIILEIAANIILPDNGTPWRKLRSGDLSDAGRLSSDNISMFLQHNPNTNSNISGSGSRSGSGSTGGNGSAGDGSTNSTNFSYNSLLGNSLTLNPPVKAVHGTSDTNNTLASELSKNIEGLIPSWAPDFLVHGDLMNLDKLVNKMLRPNPFDRPSACNILEMPECLIVENRRKCGATIFEGEFGSPPDE

SEQ ID NO: 18472 - protein, 596 aa, Candida albicans
IMNHDNIALFESEFSQIHLNHRNNLDKKISPTRRKKVLYPPHLYPARLDAGRQISKELSPASVANLNSNKYDMSRTPVTPKRTTSATNSDTQNKLTNLQSSKNPFRSDRTVSYPVPDKISKKSDGQFSFMRETSSSLQKKQVLTPVNERRTTSGRSSSVGLSSTKKRLEYSRQLSQRSKRHISNSLINKSNHDFSDFENSHTGKYRLSLESSPEEYYQLNTDDIVIDESPSKPRRRMTQPLPKTDNVFDRLYPKSLKHPTAKLPTTKPNKETQTLKSIPRLKIESISQLHQSLYIKNPQLFRDDTLEEQLQAPHDIQESDLDGLSMYEKGELARKKEIYYISKRPLRQIAVNSQENNFGFDDNKGNYIIIPEDHINYRYEIISVLGTGSFGNVVMANDHKTNRLVAVKIINNHINWSLQQSINEIKLLKNLQDRQKTLQNSNIISILDNFNFRSHMCIITELLSTNLYSMLELTNFQGFGYDLLRYITKQILTGLQFIHDANIIHCDIKPENIMIKLPPSPNHNWFQIKIIDFGSSCFVNETSFTYIQSRYYRAPEVLLGTSYDQKIDIWSLGCLVVELFTGVTVITSSQRRGRSK

SEQ ID NO: 18473 - protein, 485 aa, Candida albicans
  UNSURE (477): Identity of amino acid sequences at the above locations are unknown.
PSPLYSAGPVSSVVKTAAAAAAAAAYYLPPARLGRSALIVQYQQYQQALQNQRITKHKNPAPKARKIYNKLDLTPKFHQQPKYRRCSINSIHISPVNALSIYLTESYSLCQPRKFQYSKSTNPKRVLTKPLEPKYNNGYDNEDSDYILYVNDVLGSEEGKKYMVLDLLGSGTFGQVVKCQNLNNQTVCAVKVIKSKPAYMNQSLTEVRLLEFLNANSDGKNFIRLLDTFMHKEHLCLVFEILASNLYELIKQNQFQGLNMKLVKLLTKQLLDSMAQLKNFQMIHCDLKPENILLCQPDKPNIKVIDFGSACFTRNTIYTYIQSRFYRSPEVILGLPYTESIDMWSLGCIVGELFLGLPMFPGTSEYNQIFKIVDMLGPPPRHMIEVGKNSFNFFKKKVNTTTINNNDNNNNNTSETKPIYELKSFDEYCQFLEYKRQKQEGATSTTNNNTNSSSSSNHHHNNYKKEQPNKNYVFYHXGRTVPRLR

SEQ ID NO: 18474 - protein, 332 aa, Candida albicans
KQKPTGLKKKQKQKKEKKRKIFKLFFFKYFNFYLVFYPCSYQLRMVEDKDIDLNINNLKIHDAPTRTPPVSLPPALPTPPTPSGILLNTTMQAKLMAFQQQRSKAAAAAAAAASVSSSSSGTQASSSSISASTSESSVSTIPANINRTVSGKKKPKPNLKLSDLPLSRNNSLHRSNTSASDSSVTTPEADTPTGKISNEPQPQGLFANYSDYVDIKSGQLNFAGKASLHSKGIDFLSGSSFRVSLDEFEYLEELGRGNYGSVLKVLHKPTGVLMAMKEVRLELDENKFTQILMELDILHKCDSPYIVDFYGAFFVEGAVYMCIEYMDGGSLD

SEQ ID NO: 18475 - protein, 526 aa, Candida albicans
QGWVQLLRSTTPMSRHHSFPLDYDSPPKHLTVHSYHSKYQTISSLGNGSFGTVNLAKIKFFKFDLLNLHKNKLGTLLCPLEDSKCNTSNLVAIKTMKKKLPLLQEYSNVKEVKFILSVPSHPCLVQIYEMFIDDIQYQLHISMEALNQNLYQLIRSRRNIKFSPVTLKSILSQLLCAIRHIHKCNYFHRDVKPENILVIPTLHFYGSKAAIPPYRKNDNFIIKLGDYGLARHVSNIKPYTAYVSTRWYRSPEILLRQKWYSRPIDIWAFGAVAVETANFVPLFPGSNELDQIWKILKILGTPFVPEPKAINASYVVPLGGYWTEALFLTNKLGIKLPDESGMSIEDIVQHPDSLALIEVIQSCLKWDPLARADATEIAKMQYFKESITMMDTYFETDTVSMNTALNKLAGIPNSPSRKLLTPSKLQKNSNGTCNTTGSVPVFQDSDDGYENYFGEYIAKQPERNSSGNESYKLFAQPWLLKVNEVLGTRESEMEPRRAGNEAHDLKKKLSKVAGTKRSFTTFSLDS

SEQ ID NO: 18476 - protein, 620 aa, Candida albicans
QIKIMSIIPYNNNKDVLYHNPNDGIVVVHDPRENTIKLLSTVASEARGESNGSQRTRRPSQAFNNDQFPHTTSMTKCPNCGFTWNEFNKSGPRRSSSHSSSGLFNISLPQEYLSQSFIHTDYFKLLGKLPSNEEHACKLTLNNSLPEGVFNQGYFKRFFKKIDPYTLGSGAHAQVYKVNHILNNIVLGTYAVKRINIGGQLEFLQQVLNEVLILYELSTTGANENNLIRYNHVWLEMGELDDLNSIFFPTPKLADRRDMKVPYVFILQQYCDGGHLEDLIKCNFTIEENLTWKEKVELERKKRRAVKVGDETLPKRKQWLSTFEIWKFFHDVANGVNYLHQNGILHRDMKPSNCLLDVKYVPHEMKLTFESQEDFELHLYNLPRVLVSDFGEGKFIEKRQNVNLENLSDRQGNTGTLEFTAPELWLYSRDPKFGKDGKKFYNDFTYESDIYSLGLILCYLCIGKLPFSDMIRDENDPQEARSKIMNWYNNLSSASFSEWFESQIHDREGVMDECMEDFQKLAFKMIKGEEEVVDNGTTSRIGSKDILLYLNNIKWERFIITGHTFISGNSWSMSNELAIIEKDDLDLHSFNKDRVPSLLQNEVFSDAEDGTIEYAVFTAS

SEQ ID NO: 18477 - protein, 186 aa, Candida albicans
  UNSURE (4): Identity of amino acid sequences at the above locations are unknown.
EYLXSRCCGSNTTNPSQRNPTQPNSTQPNPTILSKRYYYIDCSYIFISIMASRELTPIPTGATTGTGTAATNGSNTSTPLMPSIVQISRPFFTHKEISYLHNQTIPESLKPHYTNIKNNVFQFLFQIIKQLKFPLRVLATAMNYYQRYYLFNKFETNNNSGGGGNGGATFDSSDDPHSISHFSFNF

SEQ ID NO: 18478 - protein, 266 aa, Candida albicans
FGNQRIFYLTLNGLAKLCDFGVSEFGHEVPEDFSSPVKLSTAYVGSPPYAPPEVMLLKEKSSTEIKAFAYDPFKMDCWGLGMLLFCLVYGGVPFQQSSPNDHAFRDYKFSHKRFCTDHHTFKSNQGYPRGPGSEFKLAAKFENNGASRVAWKLCDPSENTRYTMDMLFDDPWFQSVEMCIYESPDQEVNPFVLPGTGENIDTHSVSGYSSVNNSQAPSRRGTFTSRPVGSGAGSGYNSHDESSNGLSSSFRSMLDLKDIPQQNNKN

SEQ ID NO: 18479 - protein, 325 aa, Candida albicans
  UNSURE (2): Identity of amino acid sequences at the above locations are unknown.
KXRRSFSLLKGRKHPAHPQTWAVILNYIIHISSDFSKPLWIPPLVVAKSIYSTPVNRSRSNSDRLGHVPPTGRKVLSKAETFTHLQQLNTRNAAKNQLRNHRIPSNHLSSPLSAAPHSDKIVYNPYGLNKTATQERPKNTSFYLSGVNDGERVLSNPVASPNDYLPAELQQQHVNLLEDFEIDVGTKKLGDGGSSDVRIINSCHHKKDLYALKKFTLLSKETDEDFYKRVLEEYKIHRKAAISRHVVDAFAILRIQSQSNLTRGWGMVMEFCGGGDLFSVIVKPGWKSTPLAEKYCLFKQIAYGVKFLHDHDIVHRDLETRGFFT

SEQ ID NO: 18480 - protein, 661 aa, Candida albicans
RNSDVGYKDETGYEEFIPGLDFSSLVSKWNSNSNSNLDLTRNTTNVSLYTTHSNTPRSRDGSYLDLNLLHSKVAPQPIKTSTDQQRNLSYSKLHEFMKTKQQKNAYNSNNNNDEDNDIVLLTKDNFSRSSSGLGSSPGSVKRETSASSMAETSKARKKQKSAIDPITGEVNYELILNSLPPNFNDMPYSQRKKLVKSFSESIDYSQFSLFAKNYLGSSVGSAKTLKWSSSGTGIASASSSLSRRNRVGSLNTLAGRLLARTSTTDFKKLQQAMKPKYNVDEKGAIVLGHELGKVIGFGAWGTIRECTDQQDGTIRAIKIVKSTRDFDGGPGIANHSSGNLNSKTDLTGSMKSKNPRVLEVFKKEIQIWKQLHHDNILPLIDYYETEDAIFCIMNRINGGTLFEVVDSWGQFNARVNLICGPLEYLFEEQRHRLLKVIECARQIVQALLYMHEEKGIVHGDLKLENVLVEREKGNCKMILCDFGMSRVYSSRISRKSSKRHIHYKGNNKLSIDGDLEDTLMMRSRSSNIEFRKPYFGGDSPSSRKLDFDIRDDSRVGLANFFRAHGPSMQSIHLTPVVSENGHSPSDGYFDITNKNDNGGNNDKPMFSRYQQVCNDGKEEHGIDSGLPHSHIGSLPYASPEILQPSPPPLGPSADVWSILVY

SEQ ID NO: 18481 - protein, 559 aa, Candida albicans
RRDNRNRDSYIPSGPKRLAERDNYRPDNDRYQQQENRPASSIPHRESPSSLSGATALHPSPKGPRDSYASGMKRPLPSGPASFRKRRDFNSNSNRIPIPKGPRQGFNEMDGGNGNGNGNVDNYRRARQPEKQKLSLEQIYCIKTTNRPNIYQRVLQVGEGTYGKVYKAQHKLTGEYVAMKKLRLQSEKEGFPITAIREIKLLQSFDHANIVGLLQMMVEYNQIYMVFDYLDHDLTGLLTHPDLQLQECHRKFIFKQLMEGLNYLHKKRIIHRDIKGSNILLDNIGRLKIADFGLARTMKIVGANEKPDYTNRVITIWYRPPELLLGATDYGREVDVWGVGCLLIELYCKMAAFRGMDEVSQLCRIFNIMGTPTLQTWPEIDQLPWFEMLKPKINVKSKFAQKYSESMSVPAFKLAEQLLQLNPKLRPTAEEALNHEYFQQDPQPKPLYFLKDIQGEWHEFETKKRIRAERKRIKEEEDAQLAASKKAAAAPAVASAPAEASAVNSIKEEVDSVDAITYSEKLVNGDDNKNRSSEIDLKIVDSVEEHNKMEEKSLDTKTT

SEQ ID NO: 18482 - protein, 470 aa, Candida albicans
WSHNGATFNPYTWIQVVSFDVSKNSQQENGHLTMGSNFLNLNLFIRLPNMLIPENEKTSKKHLFTNFQQGQGTGSDGGNNIGDLLIGTIKLPLNLKCHTQQIRLMNHEYLKFSNFNAGLQDLVSNDMGEIMLTIEFKPLTKKRLSIEDFDLLKLLGRGSFGKVMQVVKKDTKQIYALKIIRKQHIVSRLEVTHTLAERTVLARINNPFIVPLKFSFQSPEKLYLVLSFINGGELFWHLQREGKFSMDRSRFYIAELLTALESLHELNVIYRDVKPENILLDYQGHIALCDFGLCKLNMSNDDKTNTFCGTPEYLAPELLLNQGYTRSVDWWTLGTLLYEMLTGLPPFYDDDVPSMYKKILQNPLRFPAFLEGTDAQDLLIKLLQKDPSLRLDEASEIKSHPFFKDIDWNKLLNKSYLPPFKPNVENLLDTSNFDPDFTNEKPQDSVVDDFLTESVQKQFGGWTYNGDNVL

SEQ ID NO: 18483 - protein, 491 aa, Candida albicans
IERTENSSILFVTIIMTTKLRNQPLSLNTNQSGTGAGTSTDSIPAGSHITDTNQSFLLPGLASPPTISNTAMFQNPAPHTIRKMDLSIEVPPHQLENNEQNTTPIDINMNMLKHYEILQLPTPIFNTGSFANYNQPLSSLSSNSSNASISMSPPTFRLISRVCSLKQPKRYVSEPIPISTSTSENKVTTSPITPSSSPPTLQQEEIAKKEKQKIFYSKRLGLSFNFVEEIGKGNFSHVVLAKTNIYNSDNNGNSVNNNTNDNQEVVDLAVAVKIISVPMESKQQVHNFKSFIRRELNILYHISHHPCITSLIDYDISLDIPIEQIESDVIIDDDELYQKTPPQNLSMNPHSDVGKSSSPDQFIFMNHCNGGNLLHFLQKNNSKHHYLHNHHHHHHHHNHQQGHHDTIQYWQFLKRIVCELIVTTAFLHKNLVIHRDLKLENILLLHEFDSLASLTSSIPFGKFINVQCYLPILSEFGLSKKLATPDSLFKY

SEQ ID NO: 18484 - protein, 439 aa, Candida albicans
KLLSLIMESSTNYPMVSMNTPIKKIRDLTLNSPSSGHQLDLHLHDTSTFNSNSIYPSLDDIQTSPTAATMLQKGYSQKITNNVLSELNSRAQQLLGSPPPISRLNNYSNGDSSSNKVMNRRNKRYSTIHMNKFTQMDSINQHYSVHMKTPSPQKSESPSSGEMEESATKRRRTLNGSDQIVAVPVIQKETTVENNSSPNRKISPSKGSRDLNSILRRITTETGSPNKENFVKPYPPTNKLRQSSLEMAGVVHTSSPSQHQQQQQQKLADPPCLYKKRSIPQLQKKSSHPTLNRKSSIPTLNKKSSIPSLQRKSSIPSFSGTPSPNMPSMYFAHLPVNDMPPPPPPHGSHLPALNKKPSFTQTNKNTPRLTRVSPSKSIPLSVSSRSVDSRALQNSTNLPTMTKSKSVTIPQPFSLYDKPTVSSSLKSLNKFQKFKDKLS

SEQ ID NO: 18485 - protein, 387 aa, Candida albicans
  UNSURE (18): Identity of amino acid sequences at the above locations are unknown.
NQKICYWISIKISRFPIXVLAALEVKEKLLETSCVSPHYASPEIVAGKNYHGAPSDIWSCGIILFALLTGHLPFDDENIRKLLLKVQSGKFNMPPELSFEAKDLITKMLKVNPRERITIDAILTHPLLAKYPEPTVSYSSTTTLDINSINIKQIESVDKIDKEILKNLSVLFHNCDEKTIISRLLSPNRCPEKMFYYLLMKYRNEHLSNSNSFNSSNDVDSARSLPRSTSYVKTTVTDHATGEKHTTVKKIQQSSSIYSNRSLLKKSTSAKGNVLSNITNRPNTPKQFSASSSFNKKKALHSKTQIYASRSRNASSRSLKSNSSTGRNGNNASVTSVNKIPEITGATVLQPIPMMAMNRGDEQQNKTKKNLTGTFGNKSYIELSVDL

SEQ ID NO: 18486 - protein, 117 aa, Candida albicans
  UNSURE (92): Identity of amino acid sequences at the above locations are unknown.
SMSTVVNRRSSHQFDSPSNHLDHSSSMNVDKVVQSVTNATKRLSQISTNTNNSNKKRKTQNKIGPWKLRRTLGKGSTGRVRLAKNTTTGQLXAVKIVPKSNFKKLKNPKYKRSKEDA

SEQ ID NO: 18487 - protein, 332 aa, Candida albicans
YLPIFPRTKKPQITMISNRKRPRVLSTDGHSSVSNDTATNSTNLSDTPPFSHHHHHHHSQQLQQQQQQQMPILSDTSTDSSNSSFPFYKPLLKSSKIESSMFTNPFLSIHDRNGIQLPEYGDDDDNEEDEEDEISDNVLDNDDDDNYAIEDDDEEVDEDEIVDIEDDDDDIEEIDGFDNDDDIIFIEQRQLPKRNSDSLLYDTQALEAYNKFRSNKNNNNKKKLPPARIKKQRTNSLPQLPQAKCIYNKLPNYILQGPKLGNIRTNVIPHQLNLPPCVDESGHYIVKPNTLFANRFIIIKLLGQGTFGKVVQCFDTVQNEHVLFDHDAGRTA

SEQ ID NO: 18488 - protein, 206 aa, Candida albicans
GTGQICIVTEVLKISLYDFLENNKYIGFPGSQIQSIAKQLIRTVCFLHDLGIIHTDLKPENVLLKDDSYHKLKITSLTMTSAYLALKNDKRPVKFLKILSLTDIYVIDFGSSIFDSEYHSLVVSTRHYRAPEIIFNCGWSFAIDLWSVGCILVELIIGEPLFKTHHDQEHLHMIQKISGETIDRKMVLMCKKQGHKVGEYLMIIVD

SEQ ID NO: 18489 - protein, 235 aa, Candida albicans
VVNTHGRSSSTSNKMQGFIPVEYLPPLPTIDTNTNTIVSEAPEQQNLTVPSTARHMHPTARAKSVGGGHMRKDSYGRVSHGLQNPLPPLPTSMASQNSQEVVGKDTSEGFFDDVQLDDVGYQEVPQLTESEIIEQYNISKPNSMPSIEHCKTLFLKGFFSVQTTSAKPLPVIRYNIINVLSKLGVKFQEVKGGFVCMHTPSVQPSHSNELDEENKLYGDAFKSKSSDSFEAAEPE

SEQ ID NO: 18490 - protein, 184 aa, Candida albicans
SKTPSRQPSLQLPSHTPTTPSGPKSHKSSNSIGNIGGNVPRRKFSIGNAFNTYRIKNGSQVMMPPNAAPTAKVIHGLYDDDDKERNGEDDDDEDDYGYDDSADSLNGYGGGSDMLISSRIEQRAKHQRTVSSSSQKASKSPLKFEIHIVKVPLVGLYGVQFKKILGNTWNYKTLASQILNEMNL

SEQ ID NO: 18491 - protein, 80 aa, Candida albicans
KENFYKDKAYKKMSADGEFTRTQIFGTVFEITNRYTELNPVGMGAFGLVCSTVDTLTGQNVALKKVMKTFLNSVLGKRTT

SEQ ID NO: 18492 - protein, 221 aa, Candida albicans
RILPAPVGEDRLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDPHLPVDTWRVMMYSEILDFHQTVGVANETEGSEQPDLQVEQNNLDSANGT

SEQ ID NO: 18493 - protein, 393 aa, Candida albicans
WWRNFDQILKYTYLCEPLSYHVFKQILNALQDLHNTLNIVHRDLKPENLLFNKIPFFKRGINDNNLEKYLRKSDDINEKIDEGEFKYGIGGGTIGVIKLADFGLAKQLNDKNIAQTPCGTTGYTAPEVFQCRNNNNNNNNNNNNNNSNNSNKSSGGSGSGSGSIYHQLFKSSKSKVKTKSKQLSITNYSKSVDIWSLGCVLYTLLCGFPPFYNDDIEILTNNVINGKFEFLKPWWDEISNDAKDLVSKMLIIDPNERITIDEIWNHPWILKHMNNESKQRQQKQEEEEEEVPGYFPNHNKNTNIIKQTIFENVHEDIINPINKEKEEEDDDYSLSLAPPPPSQQIFSKSPRAIAIKKVFDNPAMTTNKSIKNKASICHGDNNDDDIYFANQEQ

SEQ ID NO: 18494 - protein, 600 aa, Candida albicans
LFDLLIKRNRPCLRISKLLFDMGSKPMICKESNNSSHSNINNHLVLLMSNENPFQQASNETPDSINVITPNDIINEYQQPDQEPQQYYPQRQQQQQDPYQQETQFQQQQQGVYTNYNQSDVTLNDKNADYNRVALQLVEEENEQRKKSVKYPNLENYQILDQMGEGAFSVVYKAKHLSTGKEVAVKILRKFQMDQAQKQAVLKEVTIMRQLDHPNIVRFIEFIDSPTYYYIVQELVPGGEIFTMIVKYTYLSEDLSRWVITQIAHAIRYLHEEVGIVHRDIKPENLLYVPIDLKPSANPISKLRKSDDPNTKLDEGEFVNGVGGGGIGTVKLADFGLSKQIWEHNTKTPCGTVGYTAPEIVRDERYSKEVDMWALGCVLYTLLCGFPPFYDERIETLTEKVAKGEFTFLKPWWDEISDGAKNCVGRLLTVDPKKRYTIDEFLQDPWMQKTSLSQQPQIPIPVTNQYPPATKVAHPIQVANNRYSKKFRSTNSDLYSPAAVALRDAFDISTAVHRMGEEAALQTKKQAPIEGLIEEEEEEHEETVTKDGRVVQDTYNQVLRTHRHRHHLKNNNNPNAFDLNLGGASIIERRKNKQIPIQSS

SEQ ID NO: 18495 - protein, 596 aa, Candida albicans
KILFWETEPTIILLKEVELVTICYSPDRWRKYRIMLVPKNEPPTPAAIETSKKIMSKYKKQVSGSKAELQEEVNQLHTKDVQAHRSTLRNFFGQRPPSELISSNLAEYFPDTRQKDLEQTVRNSVRHSVRLSRRFNLPAGAFSSSVYSLNKRQSILSNSTGFPSNRTMSISSGEQQSGVFNTSGGGSGGLRRAQRTIGDVMVNSITAIDEVVNSNDTFSVFNKPSTSFSNQPVQPLNNHDSRSIISSKSLSGGTALHRISISPNYNDNPAHDRHSTIELLNPSDSEGEDGEEDGEFGISDYAGLSSSSGENGPPENWLKGARIGSGSFGTVYLGMNPFTGELMAVKQIPLVNENGNNSDTENIQNSMQEQQREMMLLKELNHENIVRYFGSTTDENFLNIFLEYVPGGSVQSMLNSYGPFEEPLIRNFVRQVLIGLSYLHGEDIIHRDIKGANILIDIKGTVKIGDFGISKKVSAIDEEDEDFKKTGKRASLQGSVFWMAPEVVKQTTYTKKADIWSVGCLIVEMFTGRHPFPELSQMQALFKIGNHITPQIPEWCTNEAKEFLKKTFEINFEMRPDAIELLAEQFLNPLIMSKQS

SEQ ID NO: 18496 - protein, 334 aa, Candida albicans
LLYDWFKGPFPDKTYEVSLQTLPPGLDQITRAQSLANFKYAKDSAGIYTPKNKNPVEILRADLHSEQPRTLLPLSLSPNDTRNKYQEVDPGQLGRPRRVNFSSNFSTAIKRLNQVCFETYQTMRRLEHSRHDEVDASEFPNCENPTLISKWVDYSNKYGFSYQLNNDDIGVLFNDENTLLKRHNSDRFLELIYHENEGWTCIENSLANPPAQAKRQLEIVDFFAKYMNSNLSKVSEIEERKETVFLRRYTRTPDYIMFEMTNGNFQFNFKDHHKICISKTGLAITHISPGRLTQTQPLILVLKQGNFQHENVPDCMEKIMVIKEAIKKKAFKEA

SEQ ID NO: 18497 - protein, 330 aa, Candida albicans
SARRAQPLQPLNSGQLNARANNITPVKSIRRPKENVQPTDQKQKKKKEKLSALCKTPPSIVRTRNGRDYRRGNFLGEGGFARCFQMKDASGQIYAAKTVAKASIKNEKTKTKLLSEIKIHKSLRHPNIVNFVDCFEDDVNVYILLEICPNQSLMELLKTRKRVSEPEVRFFMVQIVGAIKYLHSRRVIHRDLKLGNIFFDPEMNLKIGDFGLASVLPSTDSRKYTICGTPNYIAPEVLGGKNTGHSFEVDIWAIGIMMYALLVGKPPFQAKDVNVIYERIKKTEYYFPEDKPISESAKQLIKDLLSLNPLHRPTIDEIIAVRLVQRSIPG

SEQ ID NO: 18498 - protein, 75 aa, Candida albicans
RLKSHPFFKDIDWNKLLNKSYLPPFKPNVENLLDTSNFDPDFTNEKPQDSVVDDFLTESVQKQFGGWTYNGDNVL

SEQ ID NO: 18499 - protein, 395 aa, Candida albicans
IKSRSIKNERKKERKKEKFCPITNKNMSAKIELVTENVTNGHSGASETIQYTKSQMVGHGSFGVVFQIQLQPSNEIGAVKRVLQDKRFKNRELQIMKLVHHRNIADLKYYFYTNNEKNELYLNLILEFVPETLYKASHYYVSKRLNMPPLEVKLYTYQMFRALNYIHSQGICHRDIKPQNLLINPDTGELKLCDFGSAKILNPSEPNVSYICSRYYRAPELIFGATNYTTKIDVWSAGCVMAELILGQPLFPGESGIDQLVEIIKILGTPSREQIKNMNPNYMEHRFPQIKPIPLQKIFKKMSPDCIQFLIKVLQYSPIDRISCIEGLIDPYFDELRNENTKLPNYRKIFLQQFHSNNSSGFGNAANYQLYNSQPDLRDLPELFFFNHRGWKDPR

SEQ ID NO: 18500 - protein, 411 aa, Candida albicans
TTTLAMPQSSSTFINEYTLPDVVENSSSRASKMTIKEYKRIGEGAFGTVVEAMLKYETNSSKGNDGTGSHLLGHFRHHSHSDKDNNNTTNNNNNNNKDGEWLGPFAIKRVPAQTEYKSRELEILRFVSHPNIVSLRFFFDKKSSSDNKVYQNLVMECLPSNLQSEIKYYRQSKYTIPYPHMKAYTFQLARAMLYLHGYGISHRDIKPSNILVDPNTVRLKICDFGSAKKLEPNQPSVSYICSRYYRAPELIVGCSLYTTKIDIWGLGCVIAEMFLGKPIFQGQSPESQLKEIAKLLGPPPNTFFFKSNPQYRGNMYTTRLFNCSIEERFKQIFSNSPLDAIDLLMKILVYDPDVRASPRRVLIHPFFDELKSSQFKVYPRGSSTPIELHLFNFSEYELELLGSLKNEFVKS

SEQ ID NO: 18501 - protein, 304 aa, Candida albicans
KQWLIIKILNHYLELLKKAGPSANGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETLDTGFA

SEQ ID NO: 18502 - protein, 63 aa, Candida albicans
LILDISLLMIWPVFLDNPAMSKDMEQRELDAKNGGGRKNPKEDLPFIGYTYSRFDYLTRKNAL

SEQ ID NO: 18503 - protein, 416 aa, Candida albicans
HLENYYTLSVSHAIERNQRRLELENKIANEDIGSSEERKNRQLQNLGKKESQFLRLKRTKLALEDFHTVKVIGKGAFGEVRLVQKKDTGKIYAMKTLLKSEMFNKDQLAHVKAERDVLAGSDSPWIVALYYSFQDSQYLYLIMEFLPGGDLMTMLIRWEVFTEDITRFYIAECVLAIEAIHKLGFIHRDIKPDNILIDNRGHVKLSDFGLSTGFHKTHDSNYYNKLLEKEPSNTHLQPNQLTSGRNSVMVDAIHLTMSNRQTMQTWRKSRRLMAYSTVGTPDYIAPEIFIHQGYGQECDWWSLGAIMFECLIGWPPFCSENPHDTYRKILNWQESFQIPEDVHLSPEAEDLIKRFLTSAENRIGRYGGAEEIKQHPFFRGVDWDSIRGVQAPFVPRLSSMTDIRHFLTDDLASVPR

SEQ ID NO: 18504 - protein, 503 aa, Candida albicans
  UNSURE (481),(486),(492),(502),(503): Identity of amino acid sequences at the above locations are unknown.
DMTTNPALAAAQASHNNIPTKQMNHSTSSSNGNGSNNSSVVGLHYKIGKKIGEGSFGVIFEGTNIINGVPVAIKFEPRKTEAPQLRDEYRTYKHLQGCDGIPNAYYFGQEGLHNILVIDLLGPSLEDLFDWCGRRFSVKTVVQVAIQMLTLVEEVHRHDLIYRDIKPDNFLIGRRGATDENNVHLIDFGMAKQYRDPRTKQHIPYREKKSLSGTARYMSINTHLGREQSRRDDLEALGHVFFYFLRGQLPWQGLKAPTNKQKYEKIGDKKRTTPAVTLCDGLPQQFAEYLDSVRSLPFDAEPPYEEYRMLLLSVLDDLGQACDGDMDWMHLNGGRGWDATINKKPNLHGYGHPNPPNERERRHRDQRRTRQHQQLQQVQQQQLQAQDQAQQLRQLQQAQQAQQQQQLQQHQPLSAAQLHQQKLQHLVNRPLPPIKQESQSAIQSGNGHHELLNNNLGDQHGGKHEGYSSRPDQYQQQQMVXEEAGXPGFWFXLCCQKVVKIXX

SEQ ID NO: 18505 - protein, 472 aa, Candida albicans
INFYLFPFPFMNFGTSHSSSSKNSHNNNVVGLHYKIGKKIGEGSFGVIFEGVNILNNAQVAIKFEPRKCEAPQLRDEYRAYKQLQGSKGIPNAYYFGQEGVHNILVIDLLGPSLEDLFDWCGRRFSIKTVIQVAIQMIRLVEQVHQQNLIYRDIKPDNFLIGKPDTPEANQIFFVDFGMAKQYRDPRTKQHIPYREKKALSGTARYMSINTHLGREQSRRDDLESLGHVFMYFLRGALPWQGLKAPTNKQKYEKIGMKKQTTSINELCYGFPIQFAQYLTYVRNLKFDETPDYQYLVGLMEKALISAGIELDGHFDWMDLNGGKGWDAALNKKANLHGYGNPYPHPSQGQRRQQQQQQEQFKQPLSSPKSQQYNSPHQPLLGNSRSRDNSLSSPRNNNKLGYQSIQQQQQDSRNAKFFNSNNAQQQQQQQAYLQQNGMIPIRDNDVELHSDMSSYTRKRSGTWLSWIFCCCS

SEQ ID NO: 18506 - protein, 344 aa, Candida albicans
LIMPQPPPNAYKAGTRLTVGSHKVSIIKYISEGGFAHVYTCTIDPPFQGSTVACLKRVVVPSKWQLSLLRQEVDAMRRLRGNKHIVSYIDSHASRLGDSNTSGTNHSQQQQYEVFLLMEYCENNGLIDFMNTRLVNKLTEKEIIDIMYQVTIGVAMCHHLRPPLIHRDIKIENVLIDGKGVFKLCDFGSSVNYLPPPRNPQELQLMKDDLMQHTTPQYRAPEMIDLSKGFPIDDKLDIWALGIFLYKLCYYTTPFERPNQSSLQELEHTILNCSETLRFSDQPGLIFSPRLKNAIKVCLRADPRRRPNAVQLLGEIPAMKSEKTIPMVVPSAFFNNRELNKHWL

SEQ ID NO: 18507 - protein, 259 aa, Candida albicans
NILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQLISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNLLQPRRLEGTEFAL

SEQ ID NO: 18508 - protein, 314 aa, Candida albicans
GADPASLVVKTINVDENEYSVKHHLEQLTPYDWHLIANANKIVEISSLGEGNGGAVTKCYIPQLPNKQIFALKLVMCDPNPDLQKQIFRELEVAKKCQHPNIVKYYGTFLLEKQSMIGIAMEFMDGQSLDSIYKEVLKRDKTNRINEKVLGKIPNSILSGLDYLHLKNIIHRDIKPSNILLDTKGNVKLCDFGVSGEAVNSFASTFVGTQYYMAPERITGGNYSITSDIWSLGMSLLEVANGCFPIIQSLGPIEVVEIILRSNLELKDCEEDNIFWTREFKQFIAKCLTKDYLRRPKPSDFLAHDEWCLIQLKE

SEQ ID NO: 18509 - protein, 316 aa, Candida albicans
KCEHPLHDYIQQVLREFNTMKICNHKNIISIFDLATISDTKDLALILPYYPKGDLLDYLSRLRRFKIELSASLKDSIFKQILKGVNYLHGKGIVHRDLKPENFLIDSDGILKISDFGYSLNINNHPLCHEYFKSNPHELYCGTNSFKAPELFTIEHEIKSNRFDFDGYFKDDNTITCFDKLKYLDYWALGIIYFVIFLMKSPWTTANSLDSKNLAYINYCKHYPNSSLKLKEILIELNKKSPSLFITTSNNNNNNNGHNNNSALNLFKSLHYDSRESILGLLNPQPDKRLTPNQLLNTNWLSQVYADPKDLIKLLK

SEQ ID NO: 18510 - protein, 97 aa, Candida albicans
LHIYCYPGVPPFYSESKDKILKASRLGQLNFAKPQFSKISLSSKSYIKKLLRVEVTSRMDINDCFDHNWIKLQRKKLEKKYYSVVGDRQSSLPPPLN

SEQ ID NO: 18511 - protein, 162 aa, Candida albicans
PKRKKPNIIRIYDTITRNSKIFLFQDLICGGDLFSYLVKDDYLKVIPEREAIFIVFQIMKALHFLHKKLKIVHRDLKLDNILLELPIPGSKIYLCDFGIAKHLGYNNRTNTCVGTLEYSAPEVFKADKSGNKAVQSYDFKCDTWSLGVITHILLSGGSAFLF

SEQ ID NO: 18512 - protein, 268 aa, Candida albicans
NFPVQINLLGLQKEKIYKNNEISRLFQIIFFFLDCFSHLTMDVIGILQIILIDNTQILLSKLNKDQEKYARPSISGNVIVVPLLRQQVLTIGRSPKCKVQLINPTVSMEHCIIWAIQFDSDSNLITYIFDKSRNGIKHNEADMLFGLTGILENRDTIEIKTAAHITYKCLQTEVSSQTELDQPMEDWEISNKMTGCGSFGAVYVAKKPNNPKLFAVKITQNNQSGYFSNNSKPTQESYLLSKINHVSIHALMHLLYRMSNILTKKEKA

SEQ ID NO: 18513 - protein, 510 aa, Candida albicans
AVVNTKYRNKDNNGSSLFQRKPLAPINSEFKISKPQHIKPTTHSHTFTTPTPKTRNTATTTTNNNNRNNHQYRNPNLNTSLVFTPTKNSSSSSSSHSSSLLSSSPFVEEPENQPESNHTRATSHYRTTSTSQYKSSANKDASHSLITSSKRKTSTKQTSESTNPKRRTTTTATQNTNNNKILNPSLSSSTIRFSTVSSSTSSSTTSSSSHTSPKPQQQLTLDDFEFGKILGKGKLGRVYCVKHKQLGLIFALKVMSKSEIMNLKLEKSLRREIEIQSNLYHINITRLYSWFHDSINIYLLLEYSIEGELYTHLKKLKRFDNIMASNYIFQITQALIFLHQRGIIHRELKPGNIMISLDNQLKLSDFGSSVQINQNQNQNQIHNQIQTQKTPHQKKQKQQRLTICGTLDYLPPEMIESKFHDFSVDIWALGILCYELLVGKPPFEAINRNITYEKIAKVDIKYPSNLDVDAIDLISKLVVKDPNKRLSLKEVLNHNWIIKNKPKWPKNIYK

SEQ ID NO: 18514 - protein, 293 aa, Candida albicans
  UNSURE (119): Identity of amino acid sequences at the above locations are unknown.
PPTFNIASPFQQHTINMDLRVGKKYRIGRKIGSVSFGDIYLGTNIISGEEVAIKLENTKAKHPQLEYEAKVYKALSGGVGIPFVRWYGTECDYNAMVIDLLGPSLEDLFNYCNRKFTYXTVLLLADQLICRIEYIHARCFIHRDIKPDNFLMCIGRRGSQVNVIDFGLAKKYRDPRTHLHIPYRENKNLTGTARYASVNTHLGIEQSRRDDLESLGYVLIYFCRGSLPWQGLKAATKRQKYDRIMEKKMTTPNNILCKGLPSEFLEYMNYVKTLRFDDKPDYPYLRKLFFLPH

SEQ ID NO: 18515 - protein, 513 aa, Candida albicans
RTIIELLISKALVSTIHSVTTPLIYQTTLMEVTQRTQSQTQPTQQSPTTQTQTQSKEDQNRICQLICSTGQFGNYDLNINDKTIVQGKMTWYFGRDPNSDLQVASSSKISNKHFQIWLNFNDKSLWIKDTSTNGTHLNNSRLVKGSNYLLNQGDEIAVGVGRDEDVVRFVVVFGDKYNPAKLPDSTNTIKDEGIYKDFIVKNETIGQGAFATVKKAIERSTGESYAVKIINRRKALNTGGGSAMAGVDRELSILERLNHPNIVALKAFYEDMDNYYIVMELVPGGDLMDFVAANGAIGEDATQVITKQILEGIAYVHNLGISHRDLKPDNILIMQDDPILVKITDFGLAKFSDNLTFMKTFCGTLAYVAPEVITGKYGSSQMELQQKDNYSSLVDIWSLGCLVYVLLTSHLPFNGKNQQQMFAKIKRGEFHEAPLNSYDISEDGRDFLQCCLQVNPKLRMTAAEALKHKWLQDLYEEDSVKSLSLSQSQSQQSRKIDNGIHIESLSKIDEDVM

SEQ ID NO: 18516 - protein, 149 aa, Candida albicans
  UNSURE (4),(9): Identity of amino acid sequences at the above locations are unknown.
KYFXSCQAXVVKTLEPLANSLFQETINISKSPFSFGRNDTCDCEIDDDRLSKLHCVITKENDSIWLLDKSTNSCLVNNTSVGKGNKVLLRGGEILHLFFDPLSLQHIGVKVVLVDQLSGEHKSQVEVLKQTSEEMNIIPLISGLSSISS

SEQ ID NO: 18517 - protein, 460 aa, Candida albicans
WDDVLYRRLRILTLGPFKHRKDLTRESVLSTYQIMGYIAAGTYGKVYKAKLKSNKLNKTDDDSGIDGINNKDIFSESMNDLHHDNSPSIMINTTTNITINNSLPQFFAIKKFKSDNHHHHINNNNNGGNHLSKGNNSIHQDEVLHYTGISQSAIREMSLCRELNNKNITKLVDIILENKSIYMVFEFCEHDLLQIIHYQLHPDFKPIPCPTIKSLIWQILNGVTFLHKNWILHRDLKPANIMVSSQGVVKIGDLGLARKFKSPLQSLYTGDKVVVTIWYRAPELLLGTRHYTPAVDLWAVGCILAELLSLRPIFKGEEAKIDLNNKKSVPFQKNQLQKIIEILGTPTTDIWNNLNKYPEYLSFTQHFNQNYPNNLSNWFKLINGGNNQNSEKCLELLSGLLKYDPELRLTADQALLHPYFLELPKVNENAFEGLNYKYPNRKIYTDDNDLMTTSPKRRRF

SEQ ID NO: 18518 - protein, 231 aa, Candida albicans
TFFAGLKYIHSADVIHRDLKPGNILVTTQGTLKICDFGLARGINPVYFRNRSAVITNYVATRWYRAPELIMSTKNYTKAVDIWAVGCILGELFGRRPLFPGKNLHEQIHELFKIIGNPPIETIKKYNWKVEGLLWVKYRPVKWKSLYPFAPLNALELLDSLLQWDYKARLEVEQILEQEFFKNLRNVHEEPSSKAIFDFSFEEKGKSIPQLKEILETEVRVFKEISKTGIE

SEQ ID NO: 18519 - protein, 69 aa, Candida albicans
TLQLCFAFHFTNMCCQIATLLDLDVVYVKPYEGLYCFQELADLDLARVLYSNVQFSEFHFFTTGLEDPR

SEQ ID NO: 18520 - protein, 257 aa, Candida albicans
LTILQRKDSQSLPCREITILKQLNHKNILTIQDMIFEEPKMSNRTDIITMRGSFYTVTPYMSSDLVGLLENPKIKLELGQIKCIMQQLLKGIQYVHNQKFLHRDIKAANILIGHDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFPSIMPTEEAGHHGQEIPR

SEQ ID NO: 18521 - protein, 177 aa, Candida albicans
FKMPHKKVVIVGGGISGIKAAADLYKSGIKSTVILEAQPRLGGRLFTVESTQNKGTTYDYGASWFHDCLNNPLFDKAQQLENVKYYFDDGKSLYFNKFEGQIEKWTSETVLEEMMTYFQWVYKQDPDKSDISVKQLAQEYVDKYRNVLTKEQIELSLSAVRMWSEYMARRIMGFTFW

SEQ ID NO: 18522 - protein, 322 aa, Candida albicans
VLYECGVNIWHGESWDLLSGKYTFADDGHLGRNAFVKNGYSTVFINELKELPRAYRDSAIKLNAQVIKIDYTNKKKILVYLKDGRTYSCDYIIVTIPQTILKITNAKDENYVEWVPELPPNIQKVLPDVHFGSLGKVVLEFDDCFWPRDVDRFYGLTSNTPSQDTISVDAWDYPTILINYQAVNNVPSLVALTQNPLSKYIENLQPHEKQQRIWSIFKPLIAKICELKGIQDIPEPHSIYHTPWNNESLFRGSYGTSLVGTQDPSSVIKAFVDGYQDRIKFAGAETMDDTSNGCAHGGWFSGQREAKFIVQQEAKKKVDSKL

SEQ ID NO: 18523 - protein, 264 aa, Candida albicans
VLAMPAAIRPMKKTVSFSKDVSNNNNNLESDSDTKQTPQSYLTFIPQIKNSLLVVPFHNIFILVGMFYSGLTQDLETVMWKGFLTSIPIQVIYNYIIYINLLPLKKSTRNDHQNSSSGSASNNNNNNVPLLIGSSIFVSIVLSLPLFVVIILMGAPVYKYSLKTLYLSLHLSQLIFNPLIILSNLNVNKINRLFKQDHLYRIIFHHGILSTVLLTLGGCWLRVIPIPLDWDRPWQQWPITLLVGGYLGGVVGGVLSLIVNYFSH

SEQ ID NO: 18524 - protein, 293 aa, Candida albicans
MTTMTTEEILASYPQITAPTDQTGYTSNLTPEQKTTLDIFRQQLTELGYKDRLDDASLLRFLRARKFDIQKAIDMFVACEKWREDFGVNTILKDFHYEEKPIVAKMYPTYYHKTDKDGRPVYFEELGKVDLVKMLKITTQERMLKNLVWEYEAMCQYRLPACSRKAGYLVETSCTVLDLLGISVTSAYNVIGYVREASKIGQDYYPERMGKFNLINAPFGFSTAFKLFKPSLDPVTVSIIHILGYSYKKELLKQIPPQNLPVKFGGMSDVSDDDLLLKDVGPWRDPQFIGSRK

SEQ ID NO: 18525 - protein, 219 aa, Candida albicans
LYFMNFFRKKTEEDRDSSSSSLPRDDTASVSSKATSTSTNTTSKVELVKCYIPFEQPVNPIKAPDFELDKEQIEKYEKLVAYFEDYISKEIPVNDQHNATTHPLIEDELAWLTKECFLRYLRATKWKVDAAIKRIEDTIIWRRTFGVANIPNHTDPKKLITADLVSDENETGKQLIVGYDNDNRPCLYLRNGYQNTAPSLKQVQHLVFILERVIFYTRA

SEQ ID NO: 18526 - protein, 378 aa, Candida albicans
TLVSPPILLMFAKLRNKVSTPPPPVATTGSPTSSSSEITTTTNEKSSSTTSLSTVYIPFSTPSSESHIPSEPELTQEQKDKYLHVLNHFQQSDLKIAISEETHKHKRKTKELTIGEKSWITRECILRYLRATKWHESEAIDRIELTLSWRREFGISEPFDNENKVNGELVSEENETGKEVILGYDNDSRPCLYLKPGRQNTKTSERQVQHLVYMLERVIDYMPAGQDSLALLIDFKAHPVGTQLGKIPPVGIGRQVLHILQTHYPERLGKALLTNIPWLGWTFLKIIHPFIDPLTREKLVFDQPFINYVPKEQLDKDFEGLVNFEYDHKKYWDVMIKISQDKKHQYFERFEKFGGIVGLSEVDLRGNNEELIHPVGSI

SEQ ID NO: 18527 - protein, 74 aa, Candida albicans
  UNSURE (14): Identity of amino acid sequences at the above locations are unknown.
KPFMINHLKILFPXEQLDKEFNGILDFEYIHDTYWPKMNEIADRKRANYMENFRRLGSKIGLSEYDLRLEQAAL

SEQ ID NO: 18528 - protein, 236 aa, Candida albicans
QIGGRKSKLAVVQSEIVKKVIEDTFPNLSCSILALSTLGDKVQTQPLYTFGGKSLWTKELEILLLDSVDEFPKLDLIVHSLKDMPTNLPEEFELGCIFQREDPRDAIVMKQGSSYKLLKDLPAGAIVGTSSIRRSSQLIKNYPHLRFELVRGNIQTRLNKLDQPNNEYCCLILASAGLIRLGLGHRITSYLDDMYYAVGQGALGIEIRKGDDNIKSILKKIEDPIATICCLAERSL

SEQ ID NO: 18529 - protein, 348 aa, Candida albicans
QSNFLTPTHSNKYAHTYIQIDTYSIMVTTEQIHDTSFPIRERMEALIRLKQQQITDAIAELDTVKFHTDTWLRGDNGGGGQSMVLQNGTTFEKGGVNISIVHGKLPPQAVERMRADHSNLKGSSKDGSVNFFACGLSLVIHPINPHAPTTHANYRYFETSDPETNEIQTWWFGGGADLTPSYLYEEDAKWFHQQHKDALDKFDPELYPKYKKWCDEYFFIKHRGETRGIGGIFFDDFDSKPADEILKIVESCFDAFIPAYAPIVAKRKDTPYTPEQKNWQQIRRGRYVEFNLVLDRGTQFGLQTPGSRVESILMSLPATASWVYDHHPEPGSEEDKLLQVLKKPIEWV

SEQ ID NO: 18530 - protein, 352 aa, Candida albicans
DLDLKAAKGEKVERPPIWIMRQAGRYLPEYHKVKGNRDFFETCQDAEIASEITIQPVDHFDGLIDAAIIFSDILVIPQAMGFEINMVEGKGPVFAAPLRTPDDLSRIDLKPDVNTKLAWAYKAITLTRTKLNGRVPLLGFVGAPWTLLVYMTEGQGSKMFRFAKEWIFKYPEAAHKLLQATCDACVEFLAQQVVAGAQMVQIFESWAGELGPDDFNEFSLPYLKQIAAKLPPRLKELGVEEYIPMTVFAKGAWYALDDLCDSGYDCVSLDWLYDPKNAVKVVNGRRITLQGNLDPGVMYGSDKVIAKKVKTMLEGFGKQNYIINFGHGTHPFMDPKKIEFFLQQCHKVGESL

SEQ ID NO: 18531 - protein, 247 aa, Candida albicans
SQVSRMHWVQLQMILKDQLLPRSKNYVKISVIYLSCVMFVICEYTDHGHCGILNEDGSLIREESVQRIAAVAVNYAKAGANSVALSDMMDGRIKDIKTGLMNAGLANKCLVMSYAAKFSGDLYGPFRDAAGSAPSHGDRKAYQLPPGGAGLARRALMRDMSEGADAVIVKPSTFYLDIVSDAAKLCRDYPICAYHVSGEYAMLHAAADKGVVDLKGIAFEAHQGFLRAGARLIISYFTPEFLEWLQV

SEQ ID NO: 18532 - protein, 170 aa, Candida albicans
DKLGIFLFFEKFSCQYFFLFCIVDIKIKKPTNHLMVHQAEFLPSTGNSISSVLQGGYNHPLSREWQQERQLTKNMFIFPLFITDSPDEETAIPTLPNIKRFGVNKLIPYVKNLVEKGLRAVILFGVPLKPGVKDALGTAADDPEGPVITAIKKLRENFRDLFIMCDVCHL

SEQ ID NO: 18533 - protein, 612 aa, Candida albicans
SQYLFFFFSTSQHNPKYLFFKPHYIFDSKSLIFINNRFRTLIVFLIHSFSSMTNLLTSNITTGETHLLIGYSAVSNTRIVSIIESGANPILITDSQPQNFPPNIMQYVTDNKLPVLIDKDFPTKIPHYLTTLGRAEVDSIVDRVYVSLPSSRLALKQEIYQRCRKLRIPVNTTDSPDLCTFTMLSTYTSGDFQLGVTTNGKGCKLALRIKRELVNSLPSDIDAICKQVGELIRQIQMEDKAESEHGEHEDDAINNHKFNSFVPEFNKTQEDLKLQRARWLSQIVEYYPLNKLGSISLKDLSSAYKLHKQANVPGAKEEDSEAGQMTLVGSGPGSVSLLTLGALQAIQTADLVLADKLVPQQVLDVIPTTHHTRLFIARKFPGNAEKAQEELLTLGLEALRRGEKVVRLKQGDPYIFGRGGEEFNFFSQHGFKPTVVPGITSALAAPVLSNIPMTHRDVADQVLICTGTGRRGAVPNLPDFVSSRTTVFLMALHRVVELIPLLVNDKKWDENLPVAIVERASCPDQRVIRTTLSKVGDAVEACGSRPPGLLVTGYACEVICKNSGSESLPWVVEEGCNSGDDGELKRIVELVNGNCKESTAVVSPNLQKEIAA

SEQ ID NO: 18534 - protein, 209 aa, Candida albicans
FISQRAVEMFKECIEELNHDIRQRIYQKIGYTVGPATYKILKSVGFKDVRGGDEAGNGSKLADLIKQDTIGRENIPMVFFTGVIRKDIIPRKLIDSGYNNFQEFILYQTGDRLDIIDNFKKVIHGLDKDKDNDDVWIVFFSPQGTKEIVNYLIDRDGNSNQKNWKIASIGPTTRDYLKDFDLSPHVIAPKPDPEALFETIFQYDKTYAL

SEQ ID NO: 18535 - protein, 363 aa, Candida albicans
EHFTNTESTTTHLINLIALIQMTSIKHPKPSTVSASSHGIRTPPTVSTSPDLDVNRIPMVTPKPSTNNLPVTTPQPPPAITQSMRNKSGLPDSLPHVKCLARARIPTTQGPDIFLHLYENNIDNKEHLAIVFGEDIRSRSLFKHYPGETQQDRMTRGAYIGRLTPGRTIADSDGTNELKFDKDGNLIIDSLTYTDPTLVRIHSECYTGETAWSARCDCGEQFDEAGRIMGEAGHGCMVYLRQEGRGIGLGEKLKAYNLQDLGADTVEANLILRHPADGRNFSLATAILVDLGLVEIKLLTNNPDKIVAREGKHQEIKVLERVPMVPLSWGKDGKNGIKNKEIEGYLSTKIERMGHLLEKPIKI

SEQ ID NO: 18536 - protein, 293 aa, Candida albicans
SYHTHSTTSAKSFILFFFLFLLKYFPLFYFTFFSSNRSMFKQVVSKNRIPIENSIASIRKMTLNSTSANPDTRREDPETTTQEPIIFAPATYQYTKGHLGDTEVDKDPLAQFNKWFKEAQDNLPANSDIIVEATNFSTARLPSGRVSSRIVLLKELDKYGFLVYSNWNTSKKAKDFELNKYASLTFFWPHVQRQVRVEGIMEHVTRETSERYFNTRPRGSKIGAWASPQSSVVQSRDDLDQIKDKYNDKFKDLQDHEIPCPDYWGGIRIEPLEVEFWQGGLSTLHDRFTFRRD

SEQ ID NO: 18537 - protein, 256 aa, Candida albicans
ARIRRLRGEDTLNSSSANPDTRREDPETTTQEPIIFAPATYQYTKGHLGDTEVDKDPLAQFNKWFKEAQDNLPANSDIIVEATNFSTARLPSGRVSSRIVLLKELDKYGFLVYSNWNTSKKAKDFELNKYASLTFFWPHVQRQVRVEGIMEHVTRETSERYFNTRPRGSKIGAWASPQSSVVQSRDDLDQIKDKYNDKFKDLQDHEIPCPDYWGGIRIEPLEVEFWQGGLSRLHDRITYRREKKEDPNWEIVRLAP

SEQ ID NO: 18538 - protein, 103 aa, Candida albicans
NMSLIPLPESLIPFLDPYLPNIKVTTTNNESLKRPFVTLTYAQSLDSKIAAQPGTQTKLSHLETKTMTHYLRSKHDAILVGIGTILPESSPRNSTDPPIIFGN

SEQ ID NO: 18539 - protein, 92 aa, Candida albicans
NCGISSGVVKIGIGAGPYTSGQVLVISDLLGMKDGHVAKFVQQYNNFFQQGVEGVKQYTKDVKSKKFPNPDTHGYKMKKDVLDEFKEIAKDL

SEQ ID NO: 18540 - protein, 284 aa, Candida albicans
IVVLFMQKKIYDRFRPIIFVISILNFFENCITLFLTPSSKLQLFLSTMFTGLVETIGTVLDYSKHDDSSTGGDGVSITIGNCSEILEDVKLGDSISTNGVCLTVTEFNLGKTLFKVGVAPETLRRTNLGDLKHGAPVNLERAVTSEVRLGGHIVQGHVDTIAKIVDKKPDGNAIAYTFELRDKEFINYIVHKGFIAIDGASLTVTNVDPSKVQFSIMLISYSQEKVILAKKEVGDTVNIEVDLTGKFIEKQVEINLTGQIENSDSPLNKLISSLVEKKVREYIK

SEQ ID NO: 18541 - protein, 218 aa, Candida albicans
YGVNPPNTNLTLRLQEIAISYNGGKDCLVMLILLMATIHKKFSSSEMNNPSVNILPPDYKLDSIYINSETPFPQLVDFITSSTEYYHLNPIIIQKSLKDGFEYYLNEVNPRVKSVIVGIRHSDPYGETLQYEQMTDHNWPKFLRIHPILHWNYVDIWDFLIGCDVKYCEMYDQGYTSLGGINSTVPNPLLKLPNGKYQPAYMLKEDADNNERLGRVKK

SEQ ID NO: 18542 - protein, 119 aa, Candida albicans
PTPFLYIYIMISMTNIFTPIEEALEAYKNGEFLIVMDDEDRENEGDLIMAAELITQEKMAFLVRYSSGYVCVPLSEERANQLELPPMLANRSDRHGTAYTITCDFAEGTTTVFRPMIKL

SEQ ID NO: 18543 - protein, 303 aa, Candida albicans
KRIMAPEYANLLPVSGNWKQKITDYLTEDVPSFDFGGFVVGNTPETGSLYMKQSGVICGIPFVNEVFHQCNLQHKWIFSEGQFVSDKEIASAGGKIVVCTVKGSASNILLAERTALNLLSRASGVATQSYKTKKLADESGYTGIIAGTRKTTPGLRQLEKYAMLIGGVDTHRYDLSSMVMLKDNHITSTGSITKAVKKAKSVCGFAVKVEVEVSNEKDAEEAIEAGADVIMLDNFKGEELRQVAQSLKKKFAGTNKSFLLECSGGLTLQNLSSYLSNDIDIYSTSSIHQGVSTIDFSLKIDAK

SEQ ID NO: 18544 - protein, 468 aa, Candida albicans
KIGVAGYPEGHPEEEDEQKTLRYLKEKCDAGADFIITQMFYDVDNFISWCSKLRKIGVDIPIIPGIMPISTYAAFIRRAKWSEIAIPQHFLDALDPIKDDDFLVRERGTELVSEMCNKLLQSGYVNHLHFYTMNLEKATVMILEKLNLIEAIKSHDVVGGSELPWRKSLHPERSKESIRPIFWQHRKYSYISRTATWDEFPNGRWGDSRSPAFGDIDLCASELLRQSPKKAFELWGLPQSLAELSGIIINYLKGDLKSLPWSDGPVGDDTKVIVDDLIYLNQHGFFTMNSQPALNAVKSSEKVFGWGPKNGYVYQKQYLEFFCHKDVVSKLLDHVEEFNVKGAESSSAFISYYAVDKDGNLSTNCKDDDINAVTWGVFPGEEILQPTIVEKTSFLAWKDEVYRLFTEWAKIASSNLVEANQTQVDEFVQLMKKFGDEFVLCNLVNNDFVDGNSTLFDLIKRLNIDDLN

SEQ ID NO: 18545 - protein, 507 aa, Candida albicans
NSVALCLFSSLFFFSLFCTTIKLIKWSMISRFVRTLATSAKFQDVVIIGGGPAGLTLLAALKTSPKTKHLQCTLIEGSSLDNVRKFHNDPPADYTNRVISLTPKSIEFMQNKVGSWDFIHEDRVKAYDGIIAYDSQDANSRIEFDISTIGQSTLAAMCEVINIQSSLLAKIESLQDKSTTIKDNTKVVEIVNPIEPDLDNHNLTEIDTNVSDPKLDWPIVKLENGETIQTRLLVGADGYNSPVRKYAHIESRGWQYNTFGVVATVKLQYEDFRAVGWQRFLTTGPLAILPLSEDNATIVWSSTPELADLLLKVNEKIFPHLVTAAMVLEEVDLNYIYSVLQEDPNDFSVLEDIEWRLSKFNPEELEERYPLPVVDVLSGSRARFPLKMSHADTYVAPRVALVGDAAHTIHPLAGQGLNMGQSDVAALVEALEKGIDRGMDIGSTLVLENYVANAWPSNHALLGICDKLHKIFSTDFYPLVWARGFGMKSINSFGAIKELMMKSISGR

SEQ ID NO: 18546 - protein, 109 aa, Candida albicans
THHKSTLNIHPIIIKTMSNPSHNPKHHLREEDSNGTQDGPKSTVPIKRSKLVGSSNLVSPNFLPRDLIETPLQTRAASPLTLNPPIDSDGLSWPSLGARILIYHTLKVL

SEQ ID NO: 18547 - protein, 165 aa, Candida albicans
LEGFFETPGRYARAMLYFTKRDMQIIFRDVIKRAVFEEDHDEMLLFRDIEIYSLCAHHLVPFFAKAHIAYIPNKRVLGLSKLARLAEMYSRRFQVQERLTKQIAMALSEILKPRGVAVVIEATHMCMVSRGVQKTGSSTTTSCMLGCFRDQQKTREEFLTLLGRK

SEQ ID NO: 18548 - protein, 420 aa, Candida albicans
LLTIKPTLCTKRELLSRLRNTSYPPIKNKLFVIFLFFFSLIFNVYTMSVKRFFSMNAKALRAFGSTVTSTASGFKPMPMTVSNAADTLAKARSSKPRSDWTKDEISKIYNAPLMDLIFNAQLKHREYQKPAEVQLCTLVNIKQGGCTENCSYCSQSSKHDTGVQAEKLDLDAVMDIARDAKARGGTRVCLGSAWRDMQGRKSALDKISKVVKQINDELKLETCVTLGMINEKQAEILKQNGLTAYNHNIDTSREHYPNVVTTRTYDERLETIKNVQKAGIKACTGGILGLGETAQDHVSFLYTLSNMSPHPESLPINRLVPIQGTPIVEVLKNAPKERQLEFDAILRTIATARLIMPESIIRLAAGRYTMKEHEQFLCFMSGVNAIFTGKRMLTTMCNGWDEDITMLKKWGLKPMESFTK

SEQ ID NO: 18549 - protein, 123 aa, Candida albicans
MLVKLFYSNGCRNEHDDFLYKQEWSEYASVLGDKFEMFNAFSRQDPSKKVYVQDKIVENYKIVNELLNNGATIYVCGDASRMARDVQAAIAKIVAKDRDISQESATELVKSWKVQNRYQEDVW

SEQ ID NO: 18550 - protein, 570 aa, Candida albicans
DHFDLMALDKLDLYVIVTLVVAVAAYFAKNQFLSKPQDTGFLSNDGAGGSSRNILETLKKNNKNTLLLFGSQTGTAEDYANKLSRELHSRFGLNTMVADFADYDFDNFGDITDDILVFFIVATYGEGEPTDNADEFHTWLTDEADTLSTLRFTVFGLGNSTYEFYNAIGRKFDQLLEEKGGERFAEYGEGDDGTGTLDEDFLSWKDGVFDSLKNNLNYEEKELKYEPNVKLTERDDLTVDDSNVSLGEPNKKYINSQGVDLSKGPFDHTHPYLAKITKTKELFNSKDRNCVHVEFDISDSNLKYSTGDHLAVWPSNSDENIKQFLKCFGLEDKENTVIELKALDSTYSIPFPSPITYGAVIRHHLEISGPISRQLFLSIAGFAPNEETKATLTRIGNDKQEFASTITRRKFYIADALLFASKGKAWVDVPFEFIIENVQHLTPRYYSISSSSLSEKQLINITAVLEAEVESDGRAVTGVVTNLLKNIEIEQNNTNETPVVHYDLNGPRNKFSKFKLPVHVRRSNFKLPKNTTTPVILIGPGTGVDPLRGFVRERVQQVKNGVNVGKTILF

SEQ ID NO: 18551 - protein, 202 aa, Candida albicans
VKTGVGGVAMAVETIKIITGYYTKDNFVPFLTSYSAYPRQQLRVFKMRKRQKDCAVCGENPQISQRMIEDGTINYKTFCGRATFDPIDDKFRVSPKDYDSVVQNKKKHILIDVRPREQFQITHLPNAINVQWDPTFRKADAIEQYLPDDSTKDDEIYVVCRFGNDSQLAAKKLIGMGYPNVRDIIGGLDKWSDDVDSKIPKY

SEQ ID NO: 18552 - protein, 133 aa, Candida albicans
LQIIFIDMSEPSKEELLARIAQLELENEQLKQQNGKKSQHEQFNKIDDNFSLDEYKRYGRQMIVPQFGSLESQIKLKNSKVLVVGAGGLGSPALLYLSSAGIGKIGIIDPDTVDTSNLHRQVIHNTEMGLHHG

SEQ ID NO: 18553 - protein, 84 aa, Candida albicans
NIRMTSKFDDEENIIKPQDGEAEDFQLLDVDQVLEKLHNKEFKPNCGLIIVDFLIRHGHITPENEPNYLEIVSRCHVAMPFATR

SEQ ID NO: 18554 - protein, 297 aa, Candida albicans
KPPWMEIDTRNQLWNLELAEELIYGDDFQPTFIVDCIDNLDTKCDLLAYCHEKKLPIVSSGGAATKLDPTRINLADISKTEEDPLMKKIRVVLKKRGIINGIPVVFSAEKPDPRKAKLLPLPDDEFTKGNVDQLSALKDFRVRILPVLGTMPGMFGLAIATYILTTVAGYPMEPVEGKNRYKIYDDLLQSLAGQQTRIGKTDQRVQIAMHEVNYILEEVFRGKSPISNYSTRLTLSRWDPSKEISFQNVVVMTKDEQRNHEKRVLNGGEKIEDVYLKEVVDLVKSRFEDEKYFSQFR

SEQ ID NO: 18555 - protein, 442 aa, Candida albicans
SWSQRPHPTPLPMPINLGLQRIAKLLGHLNNPQNAYKSIHIAGTNGKGSTLAYISSVLTEAKIKNGKFTSPHIINYHDCISINNQTYPKSKFDRINQQVIKINNDLNLECTEFEILTATAFKIFALEEIEMALLELGVGGRLYATNVLIPYGETIGTSKGSVVATAITKIGLDHEKLLGGTLLAIAKEKSGIIKYGIPCFVDSLNDSIVLQAIREKSREVSCPLSVVEPIQANDDNQFIKYSPLKGSYQANNLSLAVEILKSLPYRISEEILINGISKTNWPGRLQTIQHKSLGSILLDGAHNESAAIELGKYLNTKYRKQEPEANMLEGNHTPIILVIGMTKGKAIGNLLKHVMSENDIVIPTMFTQPENMPWINSELISTLTSIAKDYCRDVRNIGDDAHIHQVFQYLKNNKNDKLLENKPIVVCGSLYLCGDVLREIAN

SEQ ID NO: 18556 - protein, 316 aa, Candida albicans
  UNSURE (3),(7): Identity of amino acid sequences at the above locations are unknown.
PPXDIYXKVRVVGPSEVKTEGHNIVKQAEKLVSEGATIIDIGGVSTRPGSVEPTEEEELERVIPLIRAIRQSLNPDLLKVLISVDTYRSNVAEQSLLVGADIINDISMGKYDEKIFDVAAKYGCPYIMNHTRGSPKTMSKLTNYESNTNDDIIEYIIDPKLGHQELDLSPEIKNLLNGISRELSLQMFKAMAKGVKKWQIILDPGIGFAKNLNQNLAVIRNASFFKKYSIQINERVDDVTIKHKYLSFNGACVLVGTSRKKFLGTLTGNDVPLDRVFGTGATVSACIEQNTDIVRVHDVKEMKDVVCISDAIYKNV

SEQ ID NO: 18557 - protein, 583 aa, Candida albicans
CYHYEVLNWFQEGKKTIDSNSFLNRSNFLVIHEIFFFLNPLLHFLIQTLRPTFPPINNYNYFTILFSNFFKSAINPTINKQFRKAFHYSITMLKNDTVFTKDISCTAITGKDAWNRPTPQPITISLSFSTDFQKASELDNLKCSINYAVITRNVTEFMKSNEHLNFKSLGNIAQAISDIGLDQSRGGGSIVDVTIKSLKSEIRAESVEYKINRNTLGQPVPLDIFQVNKLRLLTIIGVFTFERLQKQIVDVDLQFKIAPNSNLYFHQIIADIVSYVESSNFKTVEALVSKIGQLTFQKYDGVAEVVATVTKPNAFSHVEGVGVSSTMVKDNFKDMEPVKFENTIAQTNRAFNLPVENEKTEDYTGYHTAFIAFGSNTGNQVENITNSFELLQKYGITIEATSSLYISKPMYYLDQPDFFNGVIKVNFQNISPFQLLKILKDIEYKHLERKKDFDNGPRSIDLDIILYDDLQLNTENLIIPHKSMLERTFVLQPLCEVLPPDYIHPISAESLHSHLQQLINDKPQETVQESSDLLQFIPVSRLPVKDNILKFDQINHKSPTLIMGILNMTPDSFSDGGKHFGKE

SEQ ID NO: 18558 - protein, 215 aa, Candida albicans
EIEMRAVFITGTDTDVGKTFISALLTKAWDANYWKPIQTGLESCQGDTETVQKLTNLLEDRFERPQIELNIPLSPWRAAIKENKPQTKVNEIAIPAKFLNSSRPLIIEGAGGLYVPINETEITTDLILHFDIPVILVARSGLGTINHTLLSLEHLKNRGIHKVYVVMNGPINTDNAEAIKRFSKGIKIIANIPHSKLNEIESLLSYVPSLDSIEK

SEQ ID NO: 18559 - protein, 150 aa, Candida albicans
  UNSURE (32): Identity of amino acid sequences at the above locations are unknown.
QLFHHLYLVHHHLVQEIKQSLTISSEFINSIXKLKPNDSIPASKGGWVDVRDVAKAHIIAFEHEDAKNQRILLNSGRFTSQSLVDIINDKFPDLKGKIPVDEPGSDKSVIAESLATIDDTKSRELLGFEYYNLEQSVYDTVEQIVNAHKL

SEQ ID NO: 18560 - protein, 346 aa, Candida albicans
NYFQSLSKYIRLGLAMSTTVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKELGLFVDVRDVAAAHIRAFELNEAQNKRLMLVSEPFSAQEIVDILHEMYPAVQLPLGHPGDKPNYKFNNIETKKILNTDFRSLRSSIKDDYDQYLRTHGIIS

SEQ ID NO: 18561 - protein, 267 aa, Candida albicans
QNHKEVGVFIHSASPIPFATDSVEKDILQPAIDGTKNVLTSIKKYGNENIKKLVITSSIAAVEPLGTGQTEPKTILEKDWNPITFEQGLANPAVAYYASKTLAEREVWKFVDENKNQLNFDVAVINPLFVFGPQAFGIKDKSAALRSTGEIINSVLKLKSNDPIPSLVASFIDVRDVARAHIIAFEDDDAIGQRLILDNEIFTKELIAHLIKKNFPSLDIPEGDIVKSEEEIANYPWRVDSTKTEKILGFKYISLDKSVVDTVNQLI

SEQ ID NO: 18562 - protein, 151 aa, Candida albicans
HEKKYKQPFIKYLNTSTQLFFNILSIHAQLYIAMTKVFITGASGFIAQHIIKLLLSKGYEVVGTVRSTTKGEQLKSFMPSDAKFTYEIVKELSTPNSFDEALSKHNDIEYLFHTASPLTFDTEDPENVILQPAIKGTENILHAAADLCPNL

SEQ ID NO: 18563 - protein, 62 aa, Candida albicans
KCCKRTHIIAFKKNVTQGESLLLAKDLFTTQSNLDLIRKDLPKLDSQIPKGDPPKTEDWKKI

SEQ ID NO: 18564 - protein, 352 aa, Candida albicans
SIKKYLHITTIMSSSTTVFVSGASGFIAQTLVKQLIEKGYKVVGTVRSNEKGDSLKENLKAAKLQSENFTYEIVKDIAVKGAFDDALKKHPEVTVFLHTASPFHFNVTDIEKELLTPAVEGTNNALQAIKTHGPQIKRVVVTSSYAAVGRFADLADPSIPATEESWNPITWEQSLSNPLAGYVGSKKFAEKAAWDFVEKEKPNFTLSVINPVYVFGPQAFEIKNKSQLNTSSEIINGLLNSKPDSKFDNLTGYFIDVRDVAKAHIVAFEKDSIQGQRLILAESPFSTQSILDLIRKDFPQLDSQLPKGDPSQADAWKKAESKIENEKTRELLGFKFIDFKKSIDDSVAQIIG

SEQ ID NO: 18565 - protein, 214 aa, Candida albicans
TSSDAAIYSNTDETNPTLSFNEGSWNNSSYQDALKDNITAYYASKAFAEKLAWEFVLMQKPVFGLVVVNPSWVFGPKAYDFDPKRFNSSNEMIDDLLKLNHENNSTFENVSGGYISATDIAKVQVYAIESDDLVNKRLLMTNGYFTCQQILDIINKHFPELNLPKGNPGTEAEEFKKLARVNNNATRKLLPWEFEPLETIVVDTVKQILESKQN

SEQ ID NO: 18566 - protein, 210 aa, Candida albicans
LLHLQPLNSGIDFDHDKYYTEKDGNPPTIEQKLSNPEAAYAYAKKMAEKTVWDFVETESPTFKVTVVNPTVVFGPQAFGVKDKSKLNLLIEMINDILTLKPDDEIPPYASRCIDVRDVAKAHLVAFEKEEAINQRLVLINQPFSNDLLAYIIKKSFPVINIPEGNLERSRECIAKSCIKTDLTKTQEILGFDYVPVEKTILDTIQQLYDA

SEQ ID NO: 18567 - protein, 182 aa, Candida albicans
SKIRWYVFYNSCSHKNSICPFNVHLITNILFPGSKLRIGILHARWNRKIIDALVAGAVKRLQEFGVKEENIIIETVPGSFELPYGSKLFVEKQKRLGKPLDAIIPIGVLIKGSTMHFEYICDSTTHQLMKLNFELGIPVIFGVLTCLTDEQAEARAGLIEGKMHNHGEDWGAAAVEMATKFN

SEQ ID NO: 18568 - protein, 221 aa, Candida albicans
MSKYIVENNIRKVIPYYTDFQTFVKKRWEARTIIDVYESDFGECQQNILDDIESEKLYIVTNSNKPTEQSILTGVETLIKRKLDEKDIICHTKHRHEPPIPWHNDIIKLVYEDDEILVVDKPSGIPTHPTGNYYFNSLSEIIKQQLNMDSIWTCHRLDKVTSGVLVLAKTKNGGVRFLKLMRDSKQYTEKTYLARVSGHFLKGILRLSKVPFLPSNMIGIF

SEQ ID NO: 18569 - protein, 424 aa, Candida albicans
YCIVLCMPIYKSGWVSPLKALETLSLTLSRGMKRAASPRAEQPPHSKKVVDAKGFRVRQQNIDKHKITSESTATQKSIHEEETEGANYVIEGRLRRVTPYFYTYLTYCKLRWQDRKLIDVFIDEFRDRTPDAYRMAVKERLVKVNSQVANLETILRNGDLISHRSYRREPPVSSRDIKIVFEDDDLLVIDKPGGIPVHPTGRYRYNTVTKIFEHEKGKIVHPCNRLDRLTSGLMFLGKLSKGANNMMLQIRDRNVTKEYIARVKGEFPLDRIIVDKPLSTKSPKLTLNVVDMEDGKDAKTEFQRVSYDPITNTSVVKCHPLTGRTHQIRVHLQFLGYPIANDPIYSSEFVWGKNLGENGEADLDQVMERLHLIGKSRAATSWIHPEGDGEVSLYEICPITGLPLFYPDPGFTPYGFIVGMLFLL

SEQ ID NO: 18570 - protein, 208 aa, Candida albicans
MSKYIVENNIRKVIPYYTDFQTFVKKRWEGRTIIDVYESDFGECQQNILDDIESEKLYIVTNSNKPTEQSILTGVETLIKRKLDEKDIICHTKHRHEPPIPWHNDIIKLVYEDDEILVVDKPSGIPTHPTGNYYYNSLSEIIKQQLNMDSIWTCHRLDKVTSGVLVLAKTKNGGVRFLKLMRDSKQHTEKTYLARVSGKFPEGIHRYR

SEQ ID NO: 18571 - protein, 111 aa, Candida albicans
SLRERAGEIMFTRENIPLFLEKLDKQEWGAYILMELINPPTHKNKIIRNNEVFHEDIISELGVFGTTVFNEKTGEILTNKNAGWLLRSKFSNSNEGGVAAGFGCVDNIYLY

SEQ ID NO: 18572 - protein, 146 aa, Candida albicans
KRRSFQPRGEEMLTRKNWAARLLLGDTLAIKCPSVLTQLSGTKKVQQLLTKKEVISKFLSNSSDQELNEVLSTFVAIYSLDDSNEGDTGRKLAFEEPEKFVLKPQREGGGNNVYKGKHSTVFGKIGQARVGCIHSYGVDKSANSQE

SEQ ID NO: 18573 - protein, 152 aa, Candida albicans
  UNSURE (134): Identity of amino acid sequences at the above locations are unknown.
PHTFIAKSLNYKKMSIKPFPELSHDQEKELVTNLSQWSLGNGLVMYPPNFEGFQANVAPITLFPTPIPKESFHRAVKVQKLFNELYINVITKDVKWFSSILEDLSKHDSEFTGRLFEVYQKLSKIQPLSLGLFXSDYMIHQDTNEIKQIEFN

SEQ ID NO: 18574 - protein, 239 aa, Candida albicans
  UNSURE (220): Identity of amino acid sequences at the above locations are unknown.
SITPSDSSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLXEKGGLSFYTSRLEGPRSGV

SEQ ID NO: 18575 - protein, 99 aa, Candida albicans
SYLHGREDLGLKKGVNYISYKNRLMFHKDNGSSPTPTCGLLPLSNKTPIILNSYGLKYDMRNWKTEMLGQVSSSNRISGETGFIVECSDDIVMNIEIDV

SEQ ID NO: 18576 - protein, 336 aa, Candida albicans
LFGHGSSTVVAILGDLRFSAEDILYLHRVLPQLPSDYLEYLADFKLVPSSQIKYLDNDEGDFELEIVGKWNDTILYEIPLLALVSEAYFKFVDTDWNYEGQYALAQKKAKQLISNECNFSEFGTRRRRSYESQEIVIKAIKDVQIDTQSKYIAGTSNVYFAMKYDLPPIGTVAHEWYMGIASITQDYVHANKLAMDYWIDTFGAKYAGLALTDTFGTDNYLTMFVAPYVNEYSGVRQDSGDPELYAEKIARHYEKMGIAKNTKIICFSDSLNVEKCLKYKNTADKLGLISTFGIGTFFTNDFNKLSNGEKSQPMNIVIKIKEANGKPAIKISDNIG

SEQ ID NO: 18577 - protein, 518 aa, Candida albicans
  UNSURE (11),(27): Identity of amino acid sequences at the above locations are unknown.
FIQHMNQTTEXDCMRINLQRTYKDAIXALNSLQSNFASIEATKKLGPSVNRNELSIYEVHEFTKRLGYTPTDFNILNIIHITGTKGKGSTCAFTESILKQYPISKIGLYISPHLKSVRERIRINGQPINQEKFAKYFFEVWDKFTTTKSDPQEWPTLQPCDQVKPMYFKYLTILSFHVFLQEGVDTAIYEVGVGGTYDSTNIIDKPTVTGISALGIDHTFMLGDNIASITENKTGIFKKGVPAFVSKQSEYPETHELIEKRAKQLGVSSLEFVDTEDLPNVKLGLSGEFQKQNAALAIRIANSHLKTIGITQDLPEFNNNDGKIKKLSNEFIKGLENVDWPGRCQIINNNPTGITWYIDGAHTIESINASSTWFKQEQLKLEKPKRRALLFNQQGRENYAELLEKLFNVTYGTGSEPQIKFDDVIFTTNTTWSSGQFNSELISKNTSEDAVKKLEVQNNLSEVWGKLDGGVSKRHVFADIETAVNYLKDLGDEDLQVFVCGSLHLVGGFLVVLDNERD

SEQ ID NO: 18578 - protein, 175 aa, Candida albicans
  UNSURE (162),(164),(172): Identity of amino acid sequences at the above locations are unknown.
CMTLSKMKVDYTLYLVTDSGMVPESSSFLKQVEDSINSGATIVQLREKSLSTLEFIKRAEQVHKLTQKQGIPLIINDRVDVALAVNAEGVHVGQDDMPAAIARKLIGDDKILGVTCSNVTEVQEVVEQGIADHVGLGTVYPTNTKKDVTDPEGTGPSGTRSXSXRAHEPRSXYGG

SEQ ID NO: 18579 - protein, 364 aa, Candida albicans
IKGYHFYTLNLEKAVASILDKSDVLRQVLEGPSYATRFEDAVASDSDDEDEPEKASERDITLTKTIKPRRVSSINDNELTSSKALVGKALLNDKKVLVDISTGKGALGKDAIWDDFPNGRFGDSNSPAYGEIDGYGPTLKIHTPAEASTKWGTPESIADLTQVFINYLSGKVDVVPWADSSLSPETALIQEELFQLNEKGWFSVASQPAVNGCKSTDNIFGWGPRNGIIYQKSFIELFMPKEDWKKLLLKIELDKTVTYYVGNKDGEIKSNLPIGPNVKLSKNAVTWGVFPLKEVVQPTVIDYESFKAWNEEAFLLWLEWARCYKKNSKSFELLNSIYENYVLVSMIHHDFINENALWDLLLDE

SEQ ID NO: 18580 - protein, 273 aa, Candida albicans
LNADPAVRGEEMSPVMENVNMESFKDSVNAESSKPSESDMKFYYQRLLPFRYIFQWLSHSPKPTKDFTMREFAYEYRSKIYQRYNSFGTLEEFKKSVVTANPTRFEIGAVYKINPKERKNLPKQAFKPESKELVFDIDLTDYDDIRTCCQGTDICCKCWKFIQVGSKIIEAALREDFGFEHLVWVFSGRRGAHCWVSDKRARELDETSRKAIIDYLDVLSSKNQNGSLNIKKPFHPHVERSFEIVKKEFLNVILQEQDPWNTTSEETKAWKPS

SEQ ID NO: 18581 - protein, 211 aa, Candida albicans
FYKNKIHGIPHRKRPRPGNQVEELLAFIPNKAWQIELKTKWKGQTFGSTSKEKWGDISTVASNVLKSNSQVAQLTEAKKDIIIYYMYPRLDVQVSRQVIHLLKSPFCIHPGTGNVCVPFDPLKNISGNPADDDYGFNPKSAPNLRKIQNELEEWEQNRSDENDSQEKVIADYEKTSLKPYIDYFAKFVNNLLKEELKGTEKRSREEDPLSF

SEQ ID NO: 18582 - protein, 369 aa, Candida albicans
IHHRINLGQKITSGKRKTNLHQQLFNSSGNLIKNQFMLQGENLTNDQLKQFIMYKENFIKLPFEKITGNLISNRSIFLFKGYGYLPASLQLNLLSIEFINILNDNLIKTFQTIPRLEEDDRLLPLLNNLSKNFSNFQYESEINKLDEEFISDINSKLIITPKITKHYPLCAQHLQRNLIANSHLKYNGRQQLGIFLKGIGLNVDEALKFWSSQFIKNNSMSLETFNKDYKYNIRHQYGLEGARINYKPWDCSTILSKPRPNIKSEYHGCPYRDFNLDVLINNLNNMGITDQQDLNSIVDDVNKHVYTIACTRVFELTHQKQLMGKENMNMHINHPNLYYDRSRQLERSETKDKEFVNTGSSSSSSSTDS

SEQ ID NO: 18583 - protein, 220 aa, Candida albicans
RVKFYFLFFFYFKQQTTNNKTILLLFISTHFYLYIMFRQVKRRTAGRRNFEDSTSTATTTTTTYTNGEKDSPKYLTPSALYASRLSFYDLPPTQEITLEEFETWAIDRLKILIEIESCLARSKTLKEIETSIKPLLLKYLPLNPTSGGGTVNYEKERMKDHYSHFILRLVFCRSEELRKNFITNELTLFKVRYNLLQPKEQQEFIELILHHAGWTDTRLS

SEQ ID NO: 18584 - protein, 260 aa, Candida albicans
LRRRGMLSEKSTPTKGKTYLQQLLPTQAGNAPKYIRVTESPQIRKSPIKSILETLLPIKVTKQEPVYEESQSYDTSVLNELPSSIKESVIRDVEYKEKIKKFDLVSMRDKLAQKLENKKVPVNEVTSDWLKSQEKLNKTPLFLNEQLKDNELSVKLDDWVKSSLLQGGPHEEDMDYFALFVQTMLQRDQFNRVLLLLRRLKERLKYHKTLINCQVFNEEEYLVYEESFEDWYKQLDNKVQPLVDCYSKEKKIQVGYIGVV

SEQ ID NO: 18585 - protein, 860 aa, Candida albicans
FNQLLETLMDNDQENANSEEYPSFLRSLDDESFITHIQDLNKQHLQKNRQDYPFEHVSTPKKMASFNSAISSDPFDDGLDEEIINHVNKIDDKKALSGDEDDNNKETVGKLHEFGDYATYFHSKRLKQQKQDEEYVKWDKKRRKLQNVEYEPKQIFKGCSIFVNGHTNPSITEIHRLVILHGGQFVSYMVNKSSVTHIVCDRLTPRKSIQFKNCRVVKAQWIVDSVAQQTLLDWTLYRLILEVAYDQRRLDFAKQLTIEESKEINGECENNKEEDLDGEINSSLFGEDNADFLDKLQELETFFEKREGLVQEPEEDLPVVTDEPPQSGKGIHKVNNKYVLDARHPDFLPNFFANSRLHHLSVWKADLRLKFLRRIVKERLHQPASHFQNPFIDPGEKKVIMHIDFDCFFATASCLKRPDLDLSKHPIAVSHGGKTSDIASCNYVARKYGVKNGMWLMQATKLCPDLILLPYEFESYEKFSSEFYNYLLTSKFFDSIFPVLIDEVLVDATSYCHSGVSDSVSLVNELATRIRKDVFKLTNCPVSVGASTNVLLAKLALRKAKPNGQFYLFDDIEKFLESIYIKDLPGFGRGILEKLNSEIQFSNPQIKDVVTILKQRLVQLLGEKTGTKLFEYARGMDETSIEIDTNNPEAVLGRKSVSVDVNFGIRFDTVEELDDFLMRLSRELYQRLVSLGICGSSLTLKLAKRAEGASINPPKFLGMGRCDFVNKSSKLGVPTNDWGIIGNEVKVLYRMVNIPVKELRGISITISKLVDAEGVKSNKQMRLPFKKAESNALSVRDLKQLQKMSDSKDNKSQKLIFSKQLPEKRHVNKVLILHEFADFKSLDWEVFHVLPDEIKLELKV

SEQ ID NO: 18586 - protein, 514 aa, Candida albicans
  UNSURE (441),(481),(492),(511): Identity of amino acid sequences at the above locations are unknown.
YFLALPLTTLLKTTHESSKKKFSGCSFFFFTFSTPTMNVLVYSGPGTTTEGVKHCLETLRLHLGSYYAVLPVNETVLLNEPWMRKTSLLVIPGGADLPYCNVLDGNGTRKISKYVKQGGKFLGLCAGGYFGSARCEFEVGNPTMEVTGPRELGFFPGTAKGCAFKGFKYELRTGARAVKLLVNTAALPGCASHIYNYYDGGAVFANAEKYKDVEILARYDDKTDIVDLEKAAVVYRKVGKGGVILSGTHPEFAPHLLHPRDEDGAGYFIVVDTLRAYDHNKKVFMRDCLKKLGLRVAESVDTTIPRVTPMYVVSPFKDKVRDVYLILTSKLGKLFEDSNDAFYFADETQETSEYVGSEEDPVKYINFLTLAGIPDLKMVPYFDIQKYFDNLRMLSGGDIKFGSILGYSEVITSTNTIMDKNPQWLEHLPNGFTITATTQIXGKSRGGNVWVNPRGVLATSVLFKIPPSPSSSSTVVTLQYXCGLALIESILXYGNNVSGQGVGYENMPLKXKVG

SEQ ID NO: 18587 - protein, 181 aa, Candida albicans
NQKYFKSLDDKSDISATVDGDDEKFVKVSGALINSQFINKTFYLVWGGGVNVSNPAPTTSLNLVLEKLNEIRRGKGLSPLPPYEPEILLAKLMFTIDQFYSVFEKSGLQPFLPLYYKRWFHTNQKVDVDNGSGKQRTCIIKGITPDYGLLIAEDVETKKVLHLQPDGNSFDIFKGLVYKKN

SEQ ID NO: 18588 - protein, 442 aa, Candida albicans
VDNLFSRMLLPPHQASIEQYNIVKYIGGSGPYIQNSGYGISTDIPEKCTIEQVQMISRHGERFPSKGDGKYFNSVMEVFKRYGEFHGDLSFLNDYEYFVTNPDYYEKETTPKNSKGPYFGTTNLLRHGAYFRKRYQSLFDQKEKLVVFTSNSGRCYQSGVYFARGFLGDDYSEDTVEFVVVDEDKKMGGNSLTPRYACKTLNQDLHKDLVNQYDKTYLDDILSRWLVDNPGLDLSADQVSSLFLWCAFEINVRGYSPFCNLFTKDEFIRSGYRNDVGNYYQTGPGNNMTKVIGSPMVEASLKMLQEDSKIWLTFTHDTDIEMYLTSLGLIVPPGDLPVDRVPFPNPYNAAEFFPQGARTYTEKLKCGEKQYVRFIVNDAVYPYPDCSGGPGFTCELNDFIKLVKSRLHDVDYKLQCEVDGPAELTFYWDYKDRKYNAPLIDQ

SEQ ID NO: 18589 - protein, 497 aa, Candida albicans
IEPYKSIIIQLKDYFLFPFLITFTNFLLSKKNTFFMVSVSKLINNGLLLTSQSVFQDVATPQQACVQQYNIVNFLGGSAPYIQRNGYGISTDIPAGCEIAQIQLYSRHGERYPSKSNGKSLEAIYAKFENYKGTFKGDLAFLNDYTYFVTDKNNYEKETSPKNSEGTYAGTTNALRHGAAFRAKYGSLYKENSTLPVFSSNSGRCYQTSRYFARGFLGDDFEEGKTVKFNIISEDADVGANSLTPRSACSKNKELSSSTAKKYNTTYLNAIAERLVKPNPGLNLTTSDVSNLFGWCAYEINVRGSSPFCDLFTNEEFIKYSYGNDLSNYYSNGAGNNYTRIIGSVILNSSLELLKDTKNSNQVWLSFAHDTDLEIFHSALGLLEPAEDLPTSYIPFPNPYVHSSIVPQGARIYTEKLQCGNDAYVRYIINDAVVPIPKCATGPGFSCKLDDFENFVKERIGDVDFVKQCGVNSTYPSELTFYWDYKNVTYNAPLGDF

SEQ ID NO: 18590 - protein, 404 aa, Candida albicans
DAGCEIAQIQLYSRHGERFPTASSGKDYEKIYAKFKNYNGTFKGDLSFLNDYTYFVKDQSNYAKETSPKNSEGTYAGTTNALRHGAAFRAKYGSLYKENSTLPIFTSNSNRVHETSKYFARGFLGDDYEEGKTVKFNIISEDADLGANSLTPRSACSKNKELSSSTAKKYNTTYLNAIAERLVKPNPGLNLTTSDVNNLFSWCAYEINVRRSSPFCDLFTNEEFIKNSYGNDLSKYYSNGAGNNYTRIIGSVILNSSLELLKDTENSNQVWLSFAHDTDLEIFHSALGLLEPAEDLPTSYIPFPNPYVHSSIVPQGARIYTEKLQCGNDAYVRYIINDAVVPIPKCATGPGFSCKLDDFENFVKERIGDVDFVKQCGVNSTYPSELTFYWDYKNVTYNAPLGDF

SEQ ID NO: 18591 - protein, 354 aa, Candida albicans
LNNNNLIMSKTVILTGASGYIGQHILGELLDQNYKVIAIVRSQKSSDTLSKLFKQTPKLQFEIVEQFDKPHALDKVLEKHKEATIFISTAAVVTFHAEDYERDVLDPAIDLVKNIFSSIKEHAPQITRVILTSSSASVVGLDKAFSYDAEYSDNDWSPFTREMSTLDGTMAYFASKKWAEKETWKFLKEEKPNFDLVVIMPALILGPVRFSSELKNGKFPSTSGIIGGLLHLKSDDPIQPMAAGAVDVRDVAKVHVDVITSEKASNQRILVESGKVTNDNIIQTIIDNFPSYKDKLPTPNPVPHSKFVKPKDERSRKIIGFSLRSLGDSVVDLVKQIDQENSVIESIKKLDIKK

SEQ ID NO: 18592 - protein, 181 aa, Candida albicans
LKLWRNCVYVSVCVDNFLGFTIFFLFRLALIHIKDSTHQITFTTIQLTMTNLPLKEVKRQLRKQLKSNLKTITQDSLIKQSHLIHQNLLSHEFFKTANNIAVFMNMPDLEVKTMEIIESCFKLGKSVYLPRCNYVSSPGRKSNYMSLLEMPSLEAIHQLKPQGKYQLLEPLLFTTRLENHA

SEQ ID NO: 18593 - protein, 206 aa, Candida albicans
KILFYGYFVSKTFAEKEVWIFLQIENPKFNITTINPGMVLGPQAFPINNHNGGGAGAGGTNNLELNTSSQEIVRLLNLSTVDDVNKVKISTKVENTFIDVRDVAKAHIIAFEKPQLTKNKRLLLIEDIYNEQTLLNIINNNFPQLNLPKGEPITGQIDESKLNNTWNTTQTKTIFGDKYIGIEKSVIDSVNQILEAKNEGNPQCKL

SEQ ID NO: 18594 - protein, 124 aa, Candida albicans
EVIISYKFDSISPLFLVNFYSFISSINQLLKKMSTPITVIVSGATGFIAQHVVKQLLAKRYQFLVPLISQPKGNFFRIIPQSQKFSYEIVEKIGTKGALKNFSQNPEKQNFLTLSFHIHLKLRD

SEQ ID NO: 18595 - protein, 84 aa, Candida albicans
ISSYFDWLASFQYFFFFIILPFIYLSIMTDKTNFPTTVFVSGASGFIAQELIKQLIIKGYNVIGSVRSTTKGESIKSNLTSSST

SEQ ID NO: 18596 - protein, 360 aa, Candida albicans
TTQSIKMTPPTMLQTAPVESFNLNPKSTQQAINLKSDAKNGKVSFADWNEFKFAPIRESTVSRAMTRRYFADLDKFAESDIVIIGAGSAGLSAAYTLGKNRPDLKIAIIEASVSPGGGCWLGGQLFSAMVLRKPAHLFLDDMGLDYEDEGDYVVVKHAALFMSTLMSKVLQFPNIKLFNATAVEDLITRKDPATNLQRIAGVVVNWAQLDHDTQYCMDPNTINCNVVLSTSGHDGPFGAFTAKRLEQLGRAPRDVTAGFTKPSITTSKLQEPEPISNFQLGGMKGLDMNKAEDAIVKGTREVVPGLVIAGMELAEVDGSNRMGPTFGAMALSGVKAAESVLNVLELRKQQNEACYGAYKG

SEQ ID NO: 18597 - protein, 245 aa, Candida albicans
LKKIWWHYHLKGLRVLAFATKDLGDADISNREQVESHLIFQGLIGIYDPPREETAPSVKLCHRAGINVHMLTGDHPGTAKAIAQEVGILPRNLYHYSEDVVKAMTMTANEFDALSDEEIDKLPVLPLVIARCAPKTKVRMIDALHRRKKFAAMTGDGVNDSPSLKKADVGIAMGLNGSDVAKDASDIVLTDDNFASILNAIEEGRRMSSNIQKFVLQLLAENVAQALYLMIGLAFIDASGYQFSH

SEQ ID NO: 18598 - protein, 129 aa, Candida albicans
IPFASMTWQALILAWECLDPKKSLLLIPFSELWANQFLFWSIVGGFVTVFPVIYIPVINTKVFLHKSITWEWGVAVGTTALFLLGAEAWKWGKRVFARSSKAKNPEYELERNDPFQRYASFSRANTMVV

SEQ ID NO: 18599 - protein, 309 aa, Candida albicans
  UNSURE (283): Identity of amino acid sequences at the above locations are unknown.
FMMIFSVPIPVGDRLNLIYSSSIVSKGRGSGIAIGTGLNTEIGSIAKSLQGDSGLIRKVDKSNGRQPQKREYFHAGLGSIYDIVGNILGVTTGTPLQKRLSWLAILLFWVAVVFAIVVMASQKFHVNKEVAIYAICVALSMIPSSLIVVLTITMAVGAQVMVTKNVIVRKLDALEALGGIDNICSDKTGTLTQGKMIAKKVWLPNVGTLDVQNSNEPYNPTIGDVRYSPFSPKFIKDTDEEIDFNKPYPDPMPESMHKWLMTATLANIATVNETKDEETGELXWKAHGDATEIAIQVFTTRLNYGRESI

SEQ ID NO: 18600 - protein, 255 aa, Candida albicans
YLKINGATKINEKNGSSVSESYENESSKKSIYDNTQNIEAYRLTVENVAQEFTTNIINGLSTHDAAKRLQTYGPNNLGKEESISYVKILAHQVFNAMILVLIISMIIALAIKDWISGGVIAGVILINVVIGFVQELKAEKTMGSLRNLSSPTARVTRNGDDLTIPAEEVVPGDIVHVRVGDTVPADIRLFDCMNLETDEALLTGESLPVAKNFQIVYDDFFCANTCGGSFEFDLFFFNRLKGKRVWYSYWNRIEH

SEQ ID NO: 18601 - protein, 157 aa, Candida albicans
RRGDLGVNCNSIDANTDTCSLVFKGRSAAFSVMTWCALVLSLECLHPRTSVFRFPTQDLWANQFLLWSILGGIVSVFPVIYIPVINTKVFLHKSITWEWGVAIGCTLLFLLRAELWKWGKRIISRTAKASNPEYELERNDPFQKYASFSKSNTMVVV

SEQ ID NO: 18602 - protein, 258 aa, Candida albicans
TAVAAPFTSKLANVNTVTHIIRQGRVALVSTIQMYKILALNCLISSYSLSVLYLAGMKFGDGQATISGILLSVCFLSISRGRPLEKLSKERPQDGIFNIYIMGSILGQFAVHIITLIYITREIYILEPREPKVDLEKEFSPSLLNTGMFLLQLAQQVSTFAVNYIGLPFRESITSNKGMYYGLLGVAGLTFSCSTEFIPELNEVMQFVPMTIDFKTKLTGCIILDLVVTFAIEYVLKYFFMNSKAADIALREEDEVDA

SEQ ID NO: 18603 - protein, 687 aa, Candida albicans
SGDIEKMIRNYGSNRFDIPILTFMELFKEHAVAPFFVFQIFCVALWCMDEQWYYSLFSLFMLVSFEMTTVFQRRTTMAEFQSMGIKPYDVYAYRDGKWVKIPTTDLLPGDLISITRTNEGSALPCDLLLVDGSAIVNEAMLSGESTPLLKESIKLRPADEQLQPEGFDKNSILHGGTMALQVTKPESPIVPVAPDNGAFAVVTKTGFETSQGSLVRMMIFSSERVSVGNKEAFFFILFLLIFAIAASWYVWVEGTRMGRIQSKLILDCIIVITSVVPPELPMELTMAVNSSLSKLQKFYIYCTEPFRIPLAGRIDVCCFDKTGTLTAEDLVFEGLAGFKNDDIHHLHICEDAPETTSYVLGSAHALVRLDDGEVVGDPMEQATLKAAHWNVGTHDTVERESKKGKGKSEKIKILRRFQFSSALKRSSTISQINTISGKNFVAAKGAPETIRNMIVDAPENYEEIYKSFTRSGSRVLALAYKYLESSVNVNKVKREDIESDLHFAGFIVFHCPLKDDAIETIKMLNESSHRSIMITGDNPLTACHVAKEVNITTKEVLILDAPEDHHEIGEYDNLVWRNVTESVVIPFKSSDKINLELFSKYDICITGYALNYLSDHEQILELLKHTWVYARVSPTQKEFIITSLKDAGYNTLMCGDGTNDVGALKQANIGVVLLNGTSSLRHWKVSA

SEQ ID NO: 18604 - protein, 223 aa, Candida albicans
NFLSYKRDTKKKIERRKKFQCFVGKKKNLTEVRFCHLVFFNILLLSSIQYDQNLTLYQTMSDLVANPAIQGAELLVPKAVFLRPYVWPFSIIYPIFLQIYFQQYDKYIGGKEWTFVYTIAIVSVNLLFWLMPHWNIDINAKFNYTKVDKISDASYIKITPAPNSGMGEICEINRETFHDGEKQVSFLYQKRRYLFHSKIGKFSPPEFVFDEAPKLAVYQNTKG

SEQ ID NO: 18605 - protein, 1013 aa, Candida albicans
KHDTMHQSLQDRHQLIIFVHSRKETFTTAKYLMEKLDIDIVEQEGVKEILKQEGESMSNPKLKEVIPRGFGIHHAGLTKKDRGVVEDLFAQGYLRVLVSTATLAWGVNLPAHTVIIKGTETYSPESGAWVQLSPQDILQMLGRAGRPRYDKNGEGIIITSQDEVQYYLAILNQQLPIESQLIHKLVDNINAEIVAGSITTIEEGIEWLTYTYFFVRMLQSPALYGVEATYDFTNDPTLYNRRADLIYTAFCILHENKLVVYNAALGSVASTELGKIASHFYINFETINLYGKMLKPWHSETDILSVFSNSGEFKYVPVRQEERLEISKLMEKCPIPIKEQPNEPLAKINILLQTFISRLSLEGYALIADMIYITQSAGRLLRALYEIALLQKWSSLAKSILNLCKMVDKRLWLNNSPLRQFGDVVPHQIIRASEMSHLPWIRYFHLNPDELAVALNLKGNAQIAKQYIDSFPKVSIQYMVQPITEQFLRIQVEVIPEWSWILAIHGSQEIFNVFLEGCDGNKLLHSEQFIVKRKNINKPHILEFFVSFVAPPLPNYILSFVSEKWVHCTWKSSILLSNVISPKVSPHYLDNNVDLVPTETVGDLFPFTHFNKLQSSTFDTVYNSENNVFIGSSKGDGKTVLAELAILNHWNNKKGRIVYINPCQELVDKLFKKWSTFFLSYEKEINVLSGNLREDSASVNQSHLILATPEQFNCLSKRWKTRKAFRSIDLFIWDDLHLVGSDVHYEMLVTRVRMLTSQWDDYKLRIVALSSPVLNSRDIAEWIGVAKLETFNFAPHSRENRITEIKLSVESSDNTVKIYKDLAKVNSGLRNTLIFAPSYIHAFEMAHSMVENNQAQEWRSVDLLKLEKYILKIQNPLLKNLLPKGIAVFYSGMARVDRLIVERLFESKSIGVLFCTMDTSKFAPTANNVFVAGTRVYDGHEHRFLDYPLNDLYEMVGCCQDGGVVHIYTTSQMVEFYSSFLNLGLAVESLLSNSFHDFSRTAYSTHRGDPCRK

SEQ ID NO: 18606 - protein, 544 aa, Candida albicans
  UNSURE (544): Identity of amino acid sequences at the above locations are unknown.
PQLSPNQRTTRMSNNVIRQQRDRNHEEEIPASSMTGRISKSDMRSNYKSSPAPAQLNKPPRKEPESEPVDDQLYELFVTKIRSYLPDSSHEVIQSASEVASEQLSNRDISVPEKRKELEELLNASISDDDLHELINLSNSIESAKQNHQQGNGDDECVAIDFNSSDDEEQAIEAEIEVEDESDEEADTEEPTSNEHPKAYDWHWLQQISEFKHYGSQVFDLSADKDLDLLQLDSKLNELLDSKGMDFIVKCIEHRWRIVFSKRLQTENKEPVIKEMEELGLHSLINELHRKRLLDDETSNPLKRQKKVKRVPQKISLDRIVFSTSVENARVTLPEGTIHEVKKSYDTITVPAPAQSLSDNDELLPISTLPDWAQEAFPKTETTTFNRIQSKIYNQAFETDNNLLICAPTGAGKTNVAMLTILRTIENFRNNGHIQLKNFKIVYIAPLKALVQEQMREFQRRLTSVYGVVVNELTGDLSLSKQQIAETQIIVTTPEKWDIITRKDPSYVKLVKLMIIDEIHLLHDERGPVLERLVSRSINRHHGX

SEQ ID NO: 18607 - protein, 570 aa, Candida albicans
RKRVKIWQNAVVIKSKIKQWYEVLNRNSSDALSIESKLVRALGLRVGDLVRLHKDVRIPADMILLQSSELTGEVFIKTDQLDGETDWKLRIACAATQASQNTKQIVDSVSVIVGNPSKSIHHFNGQLIYKSPSTTGSASPISNNETYALSIDQTLWANTVLASGTAVGMVIYTGIETRQLMNTTKTGVKTGLLELEINGLSKILCAVVFILSLVLVLAHGFPLKTAWYLDIMRFLILFSSIIPVSLRVNLDLAKSVYASQIQNDSSIAGTIVRTSTIPEDLGRIEYLLSDKTGTLTQNDMELKKLHLGTVSYAGDAMDIVTDYVKVLLKHLDSGQKKKDLSSRVCELVLTLALCHNVTPTYDDDEDVGFGEVTYQAASPDEIAIVKFCELVGLKLYKRDRHSITLLHVYTNKFLEFEILYNFPFSSETKRMGIIVKDKNREDIWFMQKGADTVMSSIVSSNDWLDEETGNMAREGLRTLVIGKKKLGSKLFEDFVDNYKQASLSMHDRDSDMQKVVSYYLEQDLELLGLTGVEDRLQRDVKTSIELLRNAGIKIWMLTGDKVETAIFTTG

SEQ ID NO: 18608 - protein, 272 aa, Candida albicans
PTIVLLTACVKNMIQCADVGVGIVGKEGKQASLAADFSIDQFCYLSKLLLWHGRNSYKRSAKLGQFVIHRGLLISVAQAVYSISSKFEPLALYQGWLMVGYSTIYTMAPVFSLTLDCDIDEHLTKLYPELYKELTLGKSLSYKTFFMWVFISLYQGCMIQLLSQRFQTLLDKRFTAMVALSFSCLIYNELIMVAISINKWNKIMASTIILTFLAYIGSIPFLLEYFNLTYVSSFSYIWQVGLLLVISLFPVWLVQYLNRRLRPPSYAKVQQD

SEQ ID NO: 18609 - protein, 224 aa, Candida albicans
  UNSURE (220): Identity of amino acid sequences at the above locations are unknown.
NIQLIHITLPIFILSMMLTSNQVLDKILESLNANQRKAVTAPCNGRLQIIAGPGTGKTKVLISRVAYLLISENIRPDNMIVTTFTKRAANEMIERLTKLVEGTDINIDKLIIGTFHSICFRIIKKYGKLIDLENYTIADERDKSYILKTMLTNLSAKDIERLDSFGEESLQKLRSHKANEKYHGLDLSVILKKISSLKSNCISHDVYSGKLKRNPALAFXYEKY

SEQ ID NO: 18610 - protein, 452 aa, Candida albicans
LECHRLVENFPVLNYIKHVLVDEFQDTNEIQLRLMYHFAKGNTNGDPKYQNNVTIVGDPDQGIYAFRDAQSINFEKMSTYYTKLNLSLDKISLNENYRSTSSILNISESLMNQQKGRMPKMLKSQLDSSIKPVYSCLNSAKEEAKWIVYQISHLLSLPNSAVQEKDIAVLFRAAYQSRALEDELVKRGLSYKMIRGKAFWDRQEVIAIMDYMKVCSDEYEQAAVIRTLNYPKRGIGSKTLENIEKIIEKRVKQGKSVHQCLLAMTKKSEEPEIKLTKKQIQGVEEYYTMITKVKKKLYEMEALSGEDMTNTAKELFDLIYESSKLKQEFENDEERSKRLNVEEVGNLLVQFKPKDEILPDYIGGDIEDDDAVDEGDRNFLAQFIESVGLYETNDEVEKNGSESTGDDTAKEEKLCISLSTIHGSKGLEWPVVFVQGLTDGLLPAFHHGVTIR

SEQ ID NO: 18611 - protein, 1049 aa, Candida albicans
  UNSURE (760),(781),(1022): Identity of amino acid sequences at the above locations are unknown.
PMDHHTGNTVPESRPYEESARIPIRFDAEAPRKKLKPNTPNNERKNSKKSPDNTVANNQQTASENEVTITLSELNMLKQRLQNIEANINAQSNPQSNPLYVPQTPAYPTQPNILPPPVLFNSWSPKQSNERVMFSPQQRLTTNYNVSHTRGQSPSIQLPPLSFKDTPRASIDSAPLYSEMSPPRSDLIASSLTSPESIQMSVSGDVVGVNPYLNETETINFYDGYTSICVRDFRRVNHGPFAWSSLMRKDKALSSLWNHILKKKEKKNVASQTFVFGQDVHEISQENTQLVASESHESDTKFKKKTLETFGFNDVVPYDILKKKLQTQINKTTLPLGLTLYEEQVNMELQLVDRIHQQLPKKKVLWKLIDRFFSLLYPFMPFLDEIDFRESVTKIIGETEYKDEKIKELKVEKRLDLAVIGVLLIILRMSYLSLFCNKESVNEMRLKTTDPSPEAQDMKYLLQNPIGISLIDSAQNCLQYFDIFRKTSMPVLQCAYFLQLYHIFAPEDGDDGDGADTYALNSMVVRMAYSMGLNREPDNFKDVLNDKRQNHLGRKIWHFLVIGDVHNSYAFGTPKLIGDDFYDTKVPFIEEGNENLIDKSLDQYVTKLVFPGYFLIYNSVDQILKLILSVSRRLKVSEICKILNQFEIGIAEQYGTLSDCLKPKENLIHIFARNMPVKMYISLKSFLVSVYFHLFLYYEHKNDSLSFFYLRKILKTGAGDIMPHYFELLGNSEVVCDMVINPKLIQIIHKANQINIALIXRVNMSIYRMKNLQHHAENCKXDDFYYSYYKELCKFSSCLTRCAEVGIAAVSKLSTRYYYAWKITKGHNFLLKTITSMEFYEKESTNAQEITLPKYKLEQIADLENICEVALNKLGKTLVMGDEFCSNVNYKKYKGDQTYSTSSESSSTPNKDSPLDSRKYTNDFGLDLVNNQEIDKIWLQMLSLKSEEAQQQRQQELQPFTSSQSQSQSPLTLANQGYMPRPELRRGSYYGNTPFALENLNFDGFGGTSKSSNHGEADLSSXEFFVDLPFDQLLPIKLNLVKWQLLSKI

SEQ ID NO: 18612 - protein, 692 aa, Candida albicans
LTDIDRSFPFVDEESFKKELLRIFGTRTYTDLPFESIRIEKKLDLANIAICFILLRLTYLSFFNNRNCVNEFIMNSEEETVAKYIMQNPINLSTIEVANSCIQCFQFTRKSNITVFQAMLYMRIYRNCAPEESDGIDGGDSQVATALLVQMAYSLGLNREPDKFDVCNDEKVNHLGRKMWSFLMRSDLTQCYTLGNPTSIDPRNYDVRPPFVNDNNSNIEDREMEIAIVETFVYLNSELDLMRKMLDHVLDINNGAKINDLTRDVHDFEVILHDFFNVLGNVNAGKVKTDRESVIQYYHVIKLKIFLSMKTALVSLYFHIYLHYEKRFDSELSFFYLSKMYLIIRDDLIPAIGHTLIGKYSSKALVLNPNMQLALHKINQINLSCLIRVSYLVHMFEQKPNHEELMANDIVYLEHFNKLKSLMTNVRRTGDFVRVIMERIGSRYYYSWRIAKAHVGLFKMLSQPENYDKQLSGIRKLKSFQFTPKQLDELDNLIRILGKCAEKLVFYEDSVGMLPDFEMPFKPSEGDGNEKDQNQNDSKTTTTTTTTTTSDSTGISITPENNASAIVTPYSSLASPRLHLDNISNDYVDQMWFLMMAMKYDTLEPMGNNPDCQNCNSDDPNACPVSYNTRDNGVLGGTGGQLLTQQKQMTAQEQLAQQEITRQMQFGNENGYNNGFFLNSGFDLMDDGYFYG

SEQ ID NO: 18613 - protein, 245 aa, Candida albicans
STPFPSLPTKNPSFNIYIMSDDIVWQTINHQFCAFKVKTDKGQNFCRNEYNVSGLCNRQSCPLANSRYATVKNVGGKLYLYMKTAERTHMPNRWWERIKLSKNYNKALKQIDERLQYWQKFLIHKCKQRFTRLTQVAITERRLALQEGDNERHYVGVKNKVKRREQNRERKALAAAKIEKAIEKELLERLKSGAYGDKPLNVDENIWKKVMGKVDDEQEEEDEEEFEDDIDLVSGDEDDESDVGE

SEQ ID NO: 18614 - protein, 384 aa, Candida albicans
LRGGPMEETINYQGTPTTSAALLHNKKSTQDIFEDDSMEEQRMRLKTQGKQLWCQLDLSGQGLVNISSKLFHYDFLESLYLSNNKLNSIPSSISKLRNLRTLDLSHNRINELPEELGLCFNLRYLFLFDNNIKTLPYSFGNMIELLFIGIEGNPLEPSIANLIAEKGTKELIATLRDQTTVKRTPKPRCWLTLEDDGEVVDSDEVYKVEPESSDNFTVLSYNTLCQHYATPKMYKFTPSWALQWDYRKNLLEKEVLNYNTDIVCMQEVETKTFQEFWLPVMTANGYKGYFFSKTRSKTMSETDSKKVDGCATFFKNDKFSLIHKQNFEYNSVCMGSDNYKKTKDLFNTFMSKDNIALISYLQHKESGEKIAFVHTHLHWGSCIP

SEQ ID NO: 18615 - protein, 127 aa, Candida albicans
RHSSIVVCGDFNSVKDSAVYQLFSTGASKGHEDMNGRDYGKFTEDGFHHPFKLKSAYEAVGELPFTNLTPAFTDNIDYIWYSTPTLQVKGLLGRVDEEYTSHSIGFPDANFPSDHVPILAKFQLKKG

SEQ ID NO: 18616 - protein, 129 aa, Candida albicans
IKYFGRRVLSIFNYKFARLDGNTPVQERQDLIDLFNQDDKIHIFLISTKAGGVGINLLAANHVIMFDQSFNPHEDKQAEDRAHRVGQTKEVKVYRLISDETIEKNIFSVARNKLELDEKISTLESIVYS

SEQ ID NO: 18617 - protein, 441 aa, Candida albicans
SRTFPFLLPFFDPVSNESMIDEVLTIKQVLMIGGEMDNKQVSLSFAQLSMTTNDWIWNTSGTQYILVQDEILGAATIFNTLLVINSTDSNNKRDDSYHINLYDAESFKPVETLKENTAKILMGAKSKLSHQNNTVKIVLGTVLPILSLAIIAGLIIFFFLRRNKKHKLELQQQQYNEIDYKYGYLNPPQSTLKPFYHHDNDSNSTLSGASIDSWMKKRQDYDKRRLRNSYLASNDTLNMVDDEDSNSNSGSSNYNDYSRCDGEIRDEEKDLGEGKTPQLVLSKPGRPKLLPKKAFSFTKSPPQTPVGKVKRLQSTRLTSSEHLIPGNHKHELHSDAEENHEHNGAIDSEATSLDDRMDVQVLVSSKRRSILRVVNPDAQSMHETISDQSNVIREDYDSGEAFSQVLDNHFERILNESDAEENEVGNKLLRQRVISGQSEPN

SEQ ID NO: 18618 - protein, 346 aa, Candida albicans
  UNSURE (336): Identity of amino acid sequences at the above locations are unknown.
QSELHMVHLDPNEEQEVVDLDKEDDDFDDHIIMVKKRYLTMKYIKDKPALLADDVTLNNYQQVGINWLNLLYQNKLSCILADEMGLGKTCQVIAFMAHLKQVGERGPHLVVVPASTIENWLREFNKFCPDLLVRAYYGSQAEREELRYELLNDDEFEVLVTTYTLACGSPADAKFLKSQNFNVIVYDEGHLLKNSTSERYNKLMRLKGNFRLLLTGTPLQNNLKELVSLLSFMLPQLFNEKREELSSIFNQKSGTVTKENDHNPLLAQQAIKNAKTMMAPFVLRRRKDQVLQHLPPKILQVVHCTMTKDQKRLYLDHFNNGKYVSSERQRRRTLPXFTAALEGTNA

SEQ ID NO: 18619 - protein, 89 aa, Candida albicans
  UNSURE (11): Identity of amino acid sequences at the above locations are unknown.
RQESIEAQAIXRAHRIGQTKEVTVKTLYLKGVDELKILSRNEKLKNAKNDKESFDAKEKEDNDNLLEFLDFDNSEHEYAAFPHPISIFS

SEQ ID NO: 18620 - protein, 679 aa, Candida albicans
  UNSURE (25),(41),(42): Identity of amino acid sequences at the above locations are unknown.
LSQKGGIVIFDANVTRELDKKLESXTITDKRTIQRDIEKLXXSGMIEFELIPLTKGGQPITRLLIYSKEERLKPSDDVIEDYRKSCSKDWSSAAQSKKSFSNASLRTIESKYALFKIESPFDRKGLKRLESLAQPKRRGKPIAENRRKPRTKFVDEILGVTHEDRLDVPVGQNVNTTFGALKTDIKQDEKLATVSKITDSSKSTKPTKSELSSFAPKRFKRKSAPERRSNNGKLLNRGVKKNFAVKFDKTDTITLFRAVCISKAFNISSIDYDAISELFDNVTVDSLRKTWSVTRKSIGGGAVVDKGVEDFQLIVMRGIDEGKVLAGDLEDIRILFFLDLWGNYEGADNELVDKMPLYKNVADNYRYYNKTTTETYVDTFEQIELLSMRMKEMSLASTPFYVSKDPEDPVLPIKPHDEIRTMLKAIFGTSKETSTSSKIDKLLSDFPNKHIQEASEAMIKDRELLYFGTDDSQNNFTLTDKVYDSLYVRILASFFNKAAQFKDELVNVFSSNKGYPLSQGIDNGIMAQLLDLVSSSSVLLKRIEKEYTFDGYESRLMDKNDLDCEIVLHKSPTGAANIDDQDIHMIIPVPTGKPCSRIWLDINGQIDAKLWRDIVVAILYHVHFRPGIPIDLIFRKFDSLLSVNDFTAVIDWLKKSGCIEKGAYNGYSTSNNWLNILGY

SEQ ID NO: 18621 - protein, 743 aa, Candida albicans
TNTSKGNANMLFPCAPYEVVQFTIKKLSFSGKWGLTLDELWAFIQTKFNQQDQLDEFQKQLIWQWLFVAEDEEGNSESAKIYVTYNNSPVTANSDYKIFVASYDDLTNIRVLPEQETQVLYLTGITNNKKFLSSLGDKPYELLQEIAKHGSKGIWAPTLIDITGQDNRSLTGRLNKLEEWRLIYREKRFFTEKKVHSSWIVHIKFASISEKSEDKQQKKKTDHTNVEPVESDSNGSKSKDEENDEENDEDGNISKYWKFRENLKNVIVESCKNAPHSIRVFRDLKRELRMHQTRSLSNLFRSILNALHDEGVIEKVNIKDEETSRLIYAIKYLKDRQDLKLNMETEFLEMPQLGDNGEDQEDGDDDDEDDDEARFVPSFNVMFPLASQLYQYIYDSKLDGISSRQILLLVLGQPRNRLVERFFEIFPSYQLKGQALQPLRVYPDENDKTGVVRIVEAEGKIKFYKYCARENIDSVTVTKHKKARPVLKTIANVDFKALNKMLFVKDRKKKQIQLFDTPEKLYPAIKMLRDANYKQREDEQDEHPVDKSMVAPPKIVKTKVSKVDEVVTADTVLPKTDKPPLSKRKVSKESPKTTFKKRKVETSTENDIITCLRRSARSARKPPIKIEDDVLVDEVDNDYTEVDNQDEIEVLEKEDELDVKVEMDHDSDDIITVEGLQTTESRLNKTGNLENGPVSLSLTGKRVRKYSRRKGFQTTNFGDDVQGELRRDMIVELVESKRWDCNF

SEQ ID NO: 18622 - protein, 365 aa, Candida albicans
IPNCSVNVFSIFATLTHFFVIKNFEVLAPTSEKSPNNIIPIDTYFLEHPEENYLTVMKKSESRDRESPVPGVTPPLAQSTNSFKSEVGGGVAAQSKPAGTHRKVSPIETISPYQNNWTIKARVSYKGDLRTWSNSKGEGKVFGFNLLDESDEIKASAFNETAERAHKLLEEGKVYYISKARVAAARKKFNTLSHPYELTFDKDTEITECFDESDVPKLNFNFVKLDQVQNLEANAIIDVLGALKTVFPPFQITAKSTGKVFDRRNILVVDETGFGIELGLWNNTATDFNIEEGTVVAVKGCKVSDYDGRTLSLTQAGSIIPNPGTPESFKLKGWYDNIGIHELFKSLKIDNAGSGGKQDLAKDFH

SEQ ID NO: 18623 - protein, 100 aa, Candida albicans
  UNSURE (59): Identity of amino acid sequences at the above locations are unknown.
KLTMLVVEENKISQRISINQALEEHSGSTEKPDYFSIKASVNFCKPENFAYPACPNLVXNADATTPAQVCNKNEFSRIMMVLGDVKDVQRHTKNQTGVTF

SEQ ID NO: 18624 - protein, 126 aa, Candida albicans
VFQDNDGTWRCERCAKTYEEPNWRYVLSCSVTDSTGHMWVTLFNDQAEKLLGIDATELVKKKEQKSEVANQIMNNTLFKEFSLRVKAKQETYNDELKTRYLAAGINELDYASESQFLIKKLDQLLK

SEQ ID NO: 18625 - protein, 524 aa, Candida albicans
  UNSURE (48),(52): Identity of amino acid sequences at the above locations are unknown.
PKLNMGDYLNDNSADYIPNSNVNKAESETPNFDYTSNYNYGSNSNLAXQPQXNQQQQQQPQQVHQNQLFNMNFDSNNNNTQNDYSLNINYSGYSGSGNLNANLNTSNNSADISAYNSNTQLVDGQDYLSPMGFTSYNAQSDTNVFGGSSIPGSFTNEPFLDDVAFSQAILGPQLHLQNSNTSPRPLSPNQSGQQFVNPISNSVNLDELISPQNNDESSFLNPQFFSPSTRGEHLSGLGSIAEDDKNNLAFSPDFSKRQSISGASFSNNNNTVSDLPALSYLSPQLNPTFASPGVDTIPYLNSPPQYPPIKTENWNALSPPPHSSVLSSSVPTSSGNGINRDVPTKQLSKEEKMKRRREFHNAVERRRRDLIKERIKELGVIVPPSLLNPTLSAVQNFQRKGSIESGELSELIGSVKVKETKPNKSTILNRSVDYINHLNYVLKQQEIARVNLLAQIEVLENSDGSNTSSLSQPQSQTSSQQSQFQSEDAYYLDQNTSSTTTNREIANYNPEDFFADIGTSTENI

SEQ ID NO: 18626 - protein, 170 aa, Candida albicans
YSIIHHVIFNTITNYCVTPSIDIYQSPKPTPKDNLIKLYGLIPVTKSLARTNPDGSKGIKLRKSYENHIQEFTSKHQISPAKPIPPGLLDPLIEQHPDIIKPLDPELLNKALKFDRTPINGIPGFNSSDLAINDQQTLMRGDDMGEDEHGKKIKRKKKIQNGADPKRQHI

SEQ ID NO: 18627 - protein, 881 aa, Candida albicans
FIIYNLMHSTTGGRIGSRSGSTSTSNSNSAAGGTRATGATTTTTTSSSTARILGPTLFQDETNSNPNPKYIQQYLRSIIIHSLDTLNYQNAEFASERLLALMEQKREQQLHHHNHSQPQSQRDDENDEFLDSIYLYCLVLYRQDKYKTCYYKLSNLKKFDHHLSCSFLYGKCCLKLNKFKEGIFHLIKTKKYHDINTSTTNNNNTSKFSGANTSNNDRFNKFNYEYNRNINPDISLIYHILGDLYREINDLKNSCMNYTLCLKLNQFDFEAFQKLCKLGVNIRVKSIFKFQHQPYSKNNINNAFTNVNVNTNTNSNNEGPTIPDLTNPFTDRSFNSKLTPSIHVDDFNFSTPRVKTTNNNTSISSDAALRKSNLNNGSTTNAISNNSGGSTNNPSSINAAVSVAAAAAAAAASTTTTNNNNNNLDFEFTKPSYPDDKRKSQSTYLRITSRLISQPQSLHNQHHNHNHHQQQQQQQQQTGSSQMETPKKRNLKRNNSATLDPIYHQGTSASNSTTNAIPGISAATSSPATSSSTASASSLSSSSSIIITKEIEKSEKHLLQLYLNLGKSYRSMCKYDCYKAIRMLETSLNEFEKNTPWVLSKLGRLHYEIVNYPQSELYFTKLRKLDRTRLQDMEYYLTLLWHLNKKVELTYLANELHDLQPNAAITWCVIGNLFSLIHEPNESIKCFNRAIKLDKKFTYAYTLKGHEYFSNDNYEMALENFRISLLLDPRHYNALYGLGMIYINLGDYEKADYHFRKAISINPINIILICCCGMVLEKLNKRTLAIKQYELAHKLQPLNPLPIFKLGQLYFSLKNYLLALKNFEILKNLAPNEASVHFLLGQLYNLQNDKFLAIKEFTVALNLNPKGNYLIREAMESLKKS

SEQ ID NO: 18628 - protein, 245 aa, Candida albicans
IMLSPTRRFEPVIIFTVNSVTKDIYFRGESDGINIWRIDYSNKSSFIKNKCDKVCLTKGGFSSVIPNKLSGFGFSSGPSSTTENSSSSIPESIVQLEVDSDRDILYSLSNKSVIRVYKLHPKQEHLTEGSTLTPSVIFKSASTVFVDASNFKVFERFKIISIHKISPEESSSIQLIAVTSNGCRILLKLGSTSTFSSLLTSSFSAANALKLNLVNIKFPPTREVPKINAELDTFSQRPTIHGSGP

SEQ ID NO: 18629 - protein, 203 aa, Candida albicans
LSHLYKAITSLQLFQHKALANQSIYFFKWSYKFHKALSSCTSASSSSSKYISPTLKLQDDVVVDSPQFHQDKSTGSSRGQLSRRFVQPVGLETKESNYKINVPDFANLPPLQLGSKFISDLNKIDSSIPHDIFYSETVSKSESGLDNYYFDYENGLKDFSRFEKVQQLDLPDRFFEEYNSTECITKIGLFPEIERTWIAIDNK

SEQ ID NO: 18630 - protein, 204 aa, Candida albicans
NIENSINIMLDLEFYAGAVGMLLNIAQKVGNNVKVPSLTFNQDDDSAPLKRDIAEIEKKKKSLYDLIFNILIKMDMKALKISDTNNQLLINEFLEIRDTTYDTCFASNDKNFQYTFYDWFIQQGVSERLLDINTPFILPYLEEKSENNLALSDLLWLYHAKRENYFDAAKILYALSISQFNLELNQRIELFHEFSPAVEGQRRE

SEQ ID NO: 18631 - protein, 409 aa, Candida albicans
  UNSURE (404): Identity of amino acid sequences at the above locations are unknown.
DAAKSPVLVELTNDNYSITEPYITINQGYTRATATTTTNNTTTTNSNNTAGATPNTSASSLDTNLKRTYKFDQIYGSQADQNLIYSQIAHPLLLDFLRRINVTVLAYGQTGTGKTYTMSGMDNNNKLDENSDIAGIIPRLLGELFQNLSSNATSKNDYMVKISYLEIYNEELIDLLSNNNSNNRKLRIHEKTNANKVKSIGIQNLTEYTINNYNQGIKYLKMGLQKKKTSSTNLNETSSRSHTIFSVQLYQKISSSSSSSSENDNEESVYRISKMNLVDLAGSENISRSGSIVKEAGGINQSLLTLGRVINSLNEKKLLHIPYRESKLTHILQDSLGGNTKTTLIATISPAQVNLLETCSTLDYASKAKNIKNAPMIGHDSEIIMKKTLVKNLAQELTLLNMDXIATRK

SEQ ID NO: 18632 - protein, 563 aa, Candida albicans
ANTPFFLNTITLVVTTTSQSTSIKSMSNNIKVSVRVRPLLPRELKAKKAEGEATPVSLVSMPPSDPHKVLLTNPKAQSKNNISIDNKPKSFLFDECIWSFNSKDLNYIDNHKYYEKTGPQLLSHFFEGYNVCLLAYGQTGSGKTYTMMGDKNELPGIIPLLIKDILKQMEISVNEKINCELKFLYIEIYNEQVKDLLTGDTKNGNGNGNSTHASQKCKVREHPVTGPYVENVKEYNIENYTQFLKLLAKGNSSRSTASTSMNDKSSRSHAIITLTLKQTKFEKFSGFSSDSDETNSIGDASEEMVSNIKLVDLAGSERLQKTKLYGQQERIKEGTLINKSLAVLGRCINLLSSNPSSLIPYRESILTYLLKENLGGNSKTCMIFCVSPVDYEETHQTLNYANEVKKIKTLAKANKTKLSNVPIDWQQLQLTDKTVIQSLKNDIDVLTNKLNQMQQLNEPRSHPPQSINNIIEYLDKETNKVKFENKYLKQMMNTKNNHIKELNNHIDFISNEYQLLYNDYEELKRSSLLNRKQELLKECESNKGHMDMELKEFEQFLVDAVGN

SEQ ID NO: 18633 - protein, 153 aa, Candida albicans
  UNSURE (151): Identity of amino acid sequences at the above locations are unknown.
PNMTVTDEFKKQVSKTFGPKTDLSDDEYIKLQSLLDLFNKSMDDIFVEWESFNITEVKEDLDLNLSNLIRFQGYLQTKLAKNSTHVSKKTRDTIGSTSNRKQFRTVDNHHLTPQLKKRKFEDNTPEFKTPAGIPVLLVQRLRNSNFYLATXIG

SEQ ID NO: 18634 - protein, 376 aa, Candida albicans
LLDLSNLSNYSFFPGQIVVLKGKNPSGKSFIVEQNMPLLQLGAPVTSSEELKEFQTLQNNQGLKVLIASGPFSNLNKLNYDKLDKLVDLINTKILPQVVILNGPFLDIGNKVVESGEIIIDSDQSQPQPKTLDDLFKAIVTPVLKKIDSKIQVILYPNLRDTCIKHCSYPQDSFDRKKLGLPKNFKVFPNPSGFSINEVLIGNSNLDIFKDLRDIYKEDTAIISNNRFERIVKHIFEQRRYYPIFPGSIKTEPKQKCTELLNGAQGEYLDGIAVGGSSLETPYLGLSELGDSLPDVLILPSELKYFAKVIQGVIVINPGIFIKPSKDPNREEGSYAVVNIQPPNFDAEDNIEAIDDTNTLYYHNVNKRSRVDIYSS

SEQ ID NO: 18635 - protein, 124 aa, Candida albicans
RNIKHKSSAIFISTHSYIHTLMLFFSFFKTLVDQEVTVELKNDIEIKGTLKSVDQFLNLKLDNITCTNGQRYPYLGAVKNLFIRGSNVRYVHMNPNSVDCTLLQDASRRGMFTNIFFSIISAIN

SEQ ID NO: 18636 - protein, 686 aa, Candida albicans
KRPTNDASWSDIVRENANWDTYYKSLNLIPESEWDDFKKACQTNLPMTFRITGSRKHAEEIRNIFLDRHVSQLKGKTFDGVDITPKNIEFYPDNLGWQIDVSKNVIKKQKEYAKTQRFLVVETEVGNISRQEAVSMIPPLLLDVKPHHYVLDMCAAPGSKTAQLIEALHAEDEKKLPTGFVLANDSDYKRSHMLVHQVKRLNSPNFLVVNHDATLFPRIRLNNSSQDLKFDRILCDVPCSGDATMRKNLNVWKDFRVGNALGLHNVQELILNRGLQLLKKGGRLVYSTCSLSPIENEAIVASALRKWGDQIRLVNVDNELPGLKRRAGVSDWKVYGKDMELREPGAEDVPETAFPPTKEEAEKFHLENCVRVYPHMQNTGGFFITVFEKINPVADVDAEADGNKRKADESDSEENEPKKQKSENTSSTQPDLSSKSGRLPRDANEEPFIFLDPSNSELQKCYSFYGFSDSFPKDCALVRNSTGEPLRTIYYTSPIIKDILTIEKQKLKLVHGGIKLFVAQRNDVGPCGWRIQTESLHTIEHFVDEKRHVKCNLKLLERLMKEGFPKIEEIKESGVDPEFSEKITNVTEGCLFLTVDRSNEGLENLLLPLWRGKSNVNLMVNKKDTHELLNRVFDIETSAKDHGKEKAHQDQVEAAKQQANDQTEISATAENTEQETPEVEQKINDE

SEQ ID NO: 18637 - protein, 544 aa, Candida albicans
TGVFPQLKYVKFDCLKCGVVLVPYVQDSNTEVKISFCTNCQSKGPFKLNSEKTLYRNYQRITLQEAPGTVPAGRLPRHREVILLSDLVDVAKPGEDIEVTGIYKNNYDGNLNAKNGFPVFATILEANSIRRKESSAFMGGNNLVNMWTEEEIREFRKLSHEKGIIDKIIASMAPSIYGHKDIKTAIACSLFGGVPKDVNGKLSIRGDINVLLLGDPGTAKSQILKYAEKTASRAVFATGQGASAVGLTASVRKDPITREWTLQGGALVLADKGTCLIDEFDKMNDQDRTSIHEAMEQQSISISKAGIVTTLHARCAVIAAANPNGGRYNSTLPLPENVDLTYPILSRFDIMCIVRDLVNPESDERLASFVIDSHMRSHPTNEEDILNANGKGGSDAQDDDENMEDEDGVDQPSAARTRSERIEQLNKQKEQEISPIPQDLLIKYIQYARVKIQPKLHQMNMDKLARVYADLRKEAITTGSYPITVRHLESILRIAESFAKMRLSEFVSQNDLNRAIKVSIDSFIGAQKVTVKQKLRSKFMKYTL

SEQ ID NO: 18638 - protein, 219 aa, Candida albicans
IVPPFLPLLYVLFCFILFYFTNLSCSPLHVRRSIVLVGRVMKKALPEHAKLSKESKECIQECVSEFISFITSQAADRCLVEKRKTLNGEDILWAMYTLGFENYSETLKIYLAKYRQYEQEQLSLKPPRKKIRKRKTKSSLSQTQSKEQVDQDQDFQQIEQQYDDGEEEEEELENEEGDMSNIQLNLILQNLPEYSDDYFDDEDEEEDRQQQRQANSDNE

SEQ ID NO: 18639 - protein, 109 aa, Candida albicans
NKNIMNQQNARDIELREQDRWLPIANVARIMKNTLPPTAKVSKDAKECMQECVSEFISFITSEASDKCLKEKRKTINGEDILYSMYDLGFENYAEVLKIYLAKYREARK

SEQ ID NO: 18640 - protein, 475 aa, Candida albicans
SPSIIGVTTYLEFICSTILFFSRESIRLSVQRVRNNLDNKDYVAQKVVNFGILAIAFAFPIFMVIGYWQLNYSLVMDKLFVSPFYKPVIVLFVALVILELLVEPIYCLYQFQLDFGKRSKFEGSAIFVKCIVSVLSILLARQYFVDQKFEGVAICAFALAQFSYSLTLFACYLMSFRFEFHDNKINYNLVKLKDENAREFYFEQDTLTIVKGFFVQMIFKQFLTEGDKLLISHLCTIEEQGMYAVMANYGSIIARLLFQPLEESTRLMFTKLLNENTRSQGDEKPQKLESHKCMQTFNYLKLISIFYFNLSLIILFAGVTSGPYLLKLLMGGRASNWESTDIFKLFPRYVVYLPFLAFNGILEALFSSMATNSDLKNFSKFMTLITILVLIFLYLLIDVLNLRISGLILANVFNMSSRIGYCYFKISKFYSKENVKVSFVDIVRYSCPSILITSIIWIIQPSIIVFNSRCRLFSP

SEQ ID NO: 18641 - protein, 811 aa, Candida albicans
YCCSTQIPTSDMWPHKKGLGNRLSYGVYGNAIVSIDSVIEAQNQDQLANTNITIPHNDFEMSKKSIPMMFPRINDETVELTPKQNSNQELVENQISKFNINSSMANTINSPINPPKGKLPKELSNNTYIPQDIIRAYMFESKSLTSNMAYDPIHGDLLQTFDIFVKSEDAYVDLMTFVTGESLSILNITTYESKDDCIVLSPAYQIDFCDPILQIEVSDKIDGVGLVAVRTGAKVYILNICLDKLTYIEVIPNVVLFVLGEISADCLAGNVLADVRFSSNDSRKVAVVDIKGNLTVWYVNKTVPSIRKFIKEQFVKELSDSQSLSNWRRICWLPLCDHLLVISRVEILKVMPNSESSGKIIVTSNTWSRIRDVNVVDEYMFLLTSKELIWFSANDSMTRLLSWKHFLDDSDPSLKFKVVETSPKVFTCFLYSQVNPLVIVYSFGFKGNKPYSLRDPYYFRKSSDNYDLRQINITKTEDALLIFELTTGLAIHLRRLISKNENDISNSLFHSKLVDSSVNKHRTNYLKQFSKKEIKKMIPQFLNIGEHDCTTASQQIDLIQRYAYELGNGFAQMGNFQAAQQLNYFSLYEVCNSVPLGVTDLLELDDMIVQLENSLPSERLKMKSLINNSFIRRNKFINKRETNTHIYDIYQMLEQIYPTHNKPSSKLAASILIGLSLIKCQYESDDLQEKLQKSIANAPEKVQTLLNEWDEEDNDDNSQTEGLTPTQHDSQFMIPTIKSSIPALRVNSQPSLRQQVLTQNSQTQTLLPSSLNSTVPSISSFPSQRSISSQGSQSRSGSQPKKKRKKKGGFA

SEQ ID NO: 18642 - protein, 421 aa, Candida albicans
HGLIIAENKTVECYAVTINKDGTRLASGGLDGNVKIWDLTTINVFYKMADQPHKSKKDSTSTKLEESLPDKSLRRPLCSMSRHNGVVTSLKFSPNGRWLALGSDDKICLIWEKDNTQIAKLFGTDEHDLEHWTVRKRLVAHDNDIQDICWSPDGNLLVTVGLDRSVIIWNALTFEKIKRYDIHQSMVKGIVFDPANKFFATASDDRTVRIFRYYKKLNEYNNYEFQMEHVVVDPFKKSPLTSYFRRMSWSPDGQHIAVPNATNGPVPSVAIINRGNWGSDISLIGHEAPVEVCSFSPTLFQIADTPANEEIKFQTVVATGGQDRTLAIWSTCNSRPIVVCLDIVDSSITDICWSPDGETLYFSCLDGSITGVKFGARELGQPVKEDLIDQQLNRYGADRESTILPESVEQLQLEEQSKDSR

SEQ ID NO: 18643 - protein, 468 aa, Candida albicans
PNLFSLPITNNYTLVMTLDELKLQLIVKSLHELGCDQLATELISQLRQTNSLDQQPGDELHNWILEQLRIRNYTELDDYFCSLLNDTNGLNEFVKIINYRGDNMDSIISILLYLIRRANYLDVIKLLDSLTDTERLTYVNNKLLPLLDCVDVGNNKIEDISSVIDVRILQQLSKEKESKLLMDSNHAIEQYLFQLPIDSIHSLNQFIFDKLFNGSIFNLLTTDSLANTPDLATIIQQAAKYQQSQSPFYLPPRTKQERKKAPLPLPLKRFHDNFNGNTTTLLHTLTYHKDEVWFVKFSPSGKFLVTGSLDGRLVLYDVLNNFQLIKVLEPTMAADNTAFSPISTRPTLSKNNKAVIYCCWDPKEQYIVSCCLDTVIRVWSVGDIHKRRITRSETNTITDYKLITCFTLAPDIKTWTCEFLPENRKLSGDLSGQSDSPQFIVGSPDKVLKIFDCNGIELCDFYGNIEDE

SEQ ID NO: 18644 - protein, 488 aa, Candida albicans
  UNSURE (110),(111): Identity of amino acid sequences at the above locations are unknown.
WSLILHRLVKISIRRMMPIQEAKPEQTPPISTPASAAIDIERLRKQTVTMTKSGKKRVAPLLVSTSAAPKNVLQKPLQKKRRTKSSSKISQAAYLLPKMGVQTTVHGIKXXAESMSNDTEVEENNDNDDIGENVMANTNLVSDAALKRQRNRRKRKLMELKYPSSFKYISNLPEGLFNNHTLQNIEINKIYKAHSKHKDILAEISSSTAVEIDEDLVFSVVFRVFDHMRKENEVLGQTSGRIRTTIEVRNGKPWDDDISDRDFDDATKVIVTEEGNDKREYCLFFPFRVQHVLPIILNDVLKYYVLCSFHGSVQIISADTGSYRCPTFELGESVVTMRHSQGYMLVLTSSGLFYSWDLKAMKVTMTGISIAAILNNYEIGGKIVVSPIVRGLEINPQDGSPLVLLDMTNDIYGYSIDLQCWVKTVDSWYYGVGADKDLDVVLTGLVKKLKMSYEEDKVTEKIFTYKFDSSNDLEDAMRKRGQELLDLI

SEQ ID NO: 18645 - protein, 107 aa, Candida albicans
SKMSGTGRGKGGKGLGKGGAKRHRKILRDNIQGITKPAIRRLARRGGVKRISALIYEEVRIVLKQFLENVIRDAVTYTEHAKRKTVTSLDVVYALKRQGRTLYGFGG

SEQ ID NO: 18646 - protein, 115 aa, Candida albicans
KLFNFINQSTMSGTGRGKGGKGLGKGGAKRHRKILRDNIQGITKPAIRRLARRGGVKRISALIYEEVRVVLKQFLENVIRDAVTYTEHAKRKTVTSLDVVYALKRQGRTLYGFGG

SEQ ID NO: 18647 - protein, 168 aa, Candida albicans
WPLALEKKYAYEQSPIVPSATSSSRYSQFGIYRNQPGDVVDTLASSLPRRTTTTRPEVNRTVPRVKKRYRPGTKALREIRQYQKSTDLLIRKLPFARLVREISLDFVGPSYGLRWQSNAILALQEALESFLIHLLEDTNLCAIHAKRVTIMQKDIQLARRIRGQSWIL

SEQ ID NO: 18648 - protein, 86 aa, Candida albicans
EIRRFQISTELLIRKLPFQRLVREIAQDFKTDLRFQSSAIGALQEAVEAYLVGLFEDTNLCAIHAKRVTIQKKDMQLARRLRGERS

SEQ ID NO: 18649 - protein, 152 aa, Candida albicans
LFFYFFFNYHFISTFTMARTKQTARKSTGGKAPRKQLASKAARKSAPSTGGVKKPHRYKPGTVALREIRRFQKSTELLIRKLPFQRLVREIAQDFKTDLRFQSSAIGALQEAVEAYLVGLFEDTNLCAIHAKRVTIQKKDMQLARRLRGERS

SEQ ID NO: 18650 - protein, 156 aa, Candida albicans
VVEELKELGATQVITEEQNNSKEFGHTIKGWIKESGGEAKLALNCVDGKSSTGIARKLNNNGLMLTYGGMSFQPVTIHTSLHIFKNFTSAGFWVTELLKHNRELKLKTLNQIIEWYESGELKDAKSTETRFDGSKELHELYKDGVANSKSGKQLIT

SEQ ID NO: 18651 - protein, 394 aa, Candida albicans
RRQLKLIHILSQFFSYSLPAPLNQLTTSIFQKSYTMTITGKATTYSAPGSDLPNVLQQTTFVIDEAAIQPNDVVVKTLATPINPSDVAQIFGGYNDAVPSTRLGSDTTPQPLSVGGNEGVFKVIQIGSNVKNYEVGDVVIPKLPGFGTWRTHAVVDITQDSDLTPFIKVNDLTIDQAATISINPSTAYQLLHQFVKDWKSGDWIIQNAGNSQASKYLTQLAKLINVNVLSIVRDGKPQELYDELYELGATKVLSESEFLHPEFNIEDVTKGEGNVRLALNSIGGETVGGLVKGLSRNGVLATYGVLGGGKISYDGRIQLFKNISTRAYWLTANTKANPQSKVDTVEAVSKLFKEGKLKVAAYNKVKFDSTGDLKATILNTIGKSKSGKQVVIYE

SEQ ID NO: 18652 - protein, 79 aa, Candida albicans
GRMHEDCSDRYRNYLVVGENRKQSNWTQDEVDKLMAIVDEQLAVVYIVNWTLVAEKMGTRSGIQCRYKWNRMKGINQDK

SEQ ID NO: 18653 - protein, 394 aa, Candida albicans
RKSEPYKPSSWILSARLEEQDGKNLKLAKQYILEGCKKCPRNDEIWLENIRLNQSDIKLCKQLITNALNYNPKSEKLWLKATDLETNNINKRKVLMKGLEKILNNDQLWEKLIELENDPNMVKKLLLKAVQLCSQNWEFWSALLNISNYEESKKILNQARKSIKGVKNILKVWITACQLEEREYGEETIDINKLIKLMDKAMKEISIDQMTKDDWYKLACDSERENFKVTTKAIIISYLKFKGLDQSSIFEDVDKFFNDGYIIVAKSILDYIVTNSSNDINKWKKVFSVIKKFNQELPLLFSYYDKAISLNPQVPLFYLMYAKDKWQLSKDIPQARSILNSGELANPTDLSIKFAIIKLELITGILLNAEKYIKHIIDTKPMESEKFGINIFIF

SEQ ID NO: 18654 - protein, 248 aa, Candida albicans
IKKHLKEMLQRLARGTVGFRTRTSPDSFNRRIAIVQYEVVEEEDEDNNNETTTQLNEDGIIFTIKRGKEDEDDEEADRIYNEIEKKLQSKKRKSLSNNNNRAKPTVTTTNDNYYTQFSDLKRQLANLTEDDWLNLPEPGDMTRKNKRTRLLEQQQQRMYSAPDTLISTSSSATGTNTTNFKSLSESRDKLLGSQLDNLLPAYVKTNGQSINNSSSVSEELQQSILNMTGVEQDSKYADLQKNRVILSS

SEQ ID NO: 18655 - protein, 201 aa, Candida albicans
  UNSURE (6): Identity of amino acid sequences at the above locations are unknown.
LSQIDXIAQIIIRARSILDQAILQNPNNPDIWVYKIQFEKRIGNLSSLQNLTNKALIQFPTDPWLWIINLSLIPKMSQRKTIFLDALKATNNSNLILLIIGVFFWFDGKYSKSKNWFERSLQLDNTNGDIWSWMYNYLKKFGTLKELNSFLIDYESKYDSINKGHFFNKINKDIKNYNKSPKEILDIVAFFNHRGSKEPRY

SEQ ID NO: 18656 - protein, 413 aa, Candida albicans
RPIPPSMLTGNITDKEYISKYFDGVDPAKFKEGRFVDEKVFYLEGPEGYFEQQTTRVKQSGNSLTALAPQIEYKDFARLVKLGDNLSFQRKRHLFELHKYIYHQWCFEMSQGFNLNFYGVGSKIDLLRDFATNYFGIWWENVVHADLPKVLVVNGFNPSINIKKLILEIASILLPNELYPKHIAGTVPFVVDYLNNHRLPCGSIGFHKPKILLIIHNLDGEVFRVDKTQTLLSQLMTLPEVWAMSSTDHINASLLWDLSKVKNLNFIWHNLTTYATYQRETSFRDVISLGKSKKFVGGLGAKYVLRSLTDNHRNLYRELLIAQLDKMEKAVPSASGRVGLKGNAKVAVDLKSLYNTCLDEFITSNEMNFRTFLKEYVEHKMCQLVKDPSGVEKVFIPFTYEEIQYIYKQEFDV

SEQ ID NO: 18657 - protein, 105 aa, Candida albicans
  UNSURE (4),(6),(10): Identity of amino acid sequences at the above locations are unknown.
IVYXAXGCVXIHQLLGHVSVKDAPDYYNVVREPRDLKNIMKAVKFKNEPPLYQSVKELERDIMLMFANCIMYNQSGDDLVELTKTMKQDISEVFKMFEEAEEDIK

SEQ ID NO: 18658 - protein, 1001 aa, Candida albicans
  UNSURE (21): Identity of amino acid sequences at the above locations are unknown.
FLQEFNKVYHNFEYDRETLLXRRKLEKSDMQLESNKSNKGDNASDSKSATHIDMNLGAASTSLQHLLSTIQLKRNKVPLNDHELRTLFMDVRKNRGKWANDDRVGQEELYEACEKVVTELRGYTEHSTFFLNKVSKREAPNYGLIIKKPMDLNTVLKKLKNLAYNSKQEFVDDLMLIWSNCLTYNADPAHFIRAHAIAMQKKTIKLIPTIPDIRIRNRAEVEKEEEVENGKRDEEEDSLGGKSMKKGRKRSRQDEIKAEAEAETPNSPSPAGTPFLASEVNSVRENTPAATDNGNVSNDEEEEEEEDTDNINGTATGISGMVDGDDEEFDPELQAWRTLTAKSRANYCAQRADLFDENGHLKSDVPAICRKSNEMSNFNEYLNNKEVISKSKSLLENDEPYLLEYDVAGGIPGIAYCGVDKETEETYENKLVDIYLQQTSGDASKIKSDFVLSTNSGLNKVYFENICEIQEIRKICFKISLIRQMQTQQFVHHTQMKQPEIQTLKEIDVDAASKLPNHDASTGDVQFSVFRRNIAKIAMQTGFETTQQAAINTLTQVAERYLGNLIKSLKLHSETTSDNRLPPREILLLSLLQNGVDRPDDLYTFVQERVVKQQGKLKDLRIKLSNFLKDLLRPGLENFNEKSFEDNSEQFMTVDFSNGIGDDFFGFKELGLDKEFKMLTSSIPIYLLHSRLHNQFTTGGGTAQRNKYEDLQEYEPDKIHGNEVDKQIGILISFYQTLYEKSQTFYVKAQKKKGESMELPPDNIFILTEDEDLPQKQRNVRPKLPPTGRISSIKKKIIANSFFLPEEEELQKQEMELKAKEEAEAAAAAAAAAANSTQTAETAQVMKPVDSLEMSETLNTSDIADMLREIESANAPVSREEQLPEKQFNTEEKKVGLPKTDANELKYEPVDEQSKIYATTEKNDNVKGIENKPKQEDFKQIENNQENKNLEEIEDTLEDDTEIENSDSTKLDIKENETLVYESEVDPDESSIDSLFEQNEE

SEQ ID NO: 18659 - protein, 448 aa, Candida albicans
DDNINDDNCQNDVYEQQQQQPQQQQQQQQQLHQPNMYENGNVGVISNDPVSSVGHYDNNPVSHVPTGAYSRVQDTDIWSDDVEEAFEEVLRLIPKSGLNKIKIAGRSCGRNELISDYIYAKTGKFRTRKQVSSHIQVIKNLGQKLDIIQLINDGPIFNSLEEQLESTKKFEYVFSKINLNKSLGFSDSMKRKSDSMPMHLPATKRIRIKHSGNPLNKIKFSNFFMSVNDQYGMNPIVLTIQQNGNDVKSLKLKDNANISSRFPGLSDFKSCPHIPIIHNMVKILLPQLPESYSIDDGFSSSYALKYEEPENASPTHTSIISSSRTYSLFTCVYSYGKEIVKFDEDGIQLNQDREFIPGFWKFFFSTFGDQSEGGLSAAFKGVTIKQILYESSPDSVKKEQDASKVNKLKVKLVLLWEFAKVSECKDALTTTTKLVLTNTSTGFKLKDH

SEQ ID NO: 18660 - protein, 87 aa, Candida albicans
RMSLWVNKYRPRTLEQLTYHDSITNNLRTLAKSVYFPHLFIFGPTVIWLKEPNLWFLKEIFGTQVEYLKYDVQILSPPPLTNFQFSL

SEQ ID NO: 18661 - protein, 289 aa, Candida albicans
HRRDSLIIDVKDFVTSSNRKLEFNVLSSSNHLEITPSDMGNNDRVVIQDLLKDVASTEQVDFANQLRAKHRFKIVIINEADSLSRDAQAALRRTMEKYSSNIRLILVCNSISNIIAPIKSRTLLVRIPSPSVDNINHILGHVAEKESLKFSTHNDSEINHFYSKIAETSNRNLRRCLLSFETISMQNETINVRSDVAKIALDWEAIIRNMAISIQKNQNVATLAKTRVVLFELLSHCIPARIIWKNLLFELIDIFSNNQELVLELINQASIFDERLSLGSKNISNWEGL

SEQ ID NO: 18662 - protein, 265 aa, Candida albicans
LNTKLIMLEGKFEEAALLKKVVEAIKDCVKKCNFNCSEHGITVQAVDDSRVLLVSLLIGQTSFSEYRCDRDVTLGIDLESFSKIIKSANNEDFLTLLAEDSPDQIMAILEEKQKEKISEYSLKLMDIDSEFLQIDDMEYDAVVNMPSSDFAKLVRDLKNLSESLRVVVTKDSVKFTSEGDSGSGSVILKPYTNLKNERESVTISLDDPVDLTFGLKYLNDIVKAATLSDVITIKLADKTPALFEFKMQSGGYLRFYLAPKFDDDE

SEQ ID NO: 18663 - protein, 667 aa, Candida albicans
QRSGKMYATAHTIKQQQQQQQQHPPPPLNGGLHASGAPPNSHEAAAIAQQQQQQQQHHNGPGMIVAAAAASANQQAVQARAQQQQQQQQQRLPSSAALNETTVSTWLAIGSLAESLGDIERATASYNSALRHSPNNPDILVKIANTYRSKDQFLKAAELYEQALNFHVENGETWGLLGHCYLMLDNLQRAYAAYQRALFYLENPNVPKLWHGIGILYDRYGSLEYAEEAFVRVLDLDPNFDKANEIYFRLGIIYKHQGKLQPALECFQYILNNPPHPLTQPDVWFQIGSVYEQQKDWNGAKDAYEKVLQINPHHAKVLQQLGCLYSQAESNPSTPANGAAPPHKPFQQDLTIALKYLKQSLEVDQSDAHSWYYLGRVEMIRGDFTAAYEAFQQAVNRDARNPTFWCSIGVLYYQISQYRDALDAYTRAIRLNPYISEVWYDLGTLYETCNNQISDALDAYRQAERLDPNNPHIKARLEQLTKYQQEGNTHPPQPPPSSQQPRLPQGMVLESTQQQQQQQPPPPPQQQQQQLQHQLQLQPQPQQPPQTQSQPLLLQHQSSLPPQQIQPLHQQAAKPLVNQQQSPPPPHLMNLGQPGQQPQQLPPHLPPHTQQPSQIQEKPPTQEQPHYQPPPTSRRFNSNRNRQPQTSNQPQHTQNPWPQLPQLPPHI

SEQ ID NO: 18664 - protein, 100 aa, Candida albicans
  UNSURE (98): Identity of amino acid sequences at the above locations are unknown.
ATEGRKLYRILIRMLIYRLTTLQFDSAQAAYRRVLDRDPNHAKVLQQLGWLYHQQSNSYASQEKAIEYLEKSVSAGKTSANVLDPEQAVLLFSLRTAXSD

SEQ ID NO: 18665 - protein, 202 aa, Candida albicans
  UNSURE (195): Identity of amino acid sequences at the above locations are unknown.
IQLNNIFNTKMRISPVMAKSASSATTTTAPTAVNSTSFDTAATETWITCGECANTLGLIVSAIKSFESAVNRDPANATALVGLSSSLRLNDISVNETIGSQAAIEKLNKSLESFPSLSKEANIFKELCECYLLVGLNDQAYQAIQSAIQLAPQDASLWLLSAQTLIRAGARAHATGSLAHCLSFLPDGTFSPCSXTALEGSA

SEQ ID NO: 18666 - protein, 1068 aa, Candida albicans
SFNHKSINPILFTLKYLLEKSYIQAIYKVDKVTRLYNRSDGTKLIDYLFSMCRIRLYSIPADVEGARHIREYRQLQSKSLKLDRQYASHFEQLLKYLDFSHSNWFIGKQLSIELLVHQGSLLLIDCQCTNELGTASNDELKFHLQRWSNKQSATKFTNDKSHTNNLSNTDTSGDRIKKIYDQIPSPDLSKYMVNEKNYQFIKQSKASILSTTDKLSTLANDSEHQDMIKIDGIKSTLYPFQVKSVGLMLERECIKRRTIMPNFIKLESPLSSNFYFDLFTKRIYLHADVMSLPLGGILGENMGLGKTLMCLSLINLTKYEITKIPSDNFLLYNEIEIHDEIKTLTEICREKIIHSSIPWKLYNLPTSVTANLAKHPGYFCIDLNDHEKNKRSHKSGFLINRNGVDTCKRASRTTGTKSTSYLKLYMSSTTLIIVPDNLFIQWVDEIAHHVEPNFLKILCAANYIKSDQIKDQFLPNPKFVNTIPESPVELIEYDVILISQSCLNNSFANKYRNSQKNGNSQVPSLRQVYWKRLIIDEGHIVQSKTSNAAQICRLLFSERRWAVSGTPTSGLTKIYMEEGEEDTGEKRNSHQAQNNIHVLENQFFAKTELQRLGVLISNFLKLEPYYTQPKLWTQDIINPLINSRYGSELIFSNIINSIIIRHQPNQTNIKLPNFHHEKVILEPCFQDSLSFNLLAAVLAVNAVTSERTGIDYMFHQSNRQQLRRLLSNIQRATFYWTGFQQQDVETLVSICDEALLKSGKYNESDVELLRRSKNIALIALNNQRWTIAQLIHELGYYISKDETNQYVSSVWGISAYTPDVSVFAAPQLLRLQMFWKENWVSSFDNEQTFRDKFENTAKTFWDQYLHQEFKKNDRHVAMDKLIKKNSGAELYTLDNISKSFNDVTPPKRTIDKEAQAQSPPPKKKRKVTFTDAVIEEDERKQKEPPQSKDAYDNVSKDNKTIEKSDRSIPPFDMTGLFKNMNILGTSSAKLTYLATSLLENQRNRIKSIVFFEFEDSAYYLIELLEILKIRHIIYANFITPIKRAQNLYDFSNYDVDYRRKIWWYLFGL

SEQ ID NO: 18667 - protein, 855 aa, Candida albicans
TLQMAPSRNDVADNESSSDSDTSNIGGGFIIDDISTTRTKRPRRAAARKAANISYAELSDDQESDSIDSDTFANVPAPVKKRKTRTSTRVQSKEKETKKKKTASKRSLSPDDEDDDQEFTLSLDDAKESETTDDDEVEYLGSNQIEKNGSTSAEAIDLADDLDLNNDPDENVPLASRKAPKKRAKGGKRTKKEPKPKMSYYERTTNRLFEHHPSLKEVFPYLKNTPKITPERAEHPPGMTIKLLPFQLEGLNWLIKQEDGEFNGGILADEMGMGKTIQTIGLFMHDRSKGPNLVIGPTVALMQWKNEIEKHTEPGMLKVLLYHGSNRSNSIQELSQYDVILTSYSVLESVYRKQNYGFKRKNGLVKEKSAIHNIEFYRVILDEAHNIKDRNSNTSRAAGKLNTKKRWCLTGTPLQNRIGEMYSLIRYMKLDPFHSYFCTKCDCKSEDWKFSDGRRCDLCQHPPMIHSNFFNHFMLKNIQKFGIAGLGLEGFNNLRLLLDHVMLRRTKIERADDLGLPPRVVEIRRDFFNEEEKDLYQSLYSDSKRKFNDYVAEGVVLNNYANIFTLITRMRQLADHPDLVLKRVGSNAISNEIDGVIMCQLCDDEAEEPIESKCHHRFCRMCIQEYMESFMGASNKLECPVCHIGLSIDLEQPAIEVDEELFTKTSIVNRIKLGAHGGEWRSSTKIEALVEELYKLRSDRHTIKSIVFSQFTSMLDLIQWRLKRAGFNTVKLLGSMSPQQRDNTIKHFMENTEVEVFLVSLKAGGVALNLCEASQVFLMDPWWNPSVEWQSMDRVHRIGQKRPIRITRFCIEDSIELKIIELQEKKANMIHATINNDDAAISRLTPDDLQFLFMN

SEQ ID NO: 18668 - protein, 145 aa, Candida albicans
TIRTTMPELQQPDKHSMDIPHVAAIDLPLNVHNVTRAVDMLGGEELIRASIRESHPLELRLRKDPFHHPIQALSNNSERILMKIKIPKKSLPKNNESYSIQQLLELNNQDKLTPRERIQPVAIIDKTYLFKAMADFQNSTWNDAL

SEQ ID NO: 18669 - protein, 365 aa, Candida albicans
KEDQIEMVSIPPDTTPGTSKKRKSTTTNDPSPEKDKTRKYAQASRTLKACELCRKQKSRCFRSPENPNSCLRCRFLSKTCSFENEETEGEISGMLPFNLSNQETTKKIDMIHDGINQILNYMKNGARTEDAKLLLDASESMKDRSNSIVNANDQNIPQFDSFKSVSSASPIAILQQLFPHQCNTLITNPMLQNTTLIQKEDVITLGILSEHEVTELISNFRRNYGRWVSFPSSVSTENLIVQIKEKSDLLLTSCCLVSFRYYKYKGPNNRSMECQLLTQHLTQDLNNSLVKYTSFGTCLGQVEFLQALVILSIYLKSLSKLDHSLNLDPWFLSNIGLSTFITKTALIDDFKEIDDETVEIQRETY

SEQ ID NO: 18670 - protein, 473 aa, Candida albicans
DRPDKIDQEGEANPEEGISEYVTDTNEVKKFNEQNVKLGKLPIDPDVAKEVEAELKIKDEKIEPVNNKTLTKEFQDMTKPDQDLPVRESLPLPLKDANDIKKMIIQVEDSRSKIKLGAIQASLPSVCMYTFHNTNNNMTCIEFNDDSTLVAAGFQDSYIKLWSLDGKPLKSVLKRDRHKPQENTRKLIGHSGPVYGVSFSPDNKYLLSCSEDKTVRLWSLDTYTALVSYKGHTQPVWDVKFSPLGHYFVTASHDQTARLWATDHIYPLRIFAGHINDVDCVEFHPNSNYVFTGSSDKTCRMWDVHTGNCVRVFLGHTNSVNCLAVSPDGRWLASGGEDGIICVWDIGSGRRLKSMRGHARASLYSLAFSRDGTVLVSGCADNSVRVWDVKKNTNDAGPEPEAFNNNVNGNETNSDGTLSTQQQLQPQQQQQQSKKESIATSDHMNAFFTKKTPVYKVHFTRRNLCLAAGAFQG

SEQ ID NO: 18671 - protein, 393 aa, Candida albicans
TTNQLYYSTSMGIPILSSDIQESDLYKIRYTINEPSITFTAIKFSPNGQNFACSSSNGKIYIYNTTTGKLITTLSGHTKGISDIVYSPINSNILASCSDDLTIRLWNITQQRCIKLLRKHTYHITTLKFTQKGNILISGSSDETITIWDITSNGGKILTTLAAHSDPVLSIALTPDDSIIVSASYDGLMRLFDLQTSQCLKTLTNSTFGGHGTATASTNDVINFPIAKVELSPNGQFILNSSLDGKIRLWNYMENKVYKTYQGINGEKICEKFNCDIKFITRNVNSNAITITSNNNDDEQYNNVLIVSGSDSTGLLIWDIQLKQIVFQVDPQTCGKDAILGVDTYKQGEILGCCSRDGIITILDMNKKYTERNDSVQQQKEVIDTESRGETPI

SEQ ID NO: 18672 - protein, 288 aa, Candida albicans
IYQQVFKMVDESKQLQGNKDGDKHQTQELTNTSGNSQPSAPTPAQVPSVQQQQQQKSSTQNQQSTTGSARSSQGRSNQPQYSQADLNKIVLEYLNKKGYHRTEAQLRLESSNIPTPAVPLATPATTELASVNEIGDNKDLKEKLTKAEQELKELRDKQSKIEKELREAKDREVKISKEKELKQLKELEKKTKRESDPEIYFTAYSMLRRWVGSSLDLYKPELSRVLYPLYIHCFLELISKGFSSEAKLFFDKFRSDHLVLHGIEVEKFAGLSLPEHLEDLHHGLEISI

SEQ ID NO: 18673 - protein, 331 aa, Candida albicans
KGFTEFSKKSITKHSLPLTECNSPSGVNDNNKGQLFMSTRASKLSAFQEVKIQELSSQVPVGHIPRSLTVHVNGDLVRSMNPGDTVDLSGIFMPSPYTGYRALKAGLLTETYLEAQHVKQHKKQYDSMTLSSQAQDKIDELLLQGDVYNKLAKSIAPEIYGHLDVKKILLLLLCGGVTKEIGDGLKIRGDINVCLMGDPGVAKSQLLKAIGKIAPRSVYTTGRGSSGVGLTAAVMRDPITDEMVLEGGALVLADNGICCIDEFDKMDESDRTAIHEVMEQQTISIAKAGITTTLNARTSILAAANPLYGRYNPRLSPHENINLPASFVVPF

SEQ ID NO: 18674 - protein, 315 aa, Candida albicans
  UNSURE (265),(298): Identity of amino acid sequences at the above locations are unknown.
ETDAIWFRVQLFSQNKKNIVILSTTSTSSTTTTLERGKEKKMKKKRKLIFTLLNILFLFFLQSLSNNHNMSTTTAAVLPTVQLQVNYNEVKTIAKDFITKFKDSMIDIDDEINQTHEGKYMNILQQVANRQKTSINIEFDDLKLFLTNYDPDSSNTYQEARRLLPTMLTNTRHFVELFSQVIDDLMPEPTEEISYRDDVLDVILHQRRLRNARLQQESNEEFNQLRDGFTQPDSAAANVGGQEDNIANPTDANLFPAKLTRRYCXYFVPLSNAKGLSVRPTKGIFVGSFITVKSIVTXSSDVQPNCHGSLAYTRE

SEQ ID NO: 18675 - protein, 668 aa, Candida albicans
LRPVHTHGEGPDRQNFKTKVKNYSQLTIHKQNYQEFRKVFYREAYELLALLDEQVELIRQDLDNIKVKGTDVPRPILKWSHLALPTNLSSVIHDKLKFEKPSAIQCQALPTILSGRDVIGIAKTGSGKTLSYVLPMLRHIQDQQFLKDNQGPIGLILSPTRELALQIEKEILNFTKRNNNLRVCCCYGGSSIENQINELKKGVEIIVGTPGRVIDLLAANYGRVLNLKRCTFVVLDEADRMFDLGFEPQVNKILTQIRPDRQTVLFSATFPRKMETLAKQILTDPVVIIVGGISVVAPEIKQEVVLFETSAEEQDKYKQQRVEKLHDILTNYQIEHPDSKILVFTEKQNDADELVANLLSNKYPAIAIHGGKDQMDRKYAIKEFASMDSGINILIATSIAARGLDVRNLGLVINFDPPNHMEDYVHRVGRTGRAGAKGNAITFVSSSQPKEVFNLVKALKLTHSDIDPKLEEIANKFVTKVKAGKEKISSGFGGKGLDNLQEVRDNKLKLEKQRFGDQQPQRQQEETETKKLNDEPVPDIALPEFNIIEGNTPETSGPDKCKFYCRIVINDLPQKVRWNIVQRESLSKIIDESRTSITTRGQYYPPGSKPLSNDQERNGSLAKLYLLVEGLTLQSVTEAITLIKKKMLESLDILNQRENLQPTGRYVV

SEQ ID NO: 18676 - protein, 314 aa, Candida albicans
VFLYLLQKRKKTSRACNHCHKAHMTCDSGRPCKRCIQRGLDSTCEDAPRKRKKYLQDVPNSSLMSNHSMNSSDNLDSNGVSPMQPTLLLPMPPVQELSLPTNIPNQSQVPSQSPNTALQKQLLYSPPLASTYSPNHKTYLATLFQHSATSPELMQTVPEYFPELYNQHYQPSANPNQKRRTNFLSTAADLEYSTLSNILQENFGHHTTSNEGTPNSHNFSPALSPHNMPTNNTNAPSTSTQLLTNDQQRQATSFNNHTKHNTPSPLNTSHTKLYEDARYPKCDETINQYFLGDTESGKMVVFPDVLTAIENIKN

SEQ ID NO: 18677 - protein, 97 aa, Candida albicans
QNVRNEFCVLNGWPKEELIGKDKRKFIVELLDDKSVLQYFQVFSRIAFGDFLGAIMTECTLLTPNPNVKIRTGCMWTLKRDVFGIPMMIVGNFLPIL

SEQ ID NO: 18678 - protein, 646 aa, Candida albicans
  UNSURE (425): Identity of amino acid sequences at the above locations are unknown.
DYTYVYINLQENTDQEIFFFFLFPLLFTFSSGQPFNQHLWEYLINWISFGIHFLTHPPISIPNCIETILPLAPPTRFLFIMTKKLTPQEKKNRKPAVRACVFCHQKHLQCSNERPCKNCVKRNIAHGCQDIVRKRVKYLTGEGVPGAVSNKQSTPRKKLKTGPVSTSVSPMDSVKSELTTPVESSNHFPPPMSSSVDALPTTQHSAIEIPPNDQPISDILEVPPLFDSSHMISSEAPETNITLTTQNLITPDPLLFHTNTVSNTTTDVLNKLLNDNYETESMLSANNSNGDHLLGMAHTLSGHLSNGQQFQSNYLNEEYMMLGDIILQSKQGSPSPSNTSTSENNTNTLSPSSFGYILNINFEDFNQPKRKVVQKLKDSRPFISLGFTADLAPHDNNNNTDYYDDKMTNNITGKTEEGPGNPIIXYNTKFTTDYVPPSITNNLYKTASDLYSKELKNFYYPLSYHALTKLLKVIFGGNDLSPEEKQEKRSKLLIILKLIASYRPTFIAAHRDLIQEDLLMLEMTLQRSLLDYKKLAELNSSPTIMWRRTGEIISITEDMALLLEHLLFDLLKERRFIFELMDDNSIVDYFNLFANIAVGNLKSVIQTAIQMKTKSSNLIKFTCVFTIKRDIFDIPMIVIGQFLPIV

SEQ ID NO: 18679 - protein, 808 aa, Candida albicans
NIYYIEGLRMPPKEDKKEKRTKPCCNCKRSKVKCVYTSSLPCERCVKTGQAATCQFVPKLPSFKLPSIDSNNHATRLPFTTPVLNAPCTFTPSLNNSGPLPSHLINSNLHNPIPALIPTHSSMNTQVYNNLALPPTLQNASDTAWKSQIEHRLSGFDSKIDNLVEMLKVNQQFVMNNQMQFLQQQQQQQQQQQQQYSISERQENYPSGYLTNGNSSQHVDTHRTELNSKLIGDSNESQKRKPEISETRHESPKKRKFQTEFSHDFRDGFLTKKDAHELFHFFDANISQQLFGFEISKFDVDEIWDSCPILVCAISTIASIHHPKLSTKSKQLQVYLHNLCGSIILNKPRNEQDGFNTIVALILCSFWLSDSQMFTGLALQLAKEYGLNQPNQKNKDKLKLWYLLYVLDGQQSLTFNRQPLLNSQEYSLKHSKELLLGEKGNKLSDLKSKALIKNKNKSNSKPLTDEEISKLMAKQRLTDMRLVSQVEYNQAINEAFKGTAWDLLAPASFGIPSKSNLELDRWMVSWTVLLSPESFGAIWSTKSTLIYYNFAKMHINSSAVRKITLDPNNGQFPKLDTSLSHNSTSNCSNNTLAVKKQQPNYDSEDSSDDEFDEDEFISNKELVSPDEAVINANIALNAAQTVLNLVINDKDILDNLKYVPVHIHIMLYYASLLLINPPKRSNNQTVQMNDIDYYDNLLNNLKVVRILQRKIYMNLPIDSSFGNRLIKNLQDVLGEKLHEIQIFVDELPDDHVEKHQLRTKVNALFESSENKFEEITEYEVSSSGASSKSTTPLPEKISAWPGSNHGHP

SEQ ID NO: 18680 - protein, 116 aa, Candida albicans
TRDFNPATTVFIRVLIEKKYALPYQTLDELVFYFMRFRNATINQDENMENMDIDQEKTTKVNNGPQLPVVWHKAFLSFATRYKNDLTDDQKDFLLETVRQRFHPLIGPEIRRELLS

SEQ ID NO: 18681 - protein, 214 aa, Candida albicans
TRIRISARGEEQRNRRKLYVALLAGQIIKDIEATEDLLFDDNKDKENRSPTKNDPFRIRIVNQATKLMSYFILDQELNKLISLHNIDWLYHHACVMLTHPKASKAIISAYLVIMKECKLSAKKKKALFETGDLAEKMLFALINMKRFPSSSLVSEQFMCFKNFVNLFPGIMAKNISHWFGMLLLNICEVGSPFYLKCFSVRGSLFVRGGKGIFR

SEQ ID NO: 18682 - protein, 593 aa, Candida albicans
  UNSURE (30),(31),(580): Identity of amino acid sequences at the above locations are unknown.
NAFPFGVHCLLEVVKVFLDNRKTRAYVKLXXSSTYSINIKSMSSSESIVIDSDSNDSQSQKVVDIVLSKLLELIHDGQFKEAMDIWVALTVLVGYSGESFERWEHLSKWLQITKLCFNSQVPQARVLALSCWKAIIFNLCRNDLDEIRKTLDPVMGHSNIKDKQQQITTVMKPKVKLLTYLFGSFNAAEMEDEVIDTLHNLFVAILYSTINPLVIKLRTKYLHILWDKVFQFVFINFYFKKDASNARMSQLGFAVLSKLIKSATPVNERNFNEVRCLSNEPVSINEVNSLPPRWIYSKFDKIMQNMILIFLLENLHVEDKIGFFIAFLASIKPIVKNEALVSPTTFDIIDNIPIVLSHLFKTNTLSHDLAIKLIVNLHDTFTSSLLVRRANKQDEIDTSNNIYLPVLANCSKSLSKEKYLEIFQLITQSLSHKKILVFIADYVQLGLKMEDVKAVISDILAKRTVELSSEELGLYGEICQYFDTGFETFVKKLIQTIVVVSDSEKMLNCFENLNITSWNYSIVIFLLLLLKNAPNKHIFQFTINLIEKMMKSNFIATLELLTVQDFEAEIFPLNGQIYSXSLAYSGENPLHNL

SEQ ID NO: 18683 - protein, 481 aa, Candida albicans
TSTCSLPDIDFHQIMSSNKSLKPIRQDYIAKVRYTNNLPPPPLNPKFIEYNTTDPISTQQEGEYLISSLFRKENFQNLMERIDDQLGLDLNLINNRGFLSEDKMNESVGKLKYNQLHPNDRALLRDAGIGKILKNEPEVSFLRRTEYISDRPLSKGGNNLNTATEEIKVKEKLSKDEHFDADSQLQNVEESFTVANESLYDLKNIKHPKKKHLRAVNTWPLLPDTSMLDNVFINLRFMGSASINRELNNLKQQQQQQQQQNDKKFDEKLFDRALESSLFKPIKLEGGEWISMYLLDATNTSTTANDNDNEEQINDLYEKLHSTKKEQPINLLDEDEESLETYKFKYTKNYDMTYQPFEHENEELAIKFVSDEIEDPVSKDNFKRKRKMAYYYPINGKIELKKHRASTNSEINKFIKERTYDGINFILREPSTNELKRLDTIRSEYDPMEYEGEDEEEEEEEEEEEPLEEEQQQQEVETKEE

SEQ ID NO: 18684 - protein, 437 aa, Candida albicans
NFVLTSTMSFNQQSPNFSSSSGMNANTPQQQQQQRGGNLPALTPQMLQSLTPQQFQLFRSNPQFQEVMNQYMQKQQLLQQQQQQQQQQQQQGLPHLMNGIPNQPQANPQFRQQVVANQMPPNMVNVPGSQTIINQPIHGANIPINKVPSRRMSSIPGIPGGQNPPVGVPGGAGPPLAGVPGATPLVPGQGPARSVGGVLATGVPNPGGVPSTGTLNGAHGNAGLNTNLPPGVTPEILNKVPMKPMQNVKEWSEKLKQEGKDVPLDLKVYEDLIRKDKEFVGKLNKQLHDNKFIMENINRDIKSYNQIKQLRMNSIALSNKGQYNNSIWGEGYQGYGNGITNSSTKLFIPNRDLTDRIINERVMKNKNKPKHYVPIRLEFDQERDQFKLRDTFLWDLNEEIIKVEDFTAQLLEDYKFISKVHYETILSSIKEQIADYL

SEQ ID NO: 18685 - protein, 222 aa, Candida albicans
ARFLPGPWVKTGEFCTAIAHSIREQSQMYYKALNMVGYGFDGSPVHEDEIRNHLLPPLRLVSSDSGIVDDFFSILRNPSSLPDFSPTLGKLSQLEVERLDKEMERESRRKRRHNYNEDQQQGSGRGFTSRRIAAHAGRGNTIPDLSDIPKTFRTPAPSSILPGAVDMGVPEVYEYNEVLINRTQVRNPDYRPPTPIRVENELVDYNHDPIEGTFMVTIKLPV

SEQ ID NO: 18686 - protein, 211 aa, Candida albicans
FFNNSVRLCVTEDTTSTDMGNKKKTRKTVPKEFISLFRVHSGRDAPRRDTREVQKSKKHGFRFTSLPDLPVASNALQELLLEYGLLNDIKWDSKGLKASKNKKTKLKPINSFIAFRSFYSRTISNPEHQRELSSKLADVWTQESNQEVWKQYTQSYNNYLLLPDAKLNFVDWLCEALDYTIDNTTPQIEDILLTSYNQLLSGTIEDVYIMK

SEQ ID NO: 18687 - protein, 328 aa, Candida albicans
NNLVKIKKDTVDYCNHYVHTGEPGVKFIRNVKNPLEGYPKLAKLHHLKRLQIKKHTSQAYGVRCTTGEIVPTLNRWIENYNIRFDVIMIGALVENQFILPILNSIPIHRLCSKPGFLFIWSTTQKIQELTRLLNNDNFNKRFRRSEELIFLPIDDKSPYYPHDSGATEVIPLFERQQWHCWMCITGTVRRSTDNHLIHCNIDTDLQIESPSDKTKQKSTYNAVPEAIYRVAENFSNSNRRLHLVPSKLGYSTPIRLRAGWVIMGPDVLINNFEPVKYNEELYAKSMIKYKPNNGIAANTNTTTTTQFLVPQTNEIEELRPKSPIISTK

SEQ ID NO: 18688 - protein, 83 aa, Candida albicans
LTMGKQQKKHSKGRLDRYYYLAKEKGYRARSSFKIIQINEKYGHFLEKSKVVIDLCAAPGSWCQVASQLCPINSLIIGVDIVP

SEQ ID NO: 18689 - protein, 512 aa, Candida albicans
LTMGKQQKKHSKGRLDRYYYLAKEKGYRARSSFKIIQINEKYGHFLEKSKVVIDLCAAPGSWCQVASQLCPINSLIIGVDIVPIKPLPNVITFQSDITTEDCRSRLRGHMKTWKADTVLHDGAPNVGLGWVQDAFTQSQLTLQALKLAVENLTAGGTFVTKIFRSRDYNNLMWVFQQLFEKVEATKPPASRNVSAEIFVVCKGFKAPKKLDPRLLDPKEVFEELGGGNESKQNNEAKIFNPEKFSSQRQRQGYQEGDYTLFHTMPIMDFIKQDDPINQLGSLNKFDLPAPKDDDNDDDDHDHDHEWKILSKLKLCTPELLECIKDLKVLGRKEFKMILKFRKQARDILGIDKDEKEEEEENPKIEVEPLTEEQKIDQELQDLINKQKQKAKRLKKNANELKQKEIIRNQMNMLTDMNIGIEAAQIGADSLFNLKTAEKTGQLDKLAKGKKKMIFNDEELAKDNEIHIDEEEINDNDKDSADELDELENQLDDMYHQYQARKSSPRGWKEPHL

SEQ ID NO: 18690 - protein, 124 aa, Candida albicans
LDLSMSDVIGTKVAIPGASGAGIIRYVGQIQGKIGTFAGVELLGTLATTRGKNSGSVDGIQYFQVEIPKSGLFLPYERLKSVNPGLANVNPSSKTPLTPVNNRTYQNVRNSMINENFANPDRHL

SEQ ID NO: 18691 - protein, 428 aa, Candida albicans
IPQDRSRSPIRERSPIRERSGNSYSGSGSSGRDSYSRRDYGGYSRPSYGGDRRRDYGRGSYGGGRNGRDYGRSVATSDADYRSKTERNFDNSIFIGNIPFDCTSRDIEDIFKKDFSIVRADIVTNKGRSRGMATVEFNSKDDVREAINKFDRYEYRGREIFVRQDYPPPEKKHDYGPPRGRGTTYDSRSGSRDRYNDRYQSSRRDDNNAPPAPPSKPGTEVLIGNLPFSVNWQALKDLMRDAGEVIRADVRLDNYGNSRGFGTVVFNTEEEAAKAVEMFQGYEIEGRKLDTRPGRSTGSSSGYERDSYRSSDTTEKSSYGDRSKSAVANKNSEFTDGVTADGEKSDTIYVANLPFATQDDDLYDLFETVGRTTKAEIQYADDGRPSGNAVVQFEIADLAENAILQLNNYLYGGRNLQISYAKRPEEKV

SEQ ID NO: 18692 - protein, 385 aa, Candida albicans
SCHGARKLCDMLVSLEKTNTTYCTALTRTLMDDRYFYGVRIAAAQALADCSNEANNFIGLEYLLKAFGKLYCFDDSFIPKSNDFSDFRGFMLQSAFPRILCGVKDNDGKVPKRIQNLLLNLVKFNDNSMNAFVDSLYVSELVVSLVTSTVSGWRNDIEEYNDTEFAGKVLSELFRLQKLDRWIPSYQNIIEVTCIQQNIRMALVGARKLSFEELLYMTLDKYPMEARVEAFRGILELGGLKNKSILQYFLKVCLLNFERPLYRSKLIEALVKSVSSVATYGGVSTLDDPEFHTKVDTNVKSSSNRIIIDDGSQDNSAMKSKRDDMARASIKGAIEILRRDFSEGQGLRETSWELLHTSLIGLHERRSIFCLCQVLFKEVDPYVVK

SEQ ID NO: 18693 - protein, 480 aa, Candida albicans
EESDQGRAIQNLAQQNNDSDDDDDDDEDIGNYDMVVPSGDFNNVKETPHPIDLSKKVVSWSIFNPVCAHHVGWAVGCFESFVLSDESAGAKEDDEEDTVLRGDDAENVNNPVTIYSLPEDVEWAKNTSIITNKALDFFLKEYGSFPFSSYAIVFVRYLPCQTSNFAGLSVMSSKLLYPPDMIEPMFTVTDILLKSIATQWAGINISPQTFNDMWCTIGIAGFMAISFIKKLMGANEFRYKLRKQMDKVVAEDVGRHAIASQPFKYPVSEDDLSFVWLKSPIVLFILDNRMTKTDKSFGLSRVLPKLFLQAMSGSLPNGTLNTEHFRYVCEKVNRNKLENFFKQWVFGAGAPVFRISQRFNKKKGMIEMNIRQVQHHERTPKKLDSSSFIGDAVAYLDNEPLPPQQHVFTGPMTIRVHESDGSPYEHIVELKEANTKLDIQYNSKFRKIKKKDDGVDPGIAFNQFGDVLLSHAEDCRVEFT

SEQ ID NO: 18694 - protein, 221 aa, Candida albicans
  UNSURE (221): Identity of amino acid sequences at the above locations are unknown.
PTTIFNVWYHKTFNNMRSALNHGTPRMVGGLIITPLARHINAKKVVNPVIQSFKVAHQRVNIDIDLSSNSIDGSTELTVIPTSNKLKVIKLDCREMEIKDVLINGSRSLNYVYDDLLYINNPEYFEHCIDSKVINVMDLYSDTFNVHQHHIIRSKLDYIFKNPKHDEESLEYNTQELKILLPDNMKFELTDINSIQTPSGTSHPGTTTPLHLKSKGTGNEX

SEQ ID NO: 18695 - protein, 62 aa, Candida albicans
YTPIQLKVVYKVKNPQNGVNFVTNEDIEKKLWHAYTTNSKYNVSNSSWFPCIDDLCSRSTWS

SEQ ID NO: 18696 - protein, 240 aa, Candida albicans
  UNSURE (235): Identity of amino acid sequences at the above locations are unknown.
AKKKLIYLWIKMSSVMDKPTSRQPLRDSSNYKNNSETTPSKSRTQLSVALPITQNTPPESISAIRRSDANLFETPTRFYNIDTTSLVGDSQHLMMQSSYLSPAFSSPTQRHSQEQNSDKLASSPIKKPSETKKLKSKAKTNTSPPKASRSFNLQSEDKPPYSYATLIGISILSHPEKKLTLSHIYQWISDTFKYYKKGDVGWQNSIRHNLSLNKAFIKGEKSKDGKGHYVCPHGXRNPRS

SEQ ID NO: 18697 - protein, 258 aa, Candida albicans
HLHNPFYIFASLLSTVISVAMSSSNDTPSLFVTPQTPPRQQQRRKSNTGAISTPVASSVLLTPSTTTKKPTRTPVSQKRKQGVQLSPPQANKFPFTPITPQKSPCKTRKNLDLFTSNEKFGLLLPSPSTIGSGRCHNSFTQAPPPLFDLKNVNEFKVPKTPAKQIIDNSRTKESENEDDWEVMDIDEVAKIPRAKLRNPFIDTFEPTSPVTPEESTGDRINYDTHMELINSKTGKKRVVKLTKNQMKIKPKRLSFDNI

SEQ ID NO: 18698 - protein, 391 aa, Candida albicans
IFIPVENTISVYYMNLKDITDPSDFKTTKLPALAELDILKRCYICKDLLNAPVRTQCDHTYCSQCIREFLLRDNRCPLCKTEVFESGLKRDPLLEEIVISYASLRPHLLRLLEIEKVESKQEVDREKSANESALNGNRNVNNDVDETVRVKDQLNADKLGEEKGQAQHWEQVNEQTTEVILLLSDDEENGSDSLVKCPICFERMELDVLQGKHIDDCLSGKSTKRTPTDILSPKAKRPKQITSFFKPTIDTKTPSPPTSKASTTPTATPTTTLLKANVASPSPVAQSTVHKGKPLPKLDFSSLSTQKIKAKLSDLKLPTTGSTNEMEARYLHYYVIYNANLDSNHPVKESILRQQLKQWEMVQHQPSFGDAQWKGAETGNWKELIARARSN

SEQ ID NO: 18699 - protein, 314 aa, Candida albicans
RPNIVKWNPMNTNILAAGHGDGVIRLWDIRKQDSYIAELYGHNNYSITTSMEWNNNDLFTGSKDGNIIHWDLSNISKDSQWEENDNTKLPISCGLKEGFNSIEFNGKANKLETKLDQYQCGTILPASNSSIVAMCSTTTTTSSNDHDDEEIKILSIDSSSFLGVHNKVSESINVNINTNKLYYTEEDIQLLLQSQLNNNNITSSSATGSNDTLISFGNNVSQDSLVKPLTISRKPTTTIKNNNNNTTTRPTNTHTHSASIDESIVSVHNVSNDTLVNSPTRFNICESEDEFTFNYVQTNTFSSTGASKDPHLLS

SEQ ID NO: 18700 - protein, 407 aa, Candida albicans
NYLTWLIIIVCVCLFVFFFVVSASLNFSPSIQIHINSILGSKQRKKFWSKRNETKPTNILTNLPPPFPKMLSPNDRNKKFFNSLTPIVLRDKPISSYASSEIITVAINQTGTRVVYSRTDRSVRIWKCLPASVVDPKTIVDAHLKAVECLSFNPMTEFTFATVAKDEYVKIWNANTGDKLHEIKCEFDSLKLVRYSNDGQLLVVVDRASNFLFFNVGANYKLIHKFKLDEHIYDLKWFNHDHQFFLVSSHDGSILLYEIIDGDGDNELSSKLRASVSGHNSSITTIAISPKGNYFTVGSSEGVISFWKTLENLINLKVITDVDQSIAQLDISRDGTYLAVAYDTDSNLRIYEAEGSELVHEIPNSGSGNQTFSSIVWFPTKTGFAYTSDHGTVLTVMIKPIEQKHRR

SEQ ID NO: 18701 - protein, 331 aa, Candida albicans
PSKKQKREAQKVRELDLIPKDLPNVLIKFQASDTGESTGGSIRVPGGITEKQLEELLNNLQGESDDPVPYTFSLLNSDEKDTTNNNNKLIDIKDDLYHSVLKPGIKTTEDFLTLVYTPRAIFKVKPITRSNAAIAGHGSTILCCAFAPNDSSRMCSGAGDSTARIWDCNTQTPLHTLSGHSNWVLCVTYSPDGKLIATGSMDNTIRLWDATTGKPVGKPLLGHSKWVSSLSWEPLHLVKASDNPRLVSGSKDGTVKVWDTTARTCAMTLSSHTGAVSCVKWSGSNIVYSASHDKTIKAWDISANGKCIQTLKSHAQWVNHLSISTDYVLRK

SEQ ID NO: 18702 - protein, 156 aa, Candida albicans
LRKGGFDHTSTRTTQISPEELRARALQQYEKVAKLNGSISERLVTASDDFTMYFWEPLKSSKPICRMTGHQKLVNHVNFSPDGRFVVSSSFDNSIKLWDGIRGTFISTLRGHVAPVYQTAWSADNRLLVSCSKDTTLKVWDIRTKKLSVDLPGHSA

SEQ ID NO: 18703 - protein, 394 aa, Candida albicans
LAAPPGPPTPVTSLSVIDKSQYIVNPTQRANHVKEIPPFLQDLDIAKANPEFKKQHLEYYVLYNPAFSKDLDIDMVHSLDHSSVVCCVRFSRDGKFIATGCNKTTQVFNVTTGELVAKLIDESSNENKDDNTTASGDLYIRSVCFSPDGKLLATGAEDKLIRIWDLSTKRIIKILRGHEQDIYSLDFFPDGDRLVSGSGDRSVRIWDLRTSQCSLTLSIEDGVTTVAVSPDGKLIAAGSLDRTVRVWDSTTGFLVERLDSGNENGNGHEDSVYSVAFSNNGEQIASGSLDRTVKLWHLEGKSDKKSTCEVTYIGHKDFVLSVCCTPDNEYILSGSKDRGVIFWDQASGNPLLMLQGHRNSVISVAVSLNSKGTEGIFATGSGDCKARIWKWTKK

SEQ ID NO: 18704 - protein, 230 aa, Candida albicans
SRFFTTIKPSQSTESTLTEKVSSKSPPLPPPPPPPTASPSLPSEKLLEFGFDGTKDSTSTRTTTTKSKDVEKRKSTTSSGSSFSSESKPKRPKEKRLTPLEKQILELTEQHQDKILLIQIGYKYKVFGINALKVSKILNIMYISNDIEDTRFHYCSIPDTRLHIHLQRILSHGYKVGVVKQIESTIVKQIEKTSKSSDVMRREVTGVYTKATYVPEFSHNWGMEEPRELR

SEQ ID NO: 18705 - protein, 77 aa, Candida albicans
  UNSURE (5): Identity of amino acid sequences at the above locations are unknown.
LKVLXTINRYRKKSVTEYLKLLQYHEEMLIKTCDEEFQNFLKDLDSNYTLFYKIIKNLAIFDCLLVFNHYKSTSQLY

SEQ ID NO: 18706 - protein, 298 aa, Candida albicans
SLTTTSPLPNYTRPTLIDDDLTILVKQARHPTIEQLRPNYVANDININIEYDKNRVLIITGPNMGGKSSYVKTVALLTVMTQIGCYLPCQNATMGIFDSIFIRMGANDNILKGYSTFMMEMLQCKNIILMMSNRSLIILDEIGRGTGTIDGISLAYSILKYLIESEFKPLVLFITHYPSIHVLEQEYPNQLVVNYHMGYQEIKNNTPGEIPEIIFLYNLCRGVVNNLYGLNVAKLAGISHDIIKQAYRVSEKVKLDIELKEYWKFAHSLNKALKEGGSSSPNQLDDIDYYILSKHSSL

SEQ ID NO: 18707 - protein, 224 aa, Candida albicans
SQDTISCSGRVDRIMTTTGPEREQEQEQKDEKDAKDAKEQNQEQEQEQENSQQGPEVINVTYKAINRIFIGILHDFPEFLVECHYQLVTSIPRGYIQLRNIVLSATPKDIHVPDPFTQGLKVERLPEINESPVVFYKPIEDLSKVGLKKPVENFLRIPAPGLMRTIYNGLKLNQPKEVNELGYEETINFNIKLINALVLHVGISSVADRLPNNRGFNTKSSQVA

SEQ ID NO: 18708 - protein, 93 aa, Candida albicans
  UNSURE (15),(73): Identity of amino acid sequences at the above locations are unknown.
LVDLMNYGNTEFKYXLINAIANQLRYPNNHTHWFMGIILHVFSNNNMWNSNGNKWVFKKLSLEYYWKEKTVIXTSLGINYLFTDWVILGIRNF

SEQ ID NO: 18709 - protein, 319 aa, Candida albicans
RNHLAQEEKSPFFPLSVEMEMKAYYSKMYNKELEIKEIVDMLTQMKASDDLHSQDVFACMIHSLLDEYKFFSEYPLSALASTSLLFGALLEKDLIQGTTLTVALNFIWESCNQPQDSHLFKFAVQSLYNFKSRLHEYPIYCKHLLECRSLSAHAKMYQIVKDAANGIPCTTGAAPTQTNTPDVGPKYQSINYVDRTIGYATQEEPPESIRDKLLFSVNNMTGENLRLSEIQEVLTESYFAWFSDYLVSDRAKAEPNNHELYSKLVKSLANPIFFEYILNVSLKEVDYIIRNFKDSRSERNQLKNLGAWLGRITLANDKP

SEQ ID NO: 18710 - protein, 161 aa, Candida albicans
QQQKKERFAQAQGVPDDIVSFDQLFTAITANCDKAVQLVSEVTETKLADLPPNHSIMAALTQALVIAQTNAIKYPELLLKAAQYAVNCLFTQTHENPMSNEIYVVILDKLCEYSPSTAKDVIWWLVHSSDQRKFNMPVMLSLLKVKLIQPIKLDLSIGEMD

SEQ ID NO: 18711 - protein, 226 aa, Candida albicans
NLLLILWNNIFLLPKRCVILCYRSEFVNTLDALSKYQANDQSEEDRQAKEAISTLFKLLSEAAHASNQLFAQLGYIFAEWVRLLTHGDDATHELQIEFVKGLIQSGILNNPAYVKTFFKATIEISITSFATEHELRSRTQHETYFAVDTLAMLIVRIVLLVEDSKQAIDYLKEVLGIIILNLINDHETSKANWNERAYFRFFSSLLSTWCDASVLVLPTGAENPDE

SEQ ID NO: 18712 - protein, 586 aa, Candida albicans
INIILKTPPEVNMTTLALGLSLLNGNKDRELSLIEQIKSAMPTKKVIWLLIKRYFQLIYPIIPYVVEDNFREDVERIVGKESYEDVKPDVKIENRMNFATISVLFVICRLLFLSLFHNRGFYNEQILTKKNLTKDEAERKFLILNSIKIHNIEVAQACYQHLQRLGKITLPLLQCAIYLRAYRTLAPEEGDGIDGGDSLVQHSSLVSMSYLLGLNRDPDKISYVSDAKVKHLYRKIWYYCLMQEYTLAHTYGTPLYIRPESYDTKRPYFSLEGAGCRDLEVEKSSLTVFAFISALVKGPIKDLVVLCNNVGQLVKVSEITTELNCIELAITELLGKVSDYVHNLEEESTSYHTNKIMKIGILFRINSLLMTMYCNMFTYYERKNVKLSLFYFKKFFKLSVHETLPYVFSLITRSKELFGEGSDLYINPAILLFLVRTMDVCFSSMVRSNFSLYKMSHKPNHQLRLSSDPSYKEYFDSCNRFMTVMEKVSRLCLAACSIFSSRYYFAWGVVKMRGYFLKLITTPKFYKVEIEGDYVPIATEAKQINELSELIELGLMHLESQVTKYCDDIDFTTFLKKIASNKKLSN

SEQ ID NO: 18713 - protein, 181 aa, Candida albicans
SFILLIMSIDPETRRKLLNLQKTGENKKCFDCSAPNPQWASPKFGIFICLECAGVHRGLGVHISFVRSITMDQFKPEETLRMEIGGNERLKKYFIDNGVDLNLSPKQKYDNYVAEDYKEMLTCEVEGKEFVAKDHSGEKLPDINNTASTTTDPVCRGRPIPVPLTNEQIQKNVFTRRRSNC

SEQ ID NO: 18714 - protein, 513 aa, Candida albicans [sequence omitted]

SEQ ID NO: 18715 - protein, 185 aa, Candida albicans
CLDLVTNVLFMSNLYYTVFDTDVCTVLLVLTLNGFVCYASLGKPAIELKGIMAKDFLSLPYQLKPLSTMTGDKIEIDKSVEKFKLLVETPSVSQDIKTELVFGTPLQRKVWKELVKIPAGQTRTYKELADLLGTHSRVIGNCCGANRIAVLIPCHRVVGANNKLTGYRWGKSYKEYLLKQEGIGI

SEQ ID NO: 18716 - protein, 186 aa, Candida albicans
KSANMVSFTLPPEEGLGKYGMQGLTSLVKMEQSDITNFALGQDISKCGLDLTKDSEILKNLSSPWAETSRSEVEPYYNLPKSIRASSINPPPGPCDSKIQNFTDETLFYIFYMKPRDTLQEYAARELVARNWRYHKGIQVWLTKDSNVEPVLINPDVEKGVYIFFDPHNWEKIRKEFVLHYSLVQA

SEQ ID NO: 18717 - protein, 65 aa, Candida albicans
  UNSURE (59),(61): Identity of amino acid sequences at the above locations are unknown.
QLLPLYHNFCLEVLQQLTIDKLIRIVYLCINRLGPDYEPGLELGLFVTIGMAAPSECYXRXTSKI

SEQ ID NO: 18718 - protein, 312 aa, Candida albicans
RPDLISIGKQFAVSGNTISMILDCEAVAWDREDHKILPFQKLTTRKRKDVNEEDIKVQICLFAFDLLYYDNESLLPKSLAERRKIMQENLSPIEDRFQFATATNSSSNLEVLQQFLDQSIKDSCEGLMVKMLNGLESFYEPSKRSRNWLKLKKDYLEGVGDSLDLVVIGAYNGKGKRTGTYGGFLLASYNEDSGDLETCCKIGTGFSDEDLLNLYNKLHPTEIASPKNYFVYDTNNSNAVPDVWFEPSMLFEVLTADLSLSPIYKTGHQEFGKGVSLRFPRFIRVRDDKGIEDATSSDRVCEFYQRQAHVNN

SEQ ID NO: 18719 - protein, 368 aa, Candida albicans
EAKQKREATPPKSPPRSKKARIETKSDESSSSSSSNGDIEMETEPKLEKNNGSGNDVRNEAEELIKLSESEQAKHSNEKLGVKIPYAKLASVFEAIENESSRLAIIAIISQFFLEVLQQLTIDKLIRIVYLCINRLGPDYEPGLELGLGETILIKAISECYGRETSKIKADYKSTGDLGLIAQKSRSLQPTMFKTAPLDVDTVFDNSLKIAKSTGKESQSKKISIIKQMLTACQMKSSEAKFLIRSLQGKLRIGLAEKSIIVGLAQAFVNYENKSNKKIDPSKLAEAEEIMKEAFSRVPNYEVVLKTAYQYGIFNLLEHCFVTPGIPLKPMLANPTKSIGEVLDRFQNEEFTCEYKYDGVRARAHILY

SEQ ID NO: 18720 - protein, 382 aa, Candida albicans
SVGLSSPVGDDDEADKMLSREFKGIIEQILEFFPPNRQALLFSATFPLAVKSFMDKHLTKPYEINLMDELTLKGISQFYAFVEEKQKLHCLNTLFSKLQINQSIIFCNSTNRVELLAKKITELGYSCYYSHAKMPQQARNKVFHEFRQGKVRNLVCSDLLTRGIDIQAVNVVINFDFPKTAETYLHRIGRSGRFGHLGLAINLMSWNDRYSLYKIEQELGTEIKPIPATIDKSLYVAENADAVPRPFRIDELPKGNETVHNKGYQYKGQPVKDENLGSSSQQQQQPPPQQQQQQSTSPPQQQPQQQQQQPNPQHQFAPHPNGQFPPYPQQFHQPGAIPPQQFNGYPPYPQYPPQFAGYPGQPPQLPQGQQQHAQAQNPAQQY

SEQ ID NO: 18721 - protein, 206 aa, Candida albicans
FLFSLSYLHSTKHTLTYHISNTIFTHNNMTDTNWKQNLNLPPKDTRPQTEDVLNTKGKSFEDFNLKRELLMGIFEAGFEKPSPIQEESIPMALAGRDILARAKNGTGKTASFIIPCLQLVKPKLNKVQALILVPTRELALQTSQVVRTLGKHVGTQCMVTTGGTSLRDDIVRLHDPVHILVGTPGRVLDLAARKVVDLSDLHFCMF

SEQ ID NO: 18722 - protein, 574 aa, Candida albicans
VRKPLTNIDKLLERQNTVKILSQSELHEIRSNIRKGLKYTKNSKSIVNGLEAGKLNWQVWKNLVLFLQNVMYLLKQIRLGFLEENLPTELALFYNQELMIAFNELEKLILLYAEPITSEEDNKLRIINGVDDTLDELRIQYNNLEEVLQETTRIIAANFLEEVFNTVYIPQLGFLVSREADVQTADSTFMPNEWQEVFRTSTNIYYKTDEVWQLDEQYGDIYTSINDREIEIIQSMLAKVSEFNTVIIQVGEAAVELDCLCSLSEVSQFRNYSFPCITDTNELEIVQGRHPLVETFLNMFVPNDTIFDSEEKIMVVTGANLSGKSVYLNQTALIVVMAQIGCAIPAENATLGIADKILTRILSRESLDKQQSTFAIDVYQLSKCISLATDRSLVIVDEFGKGSDPIDSTSMFGGTLSYFKKKSLDCPRCIFSTHFLDLFKDKEFCNMSQSPKIKMMSTENLLEKTTNSMLDNVTYLLQGETQDLLPKSFWEYIVQNFVGISEKVIQRAEYIAQMLDNGDDVAYELTKLSEEEEQNYSVAKTVVTKFLEIELEDAELSINDSIRYMAKFDEIFQS

SEQ ID NO: 18723 - protein, 326 aa, Candida albicans
RSYKLRSFILENNNSEESLSLAISIPKPQSDSIEEILNILSNANSEVSLESRNPLRIISGAIMIDKFESLIENLNQDLVNHNENILRILVHLSIFIAIIKPWGDDQLANLTAIITLYISMLSETNKSELIPVYLSFIPDEKDARETYSMILSSITDKEQQTRQLQAAKKLTQPFVNINEGKDNGDVNVNVNDNVNDNVNVDVDADADMVIVEDDDNNKLINVLRRTVERVMIETAPNYERQQNDPVIVKDDESSVDEIDFKLYRAVEWFYENQMYGDAINATIVVIRRFLINGKLASLKKFAKENNFKQLISDYDIETIGLKPEDD

SEQ ID NO: 18724 - protein, 493 aa, Candida albicans
HIVTMSPDSISSLVNQDLSTPTPPTSLSSTSTNSNTNASSGQKRIRATGEALEFLISEFETNPNPSPERRKFISDKAQMNEKAVRIWFQNRRAKQRKFERQMLRKETDSPGNYAGIYNTYTPNPPTVTTDMTNFNVNGSAGGATADFNDKLKNISSIPVEVNEKYCFIDCRSLSVGSWQRIKTGFHQSNLLTNNLINLAPVTLNQVMSNADLLIILLKKNLELNYFFLAISNNSRILFRIFYPLNAVVKCSLFDNNYYQNNNTNGTNSSDDNNISEIRLNLCQKPKFLVYFFNGSNTNNQWSICDDFSEGQQVSCAFAANDNSLPSNGKNQSFSNTIPHVLVGSTLSLQYLSQFILQHQQRQRQQQRQAQPQPQPQPHNQFDFNSQPFETIPTSAINNNFNTTKTVNSSSMQGFVPGDFQDLPAIYESISNSNHTTTTDLKDTNATTTTTNKHTPSSTTFTPQNLNGSNQSQTNVTSTSLHHGSGRTAPMLRP

SEQ ID NO: 18725 - protein, 67 aa, Candida albicans
  UNSURE (56): Identity of amino acid sequences at the above locations are unknown.
MSDSQIYSATYSNVPVFEFVTLEGPIMRRKKDSWINATHILKIAKFPKAKRTRLLXSPRDCPSEKSE

SEQ ID NO: 18726 - protein, 184 aa, Candida albicans
TDVYECMMNESSIMRRCKDDWVNATQILKCCNFPKAKRTKILEKGVQQGLHEKVQGGFGRFQGTWIPLEDARKLAKTYGVTEELAPVLFLDFSDPNLIIPRKEKPASKEPAAAKRKYMKKAKQAGDPPRRYKTGKKAALQAAELFCCRRRCSSSSLNRNWTGKHTPNNDVRIRNYFAIICYNSC

SEQ ID NO: 18727 - protein, 486 aa, Candida albicans
SHQYFIRTTTFPIEEVQNSSDSDSNGDEKKSNSTSLRNKSSNRNSRVLPFVNQYSTPPLSSDHLNTDEISADTGERTVYLDVIDTPPESQADPLAGNQLKPALDVSPGRNTEQKSKSFLILSPNQFHDNEFHNTRSPMIDSPGTIISLNSNQNTKAVNLSVEDRPRSACPSPFAKVNRQARVVETNDEILTDGVDEDLAIGTPRQEHSRAGTLKSVSSPPPKVPLPSTPSRGEDISKKFSFVETPKGLGLEGVDYDNHEDQRSYIKLQQDQRQHDISEKTSPSSIMSTPKRVVGNFSPAVTNLEPKNSDLSNDQQHKHLQKNQNVSRTASLIKNLKHKRSTSGNQNKLAALFTTGSKEDHRNGHTRQTSDGSLFSSIANAYISPPITNGALGGRNHIRLTSDSTVLLSDEDHHYSNVAVKNDIEQLNSSKVLLEEDVKKLRDERHKLNEQLKMIQSKISSESIRYDNLVAEISELQIRKTKITDRE

SEQ ID NO: 18728 - protein, 745 aa, Candida albicans
RRNRNAPPAPKHNHASALNVAKRQALLLKKQKEKQVQPTLSDTSFGSSTSVPPTTVPKKRGRPKRATLSATPSLQRSDTTPINKSLIDFNANDHSAKSSFIGVVPSFARNDTEQDALQIMTNNMNLRQEDLASVETDDDEEYHNGSRGDGLQNGSFTTKRRKYPGGMTNGNGLESQADLLTSKELFGVSRTSFEKRANQQHNHYLPLQPYHQPSISLSQENQIYSDYFQSLLSYFLDDNNKIRSPIPDSLLSPPLPLSKIHIYQTIDSDGNTIFHWACSMGNLNMVEFLLKTFTHSLNPDVRNNNGETPLMFMVKFNNSFQLRNFPLILDLLKESVLLVDSNGKTVLHHIVDTDSKHKREKFAQYYLESLLEKIVDERQEQGDSNGHAMEDDLTKDELVTKFINHQDSDGNTAFHIAAHNLNKKCIKVFINYHRFINFGLRNLVSCTVEDYLASHNYVLRLDPVEHDQSNNSDGDEDIMEDYTNENQSFETQLHNSKMAINLQNTTANLLTEKMTQLAYAIDSELSEKDEVILTYFKVLSQINQIKLESQRKILSFFKLDHLIEELEQNKDDSQQQQQQVTDDDDPTSVHGNDLHLDFKRDHILQEEIYRLMNDLTYQELHQQDELDKVEHSYRMTKERLHEKVLDASSFVIDQTHQQGNKHEQLELAKQLQVEIIKRKKLVDEISKLTKNVPLPENPNAKTIIDTYPSTDKLYKYCKLISLSCGIPMDEIETSIDAMEESLVKK

SEQ ID NO: 18729 - protein, 262 aa, Candida albicans
ALHGSLHRRVENFASRLASLNLVSSFIELGLNSPIRGNNAGESPLISCIQVTNSMEKGNFTKILSNWLYPDIWLLDKRKRTVFHHLTLQIDKNDSFRFYTTKILEYIISDNNQNLLDFRANILNAQDEDGNTALHLAIEKDSKWFIKVLVDLGADTSISNKRGTKPSDFEIIRDLGSIENDDQIFDLISTGLEFLNKRLEIGGEKLPEVESPKVVTTPKLIDQEGSSSSGKIFNSIQQLLSNTNVEYEKHFELQKRADQTIR

SEQ ID NO: 18730 - protein, 265 aa, Candida albicans
HVHISVITTMDYSGRVNSKKGAGGIASNEDINIQTKQRVQELLSTHVLDIDNDPYVFRNHLGMLECKLCLTTHINESSYISHLGGRKHHLNLERRRILDEKQNKLREHQLSSQNILSINNIEKRSWKKIGKPIYKITKVRDPETLRTGILVNIKLPKITVKEPMFRIMSYYELTSKNQNSCRNFIEKYKSDDDDDAEDDDDSDGGDDNKYQYLVVSAEPYDNIAIVIPNKHEIDKPLEENKMSDSYWWYRDNDTKEFFLQFLYKL

SEQ ID NO: 18731 - protein, 305 aa, Candida albicans
SFGPPRGEDSKYVTELSLFLEATLIKLQPLLDYNALLQNWKKDYDNANEERKSNGNDGDKLFCKACNKLFSKETVYQSHLSGKKHKKNASQQNPDNFVSSLPWLEYFIEKLCQVLAPELEYTRAQVEKLSNLSERELQLDRQVQHNIENEFVAINNEFDDDDLSQNEHGDDDDNDNYLDDSFNNLPLCPDGTPIPFWLYKLQRLHKQYNCEICGNISYKGKSVSMKHFSGSKHQYGLNCLGVDDNNMKMFKNITKIDESTELWKVLRKETQLKVTELENSVEVEDKERNVMSDKDYIYLKKQRLL

SEQ ID NO: 18732 - protein, 141 aa, Candida albicans
WFVCRIDSGIASFNNVSDVGWREKETVVAVSTQNSHNLRKKITVRKFPYTLNFCACFVSNLASMSNFIEVQRSNIQEIGIIEDSLSRRLLRNPYILPSNLQPRPNILVSKVTKPNSTKRISILQQYELRYFKDRYNQIIPP

SEQ ID NO: 18733 - protein, 405 aa, Candida albicans
GAWKNQVNPFNDYGNPDSFIRAQEQQSQVPQLQQPISQQDIQRPQSPQQQGTKALLPQAFPTRRRRKITLLNDIGGSSTRKKHFDEDYLLYNPDISPGHIVTDCSLDSSLVIPPNSNELFLTESESPEFANDIIPGYENDYLFLDDDDEQIEEDVSDDEGDNYFQVDEDFDDYLMNNNGYDGYPTFNNYESSGNNTDIINNNNNIVDETISDANSNSELEVVFDQPKEVSPSAISPASPDSDDMMIDVEDETEIADATAAKEEINKKHSKSGKKESKSQKENQLTTTTKSKKHSHGISGAEITLNNPNHQCNLINPSTGEPCNKQFSRPYDLIRHQDTIHASMKKIFRCVICEGRLNGGPGNGKEKTFSRGDALSRHIKIKHGLVGQDALDLINEAKENVEYIPV

SEQ ID NO: 18734 - protein, 519 aa, Candida albicans
  UNSURE (502): Identity of amino acid sequences at the above locations are unknown.
KMESTLSVSDEKLTNSSTALNNCGDNKELSQVLTTANTTTDNQQVQPKLQHQQSASTEPLSKERTNILLENDLILVDPNQQLKNTVSDSVQDTTGVPSDHGKQQTIGDQIKILISSNPLNIEEYSSHLNRLVTILYEENFTSDFLVTLHYKILQLMDELPKFVDLQNPLKSQLYTIIDKNFDILIKLATNYKVMEVSTASIRFLTTVFMNLNYWEVYNLLNKKPVLYHFLNLIEFDLNDCYTRFINDYQRFTYDKITQPTVKSRSRSKVTKKRKVKGDSDLAGSNTATATTSVTTPDANTSHEGKQHRSEAFFSLDPDTSDHDKYVADVISGANVQKRKFRPDVKLEHHRIIKKPQPAADKLSTKSSNYDPDVIHECQLPSAEEPHKLCLRRFSRKYELIRHQETVHSKKKKLFKCFVCVKQNPGVGPRIFTRHDTLAKHIRVNHKISGKEAKAEVAYSKKHAEVVEEGDITVHVGRRKTKVDFELRAHMEKTISSGDEPNXMETSELQSGEERVTFNK

SEQ ID NO: 18735 - protein, 501 aa, Candida albicans
VLLQYLLLIIQQLIRIPTIHIHNPLIIIDTKPMIKPIYCHCKIRNQTLYQLCSRQMRFLFQDNKLSSLMGNPSQEGSEKQSGLEDHSNTNTFHGLSPITNYQSGAGNILPSIDRLTNKSSSQSGFSDVGHYPKTSSFSKPLSVGAFGAGHNLSAGERDKYPYQGILHSKDSTSPQQLENTSENVVKHEPQSIISDSAQFKDPMEGSSSNLVDSSDAQNHLSVDDKSKKPKTGVIHQCHLTDPNTLQECLKIFYGKNELLRHQEFVHATKKKIYKCIYCARIGAKVQSYPRHDSLARHIRRKHGITGKENKMAVNYAKENVEIIDPDQLITKQHDFQEPVVSESQVVFLPPKEVVPQQQKSQYQQEPPQFDQKLPPLPPQQQYPDPIRFEKPAGIPQFMSKFGESGTQLPSLQLYSIGVSQRHPSTTYPSRYTTQPPQPQDVHKYNDTLPTVSPSVGPGPGPVPVRQPLSVEGNNNNNSSYYNVTNHSQSPSNILEQPKKNQ

SEQ ID NO: 18736 - protein, 159 aa, Candida albicans
KVLYLGAASGTSVSHVADVVGPEGLVYAVEFSHRPGRELIGMAKKRPNVIPIIDDARHPQKYRMLIGMVDCVFADVAQPDQARIIALNSHLFLKDGGLVVISIKANCIDSTVDAETVFAREVQKLREERIKPLEQLTLEPYERDHCIVVGRYMRSGIKK

SEQ ID NO: 18737 - protein, 98 aa, Candida albicans
KHCPRCISLRRKKISVEEPSQRRRCAPNQIRIPVCGIHSDPSLTAGIMSGIDELGIAPGKKFYTWVLLPVLLFPTLLMLLVQKVWFMPLNSLIVQVEN

SEQ ID NO: 18738 - protein, 518 aa, Candida albicans
SIPFFDSMDDYKQLGPGIFSCSRKFPFLTTRLQQYGKSINDLLQYDEASDHAQLARLVDRPMKEINDYYRNLKKDLQVDPTSVNSLLDSEFISTGLPSIDRELGGGIPIGEVTEIFGASGCGKSHFLFQLLSNCGKEFPTSKNIYISTESFLETKRLKDFIGRNSSNIDTDLDRISYIYCQDLESQDHILFTQLPLKLDSDKGKTKLLVLDSIAQHFRREDSIMNSTYLKEKLEVQEGEIADDRLFQEVKRKQMNQLRRFNKSQKYASRTAKLYYICQLYQHLSRLAQDFNIAIVIVNQVSDYSFESSGSFTEAEAGELDYPLNLDFQTAVSSGWDSRTIYNSIPTANITLKNEEIENLEMELAKSLEERSPNKRQKLSNTSSPQKQEHNLNPRERLERQKSLISKSHEMRNRGSKKIVPTLGYPWATRIKNRIMLSKVYKPILKSNMDGDIVNDDQSLQTNSIHDKRSSAELYKLFVSIDGWQVERFAKVVTSTHGYNPNRFKRYRFIINSQGLAEV

SEQ ID NO: 18739 - protein, 638 aa, Candida albicans
KLRGAATRSEDHRHHNQQQQQQQHNHNQDQNQNIFNTNSTFASSHSSVNNTSFMSNTAASSSSNTIPSLPPINLQSLKEIDLHEILKNPQLRHDILFDPQLQFRPNLDGERGKRKKSIIDKYWLEVRKECQGFFNQKVKPEEIKIHRLPILFTTLRDILLSLLPTKDRQQVSEIMDIELLVQQLKHGSFDFVEMSQWLGDVFKLHCAPMRDQWVVEMIEKFVDAYNYNNVSYLVNGLRMIFQILEAMKLDVANHQIRILRPVLIETAVDFERDYFQTLINHSKINIHDSLNWFYKNFVKKFDSIQQQQQPSGGAIESPAKKLSTLHQDAINNTNLKPIIISSVIDLLSCRQMASEFPSTLAFDHTRLVLLRADARQLVCIQLCVVLYKQLVINAKVSTNLLSAKNIAKVQQEILAIVTDDNGNIKWTKNISAISLQLVKNLYPNESNINVSDPSIKSLVQFSHNWLMKHMQPNSQVYGLMEIKVFKELLAEISVLVENDDLISDNSNITINSNVTSTTTTANVTTNTSTSTTTSTTSNSNELKNIATRIATLVKFHWNVFGGYYIDYIKSQRSKLQQEQDNSTMLPTMMEDGDDSNDVSSKKKNDDNKANNTNPTSHRGGENNSNIDNTTSAPLSMLS

SEQ ID NO: 18740 - protein, 252 aa, Candida albicans
  UNSURE (13): Identity of amino acid sequences at the above locations are unknown.
ITQCGSSGPQAEXVVRSSEQISHDQNQEDGNVSGDVESKGERHIHFNDEVMQCIAIDVYSDDEQRYDSDEEDYDSDDDDDDYYDQYEPSNDSLAQSHLYEGDDESIEEADEEVEDDEDGSEDEEDDEGGFFLNVKSNSNAPIILGQHSSASTSTPVAPSLSRHTDITDDTASISTTNSRSYKTIQLLPSTSINYGSDESSDEANPYTSSLSHNVHNDISRRYDYYYDYNTVYTCYPNNSGFASLSKSRMLWK

SEQ ID NO: 18741 - protein, 207 aa, Candida albicans
LQLIMYCYDDMMMETSPSTTATLQFHNNIDYLQYIPSSTTTASSNNDLHYLQDNLMLTTFHKFLKSNPQYKYHDELLFHRLLNICWRSIYKNHNNLRVYNPLEINSDKNSDITWLHGPQLELIEKEKETIPRSCDFEMEVDNISNSSTSVNSTDEDNDVGRLDLFHDDLDNSSISSIESYCSTLEEEEEEKEDHDNVFTTGLPGSAL

SEQ ID NO: 18742 - protein, 396 aa, Candida albicans
LPPYRPLGVKTSEKSEIEIVEKTDNKNIAVHDDIDTSYKTKINATRLEGPSEDKDDLNGNDKQEKTGDQDEQEQENDDEQQRPEVDNDVINLSEPVRKTDKDSDNKKVSEIDNNENVANQISTVNQPSNLQGVLSTNEQNEMSENIKITTFEPILESAEPLTIENKHIILDEPVVLESSQENNNNSIFSSHDIKSSPQNTCTADTLEMNKLFCHQEHDEEEDKCDHQDNHGKNFYPVKHKLDDSEEENMTVISIGDETFQQYDERRPSKRLKRDMLRNMYNKKIVNSSQDILSSINKNLQSPQNQSESIVIKKEPDEVKPNSVEDLQTNQQQQYEEVESYQINKQDFLKMKLIGQFNLGFIIVDFDDNNNLFIIDQHASDEKYNFEKLMASFKINY

SEQ ID NO: 18743 - protein, 651 aa, Candida albicans
DRGSSRAVGQDNTAPTHKTSVAKLQSLLKTPNSSSSASLKDLMKDEAVVVPSSEQISHDQNQEDGNVSGDVESKGERHIHFNDEVMQCIAIDVYSDDEQRYNSDEEDYDSDDDDDDYYDQYEPSNDSLAQSHLYEGDDESIEEADEEVEDDEDEEDDEGGFFLNVKSNSNAPIILGQHSSASTSTPVAPSLSRHTDITDDTASISTTNSKSYKTIQLLPSTSINYGSDESSDEANPYTSSLSHNVNNDISRGYDYYYDYNTVYTCNPNNSVYASYQSPDVVDVPENLDMGSNFDYEFIENNDSIPVVDTTFENNSTINNMPILYSLPSSPLSVAISGGGKNSGVTVNSPNFPIVNVNSNPQQQQQSQAKPKPKTKASPFQLSDSEDDSNSDSDDDGISGLSIGTRRSSQALAELVFQSSLTSSTQETAPQHFPDAKEIEPVAEHVSSINPRYSSTSISKQPTSSSSLSQLFFGGAGGLSSTDKELSKLFLGGSTSASTSTSHDEKTTTIDSSSTGFFQVPNRDYTPSPDNNTLTRTLSNTSKKSSPLPPQTTSENAFRGDGQQSQSQSQSQSQLPLQQQLQPRRGLLFDEEDSEDSEHEGMVIGGKREDKILHGPRYNALCQVAGRNGIHSPSPPFGNASAHLQYLDSSLD

SEQ ID NO: 18744 - protein, 73 aa, Candida albicans
SPLFFIMSLSGEVFSGGATTSQHIEAQDDDHFENTTFKLKRTRSMGLLDEFIPDKLKEQDGNNSEANSSTTSS

SEQ ID NO: 18745 - protein, 269 aa, Candida albicans
NPRCFIFIFINPPFFIMSLSGEVFSGGATTSQHIEAQDDDHFENTTFKLKRTRSMGLLDEFIPDKLKEQDGNNSEANSSTTAASTTSSRNLAAMAAIASQTNSSYVNETPSSQHHETIESISNNSDGDVTHSSDVAPSSTSPVNSPSPTSSPALDLKSPELLPHDDTDLAVEPSRHVDYLSHQWDVSDIWKSWRYVISKRKDVANAARLENASWRTWAQRRSNLKTISPEVVNWSKDSDVTWLYGPILKDDDHVNNENHDSDAIETTAT

SEQ ID NO: 18746 - protein, 72 aa, Candida albicans
  UNSURE (57): Identity of amino acid sequences at the above locations are unknown.
DPYPIVMAKKKLNSTIKRSRTRSGCVTCRDRHIKCDEQQPVCKNCQKSNRKCYRRIXVNFTQYTFYNPDDNK

SEQ ID NO: 18747 - protein, 316 aa, Candida albicans
ILQVLRILLQYLLGSPYLLTAILATSATFQFIETRQMIHKDHQFKYTNISLKYLSEAFPQESNKDIHNSNNSGTTDNANFKMMTKDVEKLLLTILVLTLNFTALAYFQSNNRDGSTGISSVNKNNWKIHLRGVKDLLLKYSKLAHSNNQQYITDGLALAKTWFFAIESVAELNDPLGGTIKYSTKNISSHVDIIKTNQNVLDCSDLSRLWVETGYFNRGKNQDYHDALYRIGMVTNPNLPISTQFNMFLGFSIDVVKLIDEMTKLLDLLRENKPGQLSGTSIANIFTLISRARNNDIVPKVNKETFVIPKESIGHP

SEQ ID NO: 18748 - protein, 232 aa, Candida albicans
RKFFFISFSLSFFLNFRDNIIKQCLICQKKMEEKKKIRRSRNGCHTCKRSKIKCDENKPTCSYCSKTKAICDYSLKLTWGGRPFKDANKRKQLPSVKKEVQPMLNDFPVMTSTSLSTSITNNSNTKGDTGLTFILHEFNTESIKSPLSPSESVSSHIDPPAPHRNGKRKIIEIDSIADLEIKKRDTHMTLTDITPELNNGIENLTNALIDFGGQQFQLLNFFTTPWKDRIAT

SEQ ID NO: 18749 - protein, 290 aa, Candida albicans
VLAGISSQKGGTLQTEQEIDELINSGDEYEQQVLKELGIILDNGFNIMGGYQHECYNYFGKLIKILNQDRNGKLNPQESFEYIKLFVDLERQRNLQFVDKRGSWVTSSNSEDNNNDVTDEKHINSLLVERVPTTDNKSQVISWMDVSHQAYTMALMITVLEKCFGENYSNPQIQLLSDSIIQFVDYLYHHDVQNLLPKHKIESALMMLQWPLLVAGRNIASNGTADNNGNTPETIQHKKDVVIKFFEALSKVGSGGALIASKIIQKIWNKRDNIEESDNDDNENEDLLSY

SEQ ID NO: 18750 - protein, 638 aa, Candida albicans
LSNIIYYTVPKMMDIYQKALKNPDPPKKPASTTTTPPSSTSTDYNTRLPPMNHNNNNVDSMNYNYSHDNGLFTGSTTTTTNISNENSNNNSSTNSPNSRPSSTNTNTNAHTSEEIKNNVIRKKKNSRRKHRNSHLGCGTCKKRRIKCDETLPACLNCLKGKLHCAYLNLDNNAINALRVAQYNQTIRQEKLDANSSSSTTANINNNTKLIDPSKDNILVQQQQPVGIVQSLAHGISIVPPHPSTAAAAGSQNAPMMATGPGSYPMAATVLPNNQTLVTAVPQQLQASMSIPPFANSILAPGIQANPSPSITTNNLNSSIANTTSNTNNNTNADMTSSGSTSGNIQNIALTPQVVQSPYGPMIPLLTQSGSVVYAPTHSLVPAQPSQLPPQQLQNNVAFSNTTVPATGTLPPPMSQPSVLSTANTAATTSPNIPPLAAPPPTTGVAGTASTGIMANVSPVLTNKQQPSSTPITSSAASVATIASQTIPVKTGNGTSSTASTSSPTTATVSPPGIANILPPPINTLGNSSNGANSSGTDVFKPNVSDSSIKELKPINDSNGNTPPSTTTSAIGNYGDGVKLSPNSSMTNLKKLTIREDNNSGSDIKLPSITTLKRESSKSPSETNGYVDEKVPTISKLIT

SEQ ID NO: 18751 - protein, 621 aa, Candida albicans
RNIGCPNCKSKRIKCTEELPSCYNCIKKNYRCGYLDFPEHKLQIIRNKNNKRLLQEQRLLEMVTPGIPQQILQPLPPLPQQLQPPPPIAAAAVVQPPILSLIPPLQPPLQQQLQPPAPPFLSMPRPYHNITEQHSLQSNNDVFNHDNPTSYSHTPVPLHLNDQAQLIENNTGFSMPAATLGPQYHSNSASLYSSPLSTTPNCSNELIPNFQPPTIPNEENSITPPNIFEAVSNDKIDYSIEVPGSKSDLKIALYKDSVRKISLARNDLQLPSYSSDSPIYDKQTPKNEDYLVDLQQQQQNCVSHQSPSQHSKSNHNHQHQHHRDNNQNSLQYNNNTPIDRLSEFDTGYESQSSDGFGNTRHIFAEHFGIVITNDDHGIGRNNNIVHNRSMGDTISGNVGKPLPNARNSPISINLLNPTEHCGILLNQQHQAFENKMLVPTINWTLADNKLLWNSMFNGAVSSRYSFFSFFMDRSLNVILKACIKAINSGSNETCFNQHVQDILLKKSYIYYGTLIKDLRESMANDSIENSTILLWFANWSLFIHRSSTLKAENLILTGSASLLWNCLNQYQSTTQLNPTLSFIIHSIKWHTLACTTPDYKFNVIEELFDDFKHFKRFILFN

SEQ ID NO: 18752 - protein, 192 aa, Candida albicans
LERVNLVYQRIYIPESRKRPILLSYPHIFISLSMASNISQDRSSPSVAFVSQKRIYSKHGCKECKRRKIKCDEGKPSCWQCIRLRKDCSYPKPGEKVLRILRKKQREQLIRQEEAQNHLLLLQQQYRFEQPHSIITTHAPSISSNSSQDSYRDTRSPNPIANLAPMYQQQHLPQNHYQPQFQPPPPPPQQQQ

SEQ ID NO: 18753 - protein, 714 aa, Candida albicans
DVGYSSPVGQEVPPPPPAQQLLPSHQQYQMAPPSISYYPNPPSYMQYPAHIIQAGPPTLPQNVVPNHPNPPPPPPPPPIVPQQPPQPYPQNNHSVVLPPPQAAKLPIAPLPDHLNKRLQNPAAAPSLKARNSRNDSTNSIPNLLNDTNVLSDSNTISGAGNTPQTPPQQNSNNNIHIEHSQFSNDDIVEYYNQNDLEVLATDLNNIVSEIMFDFNFVKDKNPPLESEDGSLRTATSTNGSPPPLETAPSSHHNVPIDFIHFKKESDRTYFETFYNEFAQIILPFPSFDKHNKCYFNPARDIILRSAAKVKYLLAAVLANGARQQFNKTKSEEDEQAYCFYLSRCLELLGPAIANDDKELASNIENVLLTVLLLTAGNASNLRQDWRSHLKGAKDLLVKNSPKSTTKRKHSKVFIFCKIWFVTIEVLAGISSQKGGTLQTEQEIDELINSGDEYEQQVLKELGIILDNGFNIMGGYQHECYNYFGKLIKILNQDRNGKLNPQESFEYIKLFVDLERQRNLQFVDKRGSWVTSSNSEDNNNDAIDEKHINSLLVERVPTTDNKSQVISWMDVSHQAYTMALMITVLEKCFRENYSNPQIQLLSDSIIQFVDYLYHHDVQNLLPKHKIESALMMLQWPLLVAGRNIASNGTADNNGNTPETIQHKKDVVIKFFEALSKVGSGGALIASKIIQKIWNKRDNIEESDNDDNENEDLLSY

SEQ ID NO: 18754 - protein, 242 aa, Candida albicans
FPCSCQIHIHQHQDIIMSTSKRAYSRGGCKECKRRKIRCPEDKPSCATCVRLGKVCSYPLPGERVPRVSIRALANKEIPLNDSPEPKAKKSNPKPLTIQMYLVDDFGAKKKKRRLRLDDDYLTNNFNTETNSPISGNNNGYLSNSKSANNNNNNGSNTTDNLMQQINSQMIPPIKPALSITQALESMLSTTSSSSLLGGLYNDDDLNLLASDLNNIVNDIMFTSNMPNTNDSLIDDNFFSPF

SEQ ID NO: 18755 - protein, 398 aa, Candida albicans
FYAAKEPFLLSAILSQGAKLSFQKTSKQSDHDNYGSYLSRCLRLLGPALSKNRDKLVKDDLTSNIESILITVLLLTSSNAMTEKLSWRPHLKGAKDIIIKATHSKIRLSKTLILCKIWFADFEILAGTSSHLGGTIKTDCDLDSVINFEDEFVKSVLEQFGLLQGGSFNIMSGYNIQMIYLFRDLSKLLNRKREMGEQFVPNQSLEYIRLISGFYEHYGKVYIDRKCLLPGPISTPLTELYNLVDSVPTTSGNTLYISWMDISQQAYALAGLITVFTSILLDPPDLPHIQDLNSKLVDLIKFVEQSVNSFTMKFPNGFLMIQWPITVAGINCTIKSQQPVIEKFFKICIELGSVSAEITLKRIKKIWELREKGEEYYDLHIKHENGEIDGIHIDNVAY

SEQ ID NO: 18756 - protein, 689 aa, Candida albicans
ENRIVYLFLFYLAKALFCFVLFCLLFLSSILFGLILLLLIVNTILFFLYLFTVSIYISLFVLIIHITALHFFFHHISINQLSSQPLQLFINQVLTSSCHNHHLLYHLLPRLLSGVNSPLDQPPLPPRVRKSYSRNGCRECKRRKIRCPEEKPYCSTCVRLGKQCSYPLAGEKVLRISRRLIKEEIENMGKSTQFLPVQYDIPRRIKPQTQSVIKPSPLNIENLINSNDFLNGADLNVLTADLNNLVSDIIEVSNIPILEEDFQFDFLNEPIIVEQITKNVPIDYIKLPRKHEQLYWEEFYNNFAQIIEPFQAYDTKTKKTSNPARDIILQTAATEPFLLAAILAEGANTCYLKYKRPEDERAYGAYLSKCLKLLEPARETDINANIEAVLLTLLLLTAATATSQTQKWRPHLMGAKSLLLKAINQNVSKKFVFCKYWFVSIEILAGLSTNLGGTLQTDAEIDQLVTPGNEFEIEVLRDLGIISDQGFNILMGYDNTCLACFRDLLKILNKKRLNMYIDTMSYVKLLSDFYNQANIVYIDSRGVIAENELTRYVPGLPIEELRINNASYWISWQDISHQSYVLSSLIMILTRFFVIDVSGLVDKVIQFIHYLNQFSDVQQHASPYLLLMIQWPLLVTGLSTTKLEQRHLLLKYFSMVGQIGAAAANVSIQILLKHWKGTIDIENDDTLIY

SEQ ID NO: 18757 - protein, 261 aa, Candida albicans
RRPIYPPQQPNFPYHNNFVSPPTYTTAYPQYYYQPVMTPPHHQPHQQAPIHLANNVSILQSQAVMQNAYPTTHYLQHVGPHHIYANVNSQVYYQDMAREEANKALINKRRIIKRRTRTGCLTCRKRRIKCDERKPTCFNCERSKKSCLGYQDLLKLPPRKRNRDTSLDLPDGNQQQQQQQQNQQSIVGGAGNVSDEPHNETHQITSISGSSTNSRNLDMMIPQSFRNNISSQPINFYGPVATTASGANAVINKISVADLLK

SEQ ID NO: 18758 - protein, 224 aa, Candida albicans
CDESKPTCEYCLHTNRQCIYTIPKLQEYLDTFTSSSDLLEAILNCEELLSSTTSTGSVTTNTTNTTTTTTTTSINNNNNTTIMTEYSLPVEKDHLHRELILTQPTTILGISKFELKLLKFYDYQCISMFSYGHNQEIHNTWKYKVPHLFIQSQLVRNSIFALASMVLQSTITPAFNDSLQIAQIQNNLFNSTLEYFLNVLNHTKSIINGCPETIDFQNVYNGKV

SEQ ID NO: 18759 - protein, 397 aa, Candida albicans
HKPKKSSHQLKNNDKLAGDEMHEWQQSWRRIMKSSIVYFEGDQQLLEYRKAHKLLRLVGCKVTPFYDNNVTIIISKRPYDSKTEYSPHDIFSNVSKASIKVWNYDKVFRFLKHLGINIQTGVDELAVNTHTILPPSLTNNNEKPDLYNLLKEEKIYGSTDRDPNAKRDDLHYLGKNYLYVYDLTQTVRPIAIREWSDHYPVMQLSLDGKCPFIEDPTDQNLERKRLKRLRKFEANQAHREALRLATYKMINGISMSVHGFTATSTSTDKVDEEEDSTVKEPSEDPRFRQPLNRNSSCMQSKAFEAMASGYNGASNAVQPSMDSNLNSAAAMAGGNGLGPALSQVPSKQLNNLKRRILMQKITTNPPEYKDKELASGSLVKTVVFKFTYFRMNIFMIN

SEQ ID NO: 18760 - protein, 261 aa, Candida albicans
HKHFSIITPIQVNKSFIMSSKSAAAILQRQFKDLTDPKKGIPSFHIELDDDNIFLWNVGVMVLNPESLYHGGYFKGQMRFPQDFPFSPPSFRFTPALYHPNVYRDGRLCISILHQGGDPTSDEPESETWSPAQTVESVLISIISLLDDPNGNSPANIDASVEFRKNYNVYKKKVLQEVERSKKDIPEDFIMPETSDNAYSNYNNSKNKEGAEEPVDEDFWYESEEEESFDEESLMDENMDDQFEDDDEEEEDDEDEDMGGK

SEQ ID NO: 18761 - protein, 324 aa, Candida albicans
QTKISPTITTSTQIIFYQQFHNMPKYQPKNGELNPYIPRYILETPRYQQDIINKSPEQEDAQDQTTTAHDPLAHQRKTGEIIDNSIAQSGTGIKDEFKGTIRVEENESYDSKRDRWYGYSTEEWLTHLKNWNDKKQSRKHASAQDNDDSDDTDNELEIIELELDKKDMKKNIKKDPMEKMLRDRQDIPAYIYDITSNPNNKIRIEYDPKSRLAKDSAKGFLNKRNQFVKKLTGDGDELMKLQKMAQELDNEHEKDRKLAKLKQEFYGEENPKTVPQTDLSLSLEASRTLMMLKSKQLQNEKLAKSIQSKQEVMEKLSPPGWKIQ

SEQ ID NO: 18762 - protein, 587 aa, Candida albicans
LLSMGQVSTPTRSSPNVGSNSTGSTKKQSSLMDFFKPMASKDKLKPKQQPLPLSSSPLKSKSNDTKPFLSSDKENDDHSIMENHKNTTLVTSQPDDTGDKQIKPQLASSPKREELKKERKQQPLREKTTAALNSSPVAATRRSKQINYAESDDEEEVFTSRKKRRVVQDDSEEEEDDFKPAESGSDDDDDMSDFVVDDDKDEDMEPVLDDDDEVVAPKTKSKKPLSKSSKPTSLLVSGILGRFDAGSGSSRQSSSVATPKPKSTTIKSLTPSKKSFEKENEERYQWLVDIRDAEKRPIDHPDYDPRTLYIPQSAWSKFTAFEKQYWQIKSKMWNTVVFFQKGKFYELYENDAVIANTQFDLKIAGGGRANMKLAGIPEMSFEYWAKEFISHGYKVAKVEQKESMLVKQMRGGATKEEKIIERELKGILTAGTLTNLDMISNDMATYCLSIKEEDKEDGTKTFGVAFVDTATSELNFIELDDDAECTKLDTLITQINPKEIICEKGNLCQIATKILKFCTHSDHQIWNALNPITEFWDYDIALEQLVKAKYYDAENLDDYSNYPKVLVDFKENHQVAFNAFGGLLYYL

SEQ ID NO: 18763 - protein, 556 aa, Candida albicans
MLKLDTSIMSLGNIHEYHISRNSASHMILDGVTLNNLEILNNTSDGTTKGTLFKLVNRATTSFGKRQLQKWVLHPLFKVDEINQRYDSVDYLMNDGLELRSILQDTLANIPDLERLLARVHGGTLKFRDFLKVIESFESIAGVSSKLVDFTNVESGMLYKYLKSFPHEMRELIQQWEDAFDREQAKNDIIVPSAGTDEEFDNSQASMEDLKTQLDKLLKEYKRTYKSQEICYRDSGKEIYLIEVPFKLKVPGDWKQMGSTSKVKRYYSPEVETLAKELRGQQELHKMVCDTLKIRMYEKFDKHYNVWMQVIQTIANIDCLLALTKASETIGYPSCRPKLIEADKGCINFKELRHPCFVSTKEFIPNDVQLGGDEPHFGLLTGANAAGKSTLMRTTALAIILSQIGCYIPAELAELTPVDRIMTRLGANDNILQRKSTFFVELSETKKILSNATPRSLVILDELGRSGSSSDGFAIAESILHHLATHVQSLGFFATHYGTLGIWFKTHPPIQQLKMGFVVDSGSRNITFLYKLETGPPLKSFGMNFAFHVWYPDGNC

SEQ ID NO: 18764 - protein, 86 aa, Candida albicans
ILHSMCGILMAIVDNAEIAAKAYEQTSKLKKLAEESKGDDISLGLQSDFVWLATGKINDLSKDILKYDEPIKKSALENIYKMIDRL

SEQ ID NO: 18765 - protein, 573 aa, Candida albicans
  UNSURE (571): Identity of amino acid sequences at the above locations are unknown.
FISIVPNFEKRSIQIYFIFFFFCISSTHTSFFVLFIHMSSFGSSTIANGASLGNIFANQSNFGNFLGESQLNGNNQTNFKAASVFNNDNNNINTGSPEKNANTKKTQKQTNKTYQNGQSTSTTSKQISNLQVFKESDIVATGALFEQPERLGFNHRRPTEVRSIPKYFLTQPKLLYTPEFVQNPWDQENQNKLTLMEAENGGRDYQGLYEDMQKLREIERTKMEELGLVDAENVAKDLTEAISFSGSCLDMCPVFERVRRQLENNVKALEKDPISNKISRERAVKAFSRPAAGQPPPLPSDVRPPHVLSQTLNYLVDNILQQLPEAHSFIWDRTRSIRQDFTYQNNFGPEAVDCNERIVRIHLLSLHIMAGSDVEYSQQQELEQFNKALQTLMEIYQDVRNNGGKSPNEAEFRAYHLLSHVRDPDLERQIQKLPDEVYNDKLVQLALRFRKITTQNNVVERGVTNLVGALNLYTEFFRLVYSEETPFLMACLLETHFNEIRFYALKAISRSFHTKTKPYAIQRLQQVLGFDSVQKLQKFLGYYDIDIINVNGEVLVDLFNKEKLETTYKLXSI

SEQ ID NO: 18766 - protein, 236 aa, Candida albicans
KKKYPNILYFLFFFCISSTHTSFFVLFIHMSSFGSSTIANGASLGNIFANQSNFGNFLGESQLNGNNQTNFKAASVFNNDNNNINTGSPEKNANTKKTQKQTNKSYQNGKSTSTTSKQISNLQVFKESDIVATGALFEQPERLGFNHRRPTEVRSIPKYFLTQPKLLYTPEFVQNPWDQENQNKLTLMEAENGGRDYQGLYEDMQKLREIERTKMEELGLVDAENVAKDLSSSPAE

SEQ ID NO: 18767 - protein, 318 aa, Candida albicans
KLQVEMIPTLNSLTPSKHQAAGHDGCLATDSLFIKLTVQQEIDFYTQVQLHDQSVQDAPLGSQLSHWMPTFMGTLTQGDVSKTQTAGLDQLSSAEGQTDKQYIVLLNSYHGFTHPSILDIKLGAKLTDDEVTAPEKIARLQKVSDSTTSGSLNFRICGMKVYNGKSDTKPANELYENMNDSSVSVNINDADDHKYLEFNKFYGRSLSKDNIKEGLELYFNNHLPKAIVKRLLVVFHKRLQLLYNCLLDYEVRIFSGSLLFIYESDLTKWENVTEDNYDTYDLLVREIVDDEDEDDEEFEEDSKKDQTQPFSTRRADQA

SEQ ID NO: 18768 - protein, 296 aa, Candida albicans
  UNSURE (18): Identity of amino acid sequences at the above locations are unknown.
SATKKRKIVAAATEADAXEEKDLVSEADGKVEDELDEKEVKEYLNSKDDPIPPVQTGNFTQDNDTRLKNPKSEYVEPQTLSASAIAELGLFSEENNGLETQGREYLKKKYGVDLYPERDLQDLLPGEIPNIDFSKNKPPSNQVQFTTFQSYIESYFRPYLTEDIKFLKERNVVPPGFEKQGYDADVTPFIIPKLGKFYADLWSEEDSTLGSKLNSPAFQQPSSDSYKPKGSIEGLTDEALFTEDISCGPLSNRLLSAILSNREGGLSDEEDAPANDSKSETKDASKSSLAESSPRG

SEQ ID NO: 18769 - protein, 292 aa, Candida albicans
NLKLNHKGEVGEEEEEEEEVDKSIQTDKIEEDTTSIDIIAPLPSSPNKGGRGRGGGGGVKILFEEEHEPSDLEEFDIDSDQIKKKNQDFIEIDDDEEEEEEDEVVEDDDDDDDDDDDDDDDDDDNSESIKQSDEIIPIIAPKSRIKKRIIDLQSMNSNTNDEEEDIDSIIEEEEEDNNNTEPNILRQEKSNTLTEDDIINHDSVWAIYNLKMYTGKIVAKYIEDLNIEFYEGTYNIKNVDLNVLDIRIGDTVNIKGNRHKYIVTGLSTLTTNGGGDIKCMRGYNVVYLRRCQ

SEQ ID NO: 18770 - protein, 132 aa, Candida albicans
LKMAPKAEKKPASKAPAEKKPAAKKTASTDGAKKRTKARKETYSSYIYKVLKQTHPDTGISQKAMSIMNSFVNDIFERIASEASKLAAYNKKSTISAREIQTAVRLILPGELAKHAVSEGTRAVTKYSSASN

SEQ ID NO: 18771 - protein, 182 aa, Candida albicans
KVVIKCFKYSIVCHFEENILSFCFSFLYFFFSLFQLKLSIFKSNNSILTIMSGGKGKAGTSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQNLLPKKSGKGGVKASQEL

SEQ ID NO: 18772 - protein, 377 aa, Candida albicans
  UNSURE (43): Identity of amino acid sequences at the above locations are unknown.
SEQSLVNDINQLIPIFEKKVRTNPNSKSQDRLRALNQLRSILXSQVMKANELQAIQNQLQNIKEQELSSSSSSASKGGTPIPTPGPTPATTPGPSSIPPVSRVNPAFMIFNDLVLSGLVKKDQEPIPGSKPVYSLVFPQTKYVPSASGLGSNSTLEDLLLSSSSIQRSDYDKLKFTEMVKVSKLSFNNLQDFIKNNKPTTKLRDLLYDSKPSKCSICGKRFASDKEGADKKRLHLDWHFRINKKLSNKGSNVQSRNWYLDDYEWVHFNENDLLEYSTDVRIPDITQEMDETISTDSQYVIVPSTETNMNNKCLICREQIKATYNDEIGEWCWYNCIRQPGEPKNSRKIVHVTCYNESSKKRPADNDDLNPHVKREKF

SEQ ID NO: 18773 - protein, 318 aa, Candida albicans
FFAINMNIDEFKSGLKKLTVNKRVIIDDLTTFAEKYSADAAEEIAAAIHEHIRTCPPQHKLLAFYLLDNISKTVGNPYNILLANGLYQLFKDTYVIVDDGTRHRLIELFRTWEHYENTSVFNMQVLENIEKFIQQAQNLRSASPGLESLSKSELTPRILIQNAKDLLKLHDELILQVENFVKGDYHKFLLDDDFCFIEQFKQIQVQLYELINEILRHIYEDVNSYHNGKKKLVNTPQFNINAGKYKIDIVRNQKELFKQQQSLTDFLATCKATNCIRLILLKQRRTQKKITFPTRKYRFVYKKKRSPIKKFFLRNVFG

SEQ ID NO: 18774 - protein, 303 aa, Candida albicans
PIYSLIIQLKIKIPNYTMSLPMSPVSPINTTTSTSTTTTPLSPPSLIENSSHPLSTSISNNSITSDSSLDSNTSTSSTTTTNYGTKTPSGNARIFNCTLCQRAFTREEHLTRHTLSTHNKLKPFTCGICSRPFSRRDLLLRHAKNLHQGSEVAVSRIRKSYKHCNKDNDSKSGSDSNTNKTNKNGKKQEQEDDEEEGLRSDSSSGADDEDSNTSSGGSNYHAIGSGNKRFVNNSPQLKKILTNGSVPSTTTTSTTTVPTSTNNDTASITNSSTSHIHQRSLNVEDYDTPEKKRLKMSVNMLVS

SEQ ID NO: 18775 - protein, 290 aa, Candida albicans
  UNSURE (267): Identity of amino acid sequences at the above locations are unknown.
TPTPASTTKNYKHKKQNTNTGTSMSPSNSINSTNNNAAAAAATTTTSKKSKDIPLELTAFGTTPSGKPRLFVCQVCTRAFARLEHLRRHERSHTKEKPFSCGVCQRKFSRRDLLLRHAQKLHAGCTDAITRLRRKSIKKSQDGDDDDDDDDDDEEMANSEDENDHDESGNASTKNGKKDKKDPPPEFNLNLFNLKQKPTKANTTKSKVAKLSTTTSRKNSTNPTRKNSSSLHKQVLDQRQKAAVNTKIVSSTKIVSGTNSGVSITPXRSRRSASFSAQSGANYAINITEL

SEQ ID NO: 18776 - protein, 319 aa, Candida albicans
NQNTIVMSSNIFKRFKSAEESSDEDESVAPVYIPKAKRAKLEVLKAKKSQIASRLSTHKQQSAPTTTTNTSTTASTTTTATTNNTNNSKPSIQTKKPTGKKFQFDWDVVEEDTASGFVPLIEMDEEIDDPLFSGQELTHWTNKNLEEMTDRDWRIFKEDYNITTKGKNIPNPLRYWNEGSINDKLVSIISQLGYEEPTSVQRASIPLALKKRDVVGVAETGSGKTLAFLIPVLNYILSIDENYLKYEKISNEPVGLILAPTRELALQITKEAEKFCKKLGYQVLPIIGGHHYQDTINKIDQTGVHLIVATPGRLMDSIE

SEQ ID NO: 18777 - protein, 126 aa, Candida albicans
RVLPAPVREDINNVVIHGSKSQDMREQAITNFRNHESEVLIATDVAARGIDIPNVTLVINYQMVKKFDEYIHRIGRTGRAGNLGESFTFISDQDTEIFTPLKKFLKKGGKRLPDWLYKHQSQTVQE

SEQ ID NO: 18778 - protein, 196 aa, Candida albicans
FRYLDSPMLMVLWNMLPLGAIEDHQVFKSEAEIDEETNETEDVDNLKLQRLKKIANLRFKGSLTGNKQSSNEEPNHHQQQQQPEQDSNLDQTEREGQTNDTEFDSIAPIQYAEFILKEKTTATRTEKSIGDDGRTNIKFKITGSDVFGGLHELSVKSTEPEEIILNPEEVPNWLTGEEGASIGEIRNGNFYNKING

SEQ ID NO: 18779 - protein, 188 aa, Candida albicans
NILPNTYVPYLGHKVLYNILDRLSKNSILQFIILWTKLKNTQPKPPSKYTQHGFNKKITKEVSEFRKLINRTPKRKLIDKIIFEYWTQGLNLLQISQIDCQLIVDKSNSAQSWIYSTVKDMHDKIVPISINPREFLNNLVKNLSSLYLSYIYICKHPKLPIILIRIQVFDLNGMDITEKPHIISHKAY

SEQ ID NO: 18780 - protein, 70 aa, Candida albicans
INRSPRTYIMDEFNEKSKLFQDWLIKNNVEISPKIAIHDYCDTNQGRGIIALEHTNLHHEERPSAITLKE

SEQ ID NO: 18781 - protein, 388 aa, Candida albicans
TQTFQGVEEFKSRPLTFEEYNKIATIIMSYSFDVEVPKSKKMTKNGTNEKGNDEEDEEEDEDKEDDDDDEEEDNEYYKSMVPFADTLNADTHLNNAILIYSTDQLIMTCIKPIAKGEQVYNTYSDHPNLELLRRYGYVELNGSKYDFGEIPLSTIKSVFIDQFNKLSTNKNKSNGDTFMTKQKFDELLQLINQLQIKKSIEQDGLEEDEAEELILDSYDCFNSGDVIIELVFLIQVLSTILVVYQYEQQQQQEKDTDKKKEFEIDQNLINRIFNKIYQLIELKKITSKCFEIYQSIINARMSQYPDIAKQPFNGNVAAANSEDETINSIRIYMAEVVLKSEYQSLEKCSSTIKDFKIINDVKLNKNILKKRNNDTNGVSETNNKKSKN

SEQ ID NO: 18782 - protein, 253 aa, Candida albicans
  UNSURE (248): Identity of amino acid sequences at the above locations are unknown.
LVISMTRGRSKSIVQKIANDVPKLNNSENALDYLLKENGGENNLTHTSTTYKMSRSKSLSQEGRNNNMELEKVHYADSITYPFTKSEFQKAESDNINSYDYDTILKPRDISHITDLQLDNILNFKNMVQRNKVEIEVFVSETNDVLSSVETLLSKYNRISNETLDFDKRANELLELQKHNQTKYDEINSYLQHLEQLDFITKNLSRSRSHLLSLKRESSSMWFCASLTLRWILLRNTHCSRNLKYTVXGSDNA

SEQ ID NO: 18783 - protein, 180 aa, Candida albicans
YLFPQKPRKRYRELDGDALLQFLNSPEFCQVEFDFKEVLAEEPLLIQYENEFYLINANSMSNNSNELTNLKEVNDELVVKINDLKRKIDSLQATHSEISDQSEQYTKDLSEAEIENQKLLKRQAELQEKYQNLTMAENLSNTIKANQEFSQRNFELELQIKNLQNSIEEKNAKLAKVQQS

SEQ ID NO: 18784 - protein, 449 aa, Candida albicans
KKICIISFPPAIRFILNYLIPFFFVCIMASSNNGFESINLASTILGPYQEEDTPIKRLHSIPASTSEDEDELDPEEFILNKVDKPATKDSHVLYNKFLDKHISDEQLSHLLDNHKPNVVTTTTLIDSIKESELLYNTMDSLMIKSINFPAAMYQSNDNNSQSPIEYLSNRVKLLTQELYEDSVKYGKFLQSGNNHIYQLRSRILQTFDQLSESHISLNELYNKDMSYAETLHGSFKKWDQQRNKVLSKVKSIKSDTSKHGAKLFTLLDEVNDVDDEIKLLEAKLQQLRSKKEILNKEIEDTSSVLESRTAKYVDIFKDLENKGRSAITDFLQSNGVPEKEIDTIVRFSPVDITISSNYSLKKEPKKEIHITKESIPQNESASKPANTPSIGMQPFIIPEAEANTKTPDLQSMNHDHGPTPFEKGYAMGTQNSTALKNQMVHIMKKFIDF

SEQ ID NO: 18785 - protein, 134 aa, Candida albicans
LPAARGEDRSYTRKVREACGRKDTSNTLLEKEQEMENKIRKMEDKYALLSTRYEEKLQQYKDLLIKYQQLQAQIEDTQMPQNNRESKMEKLRNFHKLKIGEIEQSEFINERKRIASTPVVQTRNIQFTNNSDED

SEQ ID NO: 18786 - protein, 128 aa, Candida albicans
  UNSURE (10): Identity of amino acid sequences at the above locations are unknown.
HCCSSSFFFXIPLQIISKVIGSTQDGSFFNVFPINEAAYRRMYILQQQLIDKEFHYCGLNPRLNRIGSIKLQNNETNTKPILDYDLIRRFTKLSDDRKRNLANKVSGKGIYQDIWKDIIRFEHTLNDL

SEQ ID NO: 18787 - protein, 528 aa, Candida albicans
DDEILSSILRDEFLMIFLASGDVMIFVINTYNESYDKIEIPKLLDDTIITTGYITNSHLLSAVSKNVNLLLDNNTSSNKRKRKHSALSNSEGSKKNTGKSQPSTAAPPPPPKVNKVKTFVLVTGDNRIVAFNRFHGEKCYQLNHVDKFTENLSLGFFDPNQLTVDPFIKQIMLNELGDKFDTKDEYLTILTIGGEIYMYKLYFDGENYFFKKEKDLTITGAPDNAFPYGTSIERRLVYFPNLNGFTSIFVTGVIPYLILKTVHSIPRIFQFSKIAAMSISAFSDSKIKNGLIFLDNQQNARICELPLDFNYEFNLPMKHVDIGELIKSIAYHETSDTVVLSTFKQIPYDCLDEEGKPIAGIIKDIKDTPAMSFKGSIKLVSPYNWTVIETIELEDNEVGMTLKSMILDVGSESGSTLGSDPNSLIKKYNKKKREYIVIGIGKYRMEDLAANGIFKIYEIIDIIPEPGKPETNHKFKEIFKEETRGAITSICELSGRFLVSQGQKVIVRDLQDDGTVPVAFLDTTVYGF

SEQ ID NO: 18788 - protein, 369 aa, Candida albicans
EENWWRKKNGDQNHQQQRSTKNKNVRCKKFFFIQSSPKQIDCLNHIHLLFFPFLPLSLYPAMDAYPEFIDPSKVNNCVGCNFISSTKKNLIVGKGSLLQIFETIHLKQSTINKPQYRLKLIDQFKLQGTITDLKSIRTIENPNLDYLMVSTKYAKFSIIKWDHHLNTIATVSLHYYEHCIQNSTFEKLAVSELILEPTYNSVSCLRFKNLLCFLPFEVIEDDEDEEEEEEEDEEDEDEGEENIDDTKEKKDKKQSKTDTIEEDKNSTTTNQEPRLFYDSSFIIDATTLDSSIDTVVDMQFLHNYREPTIAVLSLKQEVWAGNLIKSKDNIQFQVLTLDLNLKSTISVFKIDNLPYETIDFPFHRHGDKS

SEQ ID NO: 18789 - protein, 155 aa, Candida albicans
RVEEKEDNKDDDDNDDDDEDDLYKEEEEEETQKTISKSHIEFLYHDELINNGPSSTFTLGICSKEKFKCNLPNPNYNEVSILSNAGTDSQTKLNIITPTIQPSISSSLTFSQVNRMWNLNQKYLITSDDVNYKSEIFQIEKSYARMKSKHFINNE

SEQ ID NO: 18790 - protein, 223 aa, Candida albicans
TQHRIGFCTRPYLTLESKKKKVTTTILKSSIQPIHQDQLTQHSLIMADRLTQLQICLDQLIQQFNSTINYVNTSAEPSLLDDDDVNSYSNMAANAPLPQSQQQRQQQKKQQEPQQEIEQPQQQSNPESKSISPPKEKVSFDNVINELCTDLILKSRQIKMLIDSLPGIGVTPNEQMNLINELSDKLQAIEEERIQKIKEKDNLLNLLESMIKEVVNGITETRI

SEQ ID NO: 18791 - protein, 571 aa, Candida albicans
  UNSURE (284): Identity of amino acid sequences at the above locations are unknown.
GLKVPVLQLQLQHQLQHLGSAPQADSTRDSTSSSTPIPPTTSGTSTSSSLLSLAASQSLSDANLLKNFELQQKLLLEDRQLRDVFTKSVMQFKLSPQVFWSSRLNQLRTFALTISQHKGPYNVLSTIKPVATSDNQVNVNVTRDTINEIFTIYPIIKKAFDDLVPNKFNEGEFWSRFFNSKLFRRLRGDKISISNSRGDVVLDKYLYIDQNYQEKLQKSSTLENNGSGGGGGGAGGGSGNSEQGIQTLESPHVKKFLDLMGNQQDNSQKLGNRPDFTMRYDEDXNVDDDNKKPTLGNENEMIILMKNMNRLSSKMMSMSSTNGPEKPSETTIDGLSAAELNEYEEELDLHDLNDSENLQYIKLNINTDIAKGTKLDSYEGSNTNNKISQDELHKYLQSQTFQGQIELTETYTCKSEEIEKTSMEIAMLIKQNFRTFKLINKENDIAGTNIVPNSLIQEIITYNITIVEFLSHFWKIFLHGNNPGQLKKIFTSLKNCQSGLIELENKAIDQFKSMDILQKNQKLQDKVLKDFASCLQPMKIALDKACNEYVEAVKKAKPELNENGKRPLPEE

SEQ ID NO: 18792 - protein, 140 aa, Candida albicans
VFFHHILDLISLVLYFTMDIIRGACSVDKIGGMVYIREDLAPLMLEWKPIDEQEEDRAISIPLNSLTTLQSTKETSPKMILKIVYKLTSGPPNTNADGTDNGGGGGGEQKSFKLTFTNRPTMNTIKDSLQTIVARSRTKG

SEQ ID NO: 18793 - protein, 182 aa, Candida albicans
HTLSFHRQQSIYLSIQSNMSSPKVIIVSSDNEKFPVEPKIAEKSILIKNMINDLHPDGLEEDFEIPTPNVRANVLCKVLEWCEHHKNTVFQDDEDEDAKKSVPVEEWDRNFLKVDQEMLYEIILAANYLNIKPLLESGCKMVAEMIKSKSPEELRRTFNIINDFSPEEEAAIRKENEWAEDR

SEQ ID NO: 18794 - protein, 237 aa, Candida albicans
LNPLKEQINELTTNLEFEQQKAKLLHEENERIKLAALSTDEQKSDANKHTNETIARMQEQMDKLKTKANERIRSMNETIASKDETIKQLNEKVDQLSNSANTNEDKSKEQIDQLNTKLSNLQSEVENSKTEKNELLKKLSELESNLRAEFDKEKQEIIKSLELAKQANASDENLQKRYKELEEALTNSKKEFETKLEAERKKTREEVEKKYDIKLKMMNRKIEKYEKANILLPQQLH

SEQ ID NO: 18795 - protein, 229 aa, Candida albicans
FLQLNNNHFQKYQPPNQKGNSIGKKDSLEPRDELTDYSPTPPIEKNHNLDDEIMDDILNKGGFKFKYDPNQLVQDKELVNYLLNIDNILDHNDTTHDIKNKKDTSLSELNKAMSNLYETTLLKSKKILTPHKNEHFDSLTELSHLERYLDELHNSIDSLGRSLGANRDKVRGSYKDEINDNITRLNQVSKELETLEAKANTFRDQISQQKANNTNQMMGTIALLTDVIS

SEQ ID NO: 18796 - protein, 482 aa, Candida albicans
LVTMNENEKESKNVKLGVLEEVANMSVDELTNLEQQLASEFNTLSKEYLESRLSRINTILDKLNSLIKYATANDKSWLKIYNFEIETINSIMTNTEDLIISNNGDLKNKPDLLKSIDEYQEELKEIFKNLQSPFDFDSTFRYDNDDKLNDGSNPNLSKLPFSHLFNDYFKKHRDALNAIIKEKDYQANLLHNNLYGNRVILWKQYYNKLNQQKQKLIDKTNDQLNQLYKDYYHLNEQKNLDFSERHYYRSLLTPKELATTIDDSINTVDTQDVAAVLETNHDSNYVELDTRHKSKNKIEISDIRKKIIDEDQMLNNISCGIKRSWDETDTNTSIDPLKRSRFSLTDAEAIEDLLLIRHNITKQNSHHEQNKNQQKEGIEQNQENQLEEVDIDEAEEEEGQEQSIQHNQEGVEREGEEEEEYGEEMDSDNDREETEAPIESILTSEQKNQRELYKEIIFKNDTTEGMKIQGLPPLDCFPRFFN

SEQ ID NO: 18797 - protein, 299 aa, Candida albicans
QEKTSYLNRGKRVSSIGNGFVGVPHKEVPVSDYYKLLDTTMPGPDRLRQLLIWNMKKQFEKDEEDLKQRESEDQTAPSIARVIKEEIIRDLTEKKISTSWYDNRNNNIETISGKVVTVPNPLNITNLKNIDIYTKKLKNLRKQKAEWHKVYKQAIRPLETMKISLSDDKKQLNKYIKEERVGNIQPDAIDNSMVETIEANHTEVKSNITKLEPEVDKLYFTAFQLNRASDLLKSVEQQQLNKKVSQYLQGYSNKSKVEAYKSLPSSSGSNNRWSIPLKNVDTKDLLRAICRLETQNKSS

SEQ ID NO: 18798 - protein, 924 aa, Candida albicans
RRRCTQPTELHPNSSRSCLVVTFYYQNTRTTFVDLMATTTSNAFANSENASITQLIVNHKNVSKADDLISNFISKNQKLKVVLNLDPYGDSAFIDSSLKDVSDFVKIFEPPANSPVNSLAKTNNDTVTKQVRRVPSYTRPTLSSSRHSPKNLSKRSRINSNSPDKMTLSKRVRLKNSPLSQSVDSNPFIEKNSKIYLKNLALRTSSTDTLTDSDSHHDCCLQIETLQNEKRVLHKKYVDSIKDLKQDFLAFKQEAAGIINVLNDLDAQLSELKQKQIDLENTKNDQIKELVSEHELQIEKISKDLTEKFKLVETQLLSKHESHVQQFTKELIAESESKQQVEEELENLKTIHAKDSARILELETQLSDAAKEKSESDYKLTDTSEIVNDLKSQIETLKANLNKLEEEREIQNKKLDQVSELKELKELKVEELSNNLLKLQQELHRKEIELNEQLEKLHGVSADKEKLLQQSIEQSKIYINSLKDQNAKTDRNWEIKYGTLEQNQQKLVEEHLANRQRDQLEIEKLVKSKTELEADNQALKNQLTEISKQFSTLGVESSELKKQLEETQIKYDQAEIVHQELKAQIEKLLKESAGKDGQLKELNQSHEKFVNELKNEHEKQVKETKDQIIKEMEEKHQQAIKEIEDSHNENIKEINNEHENKAKCIIDSLNEEIEELTSQLKNAESEKNTLQSLKLEYENEIIAYKSKIDQLEKESAENLKEYEAKLQSMKFDLESDLAIEKQLRKDDGQDFENQIEKLNQLVTEKDLQLSEKDEEIASIKKYMEELEDTKAKLEEKSTTQNGMKLLDNSLTKKHAAVVAELSGKITNGDADIDGDNEPLDGNEDGTSMAITSSINKRNVLQPLLNITTSPFEKSQIPTIQKTMNLHLQSLKVLIWLQLNRSLLNFLLEFFFYIKIIYFLVFVPY

SEQ ID NO: 18799 - protein, 336 aa, Candida albicans
MTELPKKNQVRNNEIDNKKLERKREFNAAASLISEHEDSKRRKLNLPEPGTHNFEKTKSDVLTLTNQANNKLSEKEIARNQNKKRAAVAQLIKATFERLPPPKHETGEILPFVSTNILEFRNDVNANDISDIAGAKLPDETATNVSTLISRVVQRELPIPHPNNLRDLSTVKFDTLVDKLIAEECHRLIRSDYKQYHDTTINGVSTDKYDRDLLEKINQDIDKEFAQMDVSTVHSFEDYVLPKNFKVAESIIENLHTFHNENEKLTNKILQSTNYEDQRDQKLQQLTHLWRELSDVNLSYLIEKKLFELESSAIDKELLCLRSEIDKLNKKIETLR

SEQ ID NO: 18800 - protein, 721 aa, Candida albicans
PIHVMQQPPSYHHHHYHDANGKGVNQEILEKATAGLRSRSTSDLHHHHHHHHYQSNNANFPSSSSLRDILSLVFIMLSFPQYMSLGLLVVYLMLGSNFMGGKFLINFLLPQLHKLAFTNVKHSLVTFIKMGAIDVFLFYGLGKVVKKKSYFNYLVILSKAIVASEFIGSSSINYINSISSKKFTTKIQYDDKNRIFNSNLINAIVCFIIINYVKYVLNWVNLSFQLFSTPQYSAHITNFNFSHWNVQVYLFLCIHTIIQALFRQSPIAQSYIPTDDISVNVDNNQLLDIYTKNLPKFNGNYNSNYSVALKNFENFIISPFNSKLSVMKNRMRASSLSNLAMKTTTTSTTTSLTSSTTSTSLTTTTISPNVTLIENTIIVQPFWSIIAAVKAILKNPNLFNGELTKKKNEGGVFLTKEVQPNVPMAIMVIDSSKVVLHVLSSIREDIEVRLNNIKWSYFKVVGEYLVIYGLTPLFQYEIDIVAKSLVWNHLVINTTDDDNQVINKSSKETSSLATLQTSLESVMNKTESLKAKLKKYKKDENKKITEMRNSIELLKNKISKNRQGNDNRIFGKIKGLKHSVMQLENEIEGLNKEILELSKTEGKLQEAMKSKESAQLQEIAELNKIYADFESRMKDARAELKTASQELTSLSAKSQKLMVKQAAKQEELRNLSTDIKNIKKNEILAKFTKRLKRTNEKFETILPKIIQETESLTREYNELVA

SEQ ID NO: 18801 - protein, 270 aa, Candida albicans
  UNSURE (34): Identity of amino acid sequences at the above locations are unknown.
QYQLLRIFKGHNLPVKDIIFNQSGERFLSCGYDXYIRLWDTKTGEMIKSIKLKSIPNVLLFNPNNKNNTEFIVGLSNFTIEHYDFNSIQYTNPIQIYDHHQGSINDLKSLGLDKFISSSDDKTVRIWSWQINIPIKVITDPSQHSIPCIKIHPQANYIALQSMDNSIKVIHLYGKFKWYKKKFFTGHQIAGYGIEIDFSPDGKILMSGDCNGFAYFWDWKTCKLIKKLKIIDNTTTTTTKKKPLTCIVAHPQETSKVAIAGNSGEIYYCD

SEQ ID NO: 18802 - protein, 327 aa, Candida albicans
FLKLHFNQLDYNKTRKVMSKDIYLKKILGEECVSRIRNSKILMVGAGGIGCELLKDLVLTGYGEIHIVDLDTVTLSNLNRQFLFRQKDIDKSKSFTIASAVQSFNYLGVKLIPHHGNVMDTKQFPIEWWGQFNFISNALDNLEARRYVNKMALFLRKPLMESGTTGYAGQIQPIYPYYSECFDCHPKETPKSFPVCTIRSTPSQPVHCITWAKEFLFRQLFDENDNSNSMNDANQIQNETDDKDELENLNKEANELIELRSKILLLDLNFFINELFEKIFKVDIERLLSIETLWKARKKPIPLDMTEYREALQQLLEQELSRSILFS

SEQ ID NO: 18803 - protein, 258 aa, Candida albicans
DIPFEIQNWTSKEIAGNIIPAIATTNAIITGLSSLSGTQFFQHQIDLTSSDFSNIFTRASSVFISIRPNKYITGDRLSKPPENCASDSLTARGVLTVALSDLAVLTLEGFIDRLADKYGYSKEDISIQIGKSKLIYDVDFDDYLQTKLKDVPGVANGEVMLIQDDADELENLELYLNIKDDTVELKLPTLELRPKKMVPQSNHNEENNGEYAKELEGGTILLDDDDDELFGNEIEILDDEEEEDMKIVEPPVKKRKLD

SEQ ID NO: 18804 - protein, 275 aa, Candida albicans
CGNIQSVIFFRANTTTPLVTTNIQKMASDNKYKYRIEILQMMFVLGEANDPPIETTSIIEDIVRGQVIEILRQSTKTANSRGSRSMIPEDVIFLIRHDKAKVNRLRTYLSWKDVRKNAKDQEGGGTESLIENTNDVGVRAGGPSQSQSNDSSKMLSRYKKSKIRLPWELQFMFSEQHLETQEENELIDDEEKAASIAKVKKLKMADDRTKNMTREEYVHWSECRQASFTFRKGKRVKEWAPMNSLCDTRPNDDVIDILRFLTFGDCVFLNRRRPE

SEQ ID NO: 18805 - protein, 341 aa, Candida albicans
  UNSURE (237),(309): Identity of amino acid sequences at the above locations are unknown.
TKRWSCQKSCVCEKQQQKKRYFLLARRHFQRKKISSHLTFSSCFFNSLNRSINQKMDGPVEVTKQLFVRPLRNDVTREEVQDHFSRAAPVVEVRLMEGYAFVTFENEDDAKQALELLNDAEFNGEKLQIEFAKERREDTRGKYRLLITNLAEGTAWQDIKDFVREKTDSQPSYVKVFTNFDNGETTCSMQFQSREDLDRAIPLLDKAVFRDITIGAEEDTSPYIPPPPKGKGGFKGXGKGGFDRGFRGGRGGYDRYDRGGFRGGRGGFDRGFDRGGFRGGRGGYDRGGFRGGRGGFDRGGFRGGRGGFXGGRSGYDKGGYNRDNFNDRSGSYDRERSPTRF

SEQ ID NO: 18806 - protein, 922 aa, Candida albicans
  UNSURE (859),(877),(883),(899): Identity of amino acid sequences at the above locations are unknown.
ARDFPASWGRWEDVNSPDYKDPGAPLPVVPTPLVLSTVSQSAVTTNPPSVGSAPGPAPGPSPGTETLYEANNAYAQSSQILQLPQQKSAFSPILFNPIIKSDIHTKYGKGGKFYVAKDSSTNGNLDMKNISLRATSVSGMEIPFSSEDKKRLQQNLEVLDSSTTSDNEGGEDIEDDDNDYEDEGDDDEEEEGEEEEEEESDEDEISDIGKSTPLKLNTQNESVPPQQSNYNPVNITDLGSNTTNNITDKQGYENTEGFGTPFPNQISKYSIKPESPFASNELQSSVSPMYFDTSQSHQSPQLQPSTGTLEVLKASSLESPSKISESSNYLPLILRSINVSTIPSLYLMNNLISSKLLPSFTISDDDLENDLDITKSNEMIVKLGFLKEFLDFMSPNIIFDLGLMKNDESDYYINGVNDLLLNLDPGISSDWILNSLSKVFPCTYPMKLIELLYDFKSLELEDQLDSQLNFLNEIADEEDFVGPKALYRKLKALEWDSFSLNELNKTSFEKYKNVMEKLSAENTVSDDDYFKLPMVKTRILKNGNIVNLNNIGLKFWKYLNFSPVKKQKDFQILLIAETHRNTASYATEFLDQIIQNYKECNFGTISKVNLSTVETRSDLEPISDGLVLVHKEHDQLYNDFYIQTNKKLISLVELIKLDLINKTNNFEFGKPLLLFFIDFNDSSNSNVQVCKIFRNFKVALTTHQLPLVDIFTKIVPSSLLVKKVHHETALKVFSNYKLTKISMNLYNECPNDLANKSIVKNLFTTIVKDPPSKIQFKFMNSSYRDNSSNDDIFLHLAYERSIDNSWFVASWSDPLGRVVHVKSWYCSDSVSKSEKSTYRGDIMDIMSITDDIWSISTDXFKVLNDELGSFGREKILXLTRINXLIPDVELIPWKRLSLXHKEISLIIVSVRSTPRIVGSNEV

SEQ ID NO: 18807 - protein, 577 aa, Candida albicans
LQLSSGYYNLHLQLEFILKTFDRNIMVGANASSISTQYYKLAHLGSISYTIYTSSDNNDQALLELELTIRHKWPQILVTYYNKSLYYFVFGHNKVDSETIDLTKEFPQLSTKYTDTVNVDQFPNPHKSTKNDDNLAWASLSFLKATKKMILYNLSLSGAIKLFGNYCVAPTGDSVYSILCIDPILFQNGDLVVSCVEKPFTQLFSSSVAYPRNLAIDTNFVIYLIPSGIRCHLFDPTSLRNNLIEKPQIENGKLLELLKITTGVQCDESTLWVKLIPNLKHLNNQTSAIGKFIHSVENKKFILWPWDLCLLQFGKFEPAIEEEGLLESSELNNPLHLISDFLDFRIAHNTQLQQQRDSLLDQQQGETVNVPLSAGSVHATGANSFGNVPDISKDVDTVGLSTTTPIETDLFNLQNTEEFFKNDSIHMNLEDQIHKKETEPENESENDMEIDDLFGGDESDDNDDLEEAGNEEEKPTPSNNTIDKNGVIGNALEEAFIADATPSKENINLDSKIMPPDSTSEEAVPDKENFKPKETKPSYIDILKDKMNIEKIVNSPDYKDTCRPYSPVLYTGGKWIR

SEQ ID NO: 18808 - protein, 209 aa, Candida albicans
  UNSURE (9),(16),(48),(50): Identity of amino acid sequences at the above locations are unknown.
ENYSFRSRXSKVEKDXLIKIHAFIRILTPADFESFSRDLLTELTCRMXIXQYHTWRRDGLTTLEDGAKCEKDKVIRAAHYQRMGNGTGSGRHSQTPGLTNGNSFNGNGHRNKFSPQPEFRSKSTTARAPLDISHAADFELLSAEEKQLCATLRILPKPYLAIKNQLMREAVKNNGVLKKKDARQALKIDVNKASKIYEFFVHMGWCSQG

SEQ ID NO: 18809 - protein, 255 aa, Candida albicans
  UNSURE (252),(253): Identity of amino acid sequences at the above locations are unknown.
EKKYLTKTMDSRTKLFHSDVCSSDCTNRIRIQCAICTEYDLCVPCFDAGLTTGDHKPWHDYQIIEQNTYPIFDRDWGADEELLLIQGCETSGLGNWADIADHIGNRSKEEVAEHYFKIYLESKDYPLPEMNKDFTDVSPLQFLEERKERLEKRKNIPLPPPRGKPVASVPLCHEIQGYMPGRLEFDHEAENEAEIPIKDMVFDPEDLANDIDLKLTILDIYNSRLTTRAERKRVMILNHLLDYRKTIVSDQXXLR

SEQ ID NO: 18810 - protein, 499 aa, Candida albicans
SRRITSTAPLRIDVVNNEFDHKFTIHEDKLNGIYVKGLATRLVTNELELLNILSEGLKYRSISSTQMNEESSRSHTIFQVKLTQKHMETEVIKRSNLFLVDLAGSEKVDKTGAQGQTLEEAKKINSSLSALGNVINALTDGKSTHIPYRDSKLTRILQESIGGNSRTSLIINCSPSSFNELETLSTLRFGTRAKSIKNSAHVNTELSTASLKNRITQLEKMNQSNQSYIKQLEDELSSYRSEPHSSPLMFSMMRNSTATTTSIATSLATKPSNFQSRLPIPSTASIISSPPPSLARNSHMSDELDRRDKKIEELENVILNLKMQNLKTSHQEESKLFSLENSLQNITNKLNEVELVNINLRKHLLISEKIIESRDNKINTLKLSLKEQQLLISRETLGFRNRLGEIQMKLEDLNKYKEEEMSIKRETLLLQRQQSIGGVSSAGTGTGFGGGLDIMQRSGTTSTDDIQSISAFKPDPELIDNMYDDDSSSHTGAWKVRRM

SEQ ID NO: 18811 - protein, 361 aa, Candida albicans
VLSTKEKLAQEKSCESSQIKLVYSGKVLQDDKDLQSYKLKEGASIIFMINKTKKTPTPVPETKSTTGTSNVENKSTTESSTQNKAQGSTNESTTTTTSSSAPAPAPAGATTTTSEQQQPQPAASNESTFAVGSEREASIQNIMEMGYERPQVEAALRAAFNNPHRAVEYLLTGIPESLQHPVAPAQPPATGTAPAQQTEGNTSESGQQGEDEEHEGDESTQHENLFEAAAAAAAGAGAGGAGSGAGAGAGSAEGDIGGLGDDQQMQLLRAALQSNPELIQPLLEQLAASNPQIANLIQQDPEAFIRMFLSGAPGSGNDLGFEFEDESGETGAGGGAAAATGEDEQGTIFSPTGAGRPRECV

SEQ ID NO: 18812 - protein, 265 aa, Candida albicans
LSRLDLLLVVTDDVNPTRDRVISEHVLRMHRFVPPGLMEGEPIREKSAVTLAVGDDETNEQELLEQPMFEKFNTLLHAGIQNKKSNNILSIPFLKKYVQYAKQRVQPVLTKGASDYIVTTYSSLRNDLIGNNQRNTAPITARTLETLIRLATAHAKVRLSKTVDVKDAKVAEELLRYALFKEVAKKTKKRQKTTSIVDSEEEEEDESDAEMENSDNEIMPRESTRRTRATAQTQPPQQQQASPSLTPEPPLGHRDDGDDDGVGEE

SEQ ID NO: 18813 - protein, 61 aa, Candida albicans
RSRSALFANDQAAANYHDVTRAINEQMEQEDIFSEQELSAGFEVMSSENKFYLESDKIWKI

SEQ ID NO: 18814 - protein, 435 aa, Candida albicans
IIMDERFLNPPPTADQDDTNQPLDAIFGDRVRRFQEFLDRIDSNTGIDYRSIIKDMLIKSKFRLSVSIDEIREFDREFWLGLLNQPADYLPACERALRDTVLAIYDPQDPSFPHDSYDPNQQYYLSFKGAFGGHSLTPRSIDSSYLSKMVSIEGIVTRASLVRPKVIRSVHYAEKTGRFYAREYRDQTTSFDAIATPAIYPTEDMEGNKLTTEYGYSTYRDYQKISVQEMPETAPPGQLPRSVDVILDDDLVDLTKPGDRVQIVGVYRALGGAANNSSSFKTVILSNSVYLLHARSTGVASQEKLTDQDIRNINKLAKDRKIFDILSRSLAPSIYGFDYIKKAVLLMMMGGVEKNLDNGTHLRGDINILMVGDPSTAKSQVLRFVLNTASLAIATTGRGSSGVGLTAAVTTDKETGERRLEAGAILTRRAGKSSA

SEQ ID NO: 18815 - protein, 314 aa, Candida albicans
  UNSURE (16),(47): Identity of amino acid sequences at the above locations are unknown.
ADSLSESQDLFASPFXQQHQKVDTVATKNEIGLELNLGLPEMQKASXTVSTPFQIHSSVLESVFSTNLDGVNDIDHTPMFDELDLIMDGAKVNSSEDWVALFGDDNDDGVAIAGATSKEPMLSLNEDNENNDDDADDADDDDDALVPREDTIEALLLEPSPNRTISAATSASTSSLNSPESTIATTVTAGGEVVVASKKQFQLVTPNPSSTLPTPLLDSKNSKKRVKVDHLGCVTYSKKHRSQPLQPIVVDDIKDAAALKRAKNTEAARRSRARKMERMSQLEDKVENLINEKQALQDQVERLQELLRVNGIQF

SEQ ID NO: 18816 - protein, 392 aa, Candida albicans
  UNSURE (8): Identity of amino acid sequences at the above locations are unknown.
TIPMDTGXCRVAKQNGHGEFITPLADSHFYKSGNLNYELIAHVTRFIDKRLTQEAKQDGSILIFLPGVLEISSTIKEINKLSDNKFMALPLHSGLTSAEQKSIFKTAPKGKRKVVLSTNIAETSITIPDCVAVIDTGKSKNLFFDHKLNTTKLIQSWCSQAEVRQRRGRAGRVTAGTCYHLYTKETFEAMQKQPIPEIKRTRLENLYLVVKSMGISNVNEFLSSGLDAPDKSSLDKANQFLHEIGALQENILTKLGNYISYLPTDPQSAKLLILGCIFGCLDICLTLAAISSTGSPFINSYEQRDKLKQIQKTFGNGQGDFISMANAYNAYMSNKSKRFLTENYLSYTTIKDITSTRSQYLSLLVELGFVHRKLDDSCNKNAENWPVLRRHS

SEQ ID NO: 18817 - protein, 618 aa, Candida albicans
TRSVDQTKLIGCTQPRRVAAESVAKRVSEEVGCKLGDTVGYTIRFEDVTSENTVIKYMTDGMLEREALNDPNMNRYSVIMLDEAHERTIATDVLFALLKNAAKQNPNLKVIVTSATLDSNKFSRYFNNCPIITIPGRTFPVEVLYTKAPEMDYLAAALESVIQIHVSEPAGDILVFLTGQEEIETSCEALHERMKLLGENIPELIILPVYSALPSEMQTRIFEPTPPGSRKVILATNIAETSITIDGIYYVVDPGFVKINMYDSKLGMDSLRVTPISKAQANQRSGRAGRTGPGKCYRLYTEQAYEKEMIPNTIPEIQRQNLSHTILMLKAMGIHDLVNFEFMDPPSTTTMLTALEDLYILDALDDDGNLTTLGRKMADLPMEPALAKTLIQSVEYECTEEILSIVAMLSVQTIFYRPKDKQALADQRKSRFHHSLGDHLTLLNVFQLWCRNNYSKTWCRDNFIQERSMRRAMEVRKQLKLIMQRFGYKTMSCGNDVDRVRRTFCSGYFKNSAKRQEGEGYKTLNENTLVYLHPSSSLYGKKPQYVIYHTLLLTSKEYMHCVSIIDPNWLYELAPKYFRPADAKTVQEIKKKQKIVPLFSRQKKDNWRLSSHRPAKRR

SEQ ID NO: 18818 - protein, 428 aa, Candida albicans
LTKQPPFMAQPTTQLLSIVQKHLDLPQDDENVVLIAKFLVNLHGNSTLEEFKKVVKENGGDEFEDEFIKEVYNEISPPPPQVGKIYSGVVQSVTNYGAFIKIEGTSGLCHISQMSFDGSRVECTNVLAPNQKVFVKVIDIQTHANRISLSMRGINQNTGHEEPIPQRGRHQERQPRPKRKLTSPERWEIRQLISSGAVSADDYPELDQEEDTQTESEKTDNLHIELNDKKPDFLKGVKVTKDFPETTPIPVNQLGPLTKSAQRGSKFARDFKEEKFKQKKQREKEEKIQSELSDPLFQTSEPVKNSDLDPDTESFISKWKKSNKTETFGKRTSLPIQEQRRMLPVYAMRSQLLEAIRDNQFVVIVGETGSGKTTQIVQYIYEEGMNKVGGPDQIDRVYPTKKSCCRVGGEKGVRRSWLQAWRYCWLHH

SEQ ID NO: 18819 - protein, 185 aa, Candida albicans
AVLPRRGEDLDSNQQPEIQRVNLTSVILLLLSLGINDLLGFEFMDPPSKEAIIKALNLLYALGALNTQGKLTKTGKKMSEFPLDPVFTKCILTSDKFDNTKQIISIIAMLNESSNLFYRPKDKKELADKKKQEFNDLQGDQFMLLKIWQQWVDSGYSVQWCQDYFIQYKTMKRINNIYEQLIRLS

SEQ ID NO: 18820 - protein, 488 aa, Candida albicans
PRDKLKLEELIPRILFERKSFLNVTEDSLRKEIDNSLKISEEDALDTEESREDTVEADQQEVFNKHKFELSKNINNALNETQLSLDFVSLLISSVKPSLAKSTISPHLSKFVKPTSLNSDRLGQDSNDNQESKATDSFGQGWKLESLGKITDLFREASTNLNDQVIKERRYWNMINLVLANDEVLFRMRDPQNNARAIGVKYGYGDSGSNFHDQGLALLRKDNQTGEISFHPISSINNAKIVEKVSRFIRVKILSQIDGDYMLTGQSIFNFDFEKSKQSIINDIEKARFFLFEEDLFHQLIREAKLLVNYNVSIISNKIIIEINNIIIEIESIVYDELNEEELENYYQNVNEYSTLHNKKCQLILNYLKLMLCCYYKYNLKLKQKVPTALTKWKQSNSHPLILRPLVGNMRHELNLLNMKSVLDRLMHAHESELSYSKLDVEKFINLATRSKKQNPFQKSIEKPISKFHLVLCNKTSNMLDVNIQLDN

SEQ ID NO: 18821 - protein, 285 aa, Candida albicans
GWMEELKDAREERSVCWASCRTSSSSVDDMTTPLFLHRKKIEGIFFFLSVSQLSLPAMNFPPFEQPLFDPNQAELLEEAERAKNSSIPFHNPFDVNSYPITNPPIFDSTMTVPYTTDGVPRRRRISISNGQIGQIVSHEAYFAEDLDVPPEFESRPQTSVIEPPPPPPPQPQPQLPVEIAGVPPPNHQLIYNNEVIYNPENGPIPGTAAWKKERLLERNRIAASKCRQRKKQEQVQIQNNIAKMEKELKKKDAKIAELEYTVELLKASIKSCIEDGNTDRLKQFI

SEQ ID NO: 18822 - protein, 577 aa, Candida albicans
FIVSYWFKCILTYIIIYSPLCVEEMDISDKNFKPCPCGYQICQFCYNNIRQNPELNGRCPGCRRLYDDESVEYKTVSAEEYKLMQLKKEKRDREKKQKEKEKKEMEMVNKKHLAGLRVVQKNLVYVTGLNPPCNPDDLHSVLRSDKYFGQYGKISKIVINKKTPTTQTSTHHHQNPGLVVYVTFTRKEDALRCITELDGSLCDGRVLRAAHGTTKYCSSYLRGQPCPNPNCMFLHEPGEEADSYTRKDLSTQQGIKMGMTARSHTTSFGEESSNNSQSNQAGSDDDHHEAHKEHLPSTAHWAAAGTTSGSNSPSVNNNIPLANSAAFPTLGEIVRDQKQQQKKETKPRSKTTKSNNTLVPDELDAGDNSVFKFVETTTEQLRGLEDIRNVRFKGFDNGKILPLFSFKGNFLNDTQLEEEKVIARQVIEKFLLRPLKNYHLAYQNHPITQQQAILQRQQQQQQQQQQQQTPALQVAQLQQNKNDEQQKQAQQQLLLLQLQHQQQLQQQQQQRQLQQQQNQPHQLNILKTSDRVNTSTPPPPGLFAGKDVAASSDMSNTGAPLPSSSSQLLTQLMSGKR

SEQ ID NO: 18823 - protein, 257 aa, Candida albicans
MSSPEIEASGSSESKSGYSSQKNPSRTPTSWDAEDDILLMHLKDNQKLGWKEIASNFTNRTPNACQFRWRRLKSGNLKNPPKSAAALGAQFKQNPNMNSAPKKKKATTKNNKSTTESSDNTTEKETKSGKVSKTPKSSGPTNNGSKGNTPSSSSNSTTNSNNFTYNPMTTGTFQGFDNNISTALAGLNALSNSPSYISNSSPATPKGLTSPTINGSGPHHSGNPNLAHKYEASPASDRSVDQRRRSRYRHHGPGKTA

SEQ ID NO: 18824 - protein, 216 aa, Candida albicans
QRGSGQPRGEELAVTCQLPIDMGGGEGKCLYIDTEGTFRPNRLVSIAQRYGLNPNDCLDNVAYARAYNAEHQLNLLNIAAEMMAESRFSLLIVDSIMSLYRTDYAGRGELSARQTHVAKFMRTLQRLADEFGIAVVITNQVVAQVDGMSGMFNPDPKKPIGGNIIAHSSTTRLSSKKGRGETRICKIYDSPCLPESECIFAIYEDGIGDPKVEDNE

SEQ ID NO: 18825 - protein, 383 aa, Candida albicans
LLSFNYSNSIMTTPFVELQTPKNLDIISDVCFMDNTDQHRLLVSNWNSEILLFSCDSLLHEHQPPHLQPINTFTTPDIPLCLLYDNKQNVSPLVGLLDGSIRELDFENGKLGDNIGDAVDDNNEIDSGINNLKNVNISGQNSSSIVASSFNGKLQLIDTRQSQRQQQKLSPQTFHNQRKIFTMDTSDQYLILGLQNNIIEIYDFKNLHHPLETRQVGLKYQIKDLKTFPDNQGFALSTIDGRVSMEYFNPDPQFQLQNRFTFKCHRHPDPNPESAGDLVYPVNSLDFNHKYGTLFTAGSDGYVCLWDCKKRKRMRQYPRFLSAENEPESIVKLKINRQDNLMVVATSDDNYKRRRRLSESENSKTPSRVYVKQLAENECKPKS

SEQ ID NO: 18826 - protein, 590 aa, Candida albicans
LPVTSLFYSHYSKKDMSLTTNRIALSTIKDSHLNSSPSNTPSKDKKLPTLYNSNKPKSKLFSPSHLRIRQPDLITKSFSIAHSATSLNKKFSPLRAVSFSDYRSTLSNKPLSSSSSSSSPSNLKLQSTDDAFKNDTIGLAATKLKLKLQLALYKVQQNKQTRLKTTKYYNNNTNNINSYNHKIHKTNGHKSMAIKLNSILGSLESPPTSNRSSPVSAYESPNPTNNNHMVKSSTASLPTPPEQVRTSNYYSHSINVNLNATPRFNKTKLLKNITKPTNSATSTLNKVASSRTKNTKINKPSKLKLFQIKKDSIYYCSNQKKLPLSQNNTTHVTNQSKYTNNLDITATNGTTHSFNNMSTPSSQGTVTGGAGNGQSMSFFTFYPTSQEQESSQNSTTNVGTTRLPSITVDRTTNEVPSNRNTNHAQNSFYSSLGATNTALPSINKILKTPIRRANNASKQFLFQRSFNNAAPLVTNNNNNNNNNNSNTYGNDETTIDEDNDITIIQNTTISNTTIDQNATIDEQKTEYDVEQEEITQEIKNSNEEDEYEHINNPSKQHDILTSSPLSNQQFTKPNKFNVAKSLLPLGGHRM

SEQ ID NO: 18827 - protein, 236 aa, Candida albicans
TRIFHPRGEDINNCFELKNFPTVLDDLELCLINTDINGRTPLHYLCQFAKSKTKNDSLVYYLKVILNKLTILSNQSQVRQINLMKNVLDHQDVHGDTCLHIAVRSGNIDIVKILLQYGAMDDLENINRETARQLITQCNLIPNYTQVDAAQVAYQNQMQLGMGDYLNYNVNNNAMNQNHNESSHNVPIVPGLATPIQSTFTKVGILITHGITFQEDIMDDDNESVVTRVNKKHLEA

SEQ ID NO: 18828 - protein, 129 aa, Candida albicans
LPLYLLTAAKNKPILIELKSGETYNGNLTNCDSWMNLTLHNVIQTDSRGEKFMKIPEIYIRGIHIKYLRIPDDIMGYAKEQSMINMENRNRYQKRRGTSSGGGGGGGGGSGDSRRFNNRQLHGHNYGRR

SEQ ID NO: 18829 - protein, 484 aa, Candida albicans
RHDFFKLLNNNTKKKKISTKSRTTPKLFQPCHVMSDTIATKEEASKIFDRLKKDPANQVCFDCSNKNPTWTSIPFGIFLCLQCSAVHKNLGVHISFVKSSNLDSWQRIQLRNFKFGGNQQAKDFFLKNGGSQFVNNKNGVDATAKYTSPCANKYKEKLKQKAAQDAAKHPDIVTLDDVTDVMSLSDSPSESTDDFFSNWNKPVNNSNTASPLSSRAATPNASTDDLTKKKPVVRTTTTSARLKSNNTAVKKSILSGKGNGPRTSRLAAKRINKTEDDIDFDEIEKKAKQEAEEAKKLGYKPTETVEPTVKKQPTSTSLSLKKENEEVKLTPAPIQETTQQFQKLGFGMTQGDNIVGSSTKKYKEVKYTGEVSNKYGTQKGISSDEFFGRGPRFDEQAKTEARTKLQAFNGAQSISSSSYFGEEEGGARGGRSNSGAGGLGDLEASAREFASKFSGNANQDLEVLKDALEDGATKLGSYLRDFLR

SEQ ID NO: 18830 - protein, 316 aa, Candida albicans
KKKVKKAKLSKPKPKLTKSTLDLEDLLTHITIPQDLSLPPKYIQDHTPEFIKGIQHILKIDPSLYPVIVHQNFKSFSSLIYTNVTMNENYNNSNDKENRIHTYWYSLIRSVIAQQVSGAAAKAIQTRFEGLFDGIPTPNKTLKFTPEELKSVGLSNMKVKYVQSISEAFNDPNNHLTRFEFYKQSKLDDILIELCKLKGIGIWSAKMFAMFTLEEMDVFAEDDLGIARGMARYLNKRPELLKQIKQECMNDEESQLLLKRKLKFANKTDSKRNWTPIHDAYVKYAAKRFLPYRSVFMMILWRLSSTNIDVLEKLDE

SEQ ID NO: 18831 - protein, 252 aa, Candida albicans
KFPAYSQPVNNTKTMDLKLPPTNPTNPQQAKTFMKSIEEDEKNKAEDLDIIKKEDIDEPKQEDTTDGNGGGGIGIVPTLQNIVATVNLDCRLDLKTIALHARNAEYNPKRFAAVIMRIRDPKTTALIFASGKMVVTGAKSEDDSKLASRKYARIIQKLGFNAKFCDFKIQNIVGSTDVKFAIRLEGLAFAHGTFSSYEPELFPGLIYRMVKPKIVLLIFVSGKIVLTGAKKREEIYDAFELIYPVLNEFRKN

SEQ ID NO: 18832 - protein, 345 aa, Candida albicans
LHSAYVWYTHWIKMGLSSILQQIEKKGKIQQKQVPVEKKSDTVVTKDKFKNYSQDRPIDPVVARLKEKRRLEREQKERELREKKGLPPKKTTTSKPKSSTSTRSGSRQPSSQRSRTLSPSLAPQPPQPPQPPKKKLNYNELLKKAATIDHNKLSINLLQKSKSPEAKSKPLDTKSGPAPRQSTQKPIGNPRHTSPPTTAYPQKPHVKPIPQRASKPVPVIKAPLPPRQPSSKIKQRLEEKRKSRSYEEVEEEDDLSDFVEDDEEYDDGYGADEINREEIWAMFNKGKKRSMYYGDDYDSDDMEATGAEIFDEEYQSRLDAEREDRREMEEEKRLQALKRKRLNRS

SEQ ID NO: 18833 - protein, 393 aa, Candida albicans
FPPYSMSNQSPNLHHRKLLNDVNIREELPLRKKRGYQKPETIPVDDTSDSEEFEDVDLNILDDSDEFETIDLENIPKESGNDTLVIRIDNNKKEEKTPKNLISREERHRRVLLHKMYLVMMLVHGSIRNLWCNNKEIARSLKLSCVTPQITQLLENNTNALDQVKSRRLLDGLKKLMTIFLAKFRIISQGIIRKDWDELELSQKSDIVGKRTFRKLACNFRGSRDVAAQTFVTLLRGLGLNARLVFSLQPPDYTKITHGPHPSGHEKSGTPKRKTKTAGFQDSEYPVFWVEVWNKYTRQWVSIDPIVMKLIEVCPKRKKSPFEPPPTDERNQLTYVVAFDKFGRVRDVTRRYSYNYNAKTIRKRIEFRSSEDKSWYLKVLRCCDFKKTQNVAD

SEQ ID NO: 18834 - protein, 257 aa, Candida albicans
RNRGRPWRGEKAKAWCMIGRQLKVGAIPLKSKEEDVRLYAEFQTQLYIPPPVTDGIVPKNQYGNIDVYTKTMLPENSILIECDENCSMNMLQNAANLLAIDYAKAIVSFSFKGKKNKHNITATEGGIVIAKEYEEAMQLTIYNLIEQEEEDQRALSEANALRNWKYFLLKLRLEYRLNKSHGAILDTPGTEELTSNENPEGGGFVVSDEEVDEGGFIVSDKEPEEGGFIVSDEEPEDNSVDVTSEEYSDIDFEYESD

SEQ ID NO: 18835 - protein, 297 aa, Candida albicans
  UNSURE (247): Identity of amino acid sequences at the above locations are unknown.
LGYSAPGEVEKQYEAVRLEKLAKYQGVNLFVKNLDDTIDSEKLEEEFKPFGTITSAKVMVDEAGKSKGFGFVCFTTPEEATKAITEMNTRMINGKPLYVALAQRKDVRRSQLEQQIQARNQMRMQNAAAGGLPGQFIPPMFYGQQGFFPPNGRGNAPYPGPNPQMMMRGRGQPFPEQWPRPGPNGQPVPVYGIPPQFQQDFNGQNMRPQQQQQQQPRSGYYPNRNQTSKRDLAAIISSVPQESQKRXLGEELYPKIVATGKAQEPDAAGKITGMMLGLENQEILDLLDDDELFNNHF

SEQ ID NO: 18836 - protein, 176 aa, Candida albicans
SVMSAAETNQLQESMEKLNIGSTTEEQSAAAATTTADQSAEEQGESSGVAENSASLYVGELNPSVNEATLFEIFSPIGQVSSIRVCRDAVSKKSLGYAYVNYHKYEDGEKAIEELNYNPIEGRPCRIMWSQRDPSARRSGDGNIFIKNLHPAIDNKALHDTFSAFGKILSCKVATE

SEQ ID NO: 18837 - protein, 706 aa, Candida albicans
  UNSURE (613): Identity of amino acid sequences at the above locations are unknown.
IKLCSPPKKKKIFYNSPMKFFIDDLPVLFPYPRIYPEQYSYMCDIKKTLDVGGNCILEMPSGTGKTVSLLSLTVAYQMHYPEHRKIVYCSRTMSEIEKALIELHKLMEFRANELGEVEDFRGLGLTSRKNLCLHPTISKERKGVVVDEKCRRITNGQLKEKIEKGVPTEDSLCSFHEKLYDLEPHNLVPPGVYSFDALIKYCKEEGTCPYFTVRRMIPFCNIIIYSYHYLLDPKIAERVSRELSKDSIVIFDEAHNIDNVCIESLSLDLTDETLKKASRGANKLGEAIEDMKAQDSEKLQNEYEQLVEGLRQAEIARDQELFMANPVLPQDLLDEAIPGNIRKGEHFIAFLKRFIEYLKTRMKVLHVISETPTSFLQHLKELTYIERKPLRFCSERLSLLVRTLEVTEIDDFNALKDIATFATLVSTYDSGFQLILEPYETEGSTVPNPILHFTCLDASIAIKPVFDRFSSVIITSGTISPLDMYPKMLKFETVIQESYAMTLARRSFLPMIVTKGSDQVSISSRFEIRNDPSVVRNYGSLLIEFAKITPDGMVVFFPSYLYMESIISMWQSMGVLDEVWKHKLILVETPDAHETSLALETYRKACSNRRRAXLLSVAPGKVSERIDFDHHYGKTVLMIGIPFQYTESRILKARLEFMRDHFQINENDFLSFDAMRHAPQCLGRILNMDRRLWDYGFGPIERSALK

SEQ ID NO: 18838 - protein, 187 aa, Candida albicans
RQGGLGYIDTEGTFRPDRIRSIAERYGVDADTCLENISYARALNSEHQIELVEQLGNELAEGTFRLLIVDSIMACFRVDYSGRGELNERQQKLNQHLSNLTRVAEDYNIAVFLTNQVQSDPGASALFAAADGRKPVGGHVLAHASATRILLRKGRGEERVAKLQDSPNMPEKECVYVIGEGGIKDTD

SEQ ID NO: 18839 - protein, 237 aa, Candida albicans
IHHVANINLNKQRNESIHKLVNCKRKKIKCNRQQPCVSCIKSNLESICEYQQQKWLATPNNKNNGIFQIQRLNDDKINESCQNKKDEIVIPLLRNQEKEEKNVGDGDGLSQLKLLNNILKEPINNNERNEFHEFEHENIGNIESEKYLLGLFENFIKYHEHLLENLELILGIRNKIEKISQLEPLLFKFEIYLDEKYPEIKHHELINTSENEVSFSSSSLSPNKIRNYINMKMILHM

SEQ ID NO: 18840 - protein, 248 aa, Candida albicans
  UNSURE (221): Identity of amino acid sequences at the above locations are unknown.
LCLLCYTSFTYTTTTYKKMELTVDNTNTTSNIDDLSVATPTSLMTSTTTSPSMSTSTSSHSNTLDIDPATFKSTLPPRKRAKTQEEKEQRKIERILRNRRAAHASREKKRKHVEYLENYVLKLETNLMKLNNNYNQAFELLTKDNQELLLSKLEVLDDVSDLKEQIHSNMSGTRRSHNKKSNDEDIEEEDEDEHLEEGHVEKQEIKKEEPVSKKRKLNTKXKFKTKTKSSNKRITSTPLLYTPAGRYH

SEQ ID NO: 18841 - protein, 471 aa, Candida albicans
MHITKINGKIDKVNEKMKSSKDLIFAEFCEKYGFINGIEDYENMHGSTLRVRAKERAQFSKTISVLQNKLDFEKERLKETKDRRKSIESLIVDLEDDLAKVLTEKKKLEESLDKEEAEYEVLQTEISQFDDLMQSQLKTSKSIESDLDDSKLLVSTLVKEITQIEENLLKTDSERANVLRNCKIQNINLPLIDGDLDSISVGENLESSIKEVYKIELDYEMLEERFKEVFNNKLESELEVTLQNTISDLEKLTPNAKAIERLREVETKLRNYDKEYNVARQKERQVIERFKKVQEKRYDKFMDAFNHISGCIDSIYKELTKSAMSPLGGSAYLTLEDEDLPFLSGIKYHAMPPMKRFRDMELLSGGEKTMAALALLFAIHSYQPSPFFVLDEIDAALDNANVARIGNYIKKYAGPNFQFIVISLKNSLFEKSDALVGIYREQRENSSKTVTLDLREYPDDDVPLSTVTATT

SEQ ID NO: 18842 - protein, 792 aa, Candida albicans
TSTSFHCITRAKSQSETFIMGRLIGLELFNFKSYKGKSIIGFGSSYFTSIIGPNGAGKSNMMDAISFVLGVNSYHLRSQNLKDLIYRGRRNIDTDSTTLDAIEQDPTSAYVMATYEKDDGEILKLKRTITASGNSDYQINGQSVTMLNYSMVLKQENILIKARNFLVFQGDVETIASQNPKDLTKLIETISGSNEYINEYERLKEEHEKAHELTTSVFSRKRTLNSESKQYKEQMAEQRQFEEKIITKNDTVKKINLYKLFHNEKKHNQLKDEIKSKNEELKLAKKELSNKEKTYKSIMTDYSSSVLNAKKQKQQTEAAQQKIDSTKRELIPVEANQRSLSNKINFHKLKVGDLVKDIARQKTQVSSVERQLRDAQRMFDDFQAKIAAAVASSTNISPEAQKEYEELRSKFLAENGSELEEQISLLLNNKDSLNSAKSNLENQKTNAENRIAELESIVATDLKSKLHDVSNEINEVLDKKSDKVEARNALIKQKDEFNHEELKLNTRLRDVLVKLDELASQQRESNKQKKLRENVATLKRLFPQGAIKGLVYELVRPTQQKYESALATLLGPNFDSIIVESSAVAYKCIDILKERRAGVATFIPLDSIETDIINLSHLRSIHPSALPGVDIIEYQDKSLEPAVNYIIGNTVVVDTIDTARNLKWQSNTRFDNKIVTLQGSVIHKSGLMTGGQQQQKSSASLSWSKQEWTKLNELKEELNQKIFKLQEKRPKDLEINLLAEEIGALDDKLPVLRNQKTSIERIIKDRESEIEFQTGLFKGFDKSIQEKMNAHN

SEQ ID NO: 18843 - protein, 826 aa, Candida albicans
EIQTENIFWLQRFSFIPSRVVVEMALASQLSVTDDSAYGFITINAEIVSKKRKLAQNDDRFEVVMSVYSPKADSMDVGVSVLKLKTLELTLMSFCDSLTFVRTVNQIQVYEPTSIILPEAQSHSQIEKLKYIIHSNISDKVRERFMKAKAFNAFDGMNSLKLYTDINESTLGQVISNRKLSLAAANACIDYCVSTKMFRVTNKIRLKYCMCENTMLIDTCTVRDLELVDSLSETGTTLYSFLNCCLTKMGMRILRTSILQPSTHENSIILRSESVQELINDEDALISIRSLLKHTCDLEKVFSTFLEPRGLLSQEQEINNIILLKTVLQNTFVIRKSIQNVSSHLLVQVKQILEHENVQHLLAIINEYIRNDCQWANNSTELANQRANAVKSGVNGLLDVSRRIRETLLEEVSELVAKLSEELEIFMEYRFEISRGFFIKIKGNNTDINSLPEVLINRVKKRKTIECTTIELMKQSSRYNDIVSEITTLNSTIIHDMYTSINSYTPILLMVSEAIGTLDLLCSFAYFTSLQKDSYTCPEFAKEVTIMRSLHPILGGNNSNFVANNYSCNHELSRIHVITGANMSGKSVYLRQIAYLVIMAQMGCFVPAEYARMRIFNSLYSRISSDNVDINASLFSKEMSETAVILNDLDGDSLILIDELGRGSSLTDGFSICLAILEDLICKEATVITTTHFRDIAQVLANKSCVVTAHMQTVETNGQLEMKYNLVLGRNGIVGYGIRFAEVSNLLPQELIEDSKVVANILRSRKPVHGDKELKLLSRRRKLVLELYFALNYISKLNCDMNYKMQLLQTLQSKFVEEINITPNTE

SEQ ID NO: 18844 - protein, 163 aa, Candida albicans
ISDRLYKPDSDGDLPEPVKRGHMLSIVLSPTRELANQIQSVFNQVLQYLPEDKGTRINTQLLVGSIGNVREDLNQFLTNQPQILIGTSGRILEFLGSSQSIKTSSLEIVILDEADKLLDFLFEKDVINILKKLPKQRRTGLFSATISSAGNTIFVFTPRWKTT

SEQ ID NO: 18845 - protein, 104 aa, Candida albicans
TYKKVFFFFLANLPSHLKLISLIQPTNQPTYLPIMKSNTESLAWENLRYDLHSWIKEAISSMGIPTMTPLQASTIPLLSGNKDVVVEAVTASGKTLSFVIPVLQ

SEQ ID NO: 18846 - protein, 127 aa, Candida albicans
GEGWVREIIDMDKYSYADKLQEKIRLENLENDKLKKIQDAKRRKELKIKNEAWSSKSERKENKLDRKEKLKRKREAIEKQIMEEERSNGGGNKDEEDEVVEDWKDMVRKNKKKQKKNNSIQGSFDDL

SEQ ID NO: 18847 - protein, 410 aa, Candida albicans
NSIYTPDHLNSITTITSMFGNKPATSGTGFSFGQTNQTAANGTNQTSQQQQQQPAVTIGSTTQSVINPPNGPTTGTTTNFSLPVSVNTSNSSKLLKELLESANNLPKTNDNIQLGSIHLTLNELERKSQQLRKQSEKDTNFTKAHYLLAGSGISADDIEDELNAIHIPKTGGRIPSHRAIVGAENIENYLSAKKDENILNTIEQSLSLASKDFDNYIDANISIDWKVRRDELRKAVGLKTNTKFNEETLKNSIIWKSNSAASNILTPLNTSSSSIRQISREKFENQAKIIYSLNEARLQNKSFPLCLNFNEVNKLQNDIKAKQIAEIWKILISLTGEKTAKTSQEQKFFNTTKADLNAIIVTNSITYLQQEFFNYIDELYLKDGDKPQSFAPPTNINKVSYLVHQNCVEK

SEQ ID NO: 18848 - protein, 612 aa, Candida albicans
LICNKNFSIILMNYILKMAINHRVLPHQQILIKYLIWFIKIVLKNDPDLINKTLLVNGTPIGVWICYLIRAGLYLEADELVQRNREQFNKFDKNFPVYVKSYVENTNHVLPSDLNERLHKEFNQQFQFIINDVDNNVNYDPYKYSVYKIIGKCDLSNKSLPRSVNLSIEDWTWFHLSIINANQPGSESNLIFENYTLSDLQNKIIQLGPKNFMSSPNNPLYLKTLILTGLYEMAVQYSYEYVNESDAVHLAIGLAYYGLLKCSNFNKDNILTVNNNEYEINYGRLVGAYTTTFKISDPKVACEYLIMIALANGGESKSALLVCHEALRELILISCEFGVLLGELNQTNGTKIPGILERQRKLIKLESLDQFYQQIIEVAANKCQEESRIFDALLLYQLCCDYDTVVSLINKLLAEILATTDLNKPIIKSGNYEAISTGYITKEVDDTIDNNIILLAQHIMKVFNNNSHILGKLSSKVKQTSELLLPIIGIRDLFIKKDWRQVINDINQLGLIPVGVNDDLIKIRTMSESIQNNDLDDNLIKIIPSLLIMVMTSISHINYNILTKKYQSYGNEKQELIHWKKIAKNCMIYAGMVQYKMPRETYSLLINLESLL

SEQ ID NO: 18849 - protein, 822 aa, Candida albicans
IKLFSIIKRMNINIQIQELVQLKEEYANKQELLSTLSTGISSTGNVTSGYITQLNDVKLKLNASENFIKTSTLKINHLQQQMESDQMKLTKAKTENETLLSAIELHRQFIKTKQLEIDSKLGFEPTKIHQLRDQESELISQQNKFNQQLNHMRREIGNLDFQYNRPSRDFNDQLVRGVVAQLFNLPETSHDKALALQVCAGGRLYNVVVDTSDVASQLLEKGQLKRRVTIIPLDKISSRKLDHQVIDYAKQVAPGKVDLALNLIDFEDELYKAMEYIFGTTFICNDPNSAKAVTFDPKIKSRSITLEGDIYDPEGNLSGGSRRNNSTILLKLQQYNKLTIQLKKIEFELQNVKQELSRMDSLISSTRTIQNEINLKRHELSLLEKKLENNPAALILKQNDLNQLEIIRLTEEIEITKEKCRQYKQEIAIIEKDIAEFNNDKGSKINCLKKEMAHLKQQVISKEKQLENQTDKFQAAQIDSEQLKIELQNKQEALISTKNQIDELTHKIKQQDQTKEQLIEQLTLVKSELDDARANLLGLDEEITELTNIVKLKIEKMTMTKLDIQKLTHELEKSQNVTKNLKTRLDEIISEHEWVMDNQMVNNIMDQYPNIDIEETREQWELLQEKFSSMRRKVNVNIMSMIENVEKKETSLKTMVKTIEKDKNKIVNTINKLNGYKRDTLNTTYQKVSKDFGAIFADLLPGSFAKLVPIDMMDVTKGLEVKVKLGQVWKESLVELSGGQRSLIALSLIMALLQFKPAPMYILDEVDAALDLSHTQNIGHLIKTRFKGSQFIVVSLKEGMFTNANRVFRTRFQDGTSIVSVM

SEQ ID NO: 18850 - protein, 301 aa, Candida albicans
PTSQMKVDELIIDGFKSYAVRTVISNWDAQFNAITGLNGSGKSNILDAICFVLGIASMSTVRASNLQDLIYKRGQAGVTKASVTIVFNNSEVSKSPIGFENCPTISVTRQIILGGTSKYLINGHKAQQQTVLNLFQSVQLNINNPNFLIMQGKITKVLNMKPLEILSLIEEAAGTRTFEERKDKAQKTMAKKEAKLTEIRNLLSEEIEPKLEKLRNEKRNFLEFQQTQIDLEKLSRIIAACDYTLLSKNFTHHSKFLNDHETKMNNLHLEVDKLNHEIKNLNEDLDQVKSRKVFTTALEGP

SEQ ID NO: 18851 - protein, 236 aa, Candida albicans
QGHTSNATTVNGSGKPYKSPITKNGKNSQKQDFSFTNQFEKLPESTITVKSEPMETSVEPPLAPQGQQQDDSNPMLPPNGKPVEITGAPLMGFTMGKLAEGGAGTVADKKLAKKAGANNGKLSRKPSYSKNRNSVSSSSDESSSTSASTSPKMLANNGTNSSGKRSEKPATKKASHKLAEQGRRNRMNNAVQELGRLIPQSYHDEVSIPSKATTVELASKYITALLKEVEELKGRK

SEQ ID NO: 18852 - protein, 279 aa, Candida albicans
SVLEQPNEKYPVSGQHQNVSEHVSERLKLQVHNHGFFVGKKCDISCKNLEMNDTLSELPQKTTFHEIPENSDIFNYLPDSASGTKTSITENTNLRQLNQLQNNASELSRHQYGSTSSLVLATEVLPYNQRSVFPFNQFNEMQSKAFSSIYNSSNNCVISSPTGSGKTVLFELAILRELEQEFEPNFKVLYLAPTKALCSERLNDWTKKFSSLNITVGILTGDTTFKEAENVRKSNIIVSTPEKWDMITRKWKDYSRLFGLIKILLVDEIHILKELRGPL

SEQ ID NO: 18853 - protein, 301 aa, Candida albicans
DVELSLPPPCVKNKNFMNHTEDFEFSDLDDDNLFDIKPANQNESKIIEFRNETKEDEPKTEVTKPIENEIKTRRVLANGNYECNHACKDKQRCRHLCCREGLPPKTSGGNKTPQTENSKPVNSNTQQNPTETEDNSAKPEPTPISAKRHFKIRKNKATLKRTLFDDSDPEDVASPVEIPQSTTKPKKKTKSTIFSIDGSDHYENEETVHELNTIQNVDALAATSGKTSQLETKSKLAATSLSNSSELFLIEIPKTPIESLPSLSNANNAIADCNKSENEEVKVYNKELLQNLLGLDVDIDL

SEQ ID NO: 18854 - protein, 198 aa, Candida albicans
  UNSURE (190): Identity of amino acid sequences at the above locations are unknown.
TLEVVMTRMKRICIGLRILAISATVANAIDISKWIGLYDESTLPAETLCFGEKFRPVKLSKIVYGYKPTSDNDFQFDIFLNSKLIEVINRHSNGKSVLIFCSTRNSCQNTAKYLFNNLSETTRTDIKLKDRDAMNYATKGIAYHHAGLTFGDRKLIEIAFLNSRLKILCSTSTLAVGINLPAYLVILRQXAWKIRECV

SEQ ID NO: 18855 - protein, 463 aa, Candida albicans
PSDILRRGGDLFKTTAPTTTTTTTNTGATSVHPILQVDAIKYIYIFRNQLTKEQLMMTLPRLIDHLDIKSNPVVYTYSAITIEKLLSMTNFNQDHTPIFNKTDIQPYINELLTNLFNLICINNNNNNNNNNNNSSPEKLAENEFLIKCIMRILNTGEDSLNENNRFPIINQLLTILKLTAKNPSNPKFSHYIFESLGLLIKYGINDNDNDNNAANQYIEIIIPALLDILSEDVQEFVPYTFQILAFLLEKYPKQQGLPETYKNLIQPLLSPLVWQFRGNIPGITRLLIAILEHDPNSTFINGGEKTLTPLLGVFQNLLASKINDGYGFDLIQSIMLNIPIQPSLQSFLPNIARLMLTRLQKSRTDKYVKRFVTFLCLLSTISLQGTTTTTNVNKEYLNGEFVIQFLESVQSGLFQQILTSFILPTSSILTNLQHKKLVNIGLSQILVTISTTSEQYAHLTLLI

SEQ ID NO: 18856 - protein, 64 aa, Candida albicans
KSIENEPGFSINLLHVIASTNLSQSIRLAGALYLKNLIKRKWLDGDGDGNNYLLPIDDVNKIKL

SEQ ID NO: 18857 - protein, 301 aa, Candida albicans
  UNSURE (221),(244): Identity of amino acid sequences at the above locations are unknown.
NLVTEFSLTNFINNKAILLVSHLIFKKWRALFRSDELFLEIKLVLTKFVDPFLKLFIELDQLIDKSLDNEAQLIIYFENLLLLVQIYYDFNCQDIPEFFEDHMNELMAIIHKYLVYENGLLKYHDNDEEVNVLIKVKTSIVELLSLYITRYADVFQPLIQTFITSVWELINNYVTKQPKYDLLVVKSLQFLTSIIKIPDYQSLFQQESSINEIIEKIILPXILFRENDEETFEDDPILYVRSDXERSDYDSRRSSATDFFRELKESIVNYKHHSEDICYQFLNPSTYHSDWRNQVSATFLL

SEQ ID NO: 18858 - protein, 213 aa, Candida albicans
HRILHRRIARGKLEENLKIARTRKPYLHESRHKHAMRRHRGQGGRFFTAAEIAELEKAKQQQQLQQLQQQQQNEQSNQENNNENGNEIKKENQHVDDNNEIKNGDNNINKENIIENNKEEIDPNNVIIKKENNNNEVNHEMNNIENEQSSNEDFNQNNNNNINNNNTTISNNDNENGNTISSSKSNELQESIKNDNNNNNNNNGNDLQEEEER

SEQ ID NO: 18859 - protein, 279 aa, Candida albicans
TEMTSLEDPNGQAQATYFQESVSTTGNSTPTVTQSNDPQHHHHHQQQQQHHHHHHVGSYYQDSPSSTYTYEVEGDYLENHPNVTSTSAEQGTGTMPTYVDNDNIHGGVDVGMGVETEEEDDDDTNGASIGNGSGSGGEQPFYVNAKQYHRILKRRIARAKLEENLKIARTRKPYLHESRHKHAMRRPRGQGGRFLTAAEIAELEKAKQQQQQNEQSNQENNNENENGNGNEIKKENQHVDDSNKIKNGDNNINKENIIENNKEEIDPNNVIIKKENYPF

SEQ ID NO: 18860 - protein, 535 aa, Candida albicans
  UNSURE (519),(535): Identity of amino acid sequences at the above locations are unknown.
THYNQFSDDLIEDEFNELNEGIVETEMGSLQRNIIPDQGFGNDPTNTTSSSDSTGTYNYSSTLNDDMEIDAPFPHDDDDDNDSDGVNKVFPQSRSRTPTPDLTKVDFTKIISQAPPGYDGDTNMNGSGSVPPPTQMMSAASVARNAHSPLPNSDHHQKNLQQQRQPQQQQQLQLLFPDNSCGNTHAYPQQHGRPTKILKTNQQLQQFLIPIEIKWVNTTKEAIHKIAIIGSFSNWRDVIKMYPSTSHPNEFVTTINLPLGVHKLLYIINNEYRVSDQLPTATDQEGIFFNWFEVIDDTHLFNHSLNQPNHIGASTDYDANIIRYDNTTTTTSEMSTTTTATTTTTPKYVQPQTWAPRPAGKSDVDKINQKETDLLYKMSKEASGEFEHVEFIEDTDATGNGNGATAGTAGQSQDSSTPQGHNNHEAINSVDEIAFDNNPYQNYELSTSSSSFLQTTGQIIENPVEYSSEIPEMFINYDYFKMKPADYELPEPPQLPPHLNNVLLSKMTSSSSSGSGSGXGYSSTSHGSGSMTQHX

SEQ ID NO: 18861 - protein, 393 aa, Candida albicans
LAKNIPQALIIVGAPYDKNIYKKSTVLQNGLLGYEFIHTAIYITDKKCIFITSEEKSKHLKHLTNQKHDLVELWIRTKDVEHNKQLFIKLLETMTKLDSKYGKILKDKYDGKFIDEWNQILNDDNNNNNNNTTNDHALSAVDLAVTVSQALAVKDSEEFNNTKIASNASVVMMDTFVNDMMIIVDDEKKITNSQLTDQIEDKIENNKWYLKTKLGKNLLQSIKDFDPEYLEYCYSPIIQSGGDYDLKPSAVSTDKPLIGEGVILSSIGLRYKSYCSNIARTFLIDPTSEMETNYDFLLQLQKYIVDNLLKDGVPANKVYQDTIDYIKKERPDLVNHFTKNCGWLLGMEFRDLTFILNAKTTDRKLTTGQIISLTIGFNNLSNDKNDNNDKNDY

SEQ ID NO: 18862 - protein, 449 aa, Candida albicans
LLDSIIYQMIKMITMIRMIIRLIIQKINQLMALLLTDTIKITDDSSILLTNYSKDRTAIIFSCNDDNETQKENNNNNNKRPGLSQTSNTTGLKLESTENTAILKSKLRHENTNADDANSEKLRQEIQIKLHEKRLQEGLARFSKADATDADDFKPIFKKYESYVRESQIPNSVNDLKIHIDYKNQTIILPISGRPVPFHINSYKSGSQNEEGDFTYLRLNFNSPGAGGNVTKKQELPYEDSPDNSFLRSITIRSRDRQRMVDVYKAIQDLKKDSVKREQEKKQMADVITQANLIELKGSRVKKLNNVFIRPTPDTKKIGGVLQIHENGLRYQSQPQSQSNFKNDQRVDVLFSNIKHLFFQPCKDELIVLIHCHLKNPIMIGKRKTFDVQFYREASDMAFDETGGRKRKYRYGDEDELQQEQEERRRKALLDKEFKGFAELIADSSSWYG

SEQ ID NO: 18863 - protein, 96 aa, Candida albicans
LLILLHGMVDLDIPFRELGFQGVPFRSSVLCVPTRDCLVQLIDPPYLVVTLEEIEIAHLERVQFGLKNFDLVFVFKDFNKPVVHIKTIPRGITRSR

SEQ ID NO: 18864 - protein, 77 aa, Candida albicans
  UNSURE (14): Identity of amino acid sequences at the above locations are unknown.
PPPPRIGSSRPVVXYNTIPVELLQDVKSWLTDVDIPISEGQMNLNWVQIMKTVLADPYQFFIDGGWAFLTGQGESDE

SEQ ID NO: 18865 - protein, 545 aa, Candida albicans
IEMIYELRDFIPFIEFILNQDNKILDTPIYGELWIIGPLIQKSSNLRFTSTKDFLDYIIQFNIISGYLLEFSKDLNNNIDIKHLPKLISINFKGVLMLQSRLKGKQTFSQISNSKNHKLPTNLLQILEMLSKRDILPYTSTNSSLSSDLSFDVEFLQELINKPTARTILNKQKALLKTPEKPFHSICSDHNHINLLATVGLNKKEYSHFGSKQTIPVDVIHQRILKCRNILSNDVYKCVQERIHFLPIINNHTDLNLGDCSYLDTCHKLKSCRYLHYYTLTPMKKELSHSSKEEQQQRQIKLKGLEYTIGDCFSESFREPLPPQWINCDVRCLPFSILGKFAAIISDPAWDIHMSLPYGTCKDDELLSLPMHELQDEGIIMLWVTGRSIEIGRRALLKWGYQIYDEMIWIKLNQLRRTIVTGRTGHWLNHSKEHLLVGLKGNPIWINKRIDTDVVASPTRETSRKPDEFYDIVERLVGTHSRKLEIFGRDHNTRPGWLTIGNQLQGVSLFEPELKYKYELYKQTTTGTTATTSISMSTSGSGGKY

SEQ ID NO: 18866 - protein, 340 aa, Candida albicans
IVGPSTPVVKTSNTSGGGLFGGGQQQQQTNQTANTSGSGLFGAKPANTNTTSGGGLFGGQNNTANTTSTGGGLFGNKPSGGGLFGQQQNTANTANTGVGGGLFGSGTTTNTSGGAGGLFGNKPTTTTTTIGGGLFGGGQQQQQQQQQQIQTPQLTGMTRVGDLPPNIKNELEQFDKYINTQHVIATTLNSDMSKHNNLINTIPKDINYLQNKVLSTKQALKFDINQLINLKNMNNEITEDINKIMQLILQLSTPGTKLSSSFQLNEFFIKKIKKYYQMLTQYESMIKELEMILTGLEKSCTEGFGNLFGIVQVIKSQYSLFMELTETMAQLHSEVNRLTK

SEQ ID NO: 18867 - protein, 175 aa, Candida albicans
TIYCEEDFSEVHLLHANTGSTTFGSNQGTTGGLFGNKQPNTSGGLFGNTQQQQTQQPQQQQQQSSGLFSSNTTNNAQPSFSWSQPPQSSNSTSTNGNTNQISNLTSGPFGSNTNQQLNNNTYTYTPSINDQLTKIWEQWDPNSSKCALNTYIYNKFSDQEINVLLNQPRPANESS

SEQ ID NO: 18868 - protein, 403 aa, Candida albicans
SAGPSSPVVKTLTMIKPKGRPVTQCQHCRENRKSKNLHVTCSCGKKGKNGSHLPSCACHKTNHCTCSTNMTKKTTTKGDIHHMTASEKAKKKSLIDAANAGLKKRSDSVSTTQSAASSSASPSSAASPNKKLSVPPPGPTNSQQKKQQLTLPNQSRQTTQPAYNNLLDQNFVIEDIVFPFNTDNGLFDMFSSNATSEVGGAGSGTRDSQIATSNLASDNSTPFNSNYDTGISYSNKDVGLPLSPNETEADPMFPLFPLVGTQSFDRENQPLLALSNEKEPPQPQQPTPVRPSHNVSTAMNNISSNSYSSIPSAVEVSSINHQQSRPKRPESVLSIASNSSTRSFDFFGNNHTNYNSSFMNGSLPTSFTSAAFPPSNGFDENSLSNLNPDDHNNMQHHFGKNKV

SEQ ID NO: 18869 - protein, 271 aa, Candida albicans
LRSFQPRWCKNGGSASRNREIQTWFSGKFLILERFLQKINKETDDKIVLISNYTQTLDLIEKMCRYKKYGVLRLDGTMNINKRQKLVDKFNDPNGPEFIFLLSSKAGGCGINLIGANRLVLMDPDWNPALDQQALARVWRDGQKKDCFIYRFISTGTIEEKIFQRQSMKMSLSSCVVDEKEDVERLFSVANLRQLFKFQPDTQCDTHDTFNCNRCKGDKGQFIKAPAMLYGDATTWNHLNHQALANNEDILITNEAQHNDVTLHFSIYLIK

SEQ ID NO: 18870 - protein, 418 aa, Candida albicans
QYFPFFMAVRKPLTQFTTPLCSGAGVPKDKRPPRVTDSATRLSKPFKVPFASSTHNSVSSETITISRRPVRSTRKRTNYAVDGITLEKDDEEEYNNDQNVNGDGQIIKRKKFGALLPRSIINSDNIAKNEDKFKRSFTVPFDKNNSKQTEIQRGPPPPLGTKVRAILPPRALHDPTSEFAIVLYDPTVDKIPKISEVESSTSSSTSPEPEPETKETEERPIKRKRTHKSLAEILGIVTNPEEKLSKYPDVPVVIDPKLAKILRPHQIAGVKFLYRCTAGLIDARAKGCIMADEMGLGKTLQCLTLMWTLLRQSPRGKRTIEKCIIVCPSSLVRNWANEIVKWLGEGALTPLAVDGKSTKNSELGTALQQWSTAQGRNIVRPVLIISYETLRRNVDKLAGTEVGLMLADSSPRGSKEPR

SEQ ID NO: 18871 - protein, 125 aa, Candida albicans
SAGGAGTSVVKTVNYAGADGEVEDNSVKPWTNEERLALATRDANKFPVFKVKDKETTFKQRFRIPLINKSSNDYNPSRPAPTLGMRQGATFVVKPLHDPSGEFAIVLYDPTVDDIGEAPESMPED

SEQ ID NO: 18872 - protein, 254 aa, Candida albicans
KMTDIAPPSAATPNDYILSLSPEQIEHDQKIGIKAIRLFLQSKTSYDVLPVSYRLIVLDTSLLVKKSLNILLQNNIVSAPLWNNQTSRFAGLLTSSDFINVIQYYLQFPEKFELVDQLTLGGLREIEKAIGVDQIETASIHPFKSLYEACVKMLESKARRIPLIDEDEKTKREIVVSVLTQYRILKFVALNCKETKMLLKPLKNLSGLGDVKKLSTCTMDTPVIEVIHLLTENSVSSIPIVDGQSSPRPSKIQE

SEQ ID NO: 18873 - protein, 302 aa, Candida albicans
TTYSMDAKPPTSHSLWSPYDTVRDAADSLGVTISDETAKSLAMDVEYHIHEIIETAVKFMRHSKRRQLTTSDVSNALKILNIEPLYGYDNTQPLNYKETMVGAGGQTLYYIDEHEIEFEKLINQQLPKVPRQVNFTAHWLAIEGVQPMVPQNPLPSEIKSLPAAVRGATTSMLGNDILSLGSKNENGESNDSTKHESELLSNGGSSSHTNNSNSNKKSTEKDMEIKPLIKHVLSKELKLYFDKVVDVLISTDPEKEHLKNAALTSLKSDPGLHQLVPYFIQFIAEQITNQFLHHRGAISAYN

SEQ ID NO: 18874 - protein, 175 aa, Candida albicans
DFGRLRGRISSVEFAAILLQHIIKVYGSSYSTLRPRITRTLLRALLDSTKPVGTQYGALLGLKNMGNEVLKLVLLGNLKVWYLAIIEKNENDYERQILINALLDTLRKSKLEDKLLNQTKAQDSDDMDIDSNNEISDEVKTKLVERFGKSLADLLIEQEDGKQIIKGIFFGELSV

SEQ ID NO: 18875 - protein, 379 aa, Candida albicans
FYFRQSLFFFSDTASHFKRKCTKIKKKKHDIHMSIDSLIYPAMKPFITGHEELIHDIKYDFYGKHIATVSSDQHIKVFDLDSATSSWILNDLWKAHDSLIAKISCPHPEFSSSKIIASCSNDRTVNIWQEQPDEMHGSGRRWFKLATLATESYGPIYDVSFAPNHLGFKIGCVGSDGIFRIYESLEPNDLTAWVLTTEIAILNLLLPAKSLQSSFGVEWCPSKFTKTEKFIVVALDQGFVYGSVQKESSGEESASDKYVKICDLPEHNGLIRSVSWAPSMGRKYHLIATGCKDGFVRIFKATEQENGDLKIETLAKLNDHKLEVWRVSWNMTGTILSSAGDDGKLRLWKCSYLNEWKCMSVINTSNRSDSRGIETEKPI

SEQ ID NO: 18876 - protein, 153 aa, Candida albicans
DEIAASEHHTLALTEDGQVYAWGRYDMKEIGIPKDKLPKSTFKDQHGNPRSVPVPTKLEFAVKIKTIGVGSHHSFAVTEDGVVYAWGFAETYGPGLGPSIDDVEKPTRIVNTATKNEDILLIGAGGQFSVSGGVKFEDEEKAEVRLDKYEDLE

SEQ ID NO: 18877 - protein, 338 aa, Candida albicans
QMVALKREAEPRENGKSKKAKTSLATSSFVLHSYSKLPNINEYAKAKSTPLDVFVWGTGSMCELGLGPSAKNKEVKRPRLNPYLTEEKLGGTKIVDFAVGGMHTLALDGKNRIWSWGGNDSGVLGRDTSQAKEVLKDIDGKNGNDDDDDDDEDGDLNEAESTPALVENLPEGEIVQLAATDNLSAALLSNGDVYAWGCFRCNEGLLGFLRDEIKLQKTPLKIKELKNIVQLAAGKDHLLALDSKGIVYAWGNGQQYQLGRRILERHRYRSLEPQQFGLYNIKYIASGDFHCFAIDHSDNVYAWGLNQYGQCALTGDNGELEDGSVLMKPTLIPELSHK

SEQ ID NO: 18878 - protein, 404 aa, Candida albicans
SHQMLRPQLNQLVFQYHRWYLLQLVLLYLKGRREITQPETTPTSTPALTYRPSKIKESNFISRLFLPPLPPNMKDNLEKRKIISISAGREHIIALDNYNNIYTWDTGCQSNVGVMLEFPGISSNSSNFGRVMKISAGWNLSAALIDNYGLIVWYTRIGITEEQFHNREFISQAKYFIIPFTKNDVIDFTVGSNFVMFIRKSDEKLYQTRFNVHEIATRDDTSNITIDEIKQFTNPMDNFNHWKQQQSENNKENIRFTKVTGCFNDFSVFTNHDQVLLGNLHHLEYHDNGNDQGMKPIIIDELQGKNIKRIEIGDYHYLALTADGTLLSWGTESRFCGCLGLGSKQSILDQYTTPTNTEDSDEVKLRGNNLVVLKPLPVKPPPYKGKWVCIAASGWHSGGIYVPT

SEQ ID NO: 18879 - protein, 487 aa, Candida albicans
PKMTCLKEIYLVVPYNIYVFLVNNSDALKSLTKNPDFKTLLKLNDYENGWNCLHYIFFHKRLQCLKVLIDYLQGTIVQGNIFATNSPLLELLKFKDRNGHTPLNLLNNDFKDLLWFPEYITDKNEFHMTYKYERIKSTKDVVQPEYEPDTLPFLKSSEILWTDKRGASEIYVFGCNSNNQLGVGDSTDRATPALLYHDNFKFATDLTGSISERFKRPRYKRITISKNHSVVVTQDGELFSCGVGSRGRLGHGLTDLNNYFKFKRIEFFNDKTIKDVAISSNHSIALTTDNEVYAWGLNSFNQLGVPNMNNKKSTNYLDKFIATPIMVGGELRKMQNIIGIEVSKIHSLAWSKNYLCFWGLNVGQMGISYTNGDIEVKVQERSVRGETQVNPKAIQLRDDIKCVSTSELCTCVVTTLNDVHVYYNYQHFKLPKIPMKGHGDKHFDYFKPRSITEAAVIKKIVTRGPENSMILLKNGSIFFIFRLMQTI

SEQ ID NO: 18880 - protein, 313 aa, Candida albicans
RQQNNNLQAPSNQLTVNNNNPYSYSQVISNLQANTSNMPESITTSLFSGVGKESSDKKRRFSYLEKLETHKPKSSLLSKLGQTFKFIRNGNTSATFESLKGLFTSSDVLKPKEKRIMLSAAAAAAASSTPFVTPKAISRPSYKAVDARRVGSMKRLIIKSKPMKYHMIDVNKVFNTKRRKVIDNKVTADRLLTASYPSDDDSDDENNDDNEEVVSDKTFARYSYKTGNTFEESETKSTTRVVEKEPRTTRDEDKPTVELHDGYWSTPTIQQLSEMNVEQLSSLDNFIIGRVGCGQIAYDFPVDLSQIYFNAQQ

SEQ ID NO: 18881 - protein, 551 aa, Candida albicans
RGSKEELKKQKLNEKTKVVPGGWEYVIPTSDEPLNIKRRLVSDEISQQLIKYQQQHNKTEELSAQVSDITIDSDHESTTPKLVTYMDQLANFIPPGVDLNEIIDEKVYEPTISNEVVFDSIQIRPNLPTSEDWLLQLELANQLTSALAPYVTEPKKKLDKLNIERVDDILFSDFNKNVLKVSTPTKKKLSVVDDIDESQDIYIDNISTIFHKLLSKIVIGHRGNEFPKIDKTTGFEFKDIITSHQEREEKDVTILCSALFDNLTINEPNPAISAALVDNTRKKLLGDWLKNYNSATVEKLLAEYKNDPLETTFIYMCSGDMIKAIETAIQTNNSHLSVVITLSDSNDVVVKSIAQNQLTNWKQRQTILSIPSAVVKVYQILAGDFQPILETLPWNLGLALKLFYGNYNDIKKLINEFSSLIPIGNPVGDVLHAYVNGIDLESVTSSSLNIKLKWLFCKVLADFNYDTITKEFGDYILSIDYWKESIVVFAHLTNDNDIGDAITKLINSKILHIKSLTIDKEQYAIEVLKIPRMVIYKSFAIQKSQNGDFVG

SEQ ID NO: 18882 - protein, 397 aa, Candida albicans
LIDYIPIPFTLKMSSKEKPSKEDIRGQLSDIQKRLFSKKPSSGDTSGATTSASTNSNHRPVLKESNHHPQGKSSLLSGGVGSHEQERFADFLPPLPKGSGNASASLGPPAPTSNSLKRVPPLHSSRLGPESKGNDMNFVVGLSENLLTECRRLNAENSKYREKLKSALDEVQNYKDEVFKLKDFNKSHNSNEQALKDKNWELESKVIKLDDELSVLKKSHEKTIHENSELANQISNLNKINDKLEISNQSLTKSLHDTKQSYQSEILALNARIENLNDENDQLHLRLAGEDTTNSSRVETSKEATLPSMDETTESDDDTTEFDSILKELQPCDMPESNPSNPQLEIDTLRCTLQHSNRTIAKLRSSMLKLRKFDQQQTNLSNLQRTPMFSPHGQDPT

SEQ ID NO: 18883 - protein, 640 aa, Candida albicans
QLTMSTGSSPFVDHKSNNSTISINNNSSILNESSISKAYVSKLEFQLDTIKTENRILQQEKDQITSDYRKIIDEKNQELENLKLNFKYVYDEKNQLESKLTNQEQVSTNNINQLSDEIQTYKRENLKLTKDYNSLLDKFNKLNRKNQQIMHDLNKEIEVNDKLHQELKIKEKTNQELQKASDTAINELEQYSKILDKKNGSDNLLYKNLTTKSNNLQNINHQLQNKIDQLLQNKTSNELLKQQNQSLLHKLQNLENIESKYLQLEIEKLQLETKYNDLFKALDTAIASSNEYKDNENTDDTIHTSKVKSFIEYCNNLQAKNLTLQEKYDSKIIQVKELTKELEDHAREIETDFLPTITDLESKLKVYADQNTKLERTKSLREKEITFLRNLLKQMEQIHANQQHKQQEQEKEENTENKSILQYMTNLEKLVDEYKTKIDELEKKNLEYNKSSIITNEKTPSNKRQRLESNYTFKTQAIELEKENIEISSKLKQAESTIEQLKFKISELDKVETRKEQYRILQLKNNLISQDQFIKQTTLIALRKENEELINKYIKNLPIEEQIPKGVFQRQEDDKQRLQAQIDHLTKRSTRLREVFTKKSKDIITVIAKYFGFIIEFLPNPINPTDLFSRIKLRSRYIPT

SEQ ID NO: 18884 - protein, 319 aa, Candida albicans
DADFHSVGQSAVYGGVSKDDQIRKLKTANVVVATPGRLVDLINDGAINLGKVNYLVLDEADRMLEKGFEEDIKTIISNTSNSERQTLMFTATWPKEVRELANNFMNSPVKVTVGDRDELSANKRITQVVEVINKFDKEKKLIQLLRKYNANESSDNKILIFALYKKEASRIENFLKRNRFSVAAIHGDLSQQQRTAALSAFKSGQSNLLLATDVAARGLDIPNVKVVINLTFPLTIEDYVHRIGRTGRAGAKGTAHTLFTEDEKHLSGALCNILRGANQPVPEELLKFGGHTKKKAHSVYGAFYKDVDMTKTAKKIKFD

SEQ ID NO: 18885 - protein, 304 aa, Candida albicans
MTDRVTHRVSLDDLNLEKQKFDSKDDIKPWLQDNLQSTKGINVVIERSDTSKIIFKCKNKEKKTKIVESKKTASKTMIRKHTSCPFKIRANYSVRNKVWTLLIVSDEHDHVVDLPRLFVGKNLISNTIPGSSLNVLDSVAPRLNKKGIKPTSEIANTPLVTSYSPSCAVKRNEDVDAPKISSKKARNLTKKPSTQSTRSSLSSDGSSIVSFGSLTSQSSLTSLPENYKGQVPTSMDLMVVEESLTGKSLKPAASHPVKRKNMKANTMKKSKKLKQNPIVVSPIEEDLNLNSFDDANIDLQRQQS

SEQ ID NO: 18886 - protein, 136 aa, Candida albicans
SDTPFEDGTFRLLLLFDEQYPNKPPQVKFISEMFHPNVYASGELCLDILQNRWSPTYDVSSILTSVQSLLNDPNISSPANVEAANLYKDHRSLYVKRVRETVENSWNDDDDEEEEEEDEDEAEDEDDDDDDNIDED

SEQ ID NO: 18887 - protein, 373 aa, Candida albicans
NNISLFFFVFFFLSFKKLFVFFFIHHLDYYNIIPLKMPPPLNSNILYVGNIPYDWDESTVESVVCGSGNIVDVRLGFDHVGKNKGFCFVEYKTVQDAQRALPLLQQVVIYQNGRNKKLRVELSKEGYKAQKIKPDTRTIMQLNRSRLPANVRLPNEMIANIPYVSQVPVLPSSGFRSGNMPFPIPQMPLPPPAPPIVVGGPIQQIPSRLLQASKFLPFAPNFKLETANNINVLLSKIPPPQFIELLSQMKSLLQTDPTMVRNFFQSQPEISLSVAQALLLMGFIDNGVIEESLKSISSTPQVQTVQPGIQSTFYMGGQIGGYNNNMYINNGQNFQPQQQQQAIPGSNWPYLPPHVQQKLVNMPPDQAHLAAQI

SEQ ID NO: 18888 - protein, 278 aa, Candida albicans
KKMYRNWLYFGRDSIDNLLNNYSFLLPRIRKTRQLKLNMDSKSTCVSIGKFPFDYTEEQVRDIARSVGPVLDVKLLFDELTGKSKGYAIINYGDNETASSAVRNLNYMTLPNGRFLKCSFVTDYDMSSKESVKLPPLPLGIQIHPNQNASQVISTILSNIDSNSALQILKEIKVMSIDNPKSTKVLLERFPQLSLALVELGLLSNTTNQELIELTLNKRPVDLTELSLDHVRLLQSVEKLTDEEIDELDESQQEIVRKVKEEIAKGTYGEVLAVKDNA

SEQ ID NO: 18889 - protein, 312 aa, Candida albicans
YLSYPFIMDTKEIRSTVSNLEKAVDDTTILKLLNILNDGVKPSEKLLRETKVGVAVNKFRSHDSAEINGLVKKMIRNWRDAVQAEKNNKKKLAIAAGTGTGTPSSSAISPSSSGSGSTTPKPSESTTPSAARKGPRNPKTDGVNTQLYENDTRNASVSALYTSLAVDRDDSPKHILRIAIEIEAEVYKSEYLKVSDSYRNRLRSFTMNLRNKKNPELRERILSKQILPAAFIKMTPNEMAPEALKKEIEKLHKQNLFDAQGATEKRAVTDRFTCGKCKHKKVSYYQMQTRSADEPLTTFCTCENCGNRWKFS

SEQ ID NO: 18890 - protein, 251 aa, Candida albicans
  UNSURE (132): Identity of amino acid sequences at the above locations are unknown.
IYLFYFCLFHFHFHYTKLDLLIKLINVAMSMSTPMPTPTSLDTKKMPPKEKKNKDDRPYKCTFCDKAFHRLEHQTRHIRTHTGEKPHACTFPGCVKRFSRSDELTRHLRIHTNPSSRKRKNKNQNMMINPNXTTATTTGPAGMAIPTSNLPPGSYAIPNTAIPFSIDRNGNHVYHQPYPVYFVPHANGYMQPMVQTQGVTVVPNTDQQQHQQQQQYHQQQQQYQFQERPQHQQQQQTNIGYSARGCQNRGQ

SEQ ID NO: 18891 - protein, 508 aa, Candida albicans
TCLFKLINVAMFMSTLMPTPISLDTKKMPPEEKKNKDDRPYKCTFCDKAFHRLEHQTRHIRTHTGEKPHACTFPGCVKRFSRSDELTRHLRIHTNPSSRKRKNKNQNMMINPNATTATTTGPAGMAIPTSNLPPGSYAIPNTAIPFSIDRNGNHVYHQPYPVYFVPHANGYMQPMVQTQGVTVVPNTDQQQQQYYQQQQQQYQFQERPQHQQQQQTNIGTNNHLQQNGSAVFSLPSSPTMASAQTPNSGTSSSSESIKLAPLSIPNNISRSQQQQQQQQQQQIPKSESSTSLYSDGNKLFSRPNSTLHSLGSSPENNNALGPLSGVPTPSFSNLNDYFQQKSNSNNSRLFNASSSSLSSLSGKIRSSSSTNLAGLQRLTPLTSTTNNTNNTTTSNTTNNNMTKPSIIPKQPSSTSLNLEFYNGNNQQQQNYHTHKKSRPNSPSQTPIHLSSARKSANNLFIISPNETPLQTPLQFTRLKTYQDQPATNVHIKVSAPSEYIMEMLLLKK

SEQ ID NO: 18892 - protein, 176 aa, Candida albicans
KNKKGSYISHPSSSFFFFFFGFLIANFFFFLFSPYKKKFFLSPRKTSFPKTITIPLLMSIVDQQKPKKDPTVRPYKCPHCDKAFQRLEHQTRHIRTHTGEKPHQCTFPGCSKRFSRSDELTRHLRIHTNPNSRKIRNKKNEETPVAIIISFLHRRRTPQFPPLPPKTHSTPSYKIF

SEQ ID NO: 18893 - protein, 302 aa, Candida albicans
HSFAVISTTMPSDPEEDYIPWIQQFCELFGHDYFVQVSQDFIEDDFNLTGLSLQVPYYREALYTILDYQVETAEDHNTDNTTTNTSNNNDSRNGTSKRNASELPNKALLAHSAELLYGLIHARYIVSKQGLTAMASKFERNDFGSCPRYFCDGMHLIPVGSTDVPGQETVRLFCPCCNDIYIPSSSRYLNIDGAFFGTTFPGLLVKMFPEIENQCRIRITKFSQNDFGLKLFGFKINELSATGPRMKWLRMHPKTEDEKQEYDSCEYNVPISYLDEDEEMEEDDEEEDEVEEEDDDRTMASE

SEQ ID NO: 18894 - protein, 232 aa, Candida albicans
YIFFLPTSSILIFILGIVATMDVDLDKRTKVSRACDYCKKRKFKCSGVSPCELCTKKGIQCEFNIVDRRTIRRKNKKRTIRNKPATATSSTTSKIKKDENQIDKTTLKMLTRNSKVPVQLQPLLSFPLHKLDNKQNEEEKHTQQSPPAADDTPDDERKDKDRKIDKKTHPDPPKNERAPPKVLYDSEGNLRYVGESSPLSFLFECRNIFLDRIGESDFTSDLHQAAGRTRAW

SEQ ID NO: 18895 - protein, 188 aa, Candida albicans
LKSFSYILPYPLHIYSQIFQMDADLEKRTKVSRACDYCKKRKFKCSGVSPCELCTKKNIQCEFSIIDRRTIRRKNKKRTIRNKPITNTVIGSHKISKNDDDNDQIDKQTLKLWTKKSKVPEQLQPLLTFPLHKLDNKLNEEEEEQRETMITIGARKESTNTTTNHSLLGLVQSRIIVRKWTFRETRAT

SEQ ID NO: 18896 - protein, 303 aa, Candida albicans
ILTIPTVSISKITWWCHNHSLLHVEQQEVGIFFFLIDIPGATKKKNSQNQSSFSLCTAPIMSSIKTSPTKKTSESTTKQDTPNDQTNIENFDEEPSMLSDPEDYLEENETLDMNLSKGDQKVWLVKLPKYLMDDWSNPDSMNGQQLGNVKIKKDARGKLQVKLLLDNKNDRIPKEYDIKMLNTQVRNSYVFTEENLKKFKQEVTEVSDMPEQPQLKELNPEKKKFQVRRKFKYFRVQKEGENGQPVKKYIPFVKTIPKKTSLMGKVCHDCTVVPARTGLKHGESLMKHQNMTQVVTTGWKIRV

SEQ ID NO: 18897 - protein, 227 aa, Candida albicans
LFLVAMDFSNLLSNEINKKRKKVAANGRKRSKVSTTAKEPAVVVEHAPETINPQPTTTNDEPSEEQLDTKLSQFGELDTSLSKSEKARKLQLLLQQQIKNTKYKAWLDQEAPLYQDPEKQLITLDLITDITNKQDEVYLKLRVYIKQLIKQWQECDNDDQELLMETKKSIVKLLYKLRSHKLSMDMLISLLTIGYYIQPNEFNKGKRKLHETKYRQRLWANWGGQCK

SEQ ID NO: 18898 - protein, 405 aa, Candida albicans
TNHGRAGLKPNYMQDVCLNDSCSLGSPVNSIENSGCTTTKTTPIISPMSLNDYVLPPPNHHDFDTFMGNNFVDYTSSYNPEHTLPSPLSPLTMVCNDGRRHDDHMNFASTFSVHPASSKCAIQHYGNSNQELTKGYPNPNSLVYNTTNNCINNNSNSNNNKYSLHEYKDTRMMEMATPESPHKRNLLPNTRVPIIPTSPTFPIALNLIHSNANTKRHKSLGSATSMLQPPLEDSRLMNSGHAEPMKKRLLSRFSSRLIQKLRLAESDMKCRKHCNTRFGNYLELIDHFEGHGLQRYLLSRTFICPVKECPMNMIGFDKRAELRHHVHSDHVTHGLVSIQYAKYSEEIKEFLFVCDEENCGKGFYRSDTLTRHIKLVHKREKHFTKRKRRQVVAHQEDKAIKKSKG

SEQ ID NO: 18899 - protein, 116 aa, Candida albicans
FIITMSSRSERACMLCGIIQPMKSFIDYGCPNCESLLHYQYNDNKQVQDCTSPSFEGLVALGEDNKGSWVARWLRIDSFTAGLYAVKVNGKLPPSIIAELEEQNVIYRPRDGSAED

SEQ ID NO: 18900 - protein, 121 aa, Candida albicans
YTHHNMKLVRFLMNIPNSTNQPITVELKNGNIISGTLLSCNPLMNLHLKNVRLQQPLQDPILLQYINIRGNQVRQILLPDELNIESVLAKSETKIKGSGAGPGAKAVARGGFRGRGKGRAV

SEQ ID NO: 18901 - protein, 314 aa, Candida albicans
LSTELSTIINNEIERFHTLIKLKYNLIFPELESLIINKIDYIKLIKIFKQDLSNIKSYESQMKLIIDNEKVLVIIMAALQQQVSTNTNSTISLLSNQIINKILIVIDIIEQLNDLLQLLSKFISDKLAKFAPNVSAIVGPITTSQLLIATGSLKNLALTPSCNIASLGIRDLSTKKKTTTPRNSNSKNVRQTGYIYHSELVKYIPIDIIRSVMRIISGKIVLAARIDLSKSNPNGELGETYKQEILTKIDKLLTPPQQSIDKSLPKPIEMKSKKRAGRKYQKLRAKFEMSELRKAQNKLQFGKQEDTIMNGLCE

SEQ ID NO: 18902 - protein, 668 aa, Candida albicans
TRVFCPWWSHLLVECLKNLKYGLNYNSSEFDLFELNIIKQVLLYIKYNGMIDELIDIIEILLAKSIKDEQFENFLKFEYCRALLSQTNNNPTNDVKFSQIFLDLKKRSQNWKSFDDIIQLSLLQLQYCIYVKNSIKAKDRFNGILQTLLKKPQFNISKSKNLPIVSKLQNFLILGKFQLLACHVNNHIIHNKIEAFNNIKTGIQLLYSIVKKLPTNINKTLWQELNWEITRLLFDSYKLAIDLSIDIGISRDIPLFLNEWVKLNNSIDNDVPIVNCINEFEIGRYGLLSNNEFQKYIRIAQGRLGYSLVKNNSAVQQYINRDRDDEICGHASSSRQLKSLVRTIFNSDNSLSELLKSVQLLPCIIGDSSTMCSKELLDKLVQLKNEILTEVTNYEKSSSLSLNQQQQLINNLNQVVCLLSSLTLFKGDGLLSEIYYLQDYVRNLPFANERKLMDSSKQDESNNLLPHALDFNQVVEDPSNNTINNSMIDFNVDLQLYLPHNWILVTLDICQNTGDLLISKLTKGSPNPFFMRLPLLRFPSSLGFQQLMQNFEKIIDDSNLSTKRKTTSKILTVEDRKQWWRSRFTLDFQLQDILHHVESKWFGGFISGIFTNDNDVENESKNVFHKFKQDLMKILKDCLTVSDDKSNIERSLQFNEFIYYCFYSMEGI

SEQ ID NO: 18903 - protein, 244 aa, Candida albicans
  UNSURE (5): Identity of amino acid sequences at the above locations are unknown.
HELIXNLIDKVNENKQNVTSDNNNNNNNNNNNNNNNNNNSNSNNSQHIVLIPNANCSNFPWESMEFLRSKSISRMPSIHMLLDLVKSNTNNKNKLMFVDKSNLYYLINPSGDLIRSENRFKKLFESNHLWRGEIGKLSSNEHEDYQDSILCEILKSHLFVYIGHGGCDQYIKVSKLFKKCGNNQDSLNKLPPSLLLGCSSVKLDNCNYNYNSSMLQPLGNIYNWLNCKSSMILGNLCTWPTGAG

SEQ ID NO: 18904 - protein, 250 aa, Candida albicans
SNYVCGIQVGKKKIFSWAPEVETYSLLMVPNVDITELPAHDCWEALKLKETTSPIKIESKQDVSQDLDDDDDDDSLPPQTDVADPIYVKQLIEYFSVDTSNQNAYEMRRKALLKGPTLLHQKYRYGTEVHFYLEELLALLIGLDNHFDDKDFNELKLNNMVAVIVTNPSITTFMFNLLLTGDYSLQQRVLILSATLMAARQLRGFSPTNFPSQTLPEPLHRKYLELEGGSKYIDFIENEVQKELLADASS

SEQ ID NO: 18905 - protein, 194 aa, Candida albicans
PTHQAEAQTQLLGFAKVVRVSSRLKRPAKSTETPTAGFYTIIGKLFYFPLLNVWYEAGTIDIGHYSPVYIGHYIKTLALLIHCAYPLSIQLNDMVKEFLILSCNILRKISLEATPVVESIVTGVLIVCEVSNPEFLVTNHNDEIVFIQNWLSVSWELLVDDKLKSVAAGLLLRLQKLESSLERTIMDQSNSIIT

SEQ ID NO: 18906 - protein, 298 aa, Candida albicans
AWEVNQIEQYYMRCITTWNSDKQGDDEKVEKGFDILEPFINKESNIVVRKLFTEEDSVERVWTLQVSDIPVAGKNQGCCQQQIYESTLVHTHTAIEIKVGNGDPIDIDTNNDKQGDNNTDKPKQEHDGKLPEAIDEDIIKNGDEKKTTHDDNDSDIMEIDEPNPETQTLPQSLSNGVSQRTTRKDSFLIFLSDLGYEVINQYWQKGVRFFYGDIIIEIYKIFIRDESSQADSNEGIKLKLLDDSNQFQIKAYININKSTEIDSINLGVKELIKLQEFLKNLFVLEIPDRMFMDSRIKQ

SEQ ID NO: 18907 - protein, 373 aa, Candida albicans
  UNSURE (361),(367): Identity of amino acid sequences at the above locations are unknown.
LVKEVVESALVDLVNAVGVDINESVRDSRLAQTLKYVGGLGPRKASGMLRNIAQKLGSVLTTRSQLIEYELTTRTIFINCSAALKISLNKSINVKDFEIEILDTTRIHPEDNQLAMKMVADALDMDEESELHEKGGVIKELLENDPSKLNLLNLNDFANQIYKLTHKLKFRSLQAIRLELIQGFAEIRSPFRILTNEDAFFILTGEKPQMLKNTVIPATITKVTKNHHDPYARIRGLKVVTPSLIQGTIDENAIPRDAEYVQGQVVQAVVLELYTDTFAAVLSLRREDISRAMKGGVVREYGKWDYKAEDEDIKREKAKENAKLAKTRNIQHPFYRNFNYKQAEEYLAPQNVGDYVIRPSXEGASYXTITWKV

SEQ ID NO: 18908 - protein, 174 aa, Candida albicans
  UNSURE (10): Identity of amino acid sequences at the above locations are unknown.
ILGSLTAVVXTSDGFSDISEKWNQERQAVLRTAISRLCAVVALNTKDDLRRECERLIASKVRHGLLAKIEQAPFTPYGFDIGSKANVLALTFGKGDYDSAVVGVYIKHDGKVSRFFKSTENPSRNRETEDAFKGQLKQFFDEDETPDVVVVSGYNANTKRLHDVVYNFVSEYGI

SEQ ID NO: 18909 - protein, 201 aa, Candida albicans
KVNSFKDVAQSIETQLDYVVKSRVILNNINQNLDNLSSQHDLENTTRIMKAKSRHTKLSRRLLRLATIGPIVKLKGYPLLPEEEEISKQFELLTSKLNDPNSSIGKLSDVFATLAILKERAEEFNYQCENSVNLLNNTLIEGEESTSKKGSVTTAAEQSDSIIEEAIHKLSKVLLKQQMGLNYLNDILEKDIEAVNKISKK

SEQ ID NO: 18910 - protein, 402 aa, Candida albicans
SNMAKASKVDKKLSKKKEEKPAKKVEEESSSEESSSDDSSSEESSSDDDSSDDSSSSSSDEGSDSDSSDEEEVEKKESSSDESDDEDKKEESSSGSDEEEKKEEKSSSSDSEDSSSSDSSSSESDSDSDSDSDSDSEEEPCKKRKAEESKEEESAPVKKSKPAASTEEPATLFVGRLSWNIDDAWLKREFEHIGGVIGARVIMERATGKSRGYGYVDFESKSAAEKALEEMQGKEIDGRPINLDMSTGKPHASKSNNDRAKQYGDSQSPPSDTLFIGNLSFNANRDNLFNVFGEYGNVISCRVPTHPDTQQPKGFGYVQFSSVDEAKAALEAMNGEYIEGRPCRLDFSTPRDNTNNNNNNNRRGGFGGGFGGRERSATPRSGNSTPRPNKSTEFKGTKKTFD

SEQ ID NO: 18911 - protein, 544 aa, Candida albicans
FTQTGKGCTEKIPRNMQFHLTREELDQRKRENQQMEKLKQEEKEATAKPTEESEEKEEKDKPTADAAKVAPEKPTLNKNQADMSQVAPDGGARKNRKNLFKRKTRQINLMNEEKRKLRYEEHYPWVIEDYDGKNVFVGNYEAGSTEQQHVLFVFDKDGFKMIPAEKVYRFTPRNRYATLTLEEAEAKMERNSSVPRWLMKHMEDRSISEGTPDQRFRYNSPAANGSVIANVGNGSAGRRMRTVLGGSGSGNDRDSDHDDLDYDEEFADDEEAPIMDGDEEENKLSEKKIKKEMLKAAHFDGQLEAEAEDDLDDLFETEKTRKVDKEGKKLRKVLNKREGGVYDSDEEDGLMPYLSKSDLESDEESDDEVQVKKEPSSDSQTDNNTNKTSRAREVSVKSIGDGFVVIKAPPSFLGTMPPGDWNPQARKRPTPEIASPRKKIKLDETIKVKKERTLSPPPVSPTTNAATNTSSPGNGMDLNDAGPDNLLVTVKDVLDIVKDQPLTTKELLMGLKSRVSAHKDNKLRIISIVKQNLRLVDGKLVLKD

SEQ ID NO: 18912 - protein, 210 aa, Candida albicans
NTIFAKDLELGNWDLKQDRKNNDGDLFVGNEGDLVFIDKSSGLEVPYFEILKTRSVKKWLDNLQKSTPETDSNEQQQQQQQHEQLLDELKNSQVSILTLSNKKFQSIDSFINNNLTLIDSMKKSELEGKTTITANNKTKLSSPSLPVTFTNNASKIKSPLSQDVTEIILEGGEEEEEEEKDATNKKSTQPAPRPTTTKTNIDQTLEEVDL

SEQ ID NO: 18913 - protein, 432 aa, Candida albicans
QIVRNLPDDFRQFNKRHDGQLRGGKPTGLIMGLVLLDLETIVEEKFLWTKVAERLEGQYYMAQHRQRQDNIMKEGSSNNKYGPINNSFVANQRSIPPNYIQPYYYHKGWVILLKDNIGNQVAMDLLPGPAGQVGQIILFGRDFDTKLVIASSLQEFLFGFVTDLEQGNFQIDSSEYQEQLGFLSNDRNGDFMVGDEDEDQGELSFWDKDGQEFGKNVIRGRLSYIEVLKRRALKKYGLSETFETSFVPQRIPKKQQPQQKSSGSGSGSTTPIISQSRNASSSNLKKTTTNGNAASPATAAGSASTATTGAGNTKNKPPVPSPLANSDNASSSFSIPKETILNKNKPEKEEKEDKQEVSSSEKATVESKDPIETVNVSVNTDKEKPESKAESEAVKADDKESEEIKVTKNNDTEESEKKVEPFFNHEGWKEPR

SEQ ID NO: 18914 - protein, 141 aa, Candida albicans
TTQLIKKLILLSIIMGLLDNLKAFVHSITTEDHYASYDSPYRNDDNEPIGTNSHRSSTNDSALPLNNDLNNSQYSLDNSTGAAGFYRPGMKSSQQDLPLQNFSANGQPPLPSIDSLWDRIEYWIEQEYPELEDNLNDGVQL

SEQ ID NO: 18915 - protein, 230 aa, Candida albicans
KEEKWLNIFFYLNYHFPIHYFVCLFVCLFLQISYNLQKLLAYFLISIFDSFPSFLTTMKFGQKLQEFVYFLTTNDKYSEFDSRKSFNRINKPDSENLLGHHHNNSSLELVSHTNDDTSSAKNSNNSNNNLQGIHEVNLAWRHIKNWLHKYSPDLNNSLQSKCTDSDLQDFQKDLSIKLPNCVIQYFKLVDGQYYDFESSGLIFGLKLMSLDEITTATENWRRVAGYSARG

SEQ ID NO: 18916 - protein, 360 aa, Candida albicans
PNFNFDGEIYTFKERPSLIEEKEGKIEFRVVHNDNSRENLIVLTGLKNIFQKQLPKMLREYISRLVYDRSHLSMAVVRKPLTVVGGITYRPFNNRGFAEIVFCAISSTEQVRGYGAHLMNHLKDYVRATSPIKYFLTYADNYDIGYFKKQGFTKEISLDKSVWMGYIKDYEGGTLMQCSMLPSILRYLDLGKILLLQKAAIERKIRSRSKSKIVRPGLQVFKTNKNVTLDPKDIPGLAEAGWLEEMDKLAQKPKRGPHYNFMVTLFSEIQNHPSAWPFAVAVNKEEVPDYYRVIEHPIDLATIEQKLENNLYLKFTDFVDDLKLMFNNCRAYNSETTTYYKNANKLEKFMNNKLKDCSFV

SEQ ID NO: 18917 - protein, 315 aa, Candida albicans
HQESSQKICVSIVEAVSKRFSSYRHLYTGNPGNTAYSMSSSVNLSSTREIKNEIAKEDVDGTNSSNIHESTTKIKDNVSSKDNNQHSVNDDNDYDNKTPEQLSKIYEEYRNRFKVAMEKSNQLFESQQNHFITLSYYYRRNQIYLSILNDLYAANEDEINIDEDFGVSRLEDLIAKIPRTKKMLTPIIKLIKHSTITDKRDELRIGNYMIEKVSDLINDDLTKYHTNPQSIENWCHRNSVPNLISGNYVPIILDDNNDYHGIEYNLNLNDEGHQGATTSTNTTANLNSNTGSVNNSANTHTRKRRSVESTQNSME

SEQ ID NO: 18918 - protein, 148 aa, Candida albicans
FVQVGIIIMGVHSLWKIVGPTARPVRLEALSKKKLAIDASIWIYQFLKAMRDKDGNSLPSSHIIGFFRRICKLLYFGILPIFVFDGGVPALKKQTINNRKQRREKNSESRQETAQKLLAIQLQREAENALNRLKKPSNNTTNGDDERR

SEQ ID NO: 18919 - protein, 794 aa, Candida albicans
  UNSURE (787): Identity of amino acid sequences at the above locations are unknown.
KNHQITLPMATMNDVKYFEDLPINNRERESSTPSSIVNRKNDEYHLPDLKEFKVSKFDERIMPEEDLTEFYEDFDHVDGININEIDPKSKEFEALPIATQYMILSHLRLKSRLRMGYRKEQLEELFPNSMDFSKFQIQQVQRRNFYTQKLMDVTGMGADATISKRLAGDKDRKYALVKNEDGWTLALEGNSEDNPIQVDSDEAEDITREVNSYKEDLRQDKKDEDSDSDFEDVPLEEIPETEEDKDYQRALIKSIYEQYNTQENMQAPTSTINGVDDDELRKAVEKSKIDYFELQAKETQQLEEEKFDFGSSMLFSTNAVKEEALQNSEEISNLTEHAHTQVNTVHPSEQDKIINSDTKKELPNSIGQSFLFNADPHRTGKIELRTKEETIFEPEESDFEEAKTNNDQLISHIEKAKKQEPTKDQQKLPDWFQSEVNKTLNPHNVKFVNYNDYQIRNQKNQEEKDAGLVPWYEAKEILEQEQSDEEEQEQEQEKPDNDSDEIEEISKEQVNISISEEKESVPPLSVEDIRKPAVMDYQFEEEDEEELVQQLQKEELDHESLKHQIKASHAIPLTSLETRITDEQLLQEKFQKAKRDSDEVTETMINDVQELLKRFGIPYITAPMEAEAQCAELYKIGLVDGIVTDDSDCFLFGGDKIYKNMFDQKQYVEFYLQDDLFNKMALTQHKLIELALLLGSDYTEGIKGIGPVQAMEILAEFGNLEKFKEWFDKHTKSVADKTELTKLQKSLLDRIKKGKLYLPDSFPDKVVEQAYMSPEVYSDKGQFQWGXLTRRSGM

SEQ ID NO: 18920 - protein, 362 aa, Candida albicans
RQENKRQLKRQKLQKIVKHLEKEQIKRNIKYYFPTYSRHRPFNFHKFFSPSPQYYRYQRPAIGLSKNIKPLIPTKVNLEIEVDQKKIFKLRSADTASLSHEDKNVTNITQDDLDFIKNLESKRSSIDSFIKEIDYVKRDWTNCDKFDHYSKDLVLSTTDWDDDAIINAGDNEYSIVKPINELLLNNPLDNSKQNRQKIENDNTTNNYNQNNSNVQDEEEDDDIFNGQINLDKLKLDMNDPNLLFVPSKKVDATKSVVPSTDKLLELKFNISNDQEYELLRKNYNTKQRSQLSNLNIEHSVPALRLQTPYYKVKLSTDETRSFHRPVCNVRPGTLVSFSKLKLRKRKKYQGNLCNRFFPKLLT

SEQ ID NO: 18921 - protein, 187 aa, Candida albicans
NRSGFSTAGSDPRLIRAYVKRKKQIEDELLKNADVDEILPTNDKELNKIRRKALEEKLANLEKRAKQSRAKKPPKDLIHAAAAAGATIIDANTVMLPDGSYVIGGKGIGKGKSRTRRCKNCGAYGHIRTNAKCPLYKKMVLGIDDDSAAVVGSTPAVSAGDVIGETTTSTAVTLDTQRIEEQNLAEA

SEQ ID NO: 18922 - protein, 176 aa, Candida albicans
LGNLESTKEEVDAFYSFWGRFDSWKTFEFKDEDVPDDTANRDHKRYIERKNIANRKKLKQEDNKRIIELVERAHAEDPRIKLFKEKAKKEKAAKKWEKESGSRKAAEEAAAKKAAEEAAAKKAAEEAAALKANSKKAKEAAKAAKKKNKRNIRAAVKDNNYFGLHHAVEGATLWVP

SEQ ID NO: 18923 - protein, 205 aa, Candida albicans
LFWFFCSEKSPLFPLLKPSLSVYRESNSWSCYNLRTIQIPLLIFAAASICIFVCICYILINKKSFNIWKMSAPIVETKKASKRRIRRIPDDQRQKVSSACDNCKKRKFKCSGEKPCFECLKKGHDCTYTIIDKRSLRGERMAKLKQKKDNNEKQRELVNEQIAQSSIIHPQITPVLPVPEYANVTYQDSSHSTVSGNDSYHLSSS

SEQ ID NO: 18924 - protein, 284 aa, Candida albicans
LIMSTSEETKVTKPVIEDRIYVGNVDFKATEDELKELFQDLKVTEVEIPFKENTRGDKVFKRHLGFAFVQFENKDDADKAIATYNGQKFQRRNIFIKKAVPPPTEEEKKERVEAFKAKREEIKKVKEQKKAEAKKKREGATADAATTANGESATTDSTPAIPDGTPSKDTIFITNLDYKVNVKTLNSLFKELKPKWIHVPSRRVPYNRRGRGGKFRKPFNKGIAFVKFSNEETQKQAVAEFNGKEVNGREIIVDIAIDSRIPKEGSTEEDVDDEENAEANSNGN

SEQ ID NO: 18925 - protein, 113 aa, Candida albicans
QNSNQYHNKTFNTPLQKLNINVTNYITPPNPNLYQNLDNSSSIQKRLKSTNLYLPKQLELHFHGPNPLQHMHHTAPPLKSKKRHVTFNCHPFSAINSINIVVASQLLNKLIDH

SEQ ID NO: 18926 - protein, 354 aa, Candida albicans
TMNYNIHPVTYLNADSNTGASESTASHHGSKKSPSSDIDVDNATSPSSFTSSQSPHINAMGNSPHSSFTSQSAANSPITDAKQHLVKPTTTKPAAFAPSANQSNTTALQSYTQPAQQLPTQLHPSLNQAYNNQPSYYLHQPTYGYQQQQQQQQQHQEFNQPSQQYHDHHGYYSNNNILNQNQPAPQQNPVKPFKKTYKKIRDEDLKGPFKCLWSNCNIIFETPEILYDHLCDDHVGRKSSNNLSLTCLWENCGTTTVKRDHITSHLRVHVPLKPFHCDLCPKSFKRPQDLKKHSKTHAEDHPKKLKKAQRELMKQQQKEAKQQQKLANKRANSMNATTASDLQLNYYSGNPADG

SEQ ID NO: 18927 - protein, 330 aa, Candida albicans
LSLRNKLQVLLNIWEQVTSSLMNYHEVTIIIKNSLNNSLRKLGSYCVLSIKETETRRFAAVCKLISILIKHLKAQNQVTTIRDIYYQDVEVFNHCQNECRFLLGQLVERGLGWSLCDDLNIHPTQKGLVYGDYFQELSIKAEPILIPINYTKFFNTKITQIKVEKVIVVILEKDAVFQCLCTHLRQHNIINRFLIVTAKGYSDNLTLRFLTWLQTNENCKFIGFFDSDVYGLNIYWQYNQKLPEMVYSGIYLLESQPHTWLSITLRDIAMMIKICKNGNNKYNDIPYRELTRGLYLFKKAEMNVVQANDANQSYVNYMVSKILGTPSYTK

SEQ ID NO: 18928 - protein, 207 aa, Candida albicans
LRLSFDPGLVKTNNQYAIPQELVDTHEQAPESKFLFTLSPSYLRDSTITLINGKSAGVFTNSIEEELSELGHPSDLSIPNDHLRRGATTGLNDKFDNFISAKLQSLWTQRQLIKGDGGQIYELENGNLCIRTSNVFLHGNFRGLLIQIEMSNSLCDTNNHNSFKEHFNKIVEKYGFPEGNLCCDVLDKKNLDKYGDLCLQYSKILNF

SEQ ID NO: 18929 - protein, 150 aa, Candida albicans
MLKFHTSMPQYIWENKTQVGKVDEILGPLNEVFFTIKPSEGVKAESFKEGDKFYIGPDKLLPLERFLPKPPSVGPKPKRKTGGKSAGGSSRGGFSSRGGGRGGFSSRGGGRGGFSSRGGGRGGFSSRGGGRGGARGNSRGGFRGGRGGRF

SEQ ID NO: 18930 - protein, 189 aa, Candida albicans
FLYSVLILLLLCILFFFSNFSITTSSIHPKVSVQMSSSQARKALQDVIPNYLGEFTPKLLDYINSLYQLSLRKQAILPNKSEIARFHLCAVVIVEKYKQSFELPTPDVSRIPTQPKVAAKLLDTFRELIEQISAASTPVSSPKKVKPPSQSPLTPTKSRTSKENLKSGSPLKRLPSKKCCSLTRPGPGR

SEQ ID NO: 18931 - protein, 883 aa, Candida albicans
RALTLARSAIPVVKTREVLNHVSDPRIAQSNLNLQKPTKKTKKTPYKQLPQPKFVYNSDSLGPAPMSTIIIWDLPISTSEPFLRNFVSRYGNPLEEMTFITDPTTAVPLGIVTFKFQGNPQKASELAKNFIKTVRQDELKIDGATLKIALNDNENQLLNRKLESAKKKMLQQRLQREQEEEKRRQKLVEEQKKQELLKKKEKEHQESVKKEKSVEHESTIVSTRDKNLVYKPNSTVLSMRHNHKIILSVILPKDLEKYIKSRPYILIRDKYVPTKKISSHDIKRALKKYDWTRVLSDKSGFFIVFNSLNECERCFLNEDNKKFFEYKLVMEMAIPEGFTNNIRENELKSTNDVLDEATNILIKEFQTFLAKDIRERIIAPNILDLLAHDKYPELVEELKSREQAAKPKVLVTNNQLKENALSILEKQRQLFQQRLPSFRMSHDRTQQHKPKRRNSIIPMQHALNFDDDEDSESHSQSESEDEDEDETTASRPLTPVVLTMKRERSSTITSIEDDIELEEREIKKQKVKVPAIEAEIAPESSPEEGEEEEKEEVEIKQEAEEVDIKFQPTEESPRTVYPEIPFSGDFDLNALQHTIKDSEDLLLAQEVLSETTPSGLSNIEYWSWKSKNRKDVQEISQEEEYIEELPESLQSTTGSFKSEGVRKIPEIEKIGYLPHRKRTNKPIKTIQYEDEDEEKPNENTNAVQSSRVNRANNRRFAADITAQIGSESDVLSLNALTKRKKPVTFARSAIHNWGLYAMEPIAAKEMIIEYVGERIRQQVAEHREKSYLKTGIGSSYLFRIDDNTVIDATKKGGIARFINHCCSPSCTAKIIKVEGKKRIVIYALRDIEANEELTYDYKFERETNDEERIRCLCGAPGCKGYLN

SEQ ID NO: 18932 - protein, 85 aa, Candida albicans
HNFVFFQIMAEILYNQPVVIDNGSGNLKAGFAGEDKPKSYASAIIGRPKYQKIMAAGSTSLLLEQQSHDQLFIGNSAQDNRGLLK

SEQ ID NO: 18933 - protein, 219 aa, Candida albicans
IVLIGEDFSPDLQWIHKIFDEKNNVLFLDYDAVPAVEENVGEMVINTKEALLIQQIVNALVHGGVKEDEIGVMSFYRAQLSVLKKNLNNLKDLEILTADQYQGRDKECIIISLVRSNERKFAGDLMKEYRRLNVATTRAKTKLIILGSRFTLSTNELTKTFIDYLENEKWYYPLPKSAHKIYKIPEVNGPSPTRSQKSQDSPILNRNPILKNVVQDITR

SEQ ID NO: 18934 - protein, 254 aa, Candida albicans
  UNSURE (142),(217): Identity of amino acid sequences at the above locations are unknown.
GHGSIIGLLDNKVLGSIDDRVTTQRFRIVNIIEQYYGPKSEKQLILEVVNSLRDKSKLVVRGEYCELELEKGDVIHVIITDSTCPTLVDDMHNLLIWNPDIMLSATTISQQLNCSRKTVILSRYKFPGTLTIPIIVGEIVHXIFQECICTERWDMEFMSQVLDQLLLQYMLAIFGIGKELKDVRDEVVKHFDYLETWFKTYYKQPLSKINLIDETSXKDQIMFAVEDALDIEEEIGSPIFGIKGKIDAIITAEI

SEQ ID NO: 18935 - protein, 173 aa, Candida albicans
LAVFCPSTRLLKTRCEIRSACMTLNHLTENGTKEESGIEEELYEAITRDIFENDSYRKYFQHWDELISKEEDVMGRAVKELWTIPAEDQEFQGKCFSGMTITNSNETESNNFLFSSTHHDKSQDQQFVYTFAKAENPSRFNLAKSQVTINDKVIISDEEGHFALTTGYVKQIT

SEQ ID NO: 18936 - protein, 162 aa, Candida albicans
  UNSURE (5): Identity of amino acid sequences at the above locations are unknown.
ELRPXKRFRIDKDRMFYGLGLARYNVLSLFLPNGASQLRKLVVDLEKPTFTASSWEIPDAETFNPDQIAALKKVFSADNYSLIVGMPGTGKTTVIAQLIKVLVAQRKSVLLTSYTNSAVDNILLKLKDLDIEFLRIGYPQRVHKDIKDYIPEFKDSITTYEQ

SEQ ID NO: 18937 - protein, 376 aa, Candida albicans
  UNSURE (369): Identity of amino acid sequences at the above locations are unknown.
TRIFSSWARNGAGKQQVPPPPPPPSSSQSLNSKLRPPPPPPPPPPPSADSKKQSAPSTSLENEQEPRKRTWSNVVKSRRQKKSDTKRSATQVIPQKPEMPPQHLRKIMIDHGDLTLNKIASDKRSHLGSLKYLPHALLKLLENMPQPWEQQKEVKVLYHTTGAITFVNEIPRVIEPVYIAQWATTWNMMRREKKDRKHFKRMRFPPFDDEEPPLDWLENLDDTELVDAIRLKEIEDDDELRDWFYDTRPLVEDPDIVNGDSYRKWNLDFGTMNKLYQLSRPILHEGQTQKFDKNSLFTAKSLNVAIPGGPKFEPLFKDKINNPELEDFTEFNSVDRIIFRQPIKTEYKVELPFLYNSFVKKVSVSPLGXTLDCRSQ

SEQ ID NO: 18938 - protein, 282 aa, Candida albicans
RLIHGQAFKNILPDYITSKNNVSLTFKDMNHVNQYGIIRGLQFASFVYQYYGLVVDLLILGLDRALEIAGPVQNPNNFLQFKDLETETASPIRLYSRYLDKIHIFFQFDNEEASGLIQDYLSEHPDPNFENVVGYNNHRCWPRDSRMRLMRHDVNLGRATFWEISGRIPTSLTSIEWEDSFASVYSRDNPNLLFLMCGFEVRILPKIRAKELLSSQEGVWDLVDQNTRERTAKAFLQVSQEAVDHFHNRIRQILMSSGSTTFTKVAASRSLHLEDRRSAIIE

SEQ ID NO: 18939 - protein, 417 aa, Candida albicans
KMIVDSHIQYRLGNVDAYQLADGLYYLFNHLGQLTGIYRYKYKVMHQIRQCKDLKHIIYQRFNKVIGKGPGCGFWQPAWRVWLFFLRGIIPLLERWLGNLIARQFEGRRQNDVAKTITKQRVDAYYDIELRAQVMHDILDMIPEGLKQSKSKTVLQHLSEAWRCWKANIPWKVPGLPKPIESIIERYIKAKADGWISVAHYNRERIRKGAHVEKTVARKNLGRLTRLWIKNEQERQMNFGKNGPFVSPDEGVKIFQTMVSWLESRKFNPIPFPPISYKHDTKLLVLALENLKESYSANAKLNSAQREELALIEHAYDNPHECLVRIKKFLLTQRIFKEIGLKMMDYYSHLVPTYSVDPLEKITDAYLDQYLWYEAHKRKCFPHWVQPLDDEIPPLPVYKLCPRIQYFTYWCGITFAR

SEQ ID NO: 18940 - protein, 67 aa, Candida albicans
  UNSURE (61): Identity of amino acid sequences at the above locations are unknown.
RIAMLRLSPIDVQWTPTLKISRAWYGLGQAYEVLDMHLYALYYSQRATNLKRLDKRSNSPXGWKVAR

SEQ ID NO: 18941 - protein, 158 aa, Candida albicans
LEQLGGLVPGLCFLKIQHGLISYHDLDYFQAEATFDQILVEDPLRLDDLDTFSNMLYVMEKRSKLSYLAQYASQIDKFRPETCCILANYYSMKCEHEKAIMYYKRALTLNKNCLSAWTLMGHEFVELKNSHAAIESYRRAVDTNPKDFTCVVWFRTSI

SEQ ID NO: 18942 - protein, 171 aa, Candida albicans
YDRYAGWPPKNEDKAGELIKKLNLKQIKGISRVTFKQRGNLIYAIDSPDVYRSAAGTYVVFGEAKVDDMNQRIAEAQAQQAQLEALQKAAADAGKTEDKSPEAITADLEKASLGDKKAEDEEEDEGEIDETGLDPKDIEIVVEQTQVSRAKAVKALRNHDGDMVNAIMDLS

SEQ ID NO: 18943 - protein, 79 aa, Candida albicans
TGQPATSVIRSFDTKTPIIAMTGNIEDNDLVTYLQNGMSDILAKPFTKDDLYAILSKHLLDPKENKQDNEPTVKKQKLS

SEQ ID NO: 18944 - protein, 315 aa, Candida albicans
  UNSURE (277): Identity of amino acid sequences at the above locations are unknown.
KSKRTIHIGGIKKFSVLERKYKTVVENIVARTYINERYYRSMNVLINSIVQNGMKLPPLDFPPPVQLGPDSGIGSNLGPISSDTALPSISHHLLSPLPHHQQLLNRTIRPISSPIDGIPLVKLQQQSLGQNLQAPIGTPSAVPFSEEASSSIQAATPAPLAQPVAQPINQPPPPPPPPATQQQPLPPPPPPATATSQIPSAPPPPTQQQVGTSSSSVPTISPKSQGIVVSNSASPTTSAQISTTSVPNPKFHVLLVEDDNVCIQLCSKFLVKYGCLXTVVNDGLNAISTVEHTKYDLGFNGYCYAKPRRGNRPQV

SEQ ID NO: 18945 - protein, 159 aa, Candida albicans
MSSLQQPIPPNSTLATTASSNQSGFNDFVKKLFLMLQEDSYKEVVRWTVKGDSFVVINTNEFTKDILPKHFKHSNFASFVRQLNKYDFHKVKISNEAKASYPYGEDAWEFKHPEFRINDAEALENIKRKGPTAKKSASNVTIKTEANNNGTQHTCNHNS

SEQ ID NO: 18946 - protein, 314 aa, Candida albicans
YINISLKKQHDSVEIVKRRCQDIEYPVLEEYDFRHDARNPDLEIDLKPSTQIRPYQEKSLSKMFGNGRARSGIIVLPCGAGKTLVGITAACTIRKSVIVLCTSSVSVMQWRQQFLQWCTIQPENVAVFTSENKEMFASESGLVVSTYSMVANTRNRSHDSQKVMDFLRSREWGFIILDEVHVVPAQMFRRVVTTIAAHAKLGLTATLVREDDKIDDLNFLIGPKLYEANWMDLAQKGHIANVQCAEVWCPMTAEFYQEYLRENARKRMLLYIMNPTKFQACQFLIHYHEKRGDKIIVFSDNVYFFTHEPWKDPH

SEQ ID NO: 18947 - protein, 235 aa, Candida albicans
QEYALRLGKPFIYGSTPQQERMKILQNFQHNDQINTIFLSKVGDTSIDLPEATCLIQISSHYGSRRLEAQRLGRILRAKRRNDEGFNAFFYSLVSKDTQEMYYSTKRQAFLVDQGYAFKVITHLSGMEQLPDLAYSSARERRELLQQVLLKNEDAAGLEIGDDADTNFISKEKRMRLEQERNGGGATYSSGSLAGLAGGEDMAYIEYGKNKNKELRESHHPLIQKMYYKQNKAKK

SEQ ID NO: 18948 - protein, 277 aa, Candida albicans
SNMSSRNREPVNYADLEDENFSDEDVYVSNKTGAKDNDDDEYNTPSQKSRKSTGNNSKKRKAQESVDSLKQNLDETNYSDNELIELTPDVPADYIPDAVSKNFGKGDFSYLKLKPDHFSRPIWISPNDGRIILESFSPLAEQAQDFLITIAEPISRPSHIHEYRITAYSLYAAVSVGLETDDIILVLNRLSKVPVAESIINFIKAATVSYGKVKLVLKHNRYFVESTQADILQMLLKDPVIGPLRIQSSENIVTSNGLITSASEPCHFHPRDWKIRV

SEQ ID NO: 18949 - protein, 424 aa, Candida albicans
QIGYGLVLAQVSKEHEEYIKDESEFMQELFSENLKGTIKSEGFDNELFEKQVAGLLLLSTDYDLPEKFQKEFTTISDQTKKDDLVNEILEKLTELETDFETRAQNLGIKVPSPSSSPSSKTDKDTLHSPLGTIHAEKIISNKISQRLKELENLPANIGTFGDTDGIDKFKIQALIELKALRLLGKQKLLRHNILVHEAQQVKYADPNLKSLPLALLEKRSFNVRPKIEQRNPQLLAVQLEELKKLEAREAKRKQHIEKVDLVVEKSTSRSEAKYVRDHYRSHYLVRQINNFHQTTEKEESKKLERTAKQRLQALRSNDEEAYLKLLDKTKDHRITHLLKQTNQFLDSLTEKVRAQQEEASGGSMGTPRHGSPEVAVENKSDDKAELREKTDYYEVAHRIKEKITEQPTILVGGKLKEYQMKGVE

SEQ ID NO: 18950 - protein, 574 aa, Candida albicans
PGIFNSVKSFDDWFNTPFANTDAQEKIELTEEESLLVIRRLHKVLRPFLLRRLKKDVEKDLPDKVEKVLKCNLSGLQYVLYQQMLKHNALFVGADVGGAKSGIKGLNNKIMQLRKICNHPFVFEEVESVLNSLRLTNDLIWRVSGKFELLDRVLPKFKKSGHRVLMFFQMTQIMDIMEDFLRWKDMKYLRLDGSTKAEERQDMLKVFNAPDSDYFCFLLSTRAGGLGLNLQTADTVIIFDTDWNPHQDLQAQDRAHRIGQKNEVRILRLITNDSVEEVILERAHQKLDIDGKVIQAGKFDNKSTAEEQEAFLKRLLEADANGADNEENDSLDDDELNEILARSEEEKVLFASMDEERKLEKVPYKSRLIEKDELPAVFTEDISHHFEKKEKELSKMRDKKRVRYDDGLSEEQWLKAMDDDNDTVEEAIKRKEERIAKRKRNKAIREGLLEEDIKDDEVGEEDDEDFEEAAQPRKRQRRARTPLPHIDNDDISGDSGNGGGAAIELDVDDDDDNEPETDGFTSKCLSVIDEITALTDETDGHNLSDIFIKLPSRKLYPDYYLIIKKPVSINQVKK

SEQ ID NO: 18951 - protein, 418 aa, Candida albicans
LLVASQHGRAPHNISSHLPEIFFCSRFCFDSLPNQQAMSIEEEISEDLGFKLDIKDNGIPLFEPLDLQNLATKHLKLLAIHDDLMVASNSKCIKVVSLKDLDDITTIEGEFSITQLHFVGNELFVLDDSKIKSLTVEQLKNKDYSFRTIREGFVDILPSPSGILALNTNNELYLNADKVASNVSAFCWTSSLYIYASKDKPYHINNKKIKVKDVDELCIVEMFAINEKYLFVAYDTVDAELDYHDVKSYILEETDNDYTALEADIAPAFGSVARAVTYYHAQLSDWYKSNKFVLLTSSLAIDLGILDTTKGQTPKIIAQSEDINRAQFPIDDESGDDCSPVGFGVSLNELTSKVLEPCPGADEVTGVLPRIYTLLHTGNLISWWVFHKSAILKKELSLENAIKASSTQTLDHGPEDPH

SEQ ID NO: 18952 - protein, 262 aa, Candida albicans
ITHQRNGQPNHVSPISSIKNEIDKYLTLELPERESKAQAVPKKISKIVKHKQKQHEANLKRLAKEKDHERQLEEWNNPTLFAKQEREFMKDPFRTVFIARLDYNLTELDISRAFARYGMIESIRIIRDKQGKSRGYGFVVYERNTDAMNCVNDLSRTGLKLGNRPILVDIERSRVLKNWRPRRLGGGEGGRGYVKEGKVQSVAASARRIVIANNPSFNTAPPQHDQQQFQYHHHQQQQQQHQPQFQTQYNTCLHTQPLEGSA

SEQ ID NO: 18953 - protein, 373 aa, Candida albicans
TWIDEQQQQQQQQQQGFSHAQSLVLVGEGRPDRKKVKLDTEDNHLKVVPTSVVVRKRPWKSVYSERFKLEKNWRKGTHTIKTFTGHSDGVTCLQFNRKYLMTGSYDTTIKIWKIDSGECVKTLTGHTKGVRALVFDNQKLISGGLDSTIKVWNYHTGQCIATYRGHEDAVVSVDFTNKSIVSGSADHTVRVWHVDSRTCYTLRGHTDWVNHVKIHLASNTIFSASDDTTIRMWDMNSNECIKVFGGMENNGHIGQVQCIIPFTYKEELIEDESESDSENNQNSTTTTTTTSAAATATATEMGATLGTNNISLPNDTATINRSTCTPSNNNTATTATTPNSYPTHFLTSALDNTIKLWDVATGKCIRTQFGHIE

SEQ ID NO: 18954 - protein, 383 aa, Candida albicans
FTTNIEKKCLPLTMSARKLQQEFDKLNKKISEGLQAFDEIKDKINATESASQREKLENDLKKELKKLQRLRDQLKQWLGDSSIKLDKNVLQENRTKIEHAMDQFKELEKLLKIKQFSNEGLELQSQQKRSRFGDDAKYQEACTYINEVIEQLNGQNEELEQELDSLSGQLKRKGGSSIQLSIDDVKYKIERNNSHISKLEEVLENLDNDKLDPARIDDIKDDLDYYVENNQDEDYVEYDEFYDQLEVDEEDDVEVQGSLAQMAAETEDERRREEERKREEKEKEKQQQNPPRTSSSVSSSSSSNQNNIGNNTPPATQIKPSVVTVAAIGDQNNNSASSASSTSTPVKKLKPTLAPAPAPPPITSGTSYSIFTTGLEGAAMAGE

SEQ ID NO: 18955 - protein, 777 aa, Candida albicans
  UNSURE (561): Identity of amino acid sequences at the above locations are unknown.
RKKERAPLNIFFFFSFIVLPLLKKSQRLLTLSREIDIIFKKIQEGLQDFDYHYERYESIQNTEDDSDNQREKEKLANDLKKEIKKLQKFREQIKHWLQNDTVHTLGPVGTSYESKLAENKSLIEDSMETYKLVEKQSKLKTFSNQSIMMTFMDSTNGDDDDDDDDSDDDELFSGSDEDEEDEYSDLPEDAVNAIHFFKDSILQLREQTHKLDHEYEKLAAKKLRKNNLATIEAKKEKIQLTIGNNKFHQKKLKKLLRQLTSGVVTEFNLIWLLKDDLNKYLESNGDYEFTRETELYDDIFNQIAAVEEDYSEIHEDNHDHSHSHLEKTSTANGTHHESATTTATAAKNSSVTTRTSPSPILTKANGHIKELSVESGSPTTSRLKLLKIHTNTLQLSTHSNTSSSTHAQAPRQSPELTSPAIVKTLRPATAPSKPVGTLKWSAAAAAAIPDVQEKPELVETESNGSSVHKTVSKDQYEEKINYQSPAPTQQQQQPQTLVELKTLSTTQSLASSITDNINLDKYKEVIKNSNLTKTELGLFSDMNLARVPPGIQDLVISFASXRNNDNFKVLVDSTEFNQFALPLHKPYLPEIVQPSYYSQYTSTSFKHPTPLVKFQSYWNQVRANFGFQKLMDEIKSLTLQNNADNLPIIAELTFVLFYGFYYGVTPAENLIAESYLFELGWKPYKNQSEDGSNNLSTDSISLSDIDGLKSKYNRYSNYYFWFKRVKLISRGEDMGQPSNIEFGDYQVFDLSFWEIFVKYGFKFDYNLCQLEPSKTLF

SEQ ID NO: 18956 - protein, 210 aa, Candida albicans
RSAIPMVKSSDIRFYMYELLKALDYSHSMGIMHRDVKPHNVMIDHDKKLLRLIDWGLAEYYHPGTEYNVRVASRYFKGPELLVDYRLYDYSLDMWSFGCMLASMVFMKEPFFHGKSNTDQLVQIVRVLGSKNFKKYLEKYNISLGEEYEDIGYYNKRQWVRFMNENNKDLVSQEFLDLIDRLLRYDHQERLTAKEAMKHAYFDPIRVAVS

SEQ ID NO: 18957 - protein, 496 aa, Candida albicans
LSLLSTFFLHQQPSIMNTTPSRKRTIRDISNTQLPLTPTKTPTKSKKLKIDNNNSFDTGKPSCVKKLDFGLLTPTKKPSTSPSIPTSIYSQAKALFQRGSNVNYSNDYFLTSREKEAKYIADFVANSIQQKISNSLYISGPPGTGKTAQVQLILQPYQQNSRIRVVKINCMTLNNPEQIYHEIYCKIMNKLSISFHKRKTCDDFMTLMNDNENQQFDSVIVLLDELDSLITSDQQVLFQLFKMASINCIPQTKIKLVLIGISNTLDLNSKFLPRLVRNNIQLDNLQFLPYNADQIKSIIMNRLSNLKQEIFHPGAIQFCCKKSASISGDLRKAFDICYKSIELVERSCQGTDTINKVMIQHVAKICMTSFGNNENQLNNLNLLQKAILCQLFNYQKEIFSKCSNKTAATTTTLTVNSFYDYYKKQYEMNDLIGLLKHTEFIEILYALESSSCILLTNSNKNSGNSNKIIKLNVPYDDIVKSVENIGILKKILQKPN

SEQ ID NO: 18958 - protein, 186 aa, Candida albicans
LMNESSNSNSGEVKQEKQPPPQQQKLNGNKGKIHGLVEEEKVEIEGSQPPLKKKHQEDGWTKTEKDALISAVKTFKNDWYKIAHQVGGNKTPEQCILEFLKLPLEDKFNPINDEDETNIKLLKYASNYPISSIDNPVLANLTFMTKLVDSNVAKAASEAAKKAMDGSIENKVQELHILHYERLAPR

SEQ ID NO: 18959 - protein, 561 aa, Candida albicans
RPVGSTTESELTPIIESNGDDMMRLEEPDESNANSSGGTTFGLRYTKTIRGSSGSSKKSRPKSKSKIPIVKFFQSGKESGSVSDSDSDSDSDVNDRKLQLYQSDSINSTNNTLEEVTTEDGDITEQENEPEIVEVNKSHKKSQENSDVITIDSDFGVPVNSRGHVVQNYQPEDQGVSDEEIEAEIDEDYDSEDSDEYEYEYDEDGEEDSNDSEFTDLDNDSLVGSSLILDSTYNDNGGDSFSFVRTSNVSEFDTQKSRKKKKADSFDQHTIPKGNTLVRQRSSSAGNSKSYLALTALSYKNPTFQFEKVSPTKVDTPKASKLSSLIHSRYKSDNINPLNYYSFVDASSSSVKQTLVDIFVPPNTKATLIKLAMVENVAISDCIGFVLLNLCKLPELNSIKDLDYLNPNHWRLELVDEDGENYGSFGVLDRTRLLSSYNNPKELAICRITDYNEIKKNDLQSPLPVEVKKDLEALQRKRHSINQIVESGIEESTGEKIEFQIGVFEYDDDGLPRKELIKVPSEYTMGQVLKEFCAQQGLILIKYRFRLVDQSTGQSRFVKGC

SEQ ID NO: 18960 - protein, 917 aa, Candida albicans
  UNSURE (17): Identity of amino acid sequences at the above locations are unknown.
ARGKKNNFRRLKRRQRXQQTQYTVTATIRTTTGGLFYFYFIIFYFLSLQPIFFNHLSLLSYIYIYTYINRFYCFDNMSASPPEETPLDTTSSIPEETEQQQQQQQQQPESSIEHQDDEEGDVNEAEDSEDEDEQKEEKEDEDGDTEAKQSSDNNDAANDNEAGGNLSEASTEESTEESAEETQTNPTEDKNNEQQQQDDDDAESENKVESNEHQDNVNSNDNSKQDSNSDNDMQFDIPDAPDVIDSASESGKQEPTNVDADDNQDKMDVDIPQETSIAFTTNTQNTNTEEYEKEESKQELGEDEELKHIQEDDPSFDENYNSNNDPDKSNDDFDTSALINGDDFNMEIDDLDYSKDVESESNQQEGKPEEEEEEEQKKNSELSEVKSNVESTSDQKESEIKEESTGENPNESQPTTTSVVGASATEPLSSNQNTSIASSEVKTNTTDKDVDMDQQQKEVEPESKEKEEDEEDEEDDQEEEDEDEPEEPPKEKPQYKQTHLIVIPSYASWFNMKKIHKIEKESLPEFFDSIHPSKSPKLYVNYRNFMINSYRLNPNEFLTLTSCRRNLVGDVGTLMRVHRFLNKWGLINYQVRPQFKPGYALEKMPNGQSMDLPYTGDYHVKFDTPRGLFPFDTSRIPVERVDVKKLQQLMNESSNSNSGEVKQEKQPPPPQQPPQQQQKQNGNKGKKHGLEEEEKVEIEGSQPPLKKKHQEDGWTKTEKDALISAVKTFKNDWYKIAHQVGGKKTPEQCILEFLKLPLEDKFNPINDEDETNIKLLKYASNYPISSIDNPVLANLTFMTKLVDSNVAKAASEAAKKAMDESIENKVQEVYNGNNNTNGGNGGNVERQSSGKDAIATTFGIIGGRSHLFSNYEEREMHKIGSSIVNHEISKIETKLDKVEELEKIYERERQNMLKQQE

SEQ ID NO: 18961 - protein, 470 aa, Candida albicans
IMSGNVSHSTPLSISTCRSNTPGEEIDKSTGDILINIDPYAILLKDGSTKATIYPISSPNDISPNLLAFLWDEYNMEIEKGETLTFYEPLSFESFISHWFDSTSIVAIMVVGDETNMDDLGNDELHEWPSELLGIFNIKPNFPGCQRSGHICTGEFLVNAGIRGRGIGKTLTDCFMQWALKLGYTYVIFNLILETNVAARKLWESLNFSRLGKISNVAIMGHDDQERELVDGIIYGKSIENTIGESSNRDRKTPESESDSNNSKFENLKYYLQTGNYPPNVDNKEKSRLRANKANYYLQDDKLMVNGREVVSNIDLQLKICQLTHEENGHLGINRTTTLISQKYHWIRIKETVARALKLCQECKNNSLQAKEEFLNQSNKRIKLQKKTSNNDTPMPLLDNRQFEQAVIQAKQRLNDPNGVSYADVARSAIDDDSQIQSKQQSIHPEVKKYDKLSNSNQTLSVDPSVRTYY

SEQ ID NO: 18962 - protein, 191 aa, Candida albicans
  UNSURE (188): Identity of amino acid sequences at the above locations are unknown.
QSVLVMNSEEVFESVKDLPFADGNFKDTPKVKESTINFKLAKDATKTVTLFNIHDYKTVPVNLVKALENEFNYVVKEGRTYPYHSTMEGETFVKYWFTHFVSVLLEGEYKTFDELGDLSVEQWNQIFLGTFYVKPNYTGRCSHVCNAGFIVNHEKRGLGLGKELGKKYLQVAPELGDVIRLHHRAGRXHLG

SEQ ID NO: 18963 - protein, 741 aa, Candida albicans
LQFIVSPHFTKVMSLKPFTGLLFCCTGLESTTRREVVEKIETLGGIHYSDLMTDVNYLIVGDRDTEKYRFCIKYRPDIIFIDADSIFTIHKHWINGEDENLDLLRIEKYRLAIFAQLNACFSRIEMSTSQIDHLVNTVKFRQRTNTSPEYFRPKNLFKLFVDNGGIAKESLLCHQNFIITADPRGTRYNKALEWNVPAIHPIWIVDSVLRGAALDWKDYILNNNPNDCYDRGCDVWPEVFDCQEKQKQKSQQQPKRLESTEPEVKRKITNNKTNADIWNSIMDHTKKQTKQLIHDKTWDDDEEEEDNDDDGDTQTKNEKNNQYKNITTIPKDGKQKPELNGKIHNLDLKLVSESKESSPNVLESQLFLGFNYYTVGFDSREFDLLSKAIENYLGEISNDPNDDSITHVVIPAKKGYQSMLVLKVLPADLKLRIANGFVKIVTEFFIERCMFYKKIILDRWGQPMKGLVPSKKSFKICTTGFTGIELLHIEKLIRAFNFEYCETLSEQRDLLILNVNLFKKSLMNSPKLFQYKCKDIINCPTGGSVSLMSSKHKVEAAKRWNIPVVSVAYLWEILELSTNKSHIIMPDITDLQWCVFAPSNYNKPKSLLEYVKNLDKASRESSFSPKSQENEALEEPTMDNLVRLPSPRRVNLKQKYGKLVGGKSPKSIKRKLLEAANLFADGQNDHSINPDVTIEEDLMSQIRYQDNESMINQERLLEKLDGSAVLVETLIRHASKRSRKN

SEQ ID NO: 18964 - protein, 439 aa, Candida albicans
LTKIEETMSKKNKKSDEKNVSSNFKLISTSSGVRVSQACDRCRIKKIKCDGQSPCRNCQKVSVECKTSDRLSRKSFPKGFTLFLEAKVKELEDENRELREKLGDNSDAPPFEPVENKHLVSTADTSNITTVNTTPTPSTIPTTTTTSNDKVLFQTNNQSVPINNPIDQIFNLDDKGIIIGNDNLNFESQFNHLLINLNLPFLKITNSHNYLLDDPDSYLYHPSYTKSNKFHNRDLDLIYNPLTGTNTETGLRNELPTNVYDLFIKLINNFKKIFKSKREMDNQIVLFFLHYNIFIPIFDYNEFMESYNAFHTMYPFIFTYDDSSINGFNLSNTNDYQIVNNYLMTIIQIYAMILINNPTLNLNLLLNHTDPHYSINRDKSIIKSLYDFLPYFNGFHISIGQLQTYLLFLYYSLLTNNKEKSLILSSLVNAFIGILGINL

SEQ ID NO: 18965 - protein, 497 aa, Candida albicans
KLKTENQKLKKKKEKLTKPTTTTSIHRTFSFKKKMATASTTTVYGGDEINAIVLDPGSYTTRIGYAGDDFPKVITSSYYGQVKNDKKKIFGESINVPRANYDIKPILKESIIVDWDAAIEQYQYYFDQQLKVVGPEQPILITEPIWTETSYRQQLVETFFENFEFSGIYLAKSPTCVSFQQGRSNCLVVDLGHDSVLVTPVIDGICLLKSSMKTNYGGKFLSNEIQDYLIDTKKVVMEPSFKIKSKIPTTYPDPPKYELKNNNTIPTSSSSSLSQSFLEFQNEKIYHNFKEILEVPEKNSSSGTTTTTTTTNKDSSRLFELPTGQSIVIDRFKIAESIFDPTIYKFTNSKLSFPPNNGEISITQANEYRPLKRVRKNDDDEEEDSNQSTPKPEVNIRGISQLISHTLSNIDIDLRASLANNIIVTGGVSLISQLTERLYLELSNNNPGLKIRLHAVGNSTERINQAWIGGSVLASLGTFHQIWLTNFSTQTTEGTLN

SEQ ID NO: 18966 - protein, 170 aa, Candida albicans
VKLGETINDIADGTGVEYTFNRDSEETKGHSEVELTGSKSALKEAVAKIQEIIDEVENFVSRSIKVEPIYHRDLIGPGGSIMKEIISKAGGDEVPRNRQYKLLNIPNEGSGSNEVTSQGDKNIVDKIIAAIEKIVEEKRASVTQEIDLPKEKHRFNYWFLTTPWKDQVFP

SEQ ID NO: 18967 - protein, 832 aa, Candida albicans
IIMPTPAEIIAARLNRADATQNVYEEEEEEVVTSTETTPSTNAKPSITDEAAFPTLGGKKSASPVISNTGGASSWGPLMKTPVRSSTASPVPTPVQQTTPKPTNGIKSKVSTIQEAFSLDVEDQLNVARPEFIKILTFVKQETKTNIECTTSQHTKKRTFLITGRPDEVKLAKRLVIKKLTKPVKISFNIPAKLRSRVIGQGGKTLKPIIQANEVKIEIGDQVEGEDTGDDGTEEDEDEEEDIFAKTVQVTIDGDVEGSKRAKNAILAIVKEETKNLSAKVSVNETIKPFASKELKSIVDKYPTLEFAIPDYKSNRHTIIIVGERDLVLEAKPEVKAALEKLSNKVVVEEVPIPKIKQQFLPIEQVFEEHNVLIQLPKDGEGKVKFIGDKKKIAAAQASAKKTTSQYKVEILDMSKAHKGNLKHVKAVASVLTKTGVFDEIAKANDVTIHVPSSKDLESSATIPIEIVSKGDDEHIKVAKKAIVNQVNKITPDLTKTIEDIDEFLLNKVDDTIKDVAKQQGVEYVVSGKIITLFNFQQSNEDAEDFDDVSDPDSAFKKVDEALNKLRELAANLTSATLSVPSKEQDQVSGPRGTTLKSILASVEPNTVTVELHQPTSDEVYIHGIKSSVATVKKEIESVLADAKEFGNEYSTTIQVPSQVLSRLIGKNGANLNQIRDEFGTRIDVPLEKDESKDKSSSKTEVTITGVKRNVEETKTKVSALAKRWADETLVRLRVESQYHRRMIGPRAVYINRLQDKYNVKIRFPSENSANFADAPNSKDEVTIKGPSKGVAKAEEELKELYAFEKENGFKQVVQIPLKAIARVIGKAGGNH

SEQ ID NO: 18968 - protein, 544 aa, Candida albicans
QTTLTMPPIGSSDQFIHQITQQFVFQRLWTGNATTPELAPASTPYNRLVCRNNTDLFYATGNIVRCCTISPNHKNYKLFKVENQFYEVASLLMNKSGTLLAIIGEEQVDVVSLPTNVMKSSGIYVDGASFKIKNLRGKVRKCVWQTVAANDSTLVVLTDNSQIQAYDLTKSLEVPVIDVDLKRYANFANEEAISIAFGSSKNLAGGLTLYVSTLSNIYAIYPFSAKFGNLATTKEAIDIALEDTKAAMELIQEKYPVNLLDTATSTLNKAAIRQFEYYLHFKSQLSGALPIIKEVRDTHTNNPYELFVVSQTLSDWTGYSLQGPLISSNAGIKDLASIGDNDLVSILASIDANATVTYYAQLAPMLMKYNIMSIASEGAPSESSQTVCKPKYVKPKRGFGFIDNSEEEEKALVKLKQSQESFWKEELTSLDLLQRDKLPVDENDDATGFPTFFGEIDSNRFSVCVNSNKLVLVDCSWVKTFVDDLKEDKIDSVSITANYGITSTEKETITAFAYIKDDVTSTGEYLTVCRSKLVNDMGSYPDCG

SEQ ID NO: 18969 - protein, 80 aa, Candida albicans
NLALVEVVFVWSNGASFSSICKMTDIYEGSIIRALRREIELIKQLVDASKIIGNQELVDKFEKCIELINRDFVQVSSLYM

SEQ ID NO: 18970 - protein, 171 aa, Candida albicans
LKGRVAAELSTGDELMITELLFSGFFNELTPQQICGLLSAFIFQERAKELPKLKPELAEPAKVIHETANKIAKISKQSGLEIVEKDYIEQFNLALVEVVFVWSNGASFSSICKMTDIYEGSIIRALRREIELIKQLVDASKIIGNQELVDKFEKCIELINRDFVQVSSLYM

SEQ ID NO: 18971 - protein, 919 aa, Candida albicans
IEQELQKEKKKFIVKFNPLTIKHYNQLQKMDDLFDVFDEAPQAAPPKIEEIKDEVKPETTDNQTRSTKKRQLDNNNKTTTNSNNSSSSNNKKHKQAEDIKPVVFDSVEIETSREVKPSEGLSNSATVDADNKLKLKHQIRHQVAIPPSYPYVPIGEHKRKHEARTYPFTLDPFQDTAISCIDRNESVLVSAHTSAGKTVVAEYAIAQSLRDKQRVIYTSPIKALSNQKFRELQAIFGDVGLMTGDVTINPDAGCLVMTTEILRSMLYRGSEVMREVAWVVFDEVHYMRDKSRGVVWEETIILLPDKVHYVFLSATIPNAMEFAEWIVKIHNQPCHVVYTDFRPTPLQHYLFPAGGDGIHLVVDEKGTFREENFQKAMATISDNSGDDPASSDSGRGNKKGKTNKGRNHQDGKGDIYKIVKMIYMKKYNPVIVFSFSKRDCESLALKMSKLDFNTDEERNSLTQIFYNAIELLPEADRELPQIKNILPLLKRGIGIHHSGLLPILKEIIEILFQEGFLKVLFATETFSIGLNMPAKTVVFTSVRKWDGVGFRWVSGGEYIQMSGRAGRRGLDDRGIVIMMIDEKMEPQVAKGMVKGQADRLDSAFHLGYNMILNLMRVEGISPEFMLEHSFFQFQKASSVPILEGKLAQCKQEFADITIEDEPIIKDYYDLKQQLLKYNEDVRKVITHPGNILPFLQDGRVIKVKIGDLDYGWGMVTTFTKRNRRHQEEFAPHDAYVVEVFITTMFIDSPVNLIKKFNPMLPEGIRPAKSGEQTRAEFISITLSSIEKISTVRLRVPDDYKSSTAKRTLVKTLKDLPKRLPDGIPLIDPVQSMKITDDDFKKLLQKIDILDSKIVSNPLNNSARLDDLYAKYTAKVDLNNQIKKLEEQIFQAKSIIQLDQLSNMKRVLKKLEFTGSKKVV

SEQ ID NO: 18972 - protein, 121 aa, Candida albicans
VLARACENSITENLRENAYHNAELLDERLDNLGANLGTLINEINSVSDVFNKNLINELANKADARDSTSKKDDIKPDENNPFEEIVRLLNLHLENLKYIENAEEELKSKLEKLNKTKKLNH

SEQ ID NO: 18973 - protein, 437 aa, Candida albicans
MSRQDWFNGPVCGTDNCRSRLYRNQDGLTICQFGHVLEGAVEYNDDPDAGGIVQTRRLNTISFDERGHLSSAVVSNSQTIKTKLNRLYGEDAMALYYRCLQILLKKELKIFIDLFFSEGIRHDLTLIVKNNWVKLLSTDELQENHPKRQVIDTLDLICMIYISALQLQAYPIYIPDLIDNIKLNTIPYIRTLHLIPKHMLDQLPTVYHNRLQPYSLPENSQIYKRLQTTGWRTVGATLRIPTSFYFPFIFRILSEHFLLVNAVDLFVSAFNVLKSTPSFEINFRIKKFIQKFPEIYISSVLIILIRENFRSNDNLKPWLYELNKYELNNEYNSGGTSLLNWSDDKVDKYCDWIYDNLIPKKAKLNDDNTEALNTMEKRLFQIFSLDNDIENTAPETNETPMYLALRSIMNGSELKESGGLQELDTKLDAKLSNILGL

SEQ ID NO: 18974 - protein, 346 aa, Candida albicans
GETNQESESVLHNIDDGDESLYQQRLQTWVRKRASLRTQHQQEGIEEWFLPHPNIADAKLNEKFKLPGDIYPSLFDYQKTCVQWLWELYTQKTGGIIGDEMGLGKTIQIISFLAGLHYSGLLDKPVLVVVPATVLNQWVNEFHRWWPPLRCIILHSIGSGMNGSVSESKLEEYLESTDPDATQSSLHGIKSQINAQEIVDRVMEKGHVLVTTYVGLRIYSKHILPREWGYVVLDEGHKIRNPDLDISLTCKKIKTVNRIILSGTPIQNNLIELWSLFDFVFPGRLGTLPVFQQEFSIPINIGGYANSNNLQVKTAYKCAVVLRDLISPYMLRRLKSDVAPRFAQEK

SEQ ID NO: 18975 - protein, 524 aa, Candida albicans
KVMLLQDLPKKNEMVLFVKLTKIQQELYESFLQSEDLESILKGKRNVLMGVDILRKICNHPDLVYRDTLMKRKNYGDPAKSGKMQVLKNLLRLWQSENHKTLLFCQTRQMLDILEKFVANLSLINGGDFNYLRMDGSTPISKRQMLVDAFNQDPDMHVFLLTTKVGGLGVNLTGADRVIIYDPDWNPSTDIQARERAWRLGQKRDITIYRLMTTGSIEEKIYHRQIFKTFLTNKILKDPKQRRFFKANDLHDLFTLGDQDEEGTETAQLFEGGEQSQQKYSGTKPRQSRGLFKKKYKDDDDFSQVARISGVSKLDKFEDGDHNDGDGDSTYLANEDNRIMSSIFAQSGVHSTLQHDDIISGSKEKESSLVEKEADKLATAAAEALKKSRMQTRKNTIGTPTWTGKFGSAGKFGLKRRKLLNSSSTILQNLRQKNELTESKKPDDVKVEPDRKQIMENLVEYLGDQMDNFSTSNDIIKNVKLSMSTENEMIMIRSMLREIANWDSSRKGWKLKDEFLQQHQQQPE

SEQ ID NO: 18976 - protein, 367 aa, Candida albicans
QESTINMPEYTNFESKFDDIDMLEIPEDDDGENSIDNSISSETEGISDSSDSSKSSYDQWSPVAIFKSDKEYIDLSDWLNTQKSLEFKFDVQKYRKGIEKSRPFDEKYILYVNNMFKIIQKLTEDDITRFDLEEDDSPIGLVMDLMGSKAKQVRKFKKIDEALREIIDYLQDLVNSIPKEEQESYDSQCLQHVLYILECFEANNLYFDIQQKPELIIKWVNTFDPKPDPELLNDVIVNTPQPYLHPRFWNTCISQLLTRGLFTQIHEVIEHSQYQELKEKCPELYAVIGDMDTLLSNYTSYSSKGQFTAWKLLACEFRDSLSSVRNESITETKHKLIIDQIYDLACIFTGLPKTISSSCETWYEICP

SEQ ID NO: 18977 - protein, 396 aa, Candida albicans
YFKTAVSEKPPSDIFDDENENLDGLTEACFLNILENNFLKVLETLHELDPPTTAYLAELMELRFLLRGYYFDVTVTSSASFEDLLNRRIVSEYFLTRHAYDCLNIHELVPVGIGLLLNNVVCTSNNAVSANRKVIATFLPNYICNTNDDLEWALTICANLNLVSTAIQLYYQAGLKSLEEGYMYEALNNFVNCYDPTLLSGENHSEGMKKVHYIVWDLIFANCLVHNRPIKDELINNIVDKKVDLNFKIHPVIQQCLAPYAVLKEFYETLPQRDIKLSNKLSKLIHLLKFNYLPKKFVPLLLAQFIPFLSEPNTTFQLPDLVIIIELLDNYESDRNEKELKEGADLYLYSINNIESDADENDWRKLVGKDNLPKDIDLFTRLLRNLIAAKVGKVFI

SEQ ID NO: 18978 - protein, 121 aa, Candida albicans
ELFKHSGHTLVELSINSLDLLTKNFLSQVFTEDLHQFKKRLLQQLEESQDEEVEYYNHIRLPLLTYLDLGFVRAVDNELLSLIGESCPQLKIIEVYGDNRCTSKARIRPGLMVIGRQSDEI

SEQ ID NO: 18979 - protein, 531 aa, Candida albicans
SMARRQRSKQGSSSQSGVKGPNSALTEFLRNEGITDAFRQRRQREQETVNEGNENDNDANEPEQSTSAVEVTPEARRRSTRRSPSAPVEDTKDTNDDDDEIREMRRAAKRKLRAARRGSTRQPRNRHDPDNSGGDDSSSSSSGSDNDGDPNFSEDEDDLGNLNMRKFGEQDDCVDCGQTFELTVSSRFLKEKNGYLCNSCNQLLKARERKAKMNQMNARKKRKRVAQALLNKTDVKIPKLQDVCIKKITENIEDVDVLGDIGQMNMNRISMILSKNRSLNNKTISLFLSPDLKSLQFWDCSNVDSDSLNKIASYCPHLESLTLFMCGQLHNDNLQYFATQLTKLTELSLNGPFLISDVMWQDYFEEAGNRLTKFEIRNTHRFGNDSLISLLTNAGRNLTSLKLSRLDGLNAADVYGMIPHFLLPSKLTHLEISYPEKEELISDDLIISILSITDDTLVSLNLDGCSDLTEKFLIDGVAQFCPNLTHLSIQNLDQISDDGFAQALKEYLKVNVGGLLEVSLTKCIVLGDKAI

SEQ ID NO: 18980 - protein, 248 aa, Candida albicans
SHKRTLEKDEEHQEKKKANKISKDDMEIDAELLTQQASDSAHTDTATAAVAAVNNEQGKELEQTESSTNQTSALDKDDKETKDNLNPREETQSSHQEIDIPKDQLTNQQNLADQHQQYQYHQQLAQTNFKTEPTNSAKPPHGSEEWHRQRRENHKEVERKRRESINTGIRELARLIPTTDTNKAQILQRAVEYIKRLKENENNNIEKWTLEKLLTEQAVSELSASNEKLKHELESAYREIEQLKRGKK

SEQ ID NO: 18981 - protein, 62 aa, Candida albicans
PPTLSMDSTGTTIRKQKNQAYEEEKLHHTPWVEKYRPKSLNDVSSQEHTIKVLTQTINSGNL

SEQ ID NO: 18982 - protein, 246 aa, Candida albicans
  UNSURE (5): Identity of amino acid sequences at the above locations are unknown.
VTPPXEDLQNYPCPPYKIIILDEADSMTNDAQSALRRTMENYAGITRFVLICNYITRIIDPITSRCSKFRFKLLNNENAQLRLKYIGQQENLRFESENNEHQVIQELLKISGGDLRKAITYLQSAAKLSETFDINHHQSLITIQSIRETAGILPDDILAELIQFIKLKTQQSRLIKYIDQSIILSGWSAQILLDQLHDKLILDESINSLLKNKISQIFFQLDRKLNNGTDEHIQLLNVLLQISQVL

SEQ ID NO: 18983 - protein, 230 aa, Candida albicans
ARVFPAFVVPDSVEESTSSSSTTAAAGTTTINKRQSSSTINLESVPRYQQEEDGEGDGTLITQLDIETLKLKPWRAPGVDVSDYFNYGFDEFTWLAYCHKQDKLRGEFNPQKVMENIMKGPGGAVGANGTNGINLGDKTGQQQQQQQQLQQQQLLQQPPQPPMGMMMPPPGFMANMPMPPMGSMPPMPNMANMPNMANMPNMANMPPPPPGFNGQFPAPYNIPHTMNQKQ

SEQ ID NO: 18984 - protein, 217 aa, Candida albicans
SFQGPCVKNIPPLSKTTIYLIMSADENNKVRFERLRLVARKALEQLIKKSLTMEQVKTCFPTLVTSQDGVRSLELALSQMSGFWHANSLDEFDLIYKEKDIESKLDELDDIIQNAQRAKDSGTKPSNIDQLSPLEIVYSTIVSNSKNVLDSLQMIYDQLCLDNAELYTELSELTKESTRINNSIKSGIEQLNKEANSVELEKAGLQIDKLIDILEEK

SEQ ID NO: 18985 - protein, 341 aa, Candida albicans
FVIYNTYSIENYPNMRFPNVGLAELSKSIIKIRGPDATKFLNGLVTSRLLPNVVKKKQHTISESENRHSNFSEIIDVSKNYGLMHEDIYDPDYNINISRDGINSMILNSKGRVVTDCFLYPDPFHNVDWVFQESMNEPGYLLEVDTLILQQLMMILKLHKLSAKVDIVPDKKLYSYYYYDDTATFDAWLENIQFKYFKSLDPTTALQNANSFIKDNVFFNQQIAKNILGFAVDNRIPNFGIKFISNKPISTNNDNDGQQDVIPVESLFSESFSQEFDTPTINESGVVQRRFQNGLFEIQDASKGSSLLPFECNLDYTNGLSLDKGCYVGPDVFTSGLENPR

SEQ ID NO: 18986 - protein, 289 aa, Candida albicans
GVVKTADIKGLFGQIFVDFGDKFTVIDQTGEEPLSGIVSDIEKNGTVTMLDDNRHGLQDGDYVKFAEVEGMPKLNEGNPHKVEVLGPYAFKIKIDESYGEYVKGGLYTQVKVPKDLSFEPLTKQLAAPEYLISDFAKFDKPAQLHLGFQALHAFQTKHQGELPAPYNEQDATEAFRYAEELATQNPSILGEDKLDEKYLKELFYQARGDIPGVVAFYGGLIAQEVLKNCSSKFTPIQQWLYFDSLESLPSKTEYPGNEENHDPLGSRYDGTIAVLGKHSQKKLPLEKYF

SEQ ID NO: 18987 - protein, 71 aa, Candida albicans
RGSSALADMGTKGNSQVVIPNLTESYSSSQDPPEKVHSVVYFKIIPKQDRSYYSLGKIIIPRLFCRISRKC

SEQ ID NO: 18988 - protein, 248 aa, Candida albicans
  UNSURE (245): Identity of amino acid sequences at the above locations are unknown.
LNLIHPPKIHQKKSIPLCTLRSFPNKIDHTIAWAKSLFQGYFAESPESVNLYLSQPNYVEQTLKQNPDIKGTLENISKYLNNRPYTFEDCIKWARQEFETKFNHDIQQLLYNFPPDAKTSTGAPFWSGPKRAPKPLEFDINNKDHLDFIIGGANLLAFIYGLKEPNATVDDFKKVLEQVIIEPFQPKSGVEIAATDAEAEEKANNLSGSIDDEQIRKIAASLPEPSTLAGYRLTPIEFEKDDDTXHHI

SEQ ID NO: 18989 - protein, 359 aa, Candida albicans
  UNSURE (85): Identity of amino acid sequences at the above locations are unknown.
ISTRNNCYFTGTSLFASNWYSSTKVMIMSRALKFLPDVFPKIDNAAQVVLITVENFSSHEMIRDATRFAFARFIPIFKSDNDNNXQNNLFISQHLSKLITIIWSSSYLKISEYSDFLSFIGQIVHNFRTDDNIYQLLNKFITPLFQEIFQVLQNPVTEDENLRPDIIRDKNSLKRATLNFISSIVMNHLSSLLITESNKQELPEIIGKVFEYSYDLSDTTTSKLAIVQLTNFVNVFGGSGGKLDDKEDKYSENLPPIEGIDEFLINKVINLSFELPFQKQEFNLNDAQYRLIAQEIAILLKSFELKKHDEFIVVLSNYLLNMGLSQDLCNDFCLNLHNLDLKDFKKYFISFINKMKSGK

SEQ ID NO: 18990 - protein, 590 aa, Candida albicans
ETSLPQISCETFLSSVYKTFIPTFITDLLELINVSEATSTNPNNLLAIDYYTRVLIGIHSEIGDKYITRSQEIHNRHNLLKDAIRTQDMQQMVTSWIQILTNPSFAHSEEILNNTLKIVGQYVSWMEISLFISPEFINTVFSFLQNSKLRNTTCETLIDIISKKMAPQNKLELLSLLNLTEFIGTLNLIEKNKNDDDDEDEDVEFMEFVAKLLNQIGQELLIVLENQSGLLEQVNAQLFKLWPAILGCLNHNYDDVSQNVFPFLQQFLTLSKKNPQLYTVDLMSTLLNKLILKMRFDDDDDGVLDEDTQAQFLDFRAKLKSFQDTIALLEPQLYLEAIPVIINESIFETNVDDVNWRKVELGLYQLNGFSDSIRNNVFQISRNEINQSKPYLIFQEFLIKLINSDLIMKINHPMIQSNFFELIVKHYNFLVSRESNFELIIKILQIFTSPLGLFNENEKVRIRSWYLFFRFIKLTKPKLDNEALIESIVVKMQPLLVIKAELPTKDEDDDIVENGNFNNQQYLFETMGLLISLIPNELSQLKLKLIDLIFQPIFNDLEKCISIPESQRETIVILQAHHSLQAIGTLVRRL

SEQ ID NO: 18991 - protein, 360 aa, Candida albicans
NLASNQIMNIRGIEQLINLRSLNVSDNQLHGKINFKFFNFMNLIELDLSKNNLQEITGLQYLPLLRILNLDDNNLIKFDCKNSKLAKLLIRFNHIKKLDISKLPELRSLKFDGNQLEQIEGLENLRGMENISCKSQYSSKVVEQIMKSIQDIRQLDVSGNRHFNAISTFPFLSNLTISAMNLTTIPIDFYLLFPNVQTLNLSFNTLKDISGLNKLKNLRKVYMVNNKLQLHNQIMKGLRGSRDKLKVLDVRLNPCTQTIYPFLFTPSESDDSIDLENADDIEAFFKHYQELDKSQIWTMRDEEFLENLKYQDEKETIETRDIFDCFMVIFFNKLMKLDGILINDDRRNHLFNIFKELPQK

SEQ ID NO: 18992 - protein, 503 aa, Candida albicans
PNSLKEATITSVKFQHLHMCIEYNDQFKANLQKFINFLKNNQKMIDDIGDLSYHIHFEPGKKWKEYTKSEVKKYTEFLKVLRDAGASKVVHCSVINKYDMDTVYITEKEDLTKLGKEIQLDIDFWENLEILDYGESSIRFLPGVKLPDSLKILNIGGGYALETLAGFKMPPKLEQLSAGQGAMPSIDDIVFPPTLKSLEIPENKIYFLDYVKFPPSLKDLDVSQNRIESLKDVNFPSGLETLSLCFNPIESLKGVKFPESLQLLDISNIPNESMAGVKFPELLEVLNLQSSMTTTRGLKLPQHLKHLILSGNGINSINPLKLPNTIEILYLNQNHIKTLNKVVFPPKLRELYLGVNLITTLKNVAFPATIEVLDFEQDPFFYENDKHITTLKDVILPPNLKTLKLSYHGIKTIESFEFPASLRYLSLAYNELRLIRNVKFGNHLKTLDLSGNQDLQSLDNVIIPESVTELRVPPQLVANLPAYVIERANENRLIIKKDDIESE

SEQ ID NO: 18993 - protein, 717 aa, Candida albicans
PSQRSTLQLLSYCQSQNIPITITISYYLSTLSDLWDFIELLKNQQQTSSLIRYNLELEIIPGFLYNFSLNYVFDQISDSIGPLVETIMVYNYSGSFIFKNENFPYLKNLWFEDSNIKFNSNLPSTIKLLHLYPNRFGWNNNEPIIIKHQLPYQLEELNVGNCTIKNQATITHLDNLSSITLYMVKDSSANGGGQFIKQLVTNNLVNDKLNCLKVDFIWDSQRNLLDFQQLLLPSNDNENDREFIGEKLMKNLQTLSITNYIPFDVSNWKNLTRLKILRINNPQIFETCGRFPDSLQSLKLTNNNIKDLAVIDKLIGPNNNRLKYLSFSDNPIDWNLYVPNFTRFTKLKYLKLFNTQIGKHFHKINYPDSVEVLSLEVNQISSIQGIKFPAHLKNLGIGSNWIKKIYRPNLPHTIETIHLTENKLSQVDLSCNNQGQELLIEILYLNFNPLSNFKQVKLPNHLKILNMDNCKFKSISNIKFCSSLVELSFNGCELSQFENVSWTEEEEEEEDNDNSHSSSPNLKYLNLSQNDLTHLNVQFPSTLQVLNLSMNKLTSLNNTLTSTLQNLDQLQVLNLSSNQFQKFQIHFNSINLKVLDLSFNSLKSINLTFPRSTITNLQTLNLCLNKLTFLNDVMIGHNKNLTRHENLIEIDLTNNKIKSVSEINDNGGISHFPQSLKCFFIGHTGQQDRFGYDMAKNIVIDKDGNDGLCKAKRIDIP

SEQ ID NO: 18994 - protein, 476 aa, Candida albicans
  UNSURE (345): Identity of amino acid sequences at the above locations are unknown.
SVEEVMFQLIDDDALCRQSFNSTSSSLSSSSFSSAGISRANTITANSTIPENASFYSNHNKFRPKKTYTTNNGLERINSRHSTGKNKATSSSSSTSRDTRWSLLKQLTISETSISSVNRQSFKNLTNLVKLNLSSNLLESVPEGLEQLTNLRYLNLADNKITNLKGVENIISLIKLDIRKNPIKNLQPLIKLATKTQYQVYISSASTSSSSSSSSSIPIDSMRLLELEIGLRQKVKKHQSLSQNVISTSSLEMKLLSITTSKPNHEANNNTTTTTTTTTNFDPNPNHNHNNSIDKSITTKPTTTTTNTKNQNSTTNINHSPSLKLILILTDNNISSDKGIVSKPXTTTSSTTTPSTTSTTTPTMAKSPRFSLQFMHHLNDSNSSIPSNNSIKRSTTSSTLIDHEHNNNHSDGTSNSNSNSNNNGSSNSNSNGNSNGNSNGNSNGNSNGNSNNNNNNNNGAAPNIVTTVQVTVHMSS

SEQ ID NO: 18995 - protein, 218 aa, Candida albicans
THCYLLTLFYFKFPNSLVELALSGNAIQDLTSYNDVNKNWTDLVNLQDLDLYSNRIDTLQQWVPPNSLRNLNLGFNLIDELPNSWPLFNDMFNKQLQLVDLRLNVCSIEKIAEELNLPPQMKVLDLSNNSLTGPFYLLRSLKHLYVLNLAENSIDDIKIIHEDDDPCRLYLLNLSYNRICTKTRNKEAIEAFYEKLELGLNIKIRNKKFKVNSLHQLQ

SEQ ID NO: 18996 - protein, 305 aa, Candida albicans
IEADQDLTTGYDLDTDYIDLVHLKISSLEDLHLERFKKLESLCLRQNLITSMVGVKDLPDTLEELDLYDNRINHISSSIKHLVHLTNLDLSFNRIKNIKNIETLVELENLYFVQNKIREIKNLDTLTKVTNLELGGNKIEVIENLDKLVNIKQLWLGKNRIYKLQNMDNLVNLRVLSIQSNRITKIEGLENLKNLEELYLSHNGISEIENLENNINLQVLDVTANKISNLKGLSHLVKLTDFWCSYNQVSSFEEIGKELGKLPDLECVYFEGNPVQLQNPSAYRRKMKLYLGPSLNKIDATYVHS

SEQ ID NO: 18997 - protein, 714 aa, Candida albicans
IIPMVIARPDVNLFHEVAKLPSEVVAIILGYLPNCMLPELLYFSPIKKIVASTILSNVHITEIFEKHEGSDVPGVGYSECDCNMFRITLENLKKGIDKWNIYPKTIKTEFTDLFEIGWDVFSKLLTKALSIYGFFVGTSNYPPEELFELLMDSNVKFESLHLMYFLTPITLPPVATSVTLHQIKLDTYVIPGVKQLILHSKSINQERTNFTFSPDLEDLRIEAGLKMYVNLPPNLQELYISSTKTVNFRSEEMLKLKHLELQLPTIQSFEETGIRAPNLEKLVLSTCEELDCFDNLKQFQHLKHLVLNNCTYPTNLLKQKSFPMLESFQYSGTYFPNSDKMDIVTLTSPSTLKMLIVANHGFLHVFLDTLLLPATLTYLKLVNVVYNDDDGYFHLGENLQYVHIESFKLAFDRNFRIPHKVEFFLVEAFDLYFDSLDFMYHLPNSLIYLTLLAHEGGEMHLTNQRIKWPSMVDSIVLDGFNIDYRTLISLNFNESRLETIRICGGNIKKLDVDLFPVSVKDLALMDMGIQELPASFEKLENLHRLCLAKNRLKKVNSVKLPISSLRVLVLRKCDLRLISPFLVSMVEEENRDAKLKVEATGNSNINVIDVRKLLKAIKGLSLDINCVDEALNRISDNSTRFSCSSRLPDPYSEESGFSETEEVVVSDYDSDGLYNGSVFSPDEDDSDDDDDDDDDDDDDDNDDDDEDHKRRRIC

SEQ ID NO: 18998 - protein, 179 aa, Candida albicans
HPIAQQLEPFLKRFLASLDLLYTQPTSQPFPNVESYATQLGSNLKRSSAIIVNGQPIIPSPQEDCKLQFQKKWLQTPLSSHQLTSYDGHLIPGTGTFVVHFSAKVRFDQSGRNRLGESADLFQENNSIVSKTNQRPIWGSWFGVDVNLVVDENVMQDGEIINSMDYRFTYVPNDSIIKV

SEQ ID NO: 18999 - protein, 360 aa, Candida albicans
RKSVKPFKYERSGLSKFKFGAHVGMSGGISNAVLNAMDIGANSFALFLKSPRKWVSPDIKEEEIKKFHELCEKYGYNSRTDILPHGSYFINLGNPDPEKEEKAYGSFLDDLKRCEKLNIGMYNFHPGSSLDGDHKESLARLAKNINKAIEETEFVKIVIENMAGHGNLIGSNLQDIKDVIDMVEEKSRVGVCLDTCHSFAAGYDISDKEKFEDFLKQFDEIIGAEYLSAIHLNDSKAPLGANRDLHQKLGYGFLGLEVFRVIANSDRLKNIPIILETPVGNDDSVYGEEIKLLEWLEGRPIDNPEFIAKKDELSKLGSKERAEHLKKFEAKNAKAEKKSAKRKNGEDIMSALTKKAKKKE

SEQ ID NO: 19000 - protein, 368 aa, Candida albicans
  UNSURE (7): Identity of amino acid sequences at the above locations are unknown.
RTNARPXRTSVPNFKTHKYNKSLPAIPVHRSTTNGPNKSQVPKSQRETNLNMLTHASDPDKAPKIHKRSFSDESHVSSVSSFSSVGDFMHIARLQAMSPPAEKLRFINFNHGNNQNQLKIQPKSNNVKPNDSTEKLENPKKSETQDSRMLFIPPQNIRNVSSSSTSSFQSLGTSSSWDSLQKSIDITFGSRPDEEIVTKKSIKPTTKVTKILGGNNQSDDGSWLDTSESDSEDENNSNNQITQEYENTKPLNIHKEEVSNDKTVLNLMNVNNTEINRNFYFPNTFENSTNSQEVKDRVPQENNRKARHSFYSSNGQIEIPDLSDKRFSDEYSSIAPSSYNGTTFSEIRTEISVSDVDDESNTNLKIGV

SEQ ID NO: 19001 - protein, 525 aa, Candida albicans
  UNSURE (525): Identity of amino acid sequences at the above locations are unknown.
KIIPSKQQDKVFPKLPTTDIIPPKQETATSDKKLTPVPDRTSVPIFKTHKYNKSLPAIPVHRSTTNGPNKSQVPKSQRETNLNMLTHASDPDKAPKIHKRSFSDESHVSSVSSFSSVGDFMHIARLQAMSPPAEKLRFINFNHGNNQNHLKIQPKSNDVKPNDSTEKLENPKKSETQDSRMLFIPPQNIRNVSSSSTSSFQSLGTSSSWDSLQKSIDITLGSRPDEEIVTKKSIKPTTKVTKILGGNNQSDDGSWLDTSESDSEDENNSNNQITQEYENTKPLNIHKEEVSNDKTVLNLMNVNNTEINRNFYFPNTFENSTNSQEVKDRVPQENNRKARHSFYSSNGQIEIPDLSDKRFSDEYSSIAPSSYNGTTFSEIRTEISVSDVDDESNTNLKIGVPGRDAIKHLKQQYSALGDDSDADYASNITSLYNTGANSDKMQMKPASVQPQLECNLLVPGRRSPAKHARHKSMFNIDFDLGKGKNNSNHSRTKSVDILSEMTTFGKQQSRANTDSRSAGGDLDEX

SEQ ID NO: 19002 - protein, 521 aa, Candida albicans
TMYLSNLGGQSRKTGIRPKTNLKTDKYGMEDVDDFFEDDDDDRINKLKGQKLTIALPRGEEVSNYKSTISQPFNNIARKINFNQEDDETFNLPSTSSSSATVTASSVSNKKSPVTTQQSPLRSPLPEQDYDYNQFDVEEDYGNITEEDKQPSPPPPVPKTKSKAKTKAKASTTNNTNTKSTKAASSFTKKMALGKTKRLPSSFDSVNTSSVTEYYDEDDEDNDRDYGESQQDSIEDSMVDSTFNDYSQPSSNNNKTRRKIIKESPLPSPPPDNPNGLRRSKRTRIKPLAFWRNERIIYSKDLDYDDEQDTTLARDIHNIPLQLIKEVVHIPDNESVDNSGSPNTRTGAAGSTKTRLNRKRTYKQTTTTAPTDYDYESDPEISGSEWFKEDNLLLEVNDNGESKLRKIAYNHKGGNYVKPTDDNYLVASLFDEDKSFFAGGMLQLPSDGFKPPVTVTGSTYMFNVMKGLIQVTLNENMFVVTKGCKVQIPEGNEYSLRNIGQGDAYLFFVQIRKPEEIDTNW

SEQ ID NO: 19003 - protein, 102 aa, Candida albicans
RQFTGFGISQMMPTLQFFSENEMYDEASKYGEVVNVRIPRPSRNHTPGILQFNTSTGLGTIYIEFKDEKIALAAMMELAGKLYNDRTVLATFYDFDDFLMGI

SEQ ID NO: 19004 - protein, 128 aa, Candida albicans
SVEPSSVVVKNVDDADDDDDGTVTIPIPEDLNVTKVKVRNNRSKSNDKSDPKKKHKCPICESRFQRPEHVKRHLKSHSSEKPFECQMPNCGKRFNRKDNLKAHLKKIHGLVKGQEEFTRVLNENKEVS

SEQ ID NO: 19005 - protein, 760 aa, Candida albicans
ANMSQEFQPLFETTPYFNSQMLSNIPMTNGNTAGNGNGNTATTPSTGNNNPPNVNETINLLSFPETSHLSDEIFFNNYQFNNQLGSDSTNNNAFLSQQQQEQQQFLYNQQSQLQPPPPPQQRQDQRINQISSATSAHSFDNELASNISSNSLNTYFSNPHASSSTSSSSSSSSSSLSFSAGSTNNINNNIGNNNNNQATSKVPTTPQQFIHHGRQNSTTIPIDQLTLLSLRTPGTTKPVNNQLIPQNQFNNLQQPNFDSYSPTSQPPSQQQQQQQNQLSQGFQPVSSSNPALVNNISVDANTIAAAVAAATAATEDITVGPVLEEGTINPRQLFNNKLGTSMSSPSLSTLFVNNRAQQQQPQPQQQQLPPQQEQNIQSLPTSAIPPDQQSIQQLAMQQQQQQVPVNHKRSSSTPHFDFKINDDFTNSISSWFNNQNGLDPNQQIDEENNKLFVNPNGILKNHTHIKTRNHSYSSGVMHSSRGTSRRNSVQLLSNGNIIGSNGGNVNGGGVILTTATATTTNGLTTNSLHGSPITLTTAHFENINEENDSINDSSIDITSNPTGITTKPITTSVDEDGDAKHSRKRRKSSSAINMGETIGPLSDSPSISPTNSNTNNDTIMATSTVATKNITKEELMKKKSHSKSASTNNTTTATKNERKKLTTAHNISPNGNGNGNSQASFPCNECDKQFKRSEHLKRHQRSVHSNDRPFACKYCEKKFSRSDNLAQHLKTHIKTDANGNAMIVYGNPSNHGRKEKKKSV

SEQ ID NO: 19006 - protein, 163 aa, Candida albicans
FSYPPPLVTLYLNFSKTIISLFFLNIVSSFSLIMSAPAYYELYRRSTIGVTLMDALDTLISDEKIQPQLANRILINFDRIIAENLKNENIVGKSKLIFKGDLDTYRFCDDVWTFIIKNVIIKLNDVSSKDSGGGDKDKDSGDLELNVDKFKIVACNSRKAGEM

SEQ ID NO: 19007 - protein, 706 aa, Candida albicans
RQLHPFFFFFPTLMTTTTIANQIPSINTMLSNVNNNNTPSANSSQSTLINQEQQQAQQQAQQQAQQLQHHRQHQSRSGGTTTNNNYSSSSDPPRKRSKVSRACDPCRKKKIKCNAEYSELEKKVTKICTSCAKNKEICTFDRTPLKRGPSKGYIRDLEEKAGDRISSLSSKSNQASTKANIPFPPSHQYPPPPQQQQKQQSPSIAIIPPNPYPPSNIQQLPFPQNSTTHRVTGSISNTPNNNNNNNNINNGNSPTIKLPPIVNYPSKSLPSPLLSKFNSSISSSQTSNPSSPKSQLSNIPGLLNNDSNTNNNVGGGGGGGGSEQTNSPPIQGPFWKVPYEMPQSSLSRRSSIGSITSTNGGQPNILRRPSVESISSVSTNGSRLPSIRPSISNDYTSDAESEDFYSVQSFRPRSLSRNSQSLSPRNSISSMSSLNGRINRSLAFNSSSVTSPIMIGSPSQQAQVQQQQLQLQLQLQQPPPPPPSSNMTNFMPPQVPIFAPFATTNHIPLNPLDLNLKLYYERFHTIFPILPYDSRIIYNILNDKSQPPWDWLIEVFNHSLNNLINFQQVELQSSIGIFIRLIQSYPFPNETTTTTITDNSLILFFSSLIILSYTNLINGDQYNAGISFTSSVFNDYKICERFIDQITNNKKDNDINVDVNVDVDNIVNYFTKLYYCLNLIDNLNSLTLGPNKNLHLQRIIKFLNHH

SEQ ID NO: 19008 - protein, 409 aa, Candida albicans
ILRDIGLFNSTIVIFMDDSVRSLIRFVSRGFYSTPYVLILDAVLRHSVLSEDDLIHLLGIKRKEIRSLCNRLVDDRLLTNHIQREDNGQQKYVTRTYFFIHITEAIDSIKWKVHSIVNVLKQEMSSFGNPQGYVCPRCGNKVSQLDAISMLSEDKTEFICDVCQGVLIEDDSSQQATLKQERLEKLMKQLDPIIKFLKIIDETQIRDNDFESALLQAIPAQSATTASYTLSNRVSSKSRSNAQAMQNAAARSQATLHVSITANDENYEREQMEKENRRQKLEQNALPSWHSNSTVGQSNTFGKLEDEEDDHMGTPSSIKEEGEQGEANTDSKEIYGSDSKEGTTEQSSVMATPEPQSTVNNNSNFNNVSAELKEREAQDALAAYYAQLAEQDADEDDDDDDDEEFDDII

SEQ ID NO: 19009 - protein, 466 aa, Candida albicans
  UNSURE (29): Identity of amino acid sequences at the above locations are unknown.
FLPTRMELIKLLSTTIFRYLNPQEFFVSXKILSEEYELYDICDLMLSRAAYLYILCNFDECLNLCVRILNKDEYNFDVLPHYLSCLYELGGKNKLFLKAHQLAELHPINPMTWLAIGTYYLSINKMVEARKFFSKATLLNPNFGNGWIGFAHTFAAEGEHEQAISAYAFAARLFPGTHLPNLFLGMQHLQMNNLNLLEEYLLASYHICNSDPLLLNELGVINFHKNQFDKAEFFLQEALNAAKNLNSDSKTWISIHANLGHVYRRANQPYKALDCFNQVLKISNKNDANILSAIGLIHLRLQNIFQAIEFLHDALAISPLDPIASDLLKRALEANKENQEIFSTTEKLFQLNLPIERRKYESSRLAKQQRQSRCSISGGGGGCGGEENTKNIVTPLTTKIRDRHINVGNSSIDPVLFVDDPTGRNEDIQDDGEPEGEGDDVTLLAQELQNGEASSDDEDVMDIESD

SEQ ID NO: 19010 - protein, 481 aa, Candida albicans
  UNSURE (28): Identity of amino acid sequences at the above locations are unknown.
IMTDPLTFLDEFNEFFYFPEDNDTFAPXEIGKLKFGSKINATPKSIEVPSSYLDFSPETMNNLPYRLSISGLPSFSRVETQIKMNLTINAPFTNHYVHITPDLISKKKLCLEEPYSNLDDNIKKHILEFDAYILTQSNKSCAVCPRCIKREQKRASRSKAGEEKSAVWDCDVERKAIIINNKEIIAFQSGVLELSARIICYCRHHKELEGFKLLIVLKNHLGQVVAKQISSPIMIMDRKKNLKDSAPSSSANLVELDKKKLSISDSDNEKLMTNQFVQLSPNSLDESASEALATTDYETRGVKRKKLSVDDSFNTTSNPMYNGFSGYSPMSNSDTNTSAISQSFSGPTISKPSLAQFSIGFSPISQPQFPSQFQSQTQLLQQQQQQQQQQQQQQQQQQQQQTVPSIQKIIPAQGLIRGGIEVTILGFNFRPGLLIKFGANQALATHCWSETTIVTYLPPAAQPGQVLVTFENQDNDNVGGP

SEQ ID NO: 19011 - protein, 363 aa, Candida albicans
KRFLMNLYSGKAVENKRILRRNTLQTKSPDQDENTIKKDTDDETILETIWFCKILLIFAIGEMYLGTESSTHARRQKLENMKRSKEKREKHALPGSAFFYQASELFTGLFASGAIDNITKDGGIEVMLLYAFYLQVADCTIASYFYFGLALRAALILGWHVDADKENLNRFELEHRRRIWWTVYMYERMLSSKAGLPLSFADDSVSTELPIDFKIDLTDFPRDEHDVRGYYIFPPADYINNCVTITQINAVILSSLYTKQPSFNILPVVTDLVQRLMAWKTSLPKYLDVDYSVDNPKVSRLVTNLMTEYFQGINLAVRPLLFHFATKKLKELQMQNTQNKYIDLTKYSKIFTTRRQHRDIIPG

SEQ ID NO: 19012 - protein, 507 aa, Candida albicans
KAVLACLNCRKSHRICILQTNGNSCQSCITKSIECQWTSQESQVTTNTSVRNKKYERFRQEEQIYSTVVASENHQQVNGGSSGGSIGGGSGSGNGKFQFICSTHPIASFLSTDKFLCFDGDKFGLFNPWRSSPNIETATSTTSIEVDNPNLTEYLNREGAFILPPISEQRQLMEIFINKIYPFFPVIEISDNKDSLNKFPPLLLNAIFLVASRCLPQNDNKDNNNNNNQPIRERCQELFERCKLLELCENNKIALIQSFLLMSIHEEGINGSSLSKEYITRACNLCGDLGITTLSGSNGTAVQDTQHRVYKKLYYDKSILIRLFWISYACDILSASTHAREVYYNMNDVFIDDVPKEFPELIKFVELLTLLYRTLGSHYRPHKGRIIDEKLFTDIQNWNSLVDHPWLKLLYSYICMINLRCEVDPITLDPQLINSLQIQFDNVANIDPFWFKFHIVGVHSLLHVTSLLNLLGNNDENLDTNNKIKTRLEDLKEIWWLAASGLKLFGK

SEQ ID NO: 19013 - protein, 208 aa, Candida albicans
SDSCTMDSQEPSEEKKIANALINSDTIPLDLQPPSSPSVSSPMTSTRSNLETLSPLNTNTSLNPRQKRASLACIRCRTRHIRCPGGDPCRKCQLAKSKCEYVEADKKIVVSMKYLSKLHDEIARLKKDNAGLRNNLKEQELKRVDAQQGRPQFANTTPANRVSPLSMASNVMGSQNFSQPHSQTPQTIPSVLNTNTISKWRSDPSVVG

SEQ ID NO: 19014 - protein, 637 aa, Candida albicans
  UNSURE (4): Identity of amino acid sequences at the above locations are unknown.
CKLXTQTKHPTNRSNTNSTNSNVTTQGLSNSNGNNLRFLYDKDGRLRYIGESSPLSLFYEARKIFRSIRGVSEFTDDPDTVNIIDGISHVKQSRVLQMPKREHALLLLNLFEANINQTWYIYNREWLSDQFIKVIDDPLNISPERMAAFHLIFSLGLLFAEKSKHGIVEKIGAHSSQYFESGFDLIRNILDDGGLWMTETSLLMYFYYQSTARRSSSWMMLGNAIRNAQALGLHRRAVNESFPNPQYIIHRRKLWKTLYICDRISSIMLGRPLSISDYDWDDFLIPRDKEIITNDLNGDISTICLDANTRLSKILGHIVQNFYQDGVVNLMKAETIAIELKKWSFKLPSTIQIDKILKTSQTQISYEIDSSVRPAMSDNYPILLIHIMQLYGVMLLGKPIFMYLLFKKDQNTDNSTDRQQKVLKNFCSASIKASVLTIQAIHIYTKCHPQRIELYITVNCCCHAAIMLGLTILYRQTNSDYEKDEYSIDDLMQQLNIAKSILNFYGSTNTISYRLHTIVLRLINTLTLQAQPQDENDELLSLPIPTPFQERVENQPLPEVYQTQFDSKEPTDQGESIFNTPLENIINFQQFFVPSATNSEDNNSSRTSLKESERRMDNVPQVEEFMYDVGMNDLLLQ

SEQ ID NO: 19015 - protein, 231 aa, Candida albicans
  UNSURE (70): Identity of amino acid sequences at the above locations are unknown.
IMFQWLLRGVHEATRDHLDHALILFTKMKRLGNYRAALRRAQLLKLINVLDFNGVMAELLEKHDDDNNNXNNNTSSRSSSNNSKTLPGSAITNTSDNNVEPFLNPPPIRPGDLDFLQFTNVQGNEGTDGMDGVSNANVGVVGIGDVYANQDLTGIEGLTYLDAEQKLWSDITNEAGWLNMHSAEKDTNITERDPLDEGFIFNTASPDVGTSVHSGYSNLINHEFQDFMDQS

SEQ ID NO: 19016 - protein, 375 aa, Candida albicans
PTSGVKGNASRSYMYVGIAARMALILGLDDEPKPEAGLSDTENFIRMEMKRRAMWSVYMMDRCNSSGRSSHTCISLDEIKVRLPCNEKEFIFGVGKEQPLRSGELVDLSLCGYQIVLFETWREISRWVGITGAKLEKIPPWESTAPYYTLSKKLDDFEEKLPAELKYNEFNLQAHIAGGSASDFAYFSGLLLLCRVFLNREYFYASPEASPPGWWKEQATILFDSLDKLDQIPKLLKPLNLMVIAPFTGFHVFSTAATCLYIAAYPKKVMKTHFNGDVIKKYQKMAHDNLETLFSWLDSWGLGKSWINTLKEMKEVFARSTDYDQLRFKMRDYGNIEKKPDILNLLVLDEAPILDFMNNLDLPNIFPDWNDAMNI

SEQ ID NO: 19017 - protein, 829 aa, Candida albicans
KKHINIYNKNRNQPIYSENTFFLPNTINYCQRLYASYRIPKFIKFYSSIILTKKMLEKIKREKPVKVRKHVSSACLECRRRHFKCDGKQPVCDRCQKSNKPCQYVASHRGGSRKKGVSTKKKPVTVNDINQGPEMPMFVADIEDFGKSKSTENSANDGNEIKSNDEMLEKLMTLPCAHDQNRCQDLNCPGKSAVRYMKSRPEKRGQLNESETHMMETLRKRIKLESTMSNIDCLFSDNNPPIDIRSFKELEMTTAVHDPSNYVDLTVLDKDVILKNYYETFHKAHPILPAREEMLIYMSNLSIEKELLPILSIVSDGETTSVYARAIDLVSDRLIQCVEVVKSFGYIDIVSLQVLTLVSFVAHVSSLHALSKNLRHFCIYLLQDLQINLLDAPSKHGSNDMTPESETNAPLKVFNSPRLSHVSRDSIDQCARRLFWELNFVDIITGSADGKTVSSFDKIESFVDFPTVPLRDEFDYKGRSEAGTLVTYAMKMNIEITNKRPYDILLTRLQASLSSWEMRLEDPSLFEAPPLIDKSGRVNEGVHQAILLFNYAKIFVHRPFSYLWKINSPQHPKCNGEAVDSTNVPPQLQANSRTTIETRKTIEGANSIVQVLMDTGASKVFQRTHFFACALALSSLVHLSAYIWVETTLAVDKAQAFGLNEEDLDVYTEYIKLALTAIYPISKHWQLSGKLAKHIRDSLTTLRPKLYSKLKDFLPQLEIGMEKMKIREGDSTGEDSSRSLALPMNAVSSSTTTTNYDGLQSQDNNNSTLLNRQSALDIHDGAIPGDNISGLYDFENLSWEPVSPISPSGCDWIDKGLLDFNFDPFPSTL

SEQ ID NO: 19018 - protein, 400 aa, Candida albicans
LHSLVKSSISILMNPPEPVVTPSPPAVSGNYEMKQKSVSPTSGLPKKGSFKPNHERSRSTPEATISKLELHHQQQLQQLQNQQNQSATPSPTPAFQRGIDLRSKERNTENAVIAAAALTAAVDNPLPLKTVEQKPVLVKERAQVVPVSVVPAVSKSEEDQLTEPEEEDEEEEMVEARVVPVPVPMPVFVQMPIDMNHSQIKQEVASDSTSKPAIPSKEKYVPPPLETYQVNPDSGLIGCICGIEDDDGFTIQCDVCFRWQHCVCMGYENAEEVPEDMYKCYYCDESKWGKFDPEASRLRTMQRLEIDRREDSNQASVKTLPQQQNQQQGTKRKQLNSEKADNKKRKTEDKISTNTNSSNSASGSPAPKFQNPRPDEMDDLPNKDNELLADSSPRDSHEPH

SEQ ID NO: 19019 - protein, 295 aa, Candida albicans
DAKFLCWKSGFKVEKGSSYSKKLAISGFRNELELGINSVQLKFIITLNKRIDVDHLNSKLTINAKLVEKLLHLLYKSEFSLSEDDKYEESSSYLAIKLDQADALQEDDEITPQYYCVCREYEYGTMVECDKCNEWYHVQCVKDVSNPDADKYICPTCLVISMSSNYNQFLQDQITLGELKEIYAHGELLNAQSINEMIIMKDLIDELTKHHIGLQDQIARVVLQSDITTKLDCLRFILRKLYGNGVLLNDIWDHVLNLIREYEKILEDAKKLSSEIKPIENVPTTDNVEQVTLLG

SEQ ID NO: 19020 - protein, 129 aa, Candida albicans
TTRETKKKMEEPTKRVTRVNRGQNMKRHIEELLSNDVKYFSSQSTESTNKKQRVEKDVKVTKSDTEDHADTSSQDEYDGEVRCRPCGATKDNYDEDEDTLGDMVQCDQCKTWLHAKSMGYQSKRALTAV

SEQ ID NO: 19021 - protein, 246 aa, Candida albicans
ILFQSMTEEFVYKVSIKKNISEGMARDVGGKIFTFGSYRLGVYGPGSDIDTLVVVPKHVSRNDFFEVFYELLKGRSELEEIAPVPDAFVPIIKIEFAGISIDLIFARLDIPRVPRDLTLDDKNLLKNIDEKDLRALNGTRVTDEILQLVPKPTVFKHALRCIKMWAQQRAVYGNIFGFPGGVAWAMLVARICQLYPNAVSAVIVEKFFHIYSQWAWPQPVLLKQIEDGPLQVRVWHPRLSSTRRGK

SEQ ID NO: 19022 - protein, 451 aa, Candida albicans
FFFLIILIVRMNTKTYGVTEPISTNGPTPKENILNDALIQELKNRGSFESEQATKKRVEVLTLFQRLVQEFVYTVSKSKNMSDSMAQDAGGKVFTFGSYRLGVYGPGSDIDTLVVVPKHVTRDDFFSVFADIIRKRPELEEIACVPDAYVPIIKLEFDGISIDLIMARLNIPRVPLDLTLDDKNLLKNLDEKDLRSLNGTRVTDEILQLVPKPTVFKHALRCIKLWAQQRAVYGNIFGFPGGVAWAMLVARICQLYPNAVSSAIVEKFFNIYTKWNWPEPVLLKSIEDGPLQVRVWNPRLYPHDRLHRMPVITPAYPSMCATHNITSSTQKVILAELSRGSSIMQEIHAGKKTWSDLFEKHSFFYKYKFYLCVVAASIDSAEEHKKWSGFIESKLRQLVLKLEVAEGVEIAHPYVKDFSNTFILDDKNAEDIINSYGTSSLHLGERRPRLV

SEQ ID NO: 19023 - protein, 150 aa, Candida albicans
SLLKMGTIATMLIEAHEIMNLYGTLKGHDRVKGVLHAENNDNNKENVENKVELHMTKLFIGLKLDLSKEGEKKLDIQYPCAEFFNICKGWQDFDSEKHFIQIKNVKLYDLLDDVYVDGETRPIKIAKRKRAVSKNEGKKKPKSVGTVSAA

SEQ ID NO: 19024 - protein, 164 aa, Candida albicans
VKPIMPPKRKLSQSSAESSPVKKSTEESQNVAVTHSPQEYLDFFTSTLDMVFNLRDGDEELAPPFIKLPSKKFYPDYYHLIKQPISLNEIGKRIKTRYSGTSSREFLNDFELLLENASTYNSPDSWIVESARKIVNFVEGQVEEFESTSSTNLSTNKAADDTKK

SEQ ID NO: 19025 - protein, 83 aa, Candida albicans
RSSVTFQPPWAEDKYTTPATISRCGIVWFDVSLISLDAHLHKLVHQLNTYKITNDDMIRDNMLADNLRKSFVEELSNLLSYNV

SEQ ID NO: 19026 - protein, 368 aa, Candida albicans
SGICEVAKQAEHIMEFSFQRAIGSLEVCIKTYLRRLLNFANSNDNETVEIKKYVQKALLLSIMWAFAGDSSYEDRIEFANAMKDKNILWGVEMPHGNVLDYDVSLPDGEWLDWNTSVASVELEPHQVSNPNTIVPTLDTVKHEQFIFSVLNEHSPLLLCGPPGSGKTMTLFEALRKSPQLELLSLNFSKETSPVSLLKALDQYCEYRKTNRGIQLAPRINGKWVVVFCDEINLPQVDKYGNQNVISLIRQMVEHGGFWRVKDNQWVSLENIQFVAACNSPNDPGRNKLSERFLRHVPVIMVDYPGYTSLTQIYQTFNMAILKCAPDLRGFAKAITEASIQVYEKTRKKLNIQIRTQYFFSLTMSNTQY

SEQ ID NO: 19027 - protein, 203 aa, Candida albicans
ELVVQSIGETILPKLIKEDEIVFEKLRNKYFANVVGKVLDKSNLIAALEMYFTKNGVQFDEKFINKALQLIDIQNTHHGIMLVGESGSGKSTILDLIMYALSVVTNVEHTKVLIDAKVLSKDEIYGKLDLVTRDWTDGLFTSVLRKMSENLRGELSKKLWIVFDGDIDPQWAENLNSVLDDNKILTLPNGERLSLPENSSTRR

SEQ ID NO: 19028 - protein, 776 aa, Candida albicans
MMGYILNNWENNISMVQVLVPKKSLLIEENLEIVTSKIKAEALKINDFINSLNQNWQSKKPIAGNLNPSVAMIDLDNFQMHFSKLTAYVESLINISNHLDIHIVPFEDMSLSIDEIKDLKSVWSSVNGLWEELERLKKLKWSDLQPRQLRHQLDDLLNSARNLPMNIRQYSAVDEIQASVKTHLKTHQKISDLKNGSMKPRHWKILLSQLGVPDIKFEDLTVGDVWGLNITLNFQTINAMVEQANSEKTIEENLNNINNNWALITFELFNYENKCRLVKNWEQLIDQCNTDINALTSMKNSPYFGAFEREISELEKKLTQLFIVLDIWIDVQRQWLYLEGVFGNENNDLKSLLPIESSRFTNISYEFLNLLKRIYKFNLVIDIVLITDLQPMMTKCFESLVKVRKSLTDYLEKQRELFPRFYFIGNEDLLELVGGSHDITRINNHLKKMFSGVERLQYAKESSCIVGVVSEQGEELVLHNPVSLIKHTRLHEWLSELELEIKLTLSRLVKDNIKLLRETVFKKDGLVSLIESIPAQVATLLQQITFTSLIENPTTLLSSLHESLSNTIKTLVRAIGSEIEDLTRKKTQYLIIEIIHQRDVVEQLINAENESDRKFIRNIQQRFYYDISNTDLLKSLTIKQANSEFIYGFEYLGIPEKLAYTPLTNDCYLAMCQALSIQQGGSPFGPAGTGKTESIKALGHNLGKMVLVFCCDDSFDFQSMGRIFLGLCKVGIWGCFDEFNRLDDKILSAISSQIGSIENGLKNPDLAPSVSIFENS

SEQ ID NO: 19029 - protein, 408 aa, Candida albicans
VIKLFDYSSEFKLILASKESGLILHPSVASRASIINFTVTSGSLENRALDIALKETRPDVEKERTDLVMLNGEWKLRLQTLEEELLDSLSTTPGEILDNDNVMNTLETLKSETDGLNEKLAHSGEVMNRVEEIRSNYSDVAKNLSGIYTIFESLGRLNHFYKFSLTRFVNNFAHLLRVNIKLSPSEFIMELFKDSFARISTSLQYKHKIVLALVLSTAYYMEDIGDLYKTAFMKMLKLIVTDKLPNSISDVFDVCLARRESGWDVEKVLQLNQDNLVLQILSDLLLSFGSTKNKEDFVDTFSKISGFLYKDGEAPYSSPYDLNYWINDLGIRTIILTCPEVYDASYKVEQSARQFGKKLAVISMGTKEGIEMANKEIEAASMSARWVLIQNIHMAPSWISHFESQLSN

SEQ ID NO: 19030 - protein, 489 aa, Candida albicans
FNTMEELVTPLLSVNQLYDCIIGFLPFNENVPKFTQCEDVLTKFISNNNQDTLYLIKSIEEKTSRISNDLSDLDMGFKDLDTFVIIIKSKGELRNDIPLTQQLNIMSIPIPQDENHETNDLFEKLRLAVSLGLSPYFDFISTKNEESALATTKKKFNELSLALQHLQQRIHIPDLLITTHPKIKMLIAEKGSEYPDELIDDTEFLNEITSITNNWVRQIQSITRLNHEPSDGDSIMEDIQFWKSMDLALISLNQQINSPEVNLTRELLSKAKRFHITLSFENDIGLKEKLNETKLYNSFLRELPINDLLTITDDDGFQKFDDALANIFSHLKLKLNLLPLERAMKSVEVILNDITEKFQSLLGTYDLMSLSLDKFEELISLCNKELDTIEVNIKFIINLLRELLRKRQEKFKLIKIDQTKLENIKERLLYLRQFRHNHQDLMTGIESVLPQEEQLDLISKLNEAYNKHIISINPVDILLPQGLEGPAIG

SEQ ID NO: 19031 - protein, 140 aa, Candida albicans
VEEHFESQLSNLHAESKIFLTCKNTSQVPIGVISQCKVLNFENEVGIQRLVLDTYKSSSMDKRERIERHVLLLLIWYHSVILERVRYSPVSFKKKYDFNDSDYTCGVHIIEKVFESYDGKTETIPWNEIKYLIGTITYGG

SEQ ID NO: 19032 - protein, 132 aa, Candida albicans
LGTKFFLPACVKTQMFKEVAENNFPNINLNATFKEPVFFSNWMSLDYKSVNEQELRSFVSLRLRVFSEEEMEVDLVLHDEMLDHALRIDRVLRQPQGHMILVGPSGSGKSTLAKFVAWINGLKVVQLHVRKE

SEQ ID NO: 19033 - protein, 554 aa, Candida albicans
KKMVAEVLEDKKRPIEDQCDGNSSKRPRRGRRSRLRRYKNKDIDETSPLGVLQLEIKELLEKHNLTKEDVMNDMSAILNDPELLEKYNNRIISDVKVLALTSNGDSLAIIPLVDPERKQVVLIPFALPNDVVTIKVHKSHPMYVEADLLSIEKSTSMRNNELINCRYFGKCSGCQFQNIEYQQQLAIKKQTIINAYDYFAPKLVSQKLLPEVLPTQESPLTYNYRTKLTPHFYIPNKKTGKDLPCPPNLGIASKGRPTWRKSDFGPEGTNIDIEECNIGTKIINQGLANERRRFNTEYVKYSKGATFLLREDTKVLQEDTVIGPGSVDENGQVSKIEVELEDNTKLVKTCVTQTRQIVQEYINGYIFEFSAGEFFQNNNSILPIVIDYVRSNLSLSEDQPNYLVDAYCGSGLFSITCSSNVSKVIGVEISADSIRFAKRNAEKNNIKNANFIVGKAEEIFASMDTPNNQTSLILDPPRKGCDDVIFESIYQNITPAKIVYISCNVHSQARDIEWFINSTVNGNQYYVESIKGFDFFPQTHHVETVAVLSLKENK

SEQ ID NO: 19034 - protein, 140 aa, Candida albicans
YDDVLEFLRRQTTFKGTSVKELKDGWAGCVAAIDELESQGKILVLRNKKENAPRLVWANNGGELGYIDTEFKDMWDQVKLPEPDVLYQKLLDQGLKPTGADPNLIKKQPQQKEKKQKKARRGKITNTHMKGILKDYSQLV

SEQ ID NO: 19035 - protein, 257 aa, Candida albicans
TNPTYFMKQHPLVTAYKGIDDLQQLKKWFYEYNDTIDHRKKAISKVKGLLTRGKLPHGVEATSLLTSIVLDDLQRKDIDSCVLQLSYTMALIRFVNGLLDPYQQSNYAIPMHLLAKQLNLPTYFVELRHMGTHENLPSLDILRSTCSKALTWLYDNYWCHVEEANQDKQVSIGGPLTDAVEFRSNDLRTRIEDSQIYNNLKAFKRIRKQDLNKVYEKNDTTSDLAATYHRCVLDIVEFAKENCDLLVNVLLLKNYLI

SEQ ID NO: 19036 - protein, 459 aa, Candida albicans
GRGLPFRGEDAILGSANTSGTNIPVRNQSVSFSDIDNQERSRRFTISAKPSTVNVPQEVQLPQSSRHPSSAAPSRQSSVKTKRVTSPVNSGEGNVYNDVLTFMTNHSHGKLNTALPSNVHVGAIRSDNSSPITPEGAIDPGFNFDYNKNSLNRIASPSPPPFSRSNGSSSTSSPKRSKTPNTQEPVPPQEPITTTEKLISEPSSQSAIKPLPSSQIVQPIKITGTGSANSSRRGSLKKSNKTIVSSPIGPPVPFQQFLSKQDDGKFHILLACTGSVATIKVPLIIDKLFQIFTTSKISIQLVLTKSSSHFLRGCKIHEDVKIWRDEDEWANFSDAYNSASTTVCSTMGNDGLNVVNKKPKNPFEKLILHNELRKWADIMLIAPLSANTLAKIANGIADNLLTSIVRSWCPSTFQQVKKPIIVAPAMNTFMYTHPITAKQLNIILSPDFGLHHGAGRYRA

SEQ ID NO: 19037 - protein, 206 aa, Candida albicans
  UNSURE (99): Identity of amino acid sequences at the above locations are unknown.
FDQFPEMSIFKPRTIVKQSSTLPTATIHELTKNQHYCVSKLPALPSVFKSQADSFTNAYSDSESNYSLVINEDSIFVWCYKSTDATPLSIEFPIDKSIXQLPMAILTRPSSGTGQDPGIIILKSVSGLIKFYESGKHAPTLGMINDKSLEIDIPLEKDEYLALAKNVEPTGLMNGISLQRCILISLREFKSKPQLRYLESLNNERF

SEQ ID NO: 19038 - protein, 272 aa, Candida albicans
QYCKDNPKNTANVSWIRYLLDTEFAEASNSLIVAAEENDSLDNQHIKYSLAKLSSVASGNGDNLKDINHELLIIKYQKIIKHLIADNGRIEAIKKPTFTKNFVNQEIDKQFIEPIVDIYFDRFVGGFELNNSEIINLLTTVKPSISNKSGFSYAFKIAESIYNESIANYYSSMVLMRLLVLGDEKLYQVNDNDKTTKRKAKESALYKTLKQNPGAISKLDQLLNNPEINNAEYEDSITIKEFNESLLSQLTKQLGNAKFKSWVEAVKEQARI

SEQ ID NO: 19039 - protein, 241 aa, Candida albicans
SGHPKELMNHIWQVEKFIISESDHLTLLNVFNQWNINLNKFKGNYTKINNWCDKNFLQLKSLYRAKDIKHQLMLIMKKNKLAILKSKTDDDIRKCLCASFYQQLAKLTKMNLNGQPEFVNLRHSYMKMFLHPTSSLLDSNLSTNYVIYHELVLTKKEYMNCVTTVDPIWLLEYGYKFFGVADSHRNKIDSEAILNKQKFEKQLLKDKEIYDDIIKQQSKRRSNEISTSNRVSSLFKKQRGI

SEQ ID NO: 19040 - protein, 724 aa, Candida albicans
RPAGEDRKLRASLSPSSSVPSKPQGVSSNLPFRPATPPVSEPSTYEEEDLGDINLDNFSNIEADREWYNIDEESALARNNEIDEDLPQRQRKRIRNTRHPKKTPKTSFNESGASFNEFGEYIDYDHQKSLNELNRIPITSHVFIPPFLENLKQYLQLQISGSSIRGIGPTVNPVKDHTSELASMAKQGSFVVQNKRSKRERALQAKEAAGVENSNIGSIIDTANTTEEIKQEEKNADVNETKHQDIQQQRQLLPAFAVRNDLLTTIRDNQVTIVIGETGSGKTTQLTQFLYEDGFGANIDKNGEKRIIACTQPRRVAAMSVATRVSEEMNCKLGEEVGYSIRFEDKTDNQKTVIKYMTEGILLREISADPMLVNYSCIIMDEAHERSLNTDILLRLFTNLLAKRKDLKLIITSATMNANRFTKFFGVAPQFHIPGRTFPVEVFFNRDVNMDYVEMAVKQVLTIHLGRWNADNNNANDGDILVFMTGQEDIEITCDLIKEKLNLLEDPPPLDIFPIYSTMPQDLQKKIFNKTNLQRRKVVVATNIAETSLTVDGIKYVIDCGLVKVKVYNPKLGMDTLQVVPISLANADQRSGRAGRTGAGIAYRLYTEKATEPDSMYVQPIPEIQRSNLSNIMLLLKSLKVNDINSFPFLDPPPKDLLNCSLYDLWAIGALDNLGELTKLGHSMTQFPIEPTLAKLILLSTQPEFHCSEIIGEYGWHGIRWPIF

SEQ ID NO: 19041 - protein, 753 aa, Candida albicans
NIKRKESHISITNELTKLPKEPLNSLYDNKTYTKLTSFKHTKTKSSKYRSSTIETSKQNSQSNERQPSSTTSESNDRSGHFADSNQRKSLLDPSTTTSELGPPISLSQTPSYASSDTSIAESESKFNTKTVLLDEIQLLENDKTTKKKQTSERMVDFEFPSKEIYETQNKKEQHQQSFYDQDEDNKDDDDNDDDDDDDNSSQFSFVHDMKGGRNTSVKYYKTKNSKNTNNDEGLLNTFNELDLGYEVDEFSDYDYENNGGDLDDEYDDFGGFEDDDEDENYNKYFGSDLEDTNDDEGIFYRSSVDNQSPERNVITPDLENKTAPELTNTREKLGESLPPIDSDRPNKRNKFNGSFHVSIVGPKTQSPKPSPTKSGFEEDILENYLDKSDRSSTNSDDSSLDQGDFDTCNFELFALNSPIINGLTIGNNLRHRGGRDRDFINTNRLIIHRKPIDFYDDNSNVSGFHLNNKERSKLYLHAFHGSIDDGFNKAVDEKVKQFDEFTTKLTNTSEHIKENIGLGITTATEANQEKLRLAYAGSISTNDSATSRLTAPTSDMVSSSTETSTIPINNASKLNIADTASFRQSVNDMMALLGSLESKQAKAEDENFLKKANNSNTQRNSIIDMMGILGKLEDDIDKQTGSTEKAKLEVRNSIVGMMDLLANLESKELNTGAGKTNAKNKEESKKLRSSVAGMMDLLANLENTTTTNDKPKQSNRKSVVDMMSTLSALQEPPVIENNANLNMPSQHSKIIRT

SEQ ID NO: 19042 - protein, 415 aa, Candida albicans
TFNKKSNQEKKPFFESMVEYESIARHYRTRNELLQVLQEDKNRTNLIKLSVLQIVTNNHFKYGTDINTPRKTRSGKLRPDTLTEKDNKGKTVNNKTHSEQVHEYEVTINKLKLEHTTTSKLQEAKIQSLKEENAKLKLQIKNNSSNHKTNINTSFSSIFTSSKSRPSILTSRNVKRSSGTTSRIGLKSRSTTENSPVSFALNKPIFEPVSTPVKKSKLTFSKSSKSINEFSPTQAHSETTISTGGARSSSAVPSSPTRPSSLTTSTPSKYMSTFDKSDNSSSPEFSPNRSQNNTRNLVNDVDNSETGGFVSANTNVENSDNERSGDPKKNIRKTRKLQLAKSAKIERVRNASLDKKSSGILAHGLDDDELNPLKYYEDSNFKDVGLSPPTKRKHSEPDNTRKLKVRKKKNIFSIE

SEQ ID NO: 19043 - protein, 1226 aa, Candida albicans
SKQIQKAVFITFYLRITTLLYNQRLQNFDSLNYLNCSNLINVSLFIMNEGNRASKEDIDLENAIGDVFGHFDFGSVDKEEGTNHQLQQDQLEEQDKDQPQQPESKLEHYHTDTPLQDLPQPSQRKEIIAEPKQTLQHKDNKQAEHSQTNTTENSKPSEDELDLEDAIGDALDTVFGANHNNNDNHNNTDLNNDHQSSESDNQNDVKNAIENALGDIFTEVKTDTTTDDAADSHEKDKLTPELSTPIQQVKNSPDSTDRPTTQLEVEEPKDNLLETKTGEDLDDIIGKTILDLVTAPKDNKNEKDTDRGLNQKDKVDNLENSTIQQSVENADKIPTPDNSNENHLRTPETGPPKISTEDTNTTHEPTDEIKDKESIDKIDNNKGLTETNTSGDNTKTNLELNEEMDELDDVIGKAFQDAISKSQPTPIDASNVTDPQESKSRTTPKEKTNMSSSKVEQTVASFETESEPTNDSTELDQAIGDVFKQIINEDSSDTTKASPAPESVGDDDNMDLDAVIGDAFKSVLPTELPSKDKSLPLPPDDDDNDLENAIGEAFKSISDIKGKDRKQEEQVNDDELNAMIAQSFQKAVDISKSDSHIDNDDMENAITHAFKTAMAGTSATSQMSAREAAIRSLAVEISHQVQDHLKNDKFMPPLPFIPGLPQLDDNVLAHFQKVAYTDDDTNEQDKLKKTVSESTNSITTQDNGGVAELENLQMNDILQNAFKMALENPQELLSDLDIDPTIQVPTTTTSTTKFPRQVSQPQPQHIPASSLKFIPPTSNQGMQNYRKYPHQQIPEVQRPSTNTLIVKPIDKLESLENDSHKKPSLLSNPAVTSQLTSIISSLTSRINSGELSDANILQVIRQMTDVLASGGSLALFLKKPTSIQDVIVTYRDGARQKMLKSLYLTKNFLDQKLPITENEVKQKAIKLIDNIAIAFDPVGFTKIVAVEIKDEEFVGISSFLKNVLTTTLKHATTTKFSPTIINSIESVVERITQNALLDSDNEEAMKQVSQDEELVKPITDLFSLLSGSSLFDNSFPMVVATAVSVAVTGYVYKEATGVALDTTIKAVCLILSNLFNTAPGMTFKGNANSTIGNQATKRLSDLILVGDLRRTKIDPDLGKTINNDNGKADAWNIDASSSIKIPQYRRPSALHEKSNVLHKPALTLPRSSPFISNKIGSSQSNSQPLQSSNHNNKLKRPGSIQRPINAKPRATSLGFPKLHSTSFKYQ

SEQ ID NO: 19044 - protein, 836 aa, Candida albicans
  UNSURE (4),(54),(74): Identity of amino acid sequences at the above locations are unknown.
NPNXENKFVKRAKTCSLARRARELAEQVRQRNEARENKLKAEELARKVLEQEKXRIAEEKKRLEQQERELDEKXKLQEKQKAALEKLQKHQSAHDFEGLFASNRRSVTDMAPSSGMSLLDPRAHMVSRANTIGSPNLSSSSVNIDENASKVLHKFGIDVAPSPKRFSRASKTSTSKNLSSFLAPTVSRNLSSQLKTSSSKNLAGYLHGTTDTNGSAIAAKKKDNSTNKALTIEEFNAKERTSMSPSISKASVNKRNSNQSSYYRSMFSDNGNDDNVTKVRTRESHLSVLEQQEMDMENAIDEDISLIPNPRFSRFSFGGLLGSNTVANEEGDWTIMNSTLNHSNTVVRGTHNKSSTMLGLGIKMRDTTTIKEDEEFEDDKPFISVPSSEDDEGNTHINKRGGLRDSGNYDFDEEHSVASTANTEYSDVASQGQQMPGSHTIHQLETELSNFDLVSYRVADIGKVNRHKPSIVDSKETLLKNHSSDEATIEVKEDNNEHDFNDKIKQHYDDNGDSEEDDEDEDDDDDDARSSFEARPHSHNYSLAEITSESPVGGGYESPSIANDFKKSRHSTGIFSTTQFPRSPYVVNNNGDSNKDENSQQQTKHMLNDGHKGLITSPVQDTFGSKKPVESNSLFRRLSLNPNRAAPKAPAPPPPSAPISSAAKANISQPLSSPTKGHNRFSRISIGSKNMLQKEDKSTKSNWFKKFFHSLTTPSAKDQSGNSSSKVASKDIKIIDTSLTAAQLIRVIKYQLELKKIEGSISKVDIDEEFGLISGVIPSKFANGRKLKFKIEVIDLINSSSLHVIKMKGNDKGFQSLVNIVTFIIKKEEQDKICRR

SEQ ID NO: 19045 - protein, 709 aa, Candida albicans
LNNKIKILKIIKQQLMKVNSNNVILGCEIISNLQILQQELEKKEDKDSKVNGKIEEIKSIVNSFTSPVAPNKVSKEDITEKSQNAKTIVDETKDASTVKNQHNTTESSTDVISNTDYNDIDNSTTAETPFTELEKDTVSESLDTTTAPKTSTTNSDDDVAQLNDKKSIVSFGSFDEQIDEKTEESLRELKSLNRLSDKLEIKNSDTPNKLTNAAINDVQEKTKPEKVSTLLNDDDEQKVKTEVNVELKDKTEEEKKSEEINKLTPPDVVIDKDEPVKTLDESLGETKEIKKDTAVKPSTTTKEVSKNDSIVEPKTIKFHTEVKGETKSDSTTEPKVKETPKDTKEEIKTDAIVEPKVAKPIDESKDDIKKDSVSAEPKVVEPLDEHKEDKTETAKICTDTSTIAEQPPVKTEIVDSKKKEPEPLADDKTKASEDIKDVNKIEKKSGNKETMVDTKLETTLDKEVDTDSNIQEKKELFQIKEPVKDEKQIKEDLVKVETPSKDEGPAKVEVPSKDETPFKIQNIDSTTDNGKAKDEKDNVSKVDSNVDTKVVTKDDQDGIKKVEEKPVEKKDDDEGKKDNEKVTVHKDNEEEDKDKGVNEAKDKVQKDDDEEEDIDKDLVIVNKEEEDKDKDVKDDNKDVNKAVDNDKENENEEDDYNTDNENNTLKTPYDFEASPSPSPSISSQSSQSQKSSPLKKNKKKGKKKNKTTF

SEQ ID NO: 19046 - protein, 414 aa, Candida albicans
QPEEKETKIRFWAHLSLTHTKEELRLKLAQMGWKKNFFFNFFFHLLKSQLLQLLPIAKMSSNTQDLVLAYINDYVSRNEELSKLKKALSKFLAGKELPKFSKQLESIIDEVENQEKKSKPRNSSSDSEDYSSESESSTSDSESSSSDSDSFSSDSESSSSDSESSSSDSEDSDDEEDKEDKEAEKDNKDSEDSENEKVEEDNKDTSSDSSSSSDSKYDSDSDSSSSYDSSYDYDSSYDSDSRSSYDSDSSSRYDSDSDSDSDSDSDDNSSESSSEDEESSSDSESKEEQKQPEDKKRKHTDDIKEEKPVKKFKNESESSASSSTDSIPATPEPELKPGQRKHFSRIDRSKVNFENSVLQDNTYKGAAGTWGEKASEKLLQVRGKDFTKNKNKMKRGSYKGGSITLASGSYKFED

SEQ ID NO: 19047 - protein, 394 aa, Candida albicans
  UNSURE (343),(346): Identity of amino acid sequences at the above locations are unknown.
GQLSFLRRVGTQLPQRKVDDKELKRETTLSRDATFDEKELVASNDRKIWEKDADNYNKQHGFVSGNSKTPSHDSSLNATNRSATSTESNYDSGKPYSSSAEKQSQGSDSSEKGYLAAAGAAIGGAVGYAFGGKGSSKENEVDDSLIEDAEKVDPAISKLPPHKVDKDQLKKETTLSHDATFDDKELVASNDRKIWEKETDDYNKKHGFTNQTDSLIQEAAEVDPSITQLPAHKLKNQEGKEMKPKVAEANPEEVDTSAIQNFRKLEDDVSTYNKKHGHIGPQESLLAVAEEADPKILKLPTHKGDFNETKLVNPVGVAEPGGVQKLPANHPTAMHREVSENIXSDXTVDAGTIPDSHQILDHHPLHCCWYRCCLKCWLLCRAGPPGISAHPPPR

SEQ ID NO: 19048 - protein, 125 aa, Candida albicans
QKKLYNNDKNTINLIHALVKIIDKQRSQQRVFNENILSKDNKIQTLEKQVQELSRKLHTLEKGNQNKVVKYNSLLKEINQLTKQNKIYSEDLQKVKNWTLDTKNKYKIEMKRKNLEIENRRNIKD

SEQ ID NO: 19049 - protein, 285 aa, Candida albicans
  UNSURE (282): Identity of amino acid sequences at the above locations are unknown.
RHFNKRTPRVPFDADDFRISTNSQGVIDEEAYLKLSLKQEELKNSIKSLQSDVLNLSELSATSAGSFLRHKYEKDLQASQLGLSHISVEERHEEEPDKTSDVMETVFQDKKPKQSNIFKKLLRKNHDDVHPIERTIQKQEQIDWATFKSDINRMNSLTSHDKQSRTKRVVRQDGSIIVKPLDFISEINTNETVGPEDDDIDLENVQYSKIETFMLNYDLSYDLNELISDISIKFHSSVINQVRCILVHLCKFDIIEETSKILQQKPKLSEAQHSGTLNAELXIRS

SEQ ID NO: 19050 - protein, 354 aa, Candida albicans
  UNSURE (63): Identity of amino acid sequences at the above locations are unknown.
QLEKVKEWYMKIRRVGLIFWKTHKFKTIDPSGQPSRKRCLRDWELAKVGLENSHTWETKNNEXVVSHEEANAAKKELLKETNEVKIELNMLKRQHKLEIESKNATIKELKSQMSASKQSFAQEISRLEDKIETLRLENESNETVSENVNEDGKVDFDEFSKLSEAHRILQKQYLSSQENWKAIESNLSLKVDNLSSSVESLKKSKHKLTQDLAKVNNSMHLQLKEMEKLEQDKIKLQEERNQLQLTVEMKENEIVEITEKFEKFKGIYNQERAALNSKIQSLNDKIKEEKRPERLNLIRDNSVSSGFSWDNEIKLGESSTTPAINRDFSTFLDRNISLSSFTELSSTSRWKDKR

SEQ ID NO: 19051 - protein, 245 aa, Candida albicans
  UNSURE (218): Identity of amino acid sequences at the above locations are unknown.
SQRKLLGRSFDLEKNFDNLENLTNQYNEITNKFNYYYYEQIQQNQQQDQQQQEEEEEEEEEEEHQLIPQFGLKLDENIKTTNERRQFTRDEIFLNINVKQERQNLLNFRNELDHQILNDRSQAMKFNEKCDIEQDKIKDQQSIIEELKIQDSLMKRKLDDLKQTIFQIQNEFNSQIESLDQQIRETKSNIQSDMLQLERKLRDVNLNKSVIQEQLIGXRQKMDEDVHNLTSFILKFKTNIQEKID

SEQ ID NO: 19052 - protein, 369 aa, Candida albicans
TRIYHPCGQDVDECKECLKLVASSSQLETSFFFDVWKHLRLQTNNADPTITALIKEGDDNLARIKGQVEALKDISHVEEGHDVTFSSAMPDFKEMVSQIGILVKLYDLVKSDGLDINVDSLNKMIELTQVVESLYNLDTEVHSFEITVPSIYEYKSESILQQPSIDDGGLQNKLAQREREVTDLKLNIALLEQNMLSLASQNTQYITELTQKLQSLKKEEEDSSRVISQLEQDKKDLVSELNAVNRNTVSTTLFANLKSQQDYNNSLTIMEKIVHLKRLTKTIDKEQVDDFAWLQPQSKRQFWTEASSVHNLSKSLQSLALNAKPVSINDGNSHKWTKKKDLLKFAALVLEENYNKYKTMRTNLLCSEK

SEQ ID NO: 19053 - protein, 742 aa, Candida albicans
VDPSSRVVKILSQLQTESQQLTDDIENLHYKNMDEIYRLHRDKLSISIYNNAKDIYKNLNDLQQFKNKLTKASLKAFNTIANLQMKMVGVKTEMKKITTEDETATEDSKVGDVNYKTISNVKKYEDYLSLTIDLPLIFGFSLIEKRRQFEWYDFYSKGIVNNVSEQLSTIIEHEKVFRGIWLKKFGTLLSLINDDPLTPSLPNIDVTLVGNRQNNFSILYDLKIERDDIINYISLIEATNMSKNFVTLLNKNFKDLIASTNNMKKVTKVISSLSTYTTNSADDKLKSSHEEGTEEEIDFDLNLIKGLKSRIKKLENLLHQQQFKNLNNWPVIRNVPSMTNDNRQSTIIQPTVVSPARTNPTQLLLRNPSTTKENTTTNIHNNHQQSEVLDSSVIDKHLDNIRLKKLNNELQTKNTELTNQINSKNETITQQQKEMEHMKLKTEKRVDELMKKLQEKDEECQLLKQENKIKCDEVENLTKKLELSDNHNKELEAKITEYTQKATSKTKEIADLNKTVSNLRSELGDAMHMKNDLLSNLSSKEAEFTKERNQFNNDLKALQLKLDEINEDYENLMELTQAKQKKHDLIINDLNNVIINLMNDIKKTLLSVFEYFLEYCLVLESMGLLLVKEDEIYKIKRVKGLKSKKSIGDGDMLIISNGTPSSKVIEEIENEINIVNNIPPISSILPDSYSSGTESDSVVDRYNDQSMKLISTFNQLFKFNNENENENRIDHILNTLAFKNNV

SEQ ID NO: 19054 - protein, 263 aa, Candida albicans
CYEFFFSLVVLVLLLPLHQQRHLIMDTAERAYEKFQNQMIAFDNLKIEMNELAVDLDQQLSDKQSLILQQEQDHKQKVNDLTNQEYKLKLQAKSLKEKENATRDKLNLAMRSLEQQKLKVEDLVKKKQSLVDTKQDLESQIKQLETAIDQGTRELNKSNDNMLLQMNKNLVELNKYEIYTGLKIEVQSNELMCFKFFNLDPNDYDREFAITLNIGGSTYSIENTSPKLSDETVEQIQGKLNQGRQLSKFLKEVRTLFKDFVQY

SEQ ID NO: 19055 - protein, 858 aa, Candida albicans
  UNSURE (851): Identity of amino acid sequences at the above locations are unknown.
YLESFLFSMSNLSINESNDNSNVSILLNKSGAQSSTNSSPNLIVFKQPEDLSIQLQQQQQGTQEDTPEEEEEEEEEMEQITQLEVQQENQPDTLSSSPFISRPNSPLDDIIRPQGTSSPSLTIRDSYSSQVDINISNLHKSLNEMRLSTDPVDNNNNNNKVNKNNPTNSDISNDDIITIDNLTPSRIQPKNISPWRQFRPTLRGSPESTPRLLFQNKPNLKFNNGLSPTNGSRDMVTNNIATTTKSREEELNKRIVNYKIQLKLMKNFLQELIDRNNLDPHEFHTLLRRNNNNIMNNENNPLSTSLSQTSTLEIQHQNLQIELDEALELNKQLYNKIETANKEISDKDLQISNYESRINLINYSVDELIYILINEYDKNNYSHGGSNTTSPGKETLQQSISAQLEVKLNVLKLELMTRLDQLHQYNNKPHDLFTPPYTSSEYGVSTNNVANKNDLEGYIHIIEDLIKTVDELELTCENYKANKNELQNQLVEQINESIRIKNNFQIMSNKFNQLRQSLSEKENDKNLDEFSKNNHQQQQQQQIQQLEQKLIEYEKCITILQDELDQYKQPSDTTNTTNNNNNNNNNNNRSSYSSYNNHRNSSLNELNLVNDYLQLQTSYSRINDELNQVNNDYKLLNSSTLEKINNLTSKLQEKSIELRNQMGLNNKLQTELNLSLDKQRKYNTERIQMSYTVDSLRKDNEALQLKVNKLTDLMTIDRTRAESNSQSTATSTSTPTPQTAPTPAPSALATVARTASTTSSSTTTVNTNTKTTNENNNSSANIELGVKKISILEYQYKDLLLYDTNQFKRLIESYNKIADDKSLYDPKMKYEKLLNHITDIHNSNRGLTRRXKKDHRVR

SEQ ID NO: 19056 - protein, 171 aa, Candida albicans
REEENNNLESVAIEEAKDAILTLESELDSLNIKLDAVTKERDALRSINVKNPTSSKDSDYLSQANADLRKRLGDSERIISEIREQSAKSVYELNEKIRQITDKKNELALQVSVSSKYTELAETRLSISQKSLSDCREELALVRKEIEFWREQTSKFESHLCLHHGPGRTDA

SEQ ID NO: 19057 - protein, 273 aa, Candida albicans
  UNSURE (14),(28),(83): Identity of amino acid sequences at the above locations are unknown.
ATRLPKLFKTETEXELEKSRFFKEIDSXQELIELTKFQAQQRATRIEQLESYSEDIKQSMSETITSLETALSEKNEKLLETQXRLKRTEEALDAELHKETDLPKLSDSSAMIAANGSGISLSTLYSEYNHLKKQLVVERSQKQKMEMQLESFINELDARKPVIANYREQIQFYENSMKEMLGKVETIRSEKGEVEKDAKRLRSRVAENENELVSMKRLLKDLGRQLCFYLIHSKIRDNSENPLTAAEKKSIEKILSQTGNFDESSPRARRSAS

SEQ ID NO: 19058 - protein, 229 aa, Candida albicans
IDDHGLMIGDEIKMDVETEVKNDNQVKPNHIRESLMERAQRLRKEAIDSERQNLKNQDSNTYSQLDLILSKLNYLEVSLTGLNGGEDDSQILSINKEITGLNNVFAELKSTVTDTKQAVVDLQNVLVKQYSQMLDSIAQLNQKVIGEVREQHYGMEELSRKVDLLMNNHKEIAYQYEKTRQDTQGEASKLGNVIDKLLKWILFPLVLILLVLVIFVYRLRHDIKHSKLL

SEQ ID NO: 19059 - protein, 263 aa, Candida albicans
  UNSURE (253),(254): Identity of amino acid sequences at the above locations are unknown.
EISPRRNLLGKFSAFHWEIFKICTRNFSEKEERIFIFSNQSELSFRAQNTKLAQVNEISRQLLETKNKFIEKENVVEELKRKLATTRRECILQPTIAAGSGGGATSTGATSTTDSNNFEIQQLKEDLRIAESQVEELSNLAKASEATLIDSTNSFEQYKADSESKYQALLKEKELVDDEVKRLTDLYNITSQDLQSAKTLHIEEVNELKLKLNEFKYKADQYDTMEFDYQEKIESIRRDLDDQTKLFNDRHTXXLIHQPQQII

SEQ ID NO: 19060 - protein, 316 aa, Candida albicans
INNINILDNKMSSPLNEASDTSNSSVRKRVVHIDPLEITQSLGFQTFRKGARKPWTKEEDSKLSSLVATEYPKPIDVEKVNWDSIAETLFPDNFRKGKECRKRWCNSLNPTLRRGKWSKEEDEKLVRAFEKYGASWLKVSQEIEGRTDDQCAKRYMEVLDPSTKNRLKPWSMEEDLRLIQQIKIHGTKWRTISNGFEGRPSLTCRNRWRKLVTDVVRGKADPLIKLQVENVTQKNMDDESNEDNILEVLSKKQQELTESNKETEPKNSKRPKKLKRDPDLLLNTPRPTSVNTPANEHSRTEVEWRYTVPPDVFTTA

SEQ ID NO: 19061 - protein, 90 aa, Candida albicans
NHSSTATLLYIFKMQIKVKTLTGRDMPLDVEPQDKIIRIKEMMEEKEGISPAQQRLIFNGSQLNDDQTVQEAGIQAGASLHLVLTLRGGN

SEQ ID NO: 19062 - protein, 237 aa, Candida albicans
HIYTNLQAMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGF

SEQ ID NO: 19063 - protein, 296 aa, Candida albicans
SNFIHHHLHYYLLSSNMICSISGEIATDPVVSPKSGAIFQRKHIVNYIATSGTDPITDEPLTESELISLKVNEKSTAIAQPSPPDPSNSSIPSLLYTFQNEWDAIVLEVFTLKKQLQSAKQELSIALYRQDAAVNVAAKAIRERDEAREALEKLSLSINLSDVPDTNTPPEEAEPKPKKSKKSLSKGTLAKHSNDKDSETIDSEQIENIVRARDELFRLHKSQKIKLPFDVDTFLKQKGVDIQSIFEGEKISNYVYNKEIDTIVGVSQDKVIKHFSCGWSIHKVESQECQVGGNKQ

SEQ ID NO: 19064 - protein, 147 aa, Candida albicans
SNADCHSWRILTSCSISHNGKYLLISSAPEELQVWDLSPLLVNESNRPILYRKYLGHTQSSYIVRSTLGYLNEDNDQEELVLTGSDHGYIYFWKFTTGQLITRIKGHVGLCNGVDWNRNGMVIKGKDYGKIWASVGDDKLVKIWGSK

SEQ ID NO: 19065 - protein, 247 aa, Candida albicans
QLINDSFIQYSKVPTMKVKTISRSSDTYIPVKNTQESALPRNLNPALHPFERAREYTRALQATKLERMFAQPFIGQLGDGHRDGVYFIAKNYQATNQIASGSGDGIIKYWNLTDRLETASFKAHYGMVSGICIYANKMYSCGDDKTIKIWSVNSDDFDIKVNDDVDGIYRNQLGGAGGGDGKTSGGLLKTFIGEHSFKGIDHHRDDDLFVTGGATIQLWDVNRSKHISDLSWVQYSARGWNQPRCRN

SEQ ID NO: 19066 - protein, 572 aa, Candida albicans
RNLISRENKVKEVDLDEIIKKKGGLKEESDDEELALDGFGMGASKQEEEEEEEEEEVEVPEVKEVVEPEDSAEAIADFYEESSPQQTHTSFQTLQLSRPVLKGIAELKFTKPTPIQSASIPIALLGKDIVAGAQTGSGKTGAYMIPIIERLLYKPSTSTKVIILTPTRELALQVYEFGKKLSHHVNNLNIGLAVGGLNLRQQEEQLKTRPDIVIATPGRLIDHIRNSPSFSVQDIQVLVIDEADRMLEEGFQDELTEILSLIPKHKRQTVLFSATMNTRIQDLIQLSLQKPVRIMIDPPKSVASKLLQQFVRIRKRDQLKPALLYQLLKGVSSRVVVFVARKETAHRLRIVLGLLGLKVSELHGALTQEQRLQNVKNFKSLEVPVLICTDLAARGLDIPKIELVINYDMPKTFEIYLHRVGRTARAGRDGTSITFVGESSQERAIVKSAIVNGKGVAKTVDWKQAEETNKLLESKESVIDEVLEEEKEAKELLRAEMELTKASNLIKHEQEIHSRPKRTWFKGEVMEQLTKHGKKVNSKKRKANEVRKDEGRSYKKTKTDRMKISNKKKSKK

SEQ ID NO: 19067 - protein, 585 aa, Candida albicans
LILSNTLMTQRKRSSPEDDLSNSSDSELESPQLENDDDLKTHYYITPKTNSTDSSFENVYCRVTSQPKQPQKNTTPFLSLLDGNESSENVLRRFELYNQVWANQSDKIQSILNNANDELFKDLIQFVNLENLQQLSVGYVQLTTNTANNLRILQEFYQYIQRKSDYDYKLITLNSKHFTYNIKATLREVVKQFYDTCQIVEEMHRLNYDLDAIDDWFDEERLYNSRLVLVLEDTNLINNQLLNQLLKILLSYVGKWPLKIVMGLSCETVSSWINGNLTNELRIGIEGHKFKSNDNKSLGYIILNNLFLTPELTPENPLLINSTLSTIILNRFENSNNSIDALIAEIKLCYMIYFYRLPLSILIAEENPQPQELYADGLRKLSSFKKYIELKLHQGDRSVKDLLNNDKSVIKLFNESRSNFRKFKLAVMNAINIIYQLHPNKPKQKFELYKLLINHKLLNSKYLYELVKNLSKLSDSVLGKVLIGLTDNCTEILDGISDNHLIQLIKGLGELSDLRGVSDKLQNYFDNSILTTPLEYMVFHEVFSMDGGLIQEKFTKPPLFEENYENLMINLLGPILRATIEGWLG

SEQ ID NO: 19068 - protein, 109 aa, Candida albicans
RVGLDNYETYLANPLIENSVEQPLMPPTLTHLFKLYKEAPTTINLYDFYQAFKSTLDEKELSLQLSTNEDWEKLTYAWFVQNCHELMLMGILQQKPKGDFLEKAIWKGI

SEQ ID NO: 19069 - protein, 815 aa, Candida albicans
YSLYFSYHYFRKSFLFCIYTYMSESPSQPPQKKHKPTTTGPSSSSSSKLTRAISACKRCRTKKIKCDQKFPQCGKCEVNGVECIGVDLVTGREIPRSYIVHLEERVKFLEEKLRLQDRSGFVDEGVSSTPPGSSTIKKKSNEISINEPLIKNESPLINTKLDSIAFSKIMSTAVRVQNRLSDPNIKPGNGNVNLGHNSTTTNENGIDINNDISRAVLPPKSTAMQFLRVFFHQCNSQLPLFHREEFLRDYFIPIYGEFDESISLASNNTKINKSFFNSSSSDGDKTPCWFDVYKSKIQQLLTENTQNDIQTIANNIIPPLKYRKPLYFLNLVFAVATLANHLRYPIHISESFRLAAMRFSQDVDNSIDPLEHLQGILLYAGYSIMRPTNPGVWYIMGEALRICVDLDLQNELKTKSKQNFNIDNFTRDKRRRIFWCCYSIDRQICFYLDRPFGIPDESINTPYPSSLDDSKIIPNDNSTDYYYYKNHHHHHNDDDDDNDDDDNDDDDNDDDDNEDDINFSYKNVSLLFFKIRKIQSQVTKILYTNAEIPREYKDLNHWKQSILIQLTQWKQELQSKLILKQLNCDFNEIFFQLNYHHTLLYIHGLSPKNYKLSLIDYENLTNSSIQVINCYTELLKTKSINYTWAGVHNLFMAGTSYLYALYNSKEIRLINSIDQVQKITNDCLLVLQSLIGRCDAANYCCEIFHNLTMIIINLKYAPKDKKHLTELKPANSIPSSSFSSSSSFSSSSSTSSSKISRESLYRINNGNVHSNLFHLVTELDHLNPLTKTKTINNNNSDHFDITNDSSPRGSKDQRY

SEQ ID NO: 19070 - protein, 160 aa, Candida albicans
GRYVAIPMVNTESVISTTFDQLNNLEKLIGTIEFKLIEKDVVYGLQQGNKVLQKLNNEMQVEKIDALIDQLEDEKLKVDEVSELLGGVDQLNRSEEDEVDKEFQTLQEEIHGKIKQVTEEEEEESNLPKVPNTKPMPEAPSNEIEEHTPQKETKHEPIAI

SEQ ID NO: 19071 - protein, 229 aa, Candida albicans
IVNMWGYFFGGNSQQKKDLPKKAIVELREHIQTLNKKKNHLQQQMDDQDQLARKYVSSKQTTLAKSALKRKKGYESNLLKVENQIETLETQLISIEGANLNLETMKAMKQGAKAMKQIHGEYDVDKVEDTMDEIREQVELADEISEAISRPVGNEFVDEDELDEELKELEAEAKEQEQEHRVPAQKAKPQPVSREEELPQFPSVNKKAPVVEEDEDEEALKALQAEMGL

SEQ ID NO: 19072 - protein, 1089 aa, Candida albicans
GTRNIMKVIKKRFFKPKEETLPSDEVPDPQSSAEPLHSLFVPDESEEEETTTSPKTNFEKDIIAIVGDISPIIMKYLYAKYSQKRNGAKFAVTELLTNPPDVEKLQQDSIASQSAKRPHTIVSYQEPPNKKVNINPDSASSNNEPLMWQRLIGSLNIQAMATRPTMKPLKYQEKLKLKRITTKNSTMANSAIVRVYHNEREIGRIPEDWTRILSPLFDLNIAVFEASVLEETKSRLSTGDSFVIEIEVYLTNSSFAKNLDATENPIDLKKSNFDYSKESESEAALRLRQFAISNLFDRLAIKPLKVNDDTEDEEDISSQEINSGDVEHPVPEINLDQMKEFYQSNNQLKILEGLPETTTPPKENFALDLRSYQKHGLSWMLAREKELDVLEMLLNEDKLSSQSRKELENLGTMNPLWRKYKWPYATEATQDPTQNQTEKYFYANMYNGELSLEKPVIKSSLRGGILADEMGLGKTIATLALVNSVPYDNFPEPKSDRPYASQTTLIVVPMSLLFQWKSEFEKCNNNSRHVCRLHYGEDQETNLAWSLCNPDNSKIPIVMITTYGTVLNEFTRLSKRRNSKGELPKVGLYSVKFFRIILDEGHNIRNRNTKTAKSVYELQLSRKWILTGTPIVNRLDDLYSLTKFLELDPWNNFSYWKTFVTLPFEQKKISQTLDVVKSILEPIFLRRTKLQKKNGKPLVELPAKEVVIEQIKFNDDEEKLYQWFKDRAYASFAEGIKSGQLLRRYTQILTHILRLRQVCCHVDLIGGAHEMDDEIIEAEQDEDMRKFLTSIKENQIRFANDTDVKEKMYNLYGKIKEENECSICTQVPIPYSEMVVTPCAHTFCLSCILEHLDFQKELKKEKLCPNCRLPISKYQLFRIRNQPTKGNEIRFHTQKDAPDYSFQLYLYDPNRSSSKIQALVRHLKALHSQSPNLKVIVFSQFLSYLDIIQSELKLASEEFIVFKFDGRLNMNDRTKLLESFNQPLEDGKVAILLLSLKAGGVGLNLTTASRAYMMDPWWSPSIEDQAIDRIHRIGQNETVKVVRFIMENSIETKMLKIQERKKQIGEAVAAEEEERRKRRIEEIQILFEE

SEQ ID NO: 19073 - protein, 557 aa, Candida albicans
VIDSPKPASQRIVEERIRINFGCRRINGPKFEVLVSEKNEYLNKTKQTKQLISKSQRMASIEQEDLFNVQDDEEEDIEEEEEEDEDVEDQVQIEEMGENVDALQQEEQEEEDDSQMDIDTEDQQQQEEEDEEEDEDEEDNEEEENEEEEGDEDEEMADEDGENEDEEGEEEEEDEEDTSNKKDNKDIEATTKPSLEKKSNDEEKTETKSTPELQLPSAAIDESKDNDGDIFLGDDTTKQSDIPTPKDSNVDNSTSREGELPDDSNKKNKDKPIEQPRNEKGQESENTKLEESKDKEPLIEDGPKDQIQEDLDTNLSFREQIIRKAQRATEFDIIPQVAIPYANQCHTLAFTKGPKWILTGGEDGFIRKYDFIASIQGKSPLTMAQKHNLFSDSLTNAGVICSYWENEQPLTRKQLMNQNSKLKDSDFSTGSVSYEPKINPVYALDAEKNGYWCLSGLLSGGISLYTMRYNEGAIHYYFHQGSKENKSRGHTDAISVIKLNQEQDKFLSGSWDKTIRQWDLNTGRTVLEYTGNSGQISNIEFRPDGLFTSDWQAALYQ

SEQ ID NO: 19074 - protein, 1341 aa, Candida albicans
  UNSURE (5): Identity of amino acid sequences at the above locations are unknown.
FQNPXRPWMPPLMSTNQSRNIVLEKQMNSKMISHNILETSINTQLVSPKDTNDLKLQTDLNIENETDRPVVDGSDPVPSKKLDAPTSEAKMYSSPLSLNTHDSIAQDTKITQEKRNEPRLVIDRLVLTDFKSYAGKKVIGPFHSSFSAVVGPNGSGKSNVIDSMLFVFGFRASKMRQGKLSELIHNSGDQRPDYCQVDIHFQMVVDDLVVPQKADVVPDSELIISRKAFRNNQSLYYINGKTSSYSEVTTLLKNKGIDLDHKRFLILQGEVESIAQMKPKAEKENDDGLLEYLEDIVGTSKYKKLIEDSIVRIDELNDICLEKANRFDLVEKDKDLLEEKKVEALRFLELEKKLINCKSVQFQIEILAHQKRIAAKQAEADAIEKELEENKESNKEILEGIESELSTQKEIERDIKVLSAEIDSLGKNRKDISKKNVSLEEKSKNNANKLKKIQKSLENLKHTVSSSNQKLSNYAVTTEKFKSDIDRLNKELETEEARLNDIRSSLTEKTSEFTKEIQLLQKSLDPWDSKLKEKENEIKLAESAIEILRSQLNSTTNQLEEHKERLIQIKKLGKDKEVEYRENESKLGKIEEQIALGEEQCQTAKSALNNFKSQLMSFRQKTQDSAAIVHNTQNKNKVLTALLRLANSGRIQGFYGRLGDLGTIDQKYDVAISTAAPGLDSMVVETVETAQACIEYLRKNKLGYANFICLNKLRKFNLAPIQTPGDPSSIKRLFDLIQPSSSKFAPAFYSKVFNTLVAPNLNEAKKVAYGAKRWKVVTLDGKVVDTSGTMSGGGNYVSRGAMRLSDSSNSNDQAITADELEKMNTKLQEMENEFEQMNSDYNEKIAMLNKLQVLKPETEFAISRLKLDIQSLVSEKKEVTQICKNLIAEQQKLEENNPFEQQLLSKEKELEELVNAKTQIKEQMSGFEQKISVLEQKIMDVGGVELKVQSSKVDSIKQQISIIHEKTSGDRMTVKKLENEINRHTKLIESLTTEQEEAEAELEKINEQQRSLLSKLEEVNSKLKELEDERNDKEDNLEKMKHDLEEKQDQINKFKLVEIELLNKLEKCKGTLKGLKQAIEQNKEELDALVIRDVEPYISWLDETEQKKYNGALIDTLSEEDIADVDLEAVTSEIEELENYMANVKVDIEILKEYGAKIVEYNDKKSDLNQAVAERDSKKNYCDDLKRKRLDEFMVGFNTISMTLKDMYRMITMGGNAELELVDSLDPFSEGILFSVMPPKKSWKNISNLSGGEKTLSSLALVFALHKYKPTPLYVMDEIDAALDFRNVSIVANYIKERTKNAQFIVISLRNNMFELAQQLVGIYKVNNKTSSVSLANIEMH

SEQ ID NO: 19075 - protein, 295 aa, Candida albicans
HLLALAILAYGNSILPKDHPLFQNLNGSNPLLSIVERSLFKLLRKSSHTTTGNLTDHSHIVYTILIITILHLGNYDESQAWVYSSILCSQIQHVGWNVSTDYPLESNDLSKFRSKLFWNCLVVEKISASMFGRSSPINFRQLLTDFYTSETKDINELVFQFNSKLWFIYDKFMGQVYSFHFNTQNKMLYKKVLMTATQSLQDFQRFMNQYLPLNETNLDNQNIILLHLTFHVFLLLIIRPYMTMPEIAGSIFQKSISITEQCHILINQYNSQFGNGMTTRWYNCHYGVLSFQISV

SEQ ID NO: 19076 - protein, 223 aa, Candida albicans
HLKPVTTKFLMGKKNNKFLNKIYSQPLPITLTSSKYNVSLPNLYPHNPISWIWYIIRYCQINIVYQVPELHNPPLSVIYENQIFKVIDRESMLKLWRQGFFGKGILSRSEPTWEKRTITRLNLDNSNNGKDLAMEDITKKRREERKFFKLERARFQELELKKRQGIITDEEVEEMNKLEIQLTELRKIQVRFDKQENGEVKEIHIRDEDEDIITENGECLHDG

SEQ ID NO: 19077 - protein, 177 aa, Candida albicans
NSKQPLHKQIKESSPRRRIKKTSLLPPGELDNYWTGPDEDKIYTCTYKNCGKKFTRRYNVRSHIQTHLSDRPFGCQFCPKRFVRQHDLNRHVKGHIEARYSKCPCGKEFARLDALRKHQDRNICVGGNKNVISKPTKKKGTNNTQQQLLKTDTVVERIEKQLLQEDKSVTEEFLMLQ

SEQ ID NO: 19078 - protein, 108 aa, Candida albicans
SQMSAGIPVRLLNEAQGHIISIELINGDTYRGKLLENEDNMNLSLYEATITQGKSGKVSHMDQVFIRGSMIRFISVPDILKNAPMFFMKPGDKPKPPIRGPPPKRKRV

SEQ ID NO: 19079 - protein, 191 aa, Candida albicans
SLLVGYKRVVVKDYAVNSVCYGAKLMIPGLLRYEEGIELYDEVVLMTTKGEAIAIGIAQMSTVDLQSCDHGIVAKVKRCIMERDTYPRRWGLGPIAQKKKQMKADGKLDKYGRVNENTPENWKKDYKDLDEQPAPPIPESKLVAPEPQLPKKKSLIEEVEVDIDVEDKSEKKEKKDKKEKKEKKDSPENKE

SEQ ID NO: 19080 - protein, 101 aa, Candida albicans
IMSSKEDYIIKPESVSPSNDTSQWPLLLKNYDKLLVRSGHYTPIPAGSAPLNRDIKSYVSSGVINLDKPSNPSSHEVVAWIKRILRVEKTVVLPTAAGNRE

SEQ ID NO: 19081 - protein, 358 aa, Candida albicans
  UNSURE (356): Identity of amino acid sequences at the above locations are unknown.
YPTTSSSSLLSTTGGKQFQQSSALLPSGTLPPSILGTSSSLHVSALRQHQKNNLSISSHLTLFSLSGNNSSQLQSQGSSFQQSETGVDDTKRSSKESTTIFNDLLFHLTSVDGSNINTFLLSILRKINSPFTLDDFYNLLYNDRQRTLLDNSNYQNRIDKTIVSPSDTDMTVSIINQLLNFFKTPSMLVDYFPNMEDKDNKLANINYHELLRTFLAIKILHDILIQLPISEDDDPQNYTIPRLSIYKTYYIICQKLIASYPSASNTRNEQQKLILGQSKLGKLIKLVYPNLLIKRLGSRGESKYNYLGVMWNANIVQEEIKQLCDEHELNDLNEIFNSDNNNPLFSHTAAGRTIVXPN

SEQ ID NO: 19082 - protein, 858 aa, Candida albicans
ASLVVKILSSDQTAQNRNRGGDDSYNPRLQQQTSQIPSTGPDQGQQRERSQEQELDHEHQQAQQHLHQFQQSNLTPSTTAFPSSTSIPTFSKQDQGYHNQFSSPQSSYRKIGNFAQSSNAPFLNEPHPIYATNYQQNVPLQSQFQFDYSSPYIGQSQSQSQSQSQAQPQPHPQPQTYQQLPHYSQASVSLLPPTYQAFHSMHEASSADNDSATNITTPQKRKKQKRLESVTSNTGENELKQLALRSSNIPLSELAQKVKQLENDSTTTSVSLEQSKMKENKETQRQLFGMVWLLNSCDLAPTAVIPRNRIYARYVQVCADNNLAPVSPASFGKLVKILYPNITTRRLGMRGQSKYHYCGIKLTGDENMQLQLLNYQQKQKHQSQEQYNQQAQVGSSTSLAGLAGHQSPMSSCNSSVSYEESPGPIISRAHTPSFSPINTPTISMSKSLNDQLPLILHMKFIPNLFYLLNSNVATSSNPHEPIQLPSIYPYLSKDADHDIADTLYSLYKVHVNSIFEALRYMQLKKLFSSFSTFNNILTAPVLKLYTTESLAEWVMKCDLIMYKKMIRMLSKLQLQLLIPQEQLLQLKQIADGYIKTLSTSLINSKVSQNFVMMKLKLAKHFVNLLNRLIKVIETGQPASRILNDDNEKNTMTQDWMKLDIHGIICREMPCNDNNIDTLTYILTGEVVNLIKVKLDNEQAPTMSDFANYISNLPSRFPEVNTRLFLLLASNLLTTCLREISLLGGEGFGAWWIVRCWIDEYLAWSFEVGGFFQDDLQEIVAQQQLNVQLPPPSLSSLPQTQQQNPVIQEETGTQEESWGNIDLLETSFDFDAKTSQPYQQPSHTESLLNFETNIDNLLN

SEQ ID NO: 19083 - protein, 330 aa, Candida albicans
FSETITLQVGQCGNQVGLQYWQQLATEHGIQSDGSSTPYPKDINDLQLQELNNSGSSPQLYPQQTKPNGKYRNDHPELFFTLSDSNTYTPRSILIDMEPSVIAKSTSALPMFNPRNVHLSNQGNGAANNWINGYKYGTEEEETLLNLIDREVDKCDNLSNFQLFHSVAGGTGSGVGSKMLEVISDRYGHKKLLNTFSIFPSNEDTSDVVVQPYNTILTLKRLIDYSDATFVFHNDSLNRIENILFNNNSNIQHDDNDLFLGANKLIALVSASVSNPLRFPGYMYSSMESIVSNLIPTPDLKFLTSFIAPFNTQKHNYLNEYDMLLELSND

SEQ ID NO: 19084 - protein, 135 aa, Candida albicans
GDIEFTTKISFVPWGTRSVLVVHGKKSPYLKNTNLEGIQVTNNTSMIDVFTKILKQFDLLIKRKAYLNRYYSSVEEENEVMEMFNESRESVKSIIDEYKACKEITYLDDDDEDDLEDGGGNGNGYNNIDDADMGI

SEQ ID NO: 19085 - protein, 498 aa, Candida albicans
KYNRNLGLNNIWRARFSHLERNHIIRAAKNPVNLDMSAVSAVSCRMEIDLRVGTSFTRLLTDQLRQKGIIEKNELASYGTCQFPTLGFVVDRYKRVKSFTPEPFWYIEIETRKENKKTIFNWVRGHFFDKMYVVMLYDRCCKSGEFGTISKIESKRKPNFRPFPLTTVELQKDCARFFKMSAKTALAAAERLYNLGYLSYPRTETDRFAKETDFKSLLEVHKQDPRWGSYTTKLLNEGFETPRSGSHDDKAHPPIHPIKYVSLDTLNTLDEKKVYEYVVRRFIACCSKDAVGTQTVVTLKWGDEFFTASGLMVHEKNYLEVYTYKKWESSKQLPKFTEGEQVKLSSGILKDGKTSPPNHMTEPELIALMDANGIGTDATIAEHINKIETRHYINKLKKGKNEYILPTPLGMGLIEGLEKMEFEDVSLSKPFLRKSLERSLEDIATGSRPKVDVLNTTIGVYVDAYSVCSHQILVLCNECRRIILGNSSNNNNNNNNNT

SEQ ID NO: 19086 - protein, 508 aa, Candida albicans
EWELILKSNVKMGLIAVKMESSNSFSKQINSPNKVQKPKRQRNRVPVSCLACKKRKVKCDKGKPACGGCVRNGVGHLCQYINPPWIDNDASGGGSSPLASCQSLLSPVKIETTSEYKQLKSQNEKTISNQKKEIENLKRQLQVLQQLSPRNSQSANSESRDESTFYLGKDITILSKLSPFAVQPRVTMEILSEYTVLNSRVLSFPVCLDIYSWVNIIKLDPQLTTLWFKITNLQKMYHMYKINKLKNDNSAKKLAPSQLKKTSSKINEIDFTYSFLPSDSQNTEQQPLPLASSTSNNHKCPVIECDFNFMGDEAQSQTPSPKRNVTSSTLSSTTQTQDDSEKLQCPVFKPDIHNKSKSLQQKLQSLWESILNLTRGSTLNYRQLVFLLDFYFKSEIFESKTLLLFYKTDILNVIQKGLDGELILNLPKGLDEDIYYQLKISGIYVSMIAVIVEETLTYLRNVLKCEVVDDITQSFNVIFPQEYTYLGTWGPTNKYSLILMKDFLTSEE

SEQ ID NO: 19087 - protein, 298 aa, Candida albicans
SQLLADLLLTRKTPPNCQGQGITWKKHTYRAHNEGHTIDQLKHVLSLNPNFRFAGNFADPLTSFFSLIPPAWANKQLVDTFFQHIYPVIPIIDETDFNTSINRVLGPQIDGHYINSFPSIGSADDLPFLALFLLVLRISYMYTPGACPVSYDTLRAAETIMKEFDITKTHSLTALQAEIMLRFYKIVAPELYTQSNYVQVSVGVLIQNCYSLALHRDPEYIGEHNPKQQHLRRKIWHLLLRMEVIDSAIFQNHLIVNPRRKLIQNPSTYRPSTANGAKYNEKNLAAPPTCSWLLAQTC

SEQ ID NO: 19088 - protein, 986 aa, Candida albicans
LNYLYHCPLIFNKTMELEASDSNSFSMSTNETGKANPNVQIVQDGKVVKKVQKTRQRRILSCVYCHSKKIKCDRQKPCSQCTKLGMECKYFINERISRGGKKSSRLTADEKKLRGLMNSANENKKAKQESVETAKSQDTQSLLSSSPTNSSTTSTANPLAPSSSIATSIEEVEQQQFDTAPNIKDYTANPNQSQQEQLGIEDETFKTSLGLDISVSLLGFLNKPEASSNSNSLRSFTANVESPFSGADPFAIGGLIQSPMVNQATNSMTSSYFNHNFTTQATNHNNSINGANNQINFNSSSFPLANLDVSITFSSHANSPTMNFSERLQQQQQQQQQQIPPRPESASIVKTQPQSSTLYNSLNGYTINTATSVNYLYGTNTYGENSTILNDITEYLPTDKDRSFELIDRYLNSVHLLLPIVVNMKEFLVQHKLYWEIKSRRDSTTADLNNPRVESPGSSHHSGDGGNEPMPSDSNFNYIQFYTLYLPILYASTISEFEEYDNLLLNQEIHKYLMGFKICKKYYNFPEGIKTIPLLLGNVIIQSTSPNPSTMEMAQIIRYAKFLHFHKDPWITLRIKDPEIIKFRRLLWWVIFGLDALSSHNFCLPPNCRSDDFNVLMPDEEEFIGGEKKLNVSIVSMNIKFGYDILLSEIVYHLHNGLCVNINCHQINQLKQSILSYQEQIKKYISKMDKYFQLKQIFADTLNHSPIQLLNVVNFVKIHSWSFLDRALMLLHKKILLGTPKNHNHNDEIENEIVQLGLKEPVMQIRANENPLSLCKFEDTYGQILEANIITNFNNSSISLLKFGDFENFSYGDLANNLIPSILHNFNDFLLYNDFIKFGKFNWFIKRTIPIDSVILLMIIISVKFKYQFITTEELSTYKNLINSVMYIINRKWFKNEKYKRMLSLTNMTWEYLLKKFDVNDVIAFDVKNSEGAKDLVSVNIMDTLQLKEKILYDLRHNFIDVVDYCSFYSSLENLLNELIKYIESK

SEQ ID NO: 19089 - protein, 254 aa, Candida albicans
RQSIMDETNSPGKKDNRSSASPQIPKKRSRVRQPLSCSVCRKRKLKCDRARPCGTCIKKSIVHLCHYEDDNRPPINHFLPPEQQLHPTHIDNNGYIITDQPPPIHYQDPYNNHNHNHHFQQQQQQHHHNTNNDSNFDPSLLHIQANGHNQFQHQPLSSHSPQGNHQYLPIPPPPPPPPQLQQSQHPPSISPAGYNSLIKMSQAQISIPTPPPATKSSTSTSNHSSPNRPPTSSGQSSYHTTTTKNYSNFKPSTV

SEQ ID NO: 19090 - protein, 248 aa, Candida albicans
QQRIPVSGTYDEFKAAGENIDFQSTILSRFDMIFIVKDEHNEGRDISIAQHVMNVHTGGRAQDLLQEGEIPIEKMKRYIQYVKLRCAPRLTAEASERLSSHFVSIRRRLQLNEAEMNERSSIPITVRQLEAIIRITESLAKLRLSPVATEEHVEEAIRLFTASTMDAVDQGLGSSNDVTLNAEIKKVEQELRRRLPIGWSTAYKTLRKEFVDSGKASASALEKALYIMERHEVIKFRHQRQNVLRVGV

SEQ ID NO: 19091 - protein, 429 aa, Candida albicans
  UNSURE (360): Identity of amino acid sequences at the above locations are unknown.
LQVMSFERPEVFSAHVLPGEEPAENSYNEITKAFRSFILEYRIDSQFIYRDQLRENLLIKNYFLKVEADHLIAFNEELNKKLSDDPAEMIPLFENAITDIAKRIAYLSNDEIPQDFPTCQLILYSKANETSIRHLDSDHIAKIVRVSGIIISASVLSSRATQVQLICRACKHTMKITVKHGFGQIQLPPRCLAPHNSDPNSTEEKCPNDSYVIVHDKSTFVDQQVLKLQEAPDMVPVGEMPRHILLQADRYLTNQVVPGTRVTIVGIYAIYQSKQSARNNSTSNVAIRNPYLRVLGYQTDIDNGANGQGIIFSEEEEEEFLRMSRMPNLYETFVNSIAPSIYGNEDIKKAITCLLMGGSXQHLPDGMRITSDITVSLLGKSWYRQIPIALNLLEKIVPISVYTSGLRGPLQPGLKSLQFPSPSPKNIQK

SEQ ID NO: 19092 - protein, 147 aa, Candida albicans
ILIHYNHRHYEVCLIQYWLFLFLHFRILTTRFLFLFSELIDRPRSELTELELKTLEEYEFNHGPMSILNNAVKNDSPIIISCRNNHKLIGKVRAFDRHCNLVLENVKELWTEDIKNNKGKKIKSISKERFISKMFLRGDSVIIILKA

SEQ ID NO: 19093 - protein, 312 aa, Candida albicans
TLHLLFVRVILLSGNKVYEMCIQPDSLEDAYKIPRPVHREEFTQLSPSFFQTATFQLEKTNEKNNIEEPKKNKAFLNSKIIYKDLFEIRKLSNNFVNTSHPTCTETMNEQNEFSDEENFKFFGLGGCNEVGRSCHIIEYKNKVIMLDSGMHPALSGHASFPYFDEYDISKVDILLISHFHVDHSASLPYVMQQSNFRGKVFMTHATKAIYRWLMQDFVRVTSIGNSRSENGGGGEGSNLYTDDDIMKSFDRIETIDYHSTMEIDGIRFTAYHAGHVLGACMYFIEIRSLKVLFTGDYSREEKRHLHAAEVHH

SEQ ID NO: 19094 - protein, 85 aa, Candida albicans
DVHGDSVPMGTLKSALLSKYASRKGTDQEVKVYNPKNCEELIIGFKGLKIAKVLGSLAEEQLQVLKKIIQHELSAENSKITELTE

SEQ ID NO: 19095 - protein, 98 aa, Candida albicans
KEEADDIKEDNGETDTTQKPNESSINVLKTGQVVSGVLVSKDFNLNLLQLQDLHEFTQLSTSIVKSKMHLIINADISSMVWHLEQMFGYINVINDDEQ

SEQ ID NO: 19096 - protein, 235 aa, Candida albicans
FLFLFIESDQNNRPINHIYLKMAQEVPTFKLVLVGDGGTGKTTFVKRHLTGEFEKKYIATLGVEVHPLGFHTNFGELKFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLAKKLVGNPQLEFVASPALAPPEVQVDADLMPKYQQDMEQATALPLADEDEAEL

SEQ ID NO: 19097 - protein, 155 aa, Candida albicans
PDLDIMPKYYCDYCKSYLTHDTMSVRKSHLQGRNHIKFYCDYYEAKAKETNIWNPLSIPYEITLEKLNRYSDAKKSNGSSEDNMDIDKKENSLDHNKGNVVNHSDAGNDNDDDDDEMIFLPPPPNLSGLPLPPPAVYNNQKEYQKAILRQTLTKS

SEQ ID NO: 19098 - protein, 437 aa, Candida albicans
  UNSURE (370),(371),(372),(382),(396): Identity of amino acid sequences at the above locations are unknown.
HSAVMAKRVADEQITKDGMPNYSDGEPDAPAIASSDVLSRRKILKPKGRLGSNTTGAGSNAFGAINKPPQSIFSFGGSGNNAASGITPSQPAQSSNPFNFANKPESNTVNTASVDKDNKIKALNENFIQAITKLNVPNTIADFTPIAQKYIDYYKSILKNETFLEIASKEVKEPVQPPPTSSFQFKPSNVSAPSAAATVTPFSFKPSAQSSESKSNGPVFSFNSNSQQQTTTKPAFSFNTPSSSITGSTTSAPPTFSTEPVSSSVPNEASKSETKRELINLDSDSESESDKEDSKTKEVKVQGPKFTLTSNPTTKSSPFTFDPKTLAKKNAPDSDDLEDDVEIKGPTFQFNKPIQDSVFKLTSNSADNTXXXDEKKEEDEVXSTPLCGGTTQEQDXATTLKSLFGIWPKQGKVKLRFQFCLEGLFGSKGEPTLTQNH

SEQ ID NO: 19099 - protein, 666 aa, Candida albicans
QKQKKTKKRDHHHHHHSPSISSIHIFHQSATSQEVIEAPKQSMPDRKRSLSPNTETSFNNQNYNQNSSESSNKLSNGSLKFKPSTTATANESYKSNQSTTYSPRGRKQDQIDNDIDLDGPLLTNFESSDKRKRLSIQGHPPASGIPRSSVYNSESLPQNKLRSYLIICTDLKTSEEELNNDLEVRVTTKDNYNRSIGVSDVEDSSMSRDVSPFVNLPHAPNSDIITGAAKYNDEYDDDKISDGGSVVYNEGALVMQKEFGSLYQDEDGNLIRPPFINLDPRERYQLLQLKRSIELSESLQKRIKYMINPNETNGKRIPGTNKVEMSTQTHDLNYLSTKLNFKKRSPSLSFDRTEVSRPIKKPKRKGFAMKEFLYDVNEEKPVSSTSSLNGALGSISKPKFNSQPKTQDKSMTQIISREDEEPSFKTFGNKTGRDRETFGVINNAKLTLDPEYLEKTSSSSISDIIKLKEPTTLESSKPNKPTTGPSCGFKFDIKKNDFESIINDRKQNQEILAKSKLANETVPENVKSTDLNQSAKPGLFGSKPVPSQEAPKKKRNLSDSESDDKPPVPSFLFGSANTSKSATPSLFGNKEKSSTTTSLFNITNPKSNEDKDTATTTKPLFAKLSTESETIFDKPKFTFGAPASSNKPTFSFGKTPFLPRASKDRT

SEQ ID NO: 19100 - protein, 253 aa, Candida albicans
KTREDKSEAPKFVFGSSKANPFTFGASNNQGDSATTPSFNFGSNSSNNAFLFGSKPTGAFNFAQKQEDQKNETSSTVTTSSSSFGLTKPAFAFPFGSAKPEDKPEEKKNEETVPEEETGGKFEPVAKLSNEQVDSKSGEENETAKFTIRSKLMEYDSKNSENPYTNKGIGELKVLFNEQTKKSRILIRADGSLRVLLNTLILSSVKYDSIGNGSLIRVPTIDADDSSKIITYVIKVKTPQDGEQLLKCINELK

SEQ ID NO: 19101 - protein, 347 aa, Candida albicans
RGSFQPRGVKNSKITSPSNFPKIKFSGRLRVVLVPYENICFIGRYSLKTSVNSIINNEKSAVQEASEQIQILTKYQNSFEELAFKFTRQLSLHDLTVEKDQLLEKLKLSKAYVCPNFRQHYVEYLDRYLLSQEVEKLERLISDENLELLPDYEQRLQVLEAMGYIDEQHNVVLKGRVACEVNSGWELIITELVLNNFLGDFEPAEIVALLSCFVYEGRTQEEEPPLITPRLEKGKAKILEIAEKLLKVYVEKQVSLTLEEEDFVESKRFALANVVYEWANGLSFNEIMQISVEAEGTIVRVITRLDEICREVKNAALIIGDSTLHLKMVEAQEKIKRDIVFCASLYL

SEQ ID NO: 19102 - protein, 736 aa, Candida albicans
EMIIEEVPTNDPLVVDPTTVTTYECPDLNAEERRQNLKTDLLNPSPEINWEILDLVNKPLEINREKIIDKLVINPERLSRTQFRFKRSGIHGHITGYQEEVNLNELENSNTSLSINRGYSSKSESLRGNTSFLPFQPGGLIQQAATEREPKDSGLNLHRNEHGLFDIPPGFVRGLEVGGGGSGSGSLDIEPASSEEEKDSLEGVHISAASEAALNKSTILDGDVSKPKPTVPFDNKEIEGLVPFDYSNFKYTDKKNALDKRTWAHVVDLDHKIEDFQELVPNMARTWPFELDTFQKEAVFHLEQGDSVFVAAHTSAGKTVVAEYAIAMAHRNMTKCIYTSPIKALSNQKFRDFKETFKDIDVGLITGDVQINPEANCLIMTTEILRSMLYRGADLIRDVEFVIFDEVHYVNDIDRGVVWEEVIIMLPDHVKYILLSATVPNTFEFANWVGRTKQKDIYVISTPKRPVPLEIFVSAKNQLFKVVDANRRFQENEFRKHKDLLEGGGKKNELPSTTMGSGSRGGPGGTARGGNRGGRGGRGGQGRGGNANRGNFSGPKRFGRDGPKKNTWIDLVNYMKLNNLLPAVVFVFSKKRCEEYADSLRSVDFNNAREKSEIHMFIDRAVGRLKKEDRELPQILKIREMLGRGIAVHHGGLLPIVKECIEILFAKSLVKVLFATETFAMGLNLPTRTVIFSSMRKHDGRSFRNLLPGEFTQMSGRAGRRGLDKTGTVMVIAYDF

SEQ ID NO: 19103 - protein, 165 aa, Candida albicans
NTMFNTKIFENTGSSGSTTAMNIPVQSEPSNTNSAQPQPIDITFNHRPSVFNNSRFRRDSVAHSQGMGGISWGSVTIGSWLKDEVMMASGGNNNHLNPHYHPTQSHNNQSLYPNYSQQQQQQQQQSQHQQNLINPRTGSFRTSNHPNLSPHLQTSYLPELEARLL

SEQ ID NO: 19104 - protein, 287 aa, Candida albicans
KPDYCNDYNCCGQLLPTLHDLLRHYDEAHILASPQPDQTHFIVNVRNGNNYDNAHNVMETVSTTDVFLNNNHNNHHAPSMHPSATTTNYNGNNSFGNQQAHQILQQHDQQQQQQQQRQQQQQQNQNQLHHNSDNYQHLLQLTSRQPGQQFGQGNSHFGPQQQSPSSGSQGGGTPMQTDEDDMYIDDPARHLYVMENEENKPFKCPVIGCDKTYKNQNGLKYHRQHGHQGQNLRENPDGTISIIDPDSNCPYLDNAALEKDKPYRCEVCGKRYKNLNGLKYHRGHTTH

SEQ ID NO: 19105 - protein, 273 aa, Candida albicans
AASFLFQTRHLTMSHPVTPQLGVETQKPPEYDNLVKLINLSLSEPGNSPTHETAIKQTIEYLRKYKNDPHWFCRPYMYPIACYSLILFSFPNNPVLEELKVYIGKSLLTCPYCLRAFAIAKTHLRNGFITMKKTPIVNVNQFLKAITTWEATLVQPCLNLVYNSLETIEKVQKQLDHCRDWFMSNPDLLRYYKDNKEKFAHIVKVLCASGKLPSPGTLFAGLVYLLFEGSGEEKLWACQWMEEMRLQKIRYNKLSLEEPLVVEFSIHLYRILD

SEQ ID NO: 19106 - protein, 800 aa, Candida albicans
SYPPQKKSSMNDYSFQDFTDWIFLFINSLSGSQKQNASMKIGAYLLRQGNGYASSTNDLRSQRVNTLKEFGVKIFAGLFPSTVIDMNPKDPKLSVEIMSFRDVRAALEYEANTILSCAMNSPQNVDAMDLVRRCLIYDVLILVKNSYLLLKGEIPNMFDTFPIFWSSILKLKLYSNVSLVKVIIQCLRLMPMAIKFNEIKYNQANKDLESAKTQHNKSMNTICDLQNQIFSSFSLCDPENIKQIINDFDCAESVWGCIFTPLISQAALDFMNEVYNASGRLETFQECFSNNLKLSLVSININLANLTSLACYEPTPKAIRIIMDIIKALADPVDSLLSTSAANCEGEVVLFWKNCWTFLIMVFKETFVWANQFHLDELLEFARDTLDLSHLLLDSFRFIVDTLKEQTNKDMLYEFFGSFMNAFQHIIVWLKLGDLSLLNSCVELVIKGFDLASEEDFKVQDQIVEQLWKYSKKVKGHNNKLSESQRMMLMTKARELNEALVETMEREESEQKYARAGAKAEPKLRPADDEIQELRPEEFAKKINKKQQTLEGFVSFTNKAPVAPAPKEVKGTQNLDLIRQKLQQSRSSITGPPKSHLNPAPPRPAGFNSKKSPPPAPSVAIGRPLHAVKKKTTDSESSSEDESDTDLTDLFVEGKAKKIAKITEVDMNLKTIDRSNLQKRRKQIDEAKMAKERMRLRLNVNLKPLYLTVLRWNYNSKSDFPSKDKSIYQEIKDTYKDVKDYVQVTEPLLMLECWQAMQSAKLTVDEKPFELLIGSRTLVDGFFDVFASMVFTTSCRSEYV

SEQ ID NO: 19107 - protein, 405 aa, Candida albicans
  UNSURE (1): Identity of amino acid sequences at the above locations are unknown.
XSKFPSSEFYNSKLKDGDGMLELNTRPWHKDPPLTPYRFFDILGKHEKNELTRSLFNTDEAIVALQLTDKLMQLLPQDKFSGKIGIISPYKEQIRKIKEVFVRKYGKPILDEIDFNTVDGFQGQEKEIIIMSCVRASATGNVGFLSDVRRMNVALTRAKTTLWILGNKDSLSRNEVWKKLLTDAGERNCITQAYPGFLNPSNPNSGLKRKEENVFTPQQTKFAKKQKVSNESERNVHKIRNNLTKPTYRPTNAGVLPSKSKSSNGNNKPDYLANNLQLSAKQSNKDTKSNTTDDAPKPYINQPKPQGDPKNGPTRSGTISKPSTTSTPAPTSSGTVKPNKPVDAGKSAHKDCTTPQNKSVNSSAPSVKSTDAAKKPTKTVAPSSSGVVKPPSNLFIPRKRPFAKK

SEQ ID NO: 19108 - protein, 242 aa, Candida albicans
  UNSURE (10): Identity of amino acid sequences at the above locations are unknown.
SAERPSPTLXQGTVLADRKIGDSDLVVLALKDESLQHASDIRRYIKADGTMTCLAKVQDTKYSNSDYCDVVLRVYPSGPMMGALTPKSVVTGMKVMQMVTIERELSSLKGLQYYDLADSIILATPNKPIEIEDEDAKKMRKIYHVNDSQARAIMGTFNSEGFSLIQGPPGIGKTKTILGIVGYSLSQEKNNKVIDISGSGSIPTPSDKANILICAPTNAAVDELLLRLRDRVRNSSGGTYAT

SEQ ID NO: 19109 - protein, 989 aa, Candida albicans
PLQLYMNNNVASSQNSGKSSLDNLVHIASNMSQEFRLPNRPSIPPNQSLSQTPLNQQPASEYNSATSTPSPSMATGLKTKRSKKMACVECRQQKSRCDAFEKRPDPCTRCAKKGLHCDVKSDYKRTYKRARMAQIEKEFEELKKTLTTTQAAELLTKFPSLSSASPDTNPQEETLQIQVKIEPGTLNDTTQGIAGVGVAKTTSNVDLPQHSTKAVEGAYTQQNSTKNTQFTPYRILSHNSSETSQSIPNTPSITRQVESNTRSQIPLAQQEKKVELLDSSLICEEKSVDDISLMPETIKKLYLEYFERYHPILPVVDVSLGPERIYRLCPALFWVIMFVSLRRFPDNSSKSLLVRLSPIVKGILAEIMISPITRYNPIEEDEPIYNVSSVYSVQAFLLYSYWPPITSSLSADSSYNTVGTAFLQAIRIGLHTPTLVNTSEMNKDEKTKHQLTMTHEQLKTWIFCNIASQTIATAFGFPACTQFESSMWFYNQPGSSIIIPRNLQLMMEIAQFEDQMAKALNSNPMDPCGLIDASERLPLLKLLLKRLDTIEITLKNEMLQPSDRRFRVFEILSARVHLLSYYFMDTVRIAQFELQKGLIRLYNAAIALINHTSECQAEDKKFVKYLPGVYLLNLWQAGCIIGKLIHSSLKKFIDVGTGKQSYESVITFTATASILKHDMAYRSSGITRNMWQLFRELDAKKMNSLSIDIRNRMSASFFFDCLKLLRAQVGITKLTTKTDESHPVDDDEAIEESQEEVEDEDDQQLAEMGNEKAAPSEDEKNGSLHNVSQKSTPNSTTSSRVRRARTLSNNMDAESKTRKIIRTIPLDPEPISIGASKRSSIFKVVNSSTDSSPIMKSDVSTPNSNRINDHQTRTQTYNPSHVGKQYLQQLPHISSKQTVQSSQYQHHQQLQQPQQLQQHQYEQILQLDNRSYQPAQNISEAPLLQFSAFAFNESPIQLGLENLDIDNFDHDMLWKDVDSVMNDFGFHTS

SEQ ID NO: 19110 - protein, 1131 aa, Candida albicans
HTHISNNCINQILPIKTWKLVKGKMFLSISQLDKSTSKSNTGLPLKPIQPTQYWTFDNALSLLRNCQDPYLADALDEFLLSSKEVLLNPSPFTLKNDKQSPNLQTRDISLRGILYTNISVQDTSDGKLLSNLLNLDVLETIRVICQTNKKIPCKTAPPQLEAIKSKLHDKKYYENKRLRLYSSKILRERRIILKIVTELLNNKSNSYASSSIQNLGKEIFLSNQYLESLIVYIGNASHSLMKSSYITGINKEIDETIHNETVLFCIEACKVLIELSVQNANVDAQAVHLWFKLMRDTNYSVALGPYVSYHEAFSILQGLFTVLTIQYLNLNNSFDSVNETLSSSYMADVQVFKYVHDAIANPANNIFVVLYSCSIILLRKFYFLQEYPELPNSEKFLSQFNLSQLKHTINLVNQKCDNLDVFSSLKKLNELLKFDKLYSAILSTLIIASLPLITLTSEVTSCILSVIGNCPNNVIESFFENNATQNAIIIARTKFPLILSPYIQVASINGNFALHEFNDLKSYIQVFKKEEFNNMYQIDDQNTELVKTTKFIDVYPPFEANKKLSMVLSLGTKAKILPSANPDEVLVTFLYNYNGWAFLGRVLQNVSKIFNNSDSETMELVINILNSLNNVVIDNGVDDSKMVLEAMSAYTDDSDILEVILRLLEQGLHLRNVKLLVSVVNLLTNLMPFLSYRIWPYLSKSALFAQNGKEGLAAVIFGSIEMVNGDYNFTVSLIKLAEALIQNCLSLDQDYPEKSKSVIMLRFVGHLVDLFETFLYCRYNEQCQKLEIGVLLLDTFSTILASVYGIDEGVPANTKVTKVFADAASRILDSFLISDEDSPRAARLIITMIENLSQDLDLYELTDSSSFWYDNWIHCALSFSRLIITIRTSEHLKPLAFEKSLFTKTSDLVLSYSRFESVRKDILDLLTALTSGDWPDGTAPSLLSHLGSENAQVLLHSLAADLDNSFDDYKMKISLYDFICAVMEGKQEGLAVLFITGRDVFGDYTSKDDTEATKKLSLLQILKKNIRDMRYYPNSVSIHLVDAIALACNSWTTAKESEHDDEFIQTLIGRVKLQILDPPDSSESFISRCYELKLVSKIAEILALYLFTVRSEKTRDKIVLHHRGSKDAAKR

SEQ ID NO: 19111 - protein, 271 aa, Candida albicans
  UNSURE (270): Identity of amino acid sequences at the above locations are unknown.
TQVRVRPARGEELEIVKIASTLLSSSSMNFFTNLAESRGCYKPLLKLIYCSLKLIRDASLVLAEYLSLFRDLFNAIVIKGTQILLIEVQNDVYLARTRKNFKSPKMNDRIDDLMIILSVLKVFVGAQFGSILHEEIALSIKENGTINSLLNLYSFAHSIEVNDEFIFARLSLMYLLELMSVNIIAEKVIASGLFLVLLESPISRPIRTGGVSISHGIHYHRLWKNGILPIIITSLFKFRASVVPEICVVLQIIGKQTQYCIKNWSTYPSXH

SEQ ID NO: 19112 - protein, 82 aa, Candida albicans
ATKKERTCILNLILRNPKKSLQLIKNWCLYVLKLVFLRHIHSWSKSVQSNSNQLKSFPSYKNRTRLSSILKRPMSYQPLPRT

SEQ ID NO: 19113 - protein, 178 aa, Candida albicans
QIIVLVHLYLPHDMSSTKHPPLPSVTNQKRKRKRQRLFAKDIENLLYAMGDRPVSTEATVNALEDVLVEYISQISYSMVNFAKSQNRTRVKLNDLAFTLRNDPMKLARFRYILEQSYKIEKAKKMFDDDKYDNKNHEDDDDDDEEDEDDHENERNMKDKSTTKNDSKQLKKKKKKNHT

SEQ ID NO: 19114 - protein, 750 aa, Candida albicans
  UNSURE (7): Identity of amino acid sequences at the above locations are unknown.
RPTYTGXVSHPNNTTSRTSKDDEINQLKQRVRFLETELANKRLLANKKGFSNDSPTDLQSPPFVSKFDLESEISILAESSARLTDLTNQLNEAASRRIQLVSAKKPVDLISKGVITVAEAEERLKLYREQIYGRHPLIAIPDNMHAIEFLQSQPFLFNSIMSACNLITKNADKDVVLAIDNEAMTSVAVKVMVVGTKSVELVKAFLVLCLYYNSPELFKQRRYHMLNTICVSLLHDVGIFARPTYSYNQADGTLKQDANSKDKGNDEYRELVLITYFVTVSTCLVLRRSIYARWTPYVEECCSLLENSLQEKHRRLALFARMNNKLDKIHHIVHAPEMPGQKSGVSQYVIQELQRLLSDLKLKIKDNQYSLLSYYYSIEAYLHEPILTKVFKSDTELDGKAMKSIRYCTSSCLNALDEYSKLTPDQIALLPFPFGSRIMYTAGMLLRLRYLILSLPSHIDKELVPKRAVTSIQCVSKLVEQANILNPHNHYLTKMRLVLQLFIQTYATQVLELLSKNGNTPQNFKPDESETQQLRALAREYNDIRKVSKVSLVSDTRSAEPLDVLSYAATFRRENNDKPSAVAGSLRKSFSENDQAIKTPCQCGQFVSADDTPVPQVINSHPILQTNVPVLHQSQSIINGNNRNSAPLAFNNTTTPSLHQFGDVLPPSSMPQPDYRQFRLPSISNTVHYSSNPRLNANLANPDQLENSYQVLNDEFWSNLLSTDSTDRINFTSNNFNGNTSNDEVFFMNN

SEQ ID NO: 19115 - protein, 104 aa, Candida albicans
ASLLTTTTPLLITSEKKNLFFLSFVLSFVLSFLFQHSPLRTNLIMSNLTPIATYNLALQPFQPVPAIEDDFPISITITLASLDPEAADDKAEPTSLRILKKSIS

SEQ ID NO: 19116 - protein, 232 aa, Candida albicans
QAFSMVNTDFEKIYLNQSRAGGRMRIAESGLGWKASASSGSTSQPFLLPREEILIASWSIGSKGYELRVQTKNKGVVSLDGFDHDDFTQLKQELTRNFHINLEHREHSLRGWNWGKTDLARNELIFNVNNKPAFEIPYSDISNSNLTGKNEVALEFNLDNNKNGDEIVEMRFYVPGTIENETTIVKNETNGDVIEEAVVNETSAAQQFYEQLKDKADIGQVAGEAIVSFSDV

SEQ ID NO: 19117 - protein, 68 aa, Candida albicans
IQYEQIERIFSLPKPDETHHLIVFQIDPPLRTRSTKYPFLVLAFVEDEETELELNVREEDLKRIAGME

SEQ ID NO: 19118 - protein, 251 aa, Candida albicans
IRFNKRKESVSTKAIKPENKQVKIEIDNDVLSDQFEEKQEESDYNEAEDANSALESDEENISQELEDLEVEYSTKKKLKNKKLLRRSKAAATPSPKRKLQKKDIEDIYSVVTPTKRMKLGKDDRDSLPVFLSPTKSVPSEFTDPKSVAFKEVKQRLHTSQKLNALPGREDEFAMIYMNLESAVNEKTGCCVYVCGVPGMGKTATIKDVVEQMTYSSERGEMEQFSYLELNGLKLLSPTDGHFQQTVGRSSV

SEQ ID NO: 19119 - protein, 329 aa, Candida albicans
GGGTKFNAIKNASINLLRGIISKRGRSTRGNLLVILMDEFDQIATKKQNVMYNFFNWPTYSTSKLIVIAVANTMDLPERMSTNKIASRLGLRRIQFRGYTFQQLGDIITHRLEMITKNNRRKVVITSDAIGFASRKVASVSGDARRALTICRRAVEIAEKEYLENKKGEDDSGPYQVLISHISTAINETVNSPLSKYIASLPFASKLVLASLLRRSRRTGLAENSLGDIIDEMRNSFAMATHSEEQGSDELNMQDVLYSDKTFTATNETAPILNLRIHFFKQIVTSLVEAGIIIQQNSPGERSRLVKLDVPEEEVVSVFKKDNAISQFL

SEQ ID NO: 19120 - protein, 222 aa, Candida albicans
RGSYYAVVRLVSYAGIRILRQDPWECLISFICSSNNNVKRISKMCENLCINFGDYINDFEGHEYYTFPTPEALSKPNVEAKLRDLGFGYRAKYIYQTACKFTDNNKYPDITIENLNLLREAKYTTAHEFLLQLTGVGPKVADCICLMSLDKHDVVPIDTHVYQIAVRDYKFKGNKSMKTLNKETYAAIRLFFKDIFGEYAGWAQSVLFAADLADLNNGTEYY

SEQ ID NO: 19121 - protein, 261 aa, Candida albicans
VSFMEDSICILTVLYLKQLPLQQLQLQLQLETKQFQTIKIGKFFNKFNHEKCFKTSIQFWNFYFQFELTQNHWKNLKSLINHIKFNTQLPKIIIDSFIEWMYEISNDNLINFLKLNDGRSDETIIMKDLEISNSLYYNKTTIKRHAKKNNYIIINNNNNNNNNNNNNNNNNNSNNSFDKKRNNIGGEEEFLRLTSKQIGHPGIFIDAVPQITNRLMLDGNDIDLAQENLSIPPLPMFKNVEKASQPIKYPSTTTTTITQTR

SEQ ID NO: 19122 - protein, 303 aa, Candida albicans
EKDEGIANNNNDDTTPNWESKLKLELTDSLITLVISFINDESICIMTVLYLRQLRHQQLQLQLQLEAKQSQTIKIRRFFNKFNHEKCFKTSIQFWNFYFQFELTQNHWKNLKSLINHIKFNTQLPKIIIDSFIEWMYEIYNDNLINFLKLNDGRSDETIIMKDLEISNSLYYNKSTIKRHAMKNNYIIINNNNNNNNNNNNNNNNNNNNNNNNNNSNNSFDKKRNNIGGEEEFLRLTSKQIGHPGIFVDAVPQITNRLMLDGNDIDLTQENLSIPPLPMFKNVEKASQPIKYPSTTTTITQTR

SEQ ID NO: 19123 - protein, 570 aa, Candida albicans
STMFEDITFRNNEHRRATRTSHRLINKYQELKKFTEIYKSSSKIKAKTKRKSQHRPSQKKKILQLIHQEFDKRSLLKPEETYEIWHELSDSINKNVAKNNSKKKLDRKHKKGSKGEFGIDTEPEPETGGELSIDQGDELLRKKVNDIIEGNNEEEEQEEDEKEDEEPDEDENLMTHKLNQFVNNFDTSNRLSKFKFIIESNGLEILPRINEEDNTTTNNNNNNNDTDPIEMIHKSKSAFRQHINNLTTLLHLQIMKQNWSIAYKIFALLIRFPQVDIRTIWPLGIEILMQLSNKNGSNSLKVKKFFNYLSSFYMITDTNPATRFISTNHKYRNNVAPVWRSGSKTLTPLYVITSLWYIFVLGDYEQVLNKINELILEPPYNSEGVLYFISSLCHLCLGWKLVDTYITGDNDNFDVVDERYNVEKQLNIIKNKMNEDFEKCEKYQFIYPKDEIESQFKELLTVVSNKSNEKTPTLNKNGNDITMNNVSASSSSSLEENDLDWDAISSDEDEDEDDKVHTKANSLIPTQIDSLYHLKNHNGNKQHHINHDDENLVEVNFSDDESMDGESNIH

SEQ ID NO: 19124 - protein, 169 aa, Candida albicans
STLNFLCSVLNVFFFLFISNHVLFLSIQTRLFLLINTNIHNSQTLPPTLKIHSYKPCNMNSRPAPPQPRPPQQQPQQPQPNQQRLPFRPDESRARRLNQPLEQHANPINPSNFAAREYTEQEHKDIPTKLNKSLGPEFISYRDGPGGTRVQYIEGWKILNLANEIFGFN

SEQ ID NO: 19125 - protein, 612 aa, Candida albicans
TFFFFLFISNHVLFLSIQTRLFLLINTNIHNSQTLPPTLKIHSYKPCNMNSRPAPPQPRPPQQQPQQPQQPQPNQQRLPFRPDESRARRLNQPLEQHANPINPSNFAAREYTEQEHKDIQTKLNKSLGPEFISYRDGPGGTRVQYIEGWKILNLANEIFGFNGWNSQIVSCQVDFLDTHGGSGKFSVGISMVVRITIRDGTFHEDVGYGSIENCRSKILALERCKKEALTDGLKRCLRCFGNVLGNCLYDKTIVAQMKKLKKFPIEFDPNDYYRDPLLVERERKKNIIEKQHEEQKRQQEDASRLDNSGQQVQHQQQNNSNVVSNGSIPVNGQQNHQNKGSDIVEPLEANQGNTRAGQVPQLSHHAAAFVTPKLPTKVVSYVPTSKEAEELDDSFMFSDDIFDGESQSIYYPPEVREHEQNQQQQKEENQGVARNGATKETTNNGRSENRPQNECMAVDQNPPVLMNAFVTAKSAEVLQQSPTVEAAAKNIVQFDPKFVSPNMRRTVDPTKSVPIKRSDIKNSVATTPSPLCVITSSNRINKPMITSNNNNNINNMGKRIGMPPQPRTNKLVNSGNNPSSGIPHTVSTSVNGASGNENVENNSTIANTTVNQ

SEQ ID NO: 19126 - protein, 343 aa, Candida albicans
ILHSHLNMTTFSREFTKVYDYQALFNKVLNKRLRFVLNINLILSFILALVYEFMPTANSNSDTNHSIWQSIPVLICVKVPTIFFTLSVIRQVRKQFLIVEYSHHKTLGAQIYYSILSFQFLINWLGYLISSWLIFGVVIVFTLKLKFNLSDYYILSKEYRQHPIINDQWVYYWYNPVFISFFYTCNQLIFQRQRLNFEIGNIRNKPQNYLFKHLPILLGNSLGLNLFVISLTPITYWLVKYYIYKSFILIILIFRLDSDIIPNNNTSWITYLQLSYLSFFIILSWEVVNHVFNVYATIGCLDGNKPISSYSTDPLNCLLSGLRDVDPNYPLSLHNALAGSINQ

SEQ ID NO: 19127 - protein, 216 aa, Candida albicans
LLSSMMMHLQQTPTKRSILPPITPLTNSNNGSKLSLPPLSSILPTAPSSHYRDHPLTTSTPYKAPLPSINTSAAYQSPSMTYGSYIPTPESATSLVTSSNKRSFSVLDDSSIMDTSILEERKLKASTSSSVASTSSSSPTLSSPASTPTDNKAYAFISHSLATFPLQEPSIDNAPLARRKRRRTSPHELNILNQEFALGTTPNKSRRIHIANKVSK

SEQ ID NO: 19128 - protein, 932 aa, Candida albicans
FCIFFFSSQSLFNKCYIEKKNRDLWSLIFTAIYTSSQLYQMSDSDLPVQVKKEPSFANDDDLTFDEEFRRAGDQENKEVENPDDGRSLKRTREELEQEENNEKEQDQEAGQDEEEQDEDEEEEEDDEEEDEEDEVSSRRKRRRGANQFFDIEAEVDDEEEDEEDEDEEAELMREEFITDDHAPVETVEKMPQDDRLHRQYDNRRQQAEDQDAEQLAETLKQRYRKTHSVYRGETAASGTVSQKLLMPSINDPSIYAIRCTPGREKELVRKLYEKKRTLERQGNPLDILTVFQRDAFTGYIYIEAKRPDAIDKALVGMVNVFVRDKLLVPVKEYPDLLKQVKSSDVEIRPGIYVRIKRGIYRGDLAIVDNLSENGLDVRCQVVPRLDYGQNDEIGPDGKVIKLKIKPLPALFSEQKARMYDPYKLQMGRVPNSFIYRGNEYYDGYLYKDFKLQFIQTKDVNPTLEELDRFQNQNDEDGLNLQAIAATLKGNNAGEGKSSTAFQPGDKVEIRRGEQAKTIGIVVETALNEITIKVTDSGDPRFVDQRLTVPANDLRKIFYEGDHVRIVEGKHFDETGLVIKIDGDSVVIVSDQTKEDVRVFANYLVKATDASSNFDLLNSKYDIKDLVELSGLTVGVIIKAEKNIFDVLTTDGRLISVRQSGIASKLKQSRREQVATDRNGTTIRVGDTVKELLGEKSREGAILHIYKNALFIKSNEIVENLGIFVANRMNVTTVATKDSTVSKSLGPDLTSMNPNLRLPNPVAVAGLKTRVGGRDKLLYKDVAVTSGSYKGLKGKVTEADDLYARIELHTKSKKIKVLKNNLNVIVHGQPVPYLRFIGAAPEFSQPTPPTYGSSSGGRSAWNGGMTPSVSAGNGGVSAWGGSRGGFGGNGGKTPAYGAGGASTWGGASAWGGGAGGSSAWGGIKGAGSVWDKK

SEQ ID NO: 19129 - protein, 351 aa, Candida albicans
KMTDIKRNFSDIASPANLDDTKKLHVDSTATTKVGRKPIDTEPKSKRTAQNRAAQRAYRERKERKMKELEDKVRLLEDANVRALTETDFLRAQVDVLKNELAKYTGGSDFLDLNLPTKVGHLSHPNNHHSNVSTGTPHGSISSSNSVASLDNDKPSSASSVSNNSPGFAFDNPWSKDNIQKLKHQHQQQQQKVPQGVPDLVLGSSSSSTPLNDNLLVTPESLTGLSTSSKYTGQNNVPTNLDFTNQFDEQVDPFCVKLNEACGTKSNPVPKFKRSGSKANTSVTNNSPLAHLVSPESQQYTNSSNIDFMNDPFFNGVGTDYNFNFDSKNGSIQDPLSCLQDDNFDLAWGIG

SEQ ID NO: 19130 - protein, 85 aa, Candida albicans
IHIHPADAKLQIIMDQEDKDEVVLAPPQTLKCSEIWDRITSHPKYTELDIDGLCNELKSKAKCSEKGVVINTADVNQLLERSIKH

SEQ ID NO: 19131 - protein, 180 aa, Candida albicans
IFYSMNVFTSWTKSNKAESVNSHETPQFASAVTQSNTTNSRPKGTESIGPGYGRVQDLSAHAIASQTQGSPSASSLEVKVDPELPKTHGHRIVSTTKRAEQNRNAQRAFRIRKANQFKELESKAKEVDQLKQKIESLEARNRSMANYICELQRQIIEFNSNKPPTKSDKNGRENNASTDN

SEQ ID NO: 19132 - protein, 334 aa, Candida albicans
SNVSGAPCRPVVKNNGSNRNYTSAPSGAPIPSNSTSGPSQQPPLPGQQAVPIPPHVSTMQQPTPVQDTLNASSTSTVGQFQPPGIRPRVTTTMWEDEKTLCYQVDANNVSVVRRADNNMINGTKLLNVAQMTRGRRDGILKSEKVRHVVKIGSMHLKGVWIPFERALAMAQREQIVDMLYPLFVRDIKRVIQTGVTPNAAAATAAAAATATSASAPPPPPPPVAAATTTAATAISKSSSGNGNSISATSGGSNVSGASGAGSTTSPVNTKAATAAGIPQGNYYQTYNQQQYPQQYGQYNAPGKNQNTPASQPGSTTNDQYLQQQQYSTRGGRSA

SEQ ID NO: 19133 - protein, 159 aa, Candida albicans
RLSVFLINILTFIMAFKRGAPASNSNEVEILLDLKKQVTVRKYNNVNLVDIREFYTDRDGVKRPGKKGISLTEDTYYKLLEATNKIQNALDDLNGGALNKRVKLDKKEERHEKPQKKEPERKAVIEKEQESEQKEVAETKKQASEPQAEGEEEISDADE

SEQ ID NO: 19134 - protein, 637 aa, Candida albicans
  UNSURE (338): Identity of amino acid sequences at the above locations are unknown.
FFSKKGGGGLFGNWELLNILFQILGELILGSNNTGFGAGGNAFGPTGNYRFGVNQPVITGFGSCTSGGLFGQQSQQQQPGDTGGLFGQNQQQQQNAGGGLFGAKPAGGSVFGQSNTNASGGGLFGGQQNTPTTGGGLFGSKPAASGGLFGGQQSGQAQQGGGLFGQQNQQNTSGGGLFGNKPTGPTTTNGGGLFGNKPATGGGLFGGQQQQTQQQQQPQPSQLGGGLFGAKPGTTASLGGGLFGGQQQTSNVGGGLFGGGAASTGGLFGAKTNANATSNSTSTGGLFGGATTVQQQPQQAQQALASINSQNPYGNNPLFQSITGTSSQQQQQQQQQQXTNNLPQFSLVKSAAPIKKAVTLGSTSQKVTPLFKVSSLPTKTSTELVKEDTVKNKKTDDLFSAATDQAIISSDIFRPKESFKSLVLDKSKASNALLTELSSGPTKQVTFVLDKSESKELSASTPEPLDKDEKSKLELQGEQQKQQQGQDQDSDVDSEGYWMSPSLQELKKKSLLELKSIPKFKIGRKHYGELEFLEPVDLTSIVNLDDIAGNLVTFSNKTCVVYPDDNKPKPGEGLNLPARITLEGCYPINKADKLPILDPKSEIVKRHIENLKTIPEMKFISYDPTNGHWTFEVQEMD

SEQ ID NO: 19135 - protein, 448 aa, Candida albicans
  UNSURE (446): Identity of amino acid sequences at the above locations are unknown.
WSMRRAKCKEREKLREEKKNHNIRILHFNTNQLSLHSQSQLNIEMFGGGASSGFGGFGSSTTTNNSPFGGGAGAGAATTNTGASPFGSTNTNTTGGGIFGSNANSSTGFGSSNAFGASSNTNTTPAFGGNTGGGLFGSTANGTGSSPFGQQQQQQQQPQQTTSAFGSSNNSGSVFGSSATGGGLFGSKPATSTFGGFGSTTANASSPFGASTTNAFGGGASVDPNVNNGTAAKQFTPFTEKDSANMTNVFQNICCMPEYKNFSFEELRLKDYEQGRRFPPAGATANAGFGGAAGTNATGGGFGFSGAATGASPFGSGTAGAANPSGSAFGSAFGSTFGNKPAGTSPFGAASTTGAFGGTNQNQSPFGSNTAGTFGSGASNTFGGGANSTFGKPATGFGSSGGAFGGNTNTGGAGGGLFGSSGNAFGGQSSSRCFHPGSDDPHYLTXKF

SEQ ID NO: 19136 - protein, 692 aa, Candida albicans
VHHHHHHHFHFHFNNKSNTTRFITHQLLLPFSYKYLILMFIPQNKSKRLSLDKIGQLEEDLELNPLDYNKWQKLIDQLIIKDNQEQVRNTFDKYLKIFKFDGASWCKYIKYELNRDEKEKVENLFQQCLGITDNVELCRLYVDYVRGVTDFVTGGEKARGVVVQAFEFAINKVGIDITSESLWQDYIQFLQSWNPNANWEQQQKIDLIRKVYKKFLTIPTENIEVSWSQYTKWENELNPATASKFISEKSGEFMLARSWNTEFNRITDKSLKRNLNPGDHNDEDVVKQLKYWLRWLELEKENKLELKDETVNDKRIQYVYKQATYALPFVPEIWFQYVKYLLVQNEEGNLQESIRLLKEGGLALNPKSMLLTFQLAELYERDNSFNNAKIVFKNLLDALQKDYNSVANQIAELKERIDPATDKDNIQEDDDDNEEEEEEEENDNDNDNGGDLKQQPPSKKLKLNPNGGQNGSNSENNGEAVSAPSSSVKLPQVYRISLADSKQLLSFENEQKRLSDAITLTYVKFMIASKRSEGIKEARNVFKQARKFTDIGYQIFIESALLEHYSDKKSTALKIFDLGKKNFATNGKFLLNYLDYLIMINDVDTMRTVIQSSDANFTKEIGNLQEELKLTNLDPITRKKLEKQITNLKKFLKQLYKKYISFAATFLSLDVTHSFAKKCEQLFPKDDPIDLF

SEQ ID NO: 19137 - protein, 781 aa, Candida albicans
SNTDTFTTHQMIQSEDHNQQPMPSSTEFSMKDSCLFTQPETNMETGGNAFNMSESLLFKDVIHDYETNEFSKANQTNLHDLIAPQEDLEPNQESLKQDSQELVVVDFDDMDQDFSPASKPSKTVKLFSGKQIKLAPRSTERVNIDEKQLSGIFLDMDSLTNKANLRNSFKENRKKLSDPPSLSSIKHDSTSSQIWTEKYKPNSFIQLCSAGNDRQYRLILQWLKKWSPVVFGDDILNTENSDLLGRPYKKILLIHGPTGIGKTTISHILAKHMGYTVQELNAANSMDTLPQASGGGSTAYTNAASALKLKIVNALTSNSIHSQGKPSCLIIDEIDSLANINDVVKVLNDLVQADHRALNKKLKRLSTEEIEAKKKSKKKDIFLNRPIICIANDIYSQQSNRFGPNPMEKLRPISEIIQFRKPTTSKTSSGAKTGGNAIKSVKDYLMQINKQENMGLDHQEIGDIVEICEGDIRACINHMQFNSRIVDTIERRISKDTHLIDRQLSWFTMTDQLFKRDPQLSKEENLARLFDGFMNGEGRALASNSGTFDRVLKGIFDKYLDTVHIQDDSLIKPCELSDWISYQSRFTRINETNEYSPLVLLKASSLFSDIRVQPGNQTLIPNAKNLDFEHSQLLKSNKNIIRLIENRLLVQMRVALGMNAENAASLVLPCLAKILSPHMSAKVKSDLNVTEKKCLERIAGLVKELDLSLEYLKDLETGLSSLKLNPDLDLLTIYDNYLTTIPAASVVKQTQLRRQSLFPLITAQLDRIDVSKKSVKRSFTR

SEQ ID NO: 19138 - protein, 103 aa, Candida albicans
LQHNWIELMFPRNLSNVHSQDNTKESNNGDKAAKRSKTLATTSLNFFKGRYEEVNSKTHTANTDEGSSDGDKEFKTSRIWVKYNEGFSNAVRKNIGWNDLWIV

SEQ ID NO: 19139 - protein, 531 aa, Candida albicans
  UNSURE (477),(495),(507),(529): Identity of amino acid sequences at the above locations are unknown.
IVACINLYVVEENVYFNHNFFVGPFLQTSHKKNTENFQDPFDLHIIERNASINARSKKLILYIQPVLRVCLLPFHFQYSTACQAYIRMSKEFTVFVVDASKYMGIADPNVTDSDFTRALEFVIDFFNQQLMRNRKSDRYCLVVYSGSMIKVIYDNTPLSLVQVKTYRSTMNEVHDNDTGEVHKYDLIHALLQGLDRFKVNSHYKFTRNIRLITNGVLSMDKNKSISEYVNMVSNLNINITFVLIDNEHNEYTQKSLQVLSRTFNNANLVSFNELMNAGPALRLIAPRCSTEGYLGFGELGNTSEIKNMIHLDIQVYPAIKVQSQVHGHEYYVDPKLKERSKIERSTYYYTRTKDDLDEEDDDEEGVEKGDILDRTIVPRAECTPGFKYSHRDILALTSELTEVATLPTSPSINILGFMKKNNFAYAYFTEEATYVIPQQNDSERNRLTFNSMVATMIELDYIALVRFVPKSDDEVQXCAAFPRKVALGNQIGEVXLLVRIAMKEDEXIGRFPELSDTDEYSGRPVDGKXYI

SEQ ID NO: 19140 - protein, 412 aa, Candida albicans
  UNSURE (214): Identity of amino acid sequences at the above locations are unknown.
QWIGPWPVCEDKEPIALDENKYSYLTYFRQLSQVGFQVHQRTIHTCYGHTTKVPIFFNGNGPFSFEYDFLDVNSRKKLVDTVRVSNVENYAIDTPKELIGKTYDLKLSNAKDRFGCDAIIVDANSPVRVVSRLDIPEVEFSRAGQKLQVVEGSYVDIPLSIKSKIAVNGNDKIEVKYLGPTSKEPTIRRAQLVGSSIRLSDEGNYWLHSFESNXCAGRIGKAKQFVTIGYYAKPSLAISANNDMLQHTDDSTIHLKPVCNGCSNEIILKLTGEAPFVVDYEIDLPSGKMETHSMNIDTHDITIKLPTRSNGRFEHQFKRVYDRLYTKTRGKPTSLHVPKVIYDINPLPTAQFLHDDHFTQVCENKLSEDSVIAHVPIQFSGAYPFDVLLTLTNEKIGKMHDILHPTGLEGYR

SEQ ID NO: 19141 - protein, 263 aa, Candida albicans
PASSVVKILWLLPVLNIQYLSFSPLKTLLLTITLYGFSIFLVSAMALPLLSNVFLPIWRFLLQKKELNIIGESIDRSQVIDMDSHFKGQLTIHYLPDSSAKMNPFHFDQTCLGLDNNHLINMPVEFNTTSGIGYLQVQHTTPDNEIQYLNYTGHSLRRLFKKDYTHLSQYKDYKKSDKRIFYLEYPITKPGMYRIKNVLDNKGNSIRTYKSEFVISDCPLAKFFYPPNFESSNGFKCVTTLEDDSFPLPWVEVSSYHPLVCKA

SEQ ID NO: 19142 - protein, 90 aa, Candida albicans
GDYLIEDLHEGDQTELIFTFLGEPPFQLTYIRTIDIRKGKKTFRKLVEKETIKDIWQHELVVMASLEGTYEAIEIQDKYCRAVKKVDYIE

SEQ ID NO: 19143 - protein, 418 aa, Candida albicans
HCGDFRVNMEILNHPILRPFSLTHSKNNLLQLIDKVYLDTSYMSPKHNLPKQELVCEIMANLFQDLIQQERNKDEQKKTTSNLFSNWFGNFTQSRITDFCTTSSTSKNGLTRPIRKKKFLIVIGTYIIGKEKLAISILKRLNNCLIYLLSIGSRKDKFEIFKTYKNDYLNLVMTIEKEFGNINDTNDSDCMIHLVPMTLVSNNEELSKYFNHNKYYQFFERCIGLCPTGWSYSKIANTKKPNQQQQQQKEETENDETGSGCGDRTDDLLISQLEQTITMMKNQPSFNYINDILSQIPTTTPNSTKRKTKTNTKTKTKTKTKTDPDLYRLYSVPYSEHSSFRELAYFIIFFQIKQTIPTVNYENEFQLIKMNRIIQNWEKIRQIILKSDSNGSGGVDDDNNNIPDDLLQRIQRLSLNDF

SEQ ID NO: 19144 - protein, 558 aa, Candida albicans
  UNSURE (372): Identity of amino acid sequences at the above locations are unknown.
RKKKKYQTFSCKKSSLFFLYTMQLGNTFQGEIHEFPGVVVDKFSGTAEVYLLTHCHQDHLQGLLNSSFCGRVYCSALTKSTLELDTRYTRVSRFFKAKEYNETFTVDILLGKVSITMIPSYHCPGSAMFLLESFCKNVLITGDVRAESWWTLSLIKNPHLFPYITGLKTLDQIYLDTTFSYRGEPYIYIMPNSEGIFAAIELLKLYPFDSDLSFSFVDTVSGSEEAWFQIVRHFNGTLVSHGILQKRLDLCGMDLVDGKTPTFKVGNVPDTTPITIAIKQIINLNAIEYASQFLPRNICDVDFSSATSLVTTKKGHHIYLLDGRKWLLPKGGSELLPTCIPLMFSRHSSYQESRNLVALSSPKLVYPCTESXVSWLNGFTVTRVFADVCSSDDHRFDIDRFQKYGYPLPDVINREVAFISKWSLSQPETSKSVVEKPFRGQLQPLHCKRPHESHFDNFSLPYLIAQRDRESLKQAVEYHQNLHDYAKFDHGSSSSYGSVSSSKESMYFSETELLTNHDSPLSTKTPDTNKIAEIAKTLTNDRRNWTKFHLKCIGSNAN

SEQ ID NO: 19145 - protein, 182 aa, Candida albicans
LVKVSGVMTNANYNNKKKIQPIIFINHRLVTCEPLKRAINAVFLYFLPKGSHSFYYLSLEIKPENLDVNVHPTKREVRFLNEDEIIDTIVSEIHTKLSSVDTSRKFKTQSVITKRRNSDEELEEHQLPKTLQPSLKKYRQENKMVRVDASQSKLSSFMQQQPSQNYHDVMRKEFEYYSSSDN

SEQ ID NO: 19146 - protein, 406 aa, Candida albicans
KPENLDVNVHPTKREVRFLNEDEIIDTIVSEIHTKLSSVDTSRKFKTQSVITKRRNSDEELEEHQLPKTLQPSLKKYRQENKMVRVDASQSKLSSFMQQQPSQNYHDVMRKEFEYYSSLIIEDDTINTEQDILEENEKEEAEGELPVESNSILESPSKLEMKIETNHSRKQVQVNLDSIALLKNDLTLIIDKPLTNIFNNAVYVGIVDPWKRLCCFQYDVKLFLCDYAAMLLEFYYQIGLHEFCNFGEIEFDEPIKLIDILQPLYDKNEDLIPMEKVIHAIFHMKDMFKEYFQIVIDDDKQLTTLPMLLVGVEPDFNKLPYLIYRLGTKINYGDEKDCLRGVLRQIALFYLPEPTNDEIKNNTFEKQLESILFPEIKRQFLAPKNLLRDVIQIADLPGLYRVFERC

SEQ ID NO: 19147 - protein, 244 aa, Candida albicans
NKIHINTRIVRNSKTMSEPTCTIKRLDESVINKIAAGEIIIQPANALKEMLENSIDARATMIEILVKDGGLKLLQITDNGHGISKIDLPLLCERFATSKLSKFEDLESIATYGFRGEALDSISHISRLSVITKQPNSKLAYKAYYMNGQLCSSNFKSSNTNVEPKPIAGKDGTPIIVEDLFYNIPSRLRGLKSKSDEFANILDIVGRYAIHCDNVRSNCSKYGDPLHQLTTVPRFPFVKRSQFF

SEQ ID NO: 19148 - protein, 217 aa, Candida albicans
FLIPIALSYILQLLLRNSLYFMSETLPSIKTISKFDISKITSSQVIIDLKAIIKELIENSIDAHADKIDIIFHNYGVNSIQIQDNGNGINVTDFETICLRNHTSKIENFEDLDQLTTLGFRGEALNSICSLSNKLTITTTKEDLYPKCHVLNYDNMGQLVDQRIKVGGLNYKLGTSIMIEQLFKNLPVRLKNFVKNSKKELARQLILSSIISSYIHK

SEQ ID NO: 19149 - protein, 227 aa, Candida albicans
CRYVVLTHAQRYIYIINTNKDVSTPMVAFGEWDGFENFLVLEQRKNYLKSIEGANEEAREVLDQMTIEVSNLPSNQRSSYNAKIRNYRTELDTVTVTYNKLLDAQDKVELFGSNRYTDDSGDSSEQRKQLLSNNSSLERSSQRLHDSQRIAMETENIGSNILNDLRSQREQINGARNTLLQADNYVDRSVQTLKTMGRRLTANKFISYGIIAVLILLIFLVLFSKFS

SEQ ID NO: 19150 - protein, 398 aa, Candida albicans
HTMASHIRGNLTEEQLKRIEANRKRALERLQQKKKKDAGEHVPSSTPKSTSTTTTKETGSYSPTKTLSQIVNSDSVQVLSKFVEIETDGSVKKRRVLTEEQRQKIEQNRLRAIEIQKNLKQRENQKDDSTTSSKPVDNIRLNQNRPDSVVSSTKKFQPPPIRKQDYIEFDFATMKDTKGGFLQDEKTNTQGADEQTLQDWKNKQRELQKIRELPPPIDLQNIPRCRECQSMEVDANLMTNFNVRACRKCIKALPEKYSLLTKTECKEDYLLTEPELQDTTLLPRIEKPNPHGYSRMQLFVRFQVEEFAWKKWGGPEELDKEWERREENKVKRKEKKYHDQLREMRKRTRAEEYTRKLRDGKSLGERHVHDWSSPVNIDKHTIKRRCIDCGIETEEVVI

SEQ ID NO: 19151 - protein, 270 aa, Candida albicans
EGRKERITTTTTTTHHTAKQYNYRHHLLPIMPLVERIEPGPDTIRVLLTTDNHVGAFENDPIRGDDAWKTFDEITTIAKDKDVDMIIQGGDLFHINKPTKKSMYHVMKSLRSNCMGDRPCELELLSDPAQSLNNGFDEINYEDPNLNISIPVFAISGNHDDATGESLLLALDVLAVTGLINNFGKVKNTEAITVSPILLQKGQTKLALYGMSNVRDERLHRLFRDGGVKFQRPNIQTEDWFNLFVIHQNHAAHTYTSSISSPRGWKEPSW

SEQ ID NO: 19152 - protein, 239 aa, Candida albicans
LKKIYIIKHTTELELQDIIRDFLQQTQLSLVPETEMNHAVKKFVENDDKQALNQFINQEIKRETKMLLDIDIDENEFHGADEKHAKTAFKHVLLQLKNINGPINIDYEPEIEPTNNNTNKKSATTKKRTPKKNTTIPKKITTTATKKPKIDDIIISSDDSNDYGNDDDDDKEEEEEENEHDSGLRLFVTDTPDTNSTRRSKSNRSKRPTSYVEDESGILSDEDDYVPPSLHHADGRTNA

SEQ ID NO: 19153 - protein, 81 aa, Candida albicans
SNHAMPNPIENPLPLIRLRVEYNGRYEIENVTRFSNRFVGKIANFNDVVQFYKKRTPPKSDNKFTRKTKYDVDLIEENLHH

SEQ ID NO: 19154 - protein, 1753 aa, Candida albicans
  UNSURE (223): Identity of amino acid sequences at the above locations are unknown.
EEKNFFFSNSANYSSDNLYPLLLTHLALLTNMSDTSKSVLSNKEFSFPRGGSKPLSALEVKEISNEATKDVLFEQAESNKRSNSNKSDQPKKKHKKSSKNKSKNDKNDNDEETTQSVTIETFNFKNLVSGSTVLGQIKTINKLDIGLALGDNLTGYIPITSICPQVTELIEKFEQEESEEEEEEEESDSEETKSATFKSKTEKEFPDLFKIFKLGSWLKAKIXTSHEDYKNKKRFELTIEPESVNENLEVDDLIVNNILQCSVKSIEDHGIILDTGKQEYSGFISNKELTNAQIDVNTIVPGLVILCSIASKPSGRTINLKPTTATVSAKKTTVSTISSIDSIQPGVIVDALINDVTENGLVTKVYGLVDGTIALSQIQNFELKELKHKYAIGSTVKARVLAVLLKNGTKKLILSILPHVLQLGDDSSQTEALEAFPIGHVFDQVKVIGNDKHYVYVSFGSSSLFGQIHQSKFDDNKSLLDYSIGSTHKSRVIGFNEVDNLLILTFESKVIDAEYLNVRDVPIGRLLPNVEILKVLEDGVGINVKFFDEFKGFVPGNQMSDIKLVYPERKFRVGTKTKGRLLNYNGKRALVTFRKALVNLEDDEILSDIDQAEIGFKTNAIVEKFVPNGCIVSFFGNLKAFLPKTEISETFVQDASSYLKIGQIVKVRILDINKEQKRLVVTLKQSSELSNAQKNEISKLVSGKSIVKTVVVEKTKDSVLVELEGSHLRGVIYDGQLSDGNYEQNRALAKRLAIGETLEVLILDKDLKARTVIATAKKSLIDASKSKSFPVEFSDIAVNDVVRGYVKSVTSLGLFVTFTGRLTGLILAKYVTKNANEDLSKKFHKYQSINCRVLSVDKENERFVLTLNNSSSFTKDDEQLIKPIDATKKIVADYQPGETTKVVIKAVKGTQLNVQLADNLQGRVDITQCFKSIKDIKNLHQPLASSFQKGETLDVKVIGIHDAKNHTFLPITHRKSNRTTILELSLNNPQINNKLLTDLKLADFKQGDEVLAFVNNITNGMVWVSISPTIKGTIPMLDLTEDGSIFQDIDNKLPIGNAINVKVKQVDLQHQILVLTARKNFIEKFEDVRQDQTYPARIIKIKPNHVLVELGNNVIASSFVTDALNDYSDKLDHVFNVNDYVSAKVLDIDSTNKRISVSLRTDKAGSDKVINSISDLTRGQVIKGFVKNISNNGVYVSLGRSIYALVRVSDLSDSYLKDWQNFFKPNQPVIGKIVNCKQEGRILMTLKESEVNGELKIMKTFDDLQIGDIFEGTVTSTTDFGVFVKLDGTVNVSGLCHHSEISENDVDNVKLLFGTGDRVKVKILKIDSEKRQLSLGMKASYFITDSGKEDNDDEDVEMEDASEVGEEEEEGEDHEESELEEEKEEEDDDDDDIMDVDDNDENDSEDEEQSADESQEKSLSTGLSTNGFDWTASILDQADEDEESSDDDTDFTESLKKKSKKKSKSAVEDKTGDLNTRAPQSTADFERLLIGNPNSSILWMNYISFQLQLSEVDKAREIGERALKTINYREEQEKLNIWIALLNLENTFGTDESLEDTFKKSIQYMDSFTMHEKLVNIYKMSEKFDQAKQLFNRMTKKFGKVLNTWVLYGSFLLDQNSQDEMHEILAKALNILPKREHIELVKKFAQLEFQKGDPEQGRSLFEGLVADAPKRIDLWNVYIDQEIKQDNKTSDEDDTDIKSKVEDLFERVLSKKITRKQAKFFFNKWLNYEEDKQDENMIARVKSKAAEYVQNNS

SEQ ID NO: 19155 - protein, 84 aa, Candida albicans
GMVRLGLQRPLLINCKKSQPNIIPFPSHWSSKRNYCSSRRGIEKLPYQLPKYIQATGISEMRSGGRDHRTLRQQQREKVQPQNG

SEQ ID NO: 19156 - protein, 267 aa, Candida albicans
DQVDVITGHCVNNKEKKFNPKMGKLDMDYEKLYQAFFKFQIKPRVFPYGELFEEGKHSNDELVTKAAKIKPGIISLEMRLALSMPQNDGTIPPAWVTIMRDIGKPPSYKDLVIPGLDIKYSNAGYKDRNSDSRREKLKHWGALNTAIESSDGEDDEEDDDGQDEESSVATDSIEVNTTFYPLEEDEVSEEPSLNDILAGLSSANDKPKEEKKLYKIIEERKVTDDDSLTGYTYDLKNDSVEEYSENEDSKNSEDTKNSEEEPEDFKF

SEQ ID NO: 19157 - protein, 607 aa, Candida albicans
  UNSURE (41): Identity of amino acid sequences at the above locations are unknown.
SQKNLAAQNIAETANKGFMSHINNWTSTSQQEDNKVISSNXDDPLSVSDIDSDTSMLSNNSSKNYHSSKRSIPAPVLSTVTKKTKITDKYLKEFLAYHEPVFDKPPPTTIGILDMNQLEHSTKTMQKCVSSILEKAPNCNQLQYLIESDEIDNGIRLELQDNPLIDTASKLKSLHEIGKLPILDQIINDEVKISDDDLKKLKKIPAKSNSVKVNSPRDVVPEIASTGVHHDMPPLPPINDPKLFERVFIHKSTVNNKQYLEANHLLHSHNERLEFYGDSILNNLATLIIFKEFPDSTEGDLSKIRSKLVSNKTLIKIAFQYGFDKKLRSRISDDVLKTGDKKIFADVFEAYIGALAMERGFDLEDVKEWLAKVYAPLIHELKIEYIEEPIDREAKSKLYGLIGQDDLHPVYNTLQMGDGIHNKFIVQCTINGEELGRGTANNLKEAGLRAAMAGLNNNEVLKKYFVARQQIERPIKLQRLERENAKKREVAERLEQERNNLPFTPLSPIRTSMFPISVNENEPLDIDAKNKLYGILGRKIGDKPAYLTSQINGNLFKVVLCIRGITICETTDPSKKKAMARAAQTLLENESAMREICKDFRTKDSPE

SEQ ID NO: 19158 - protein, 682 aa, Candida albicans
YHDQHCIFQKMSFDKSKSLLTVCDDLTQVKGNVSQFQAMVNNIISKAPTREEYEKLLKTIRLGEAPGETKQTIERLEQLITVLQTKIAVRLKELFLAGYLPLLTSLSKINFKSNIEDQFVSYFMDYNPVLPSNVVQDLRVLQGKKADHLTAPIDIISYPPTLPSINSTILLLRIMTDRSYRQPLDFIELASNDYNKSHNGRLVLRGRAIMQLCLVEVLEESYSRLLDEDIQFISHKLMAPIILTKFAFGYNLVDHLKYNVSVDADYEEKLQIIGNIFLAYMGGLKTEGYDLSDLKLFVKRLYEPVIADYMNKNDVLSKVALVELDLLFKLITNLLYLPRENIRYEIIQVESDPHVARILVDNEELGSGVSSVSFEEAKCRAAQDILNDHNRIRKIWEILKNNHTKNNTTETTTTTTTIKTEKPETIMQIPIQQAPPTMNSHIGTPVVEQATANIASVNAGSPPMQNHTAAISPSLANATVRQTSPQFTMQPPSQQQQQQPFAFAQPQRYPGVAYQTPFLQQQQPQPYVNSPTGYFHSMQQQNPHAQQATAHSPPPQLSQQPQPQSQAQPPSNGGPLYDQPSTSMNSEQIYVDQYGIPHLGTACKNVDTNARNDLYSKLGKAKIATPEYEDKISPEKVYHVLVLAKGIYLGGGYDLNKKLAAQKAAMCALANKVKLSELGLYS

SEQ ID NO: 19159 - protein, 962 aa, Candida albicans
VRIQIFFSEDARCCVFDKCLLQTIWSLLLSFPFPLKTFHQATPAASIMESSELIQENQLNRYILEDYDRMLKSVTEIDNPQRKCHILNEVYKMKLKYFRLKQSELNDWLEAIHLMEDTHERVFSEFEFYSLISPDYTNADVTSSFLKHFQEFKDLDESGFEAKLLDAINISCHDFSRGNLIWKQLIDAAQDEYLKVNSDTNLMHLHQYYLDRLAIPHAQLEESFNEYSSFISKYYGDDYDKYMKYMKSANKIYSSTKMKQIYYEQFEISIKQSPDNPQLWIDYMESVYSHQKKKDLNPVLAIFERAILKNESWSQNWIKIWLALIYIIYGCSSDQRPEWLQFVFQKFLRTFPNSNHVYAESIRYCLTMNDNEMATEEFQSIESRLESTKKLLQWDHQQWKSVHLAFIQFNYQISKRYSMDNNKLIVELSSNSIFMRALSVIELGDPSHSVEFLAVDMLTHMGATDMAKDLIDLMLEKFNNEAEVLLFGLRYFVSYKTDFGQIRSYFKNAIHKLDLFDFPEKLCDKWLEFEQLYGDINSYMESVAKCEIALKTLSKKRTRDITVDENNQPSKKHKREPTKDIDTETKSRETCTVKVKNIAADTDEHSIRDFFKDCGEIGDISFVEAEGIRYAIFDFENEQQVFSALTKNYKSLDGNKLEVYRLQNALLFVNNYPSTFSQATVKEMFEKIGPVAKIRFPNQTLKKIKRFCYVQMISNEDAQKIIDQYHGQKYDDPNLGGEFSWEIKFSNPEEKHERSSPISARKVKVTSISFNVLKEAFEKKFTLCGEIEQVVFPKAVYEEDGKLKSNGGLAIVTYKTTEGVENALKLNDSKWMGRKLFVSKKHQHVHYTAEDFDGVKTIGLCGLDPSLNFQQVKTIFEERFGKVAKVLLFPEDKQALVEFVKPGDAGKTSMSNNFVKLGESEAKIVTKEEITMGKSAISNTTTTSSAPLTMIPTTVRRKKSKK

SEQ ID NO: 19160 - protein, 341 aa, Candida albicans
STMSESITITIKSSGDKKYEVTFDPLITVSQLKELVAEKSDIPAGSQRLIYSGKVLKDTETVTSYKVQNGHTIHLVKSAAAATSTGAATTAAAPQQSTANQLSSTPANASVPSNIAAGQGSFNPLADLTGARYAGYSQLPSASMFGPDGGMNSNIPDPEQLNSMMSNPLVQQQMQAMLSDPQMLDFMIQQNPQLRAMGPEVRQMLQSPFFRQMMSNPEMLRSMMQMGRGNAEQTNAFPAPGANPTTGESSNSGETTATPANPFANLFPNGIPPINPLALFGGAAPAAAAAPADNRPPEERYENQLRQLNDMGFYDFDRNVEALRRTGGSVQGAIEYLLGGN

SEQ ID NO: 19161 - protein, 821 aa, Candida albicans
  UNSURE (690): Identity of amino acid sequences at the above locations are unknown.
QIKFLPIDFIMSWHNQSNKNSNNDDEYGNKNFKQYEIKGGIAFLIEITPELLIPQPNLNSHSQLLEILSSINDLMQELIITSRSTGIGIYFYNCAKSNKLSSMKNTNCTGFERLFHLNVLNLQNMKKLNDLIQDDINNIKSIDEIFKYQPLKKIDLKVGKQSHSETQTQTQTQTQSSHTIQETQLTVVLNKMIDEFINKREFNKRRMVWITTNDKPYHEESEREALWRTIDDFYYYGFFIEPLFLSTNEQKPFDFELYKDIFMNTNYLKKSQENLESLRHTAHANYDNNDGNLGDDNNIDDDKNLIKPSGGFSKDSIIFKKSVVGDQIRKSIFRIKEVRRIQFTCDLILSDNGKIGGGFGCTVKGYMLYSHEKINRNELLLYTRSETLKRVFSSSKLMQNGKAIEIAKDTGKLYQDRKEEAGIRKGFEIGGGQDIIILNKQQLEFLTNYSFDHRLKDSDDEDNEDGNDSLETDISDDDDEEGGAGGTGGETKPVSFSKPPYLKLIGFRDISHFSPVYSCGAPIFVTPDVDNGMISSAVTGGFTNSFKTFASLYRSCVKLNQYAIVLGCTRSNSRPRLYALYPTQTTNSSKNPLPKNLDDEVDNDDNQDEFPQGFLLIKLPWLEDVRALPGEYIKNTQREEIHNDDTLIDNFKQLLPKFELLHYDPREFPNASLNYFYKVIKHEILQMELXPSQRPLMENDITMQKLAQLKNSINNDDTAIELLQKINSRMNEIDATVGAEVLKRKQMEDMQNNNSNNGGKRFKSGPVSDQEILDAWENNQLDRFSVDQLKAFRRKYPDVKSANKKADLIENISEFIRTHRK

SEQ ID NO: 19162 - protein, 187 aa, Candida albicans
MKSLMILKILGDVEEDTAMAIDTKGGSEMSRDAQIQPDNEFYEDDEKDKGEKAIIDNKHEDQDSMQVDKSEEPVVEQKDKPQDENNVTGDNIEEDQPQEVNPIEEQPSVEKLVVVVEDKLEEVKPVEQKVEEPKEVVDKPEDKHEDKPAETLTETTTELKPEDQPMEDAAKLTEEELKEIEELNKSS

SEQ ID NO: 19163 - protein, 448 aa, Candida albicans
TIFFKDLSQKIVNEIFINKKPTLSFLHYTDTQTPNNTTTQPNSSTMYTELPFDELKVDPNQKKRIAYFYDADIGNYAYGAGHPMKPHRIRMAHSLIMNYGLYKKMEIYRAKPATKQEMCQFHTDEYIDFISRVNPDNLDLFTKEQIKFNVGDDCPVFDGLFEYCGISGGGSMEGAARLNRGKCDIAINYAGGLHHAKKSEASGFCYLNDIVLGIIELLRYHPRVLYIDIDVHHGDGVEEAFYTTDRVMTCSFHKYGEFFPGTGELRDIGVGKGKYHSVNVPLRDGIDDATYKSVFEPVISKIIEWYQPSAIVLQCGGDSLSGDRLGCFNLSMNGHANCINYVKSFNIPMMVVGGGGYTMRNVARTWAYELGLLNNVKLPDELPYNEYYEYYGPDYKLDVRSSNMFNQNSPEFLDKILTNIIANLENTKHAPSVQMNEVPNDPEDFGRC

SEQ ID NO: 19164 - protein, 507 aa, Candida albicans
IKRKAICHQFTKRNTRLFKQNKPTEEKMYQELPFDELKVDPRKRRVAYFYDQDVGNYFYGTGHCMKPHRIRMAHSLIMNYELYKKMEIYRAQPATNLELTQFHTDEYIDFIDRVTPDNLHLFEREQVIFNVGDDCPVFDGLGEFCKISCGGSMEGAARLNRGQADIAINYAGGLHHAKKSEASGFCYTNDIVLGIIELLRYHPRVLYIDTDVHHGDGVEEAFYTNDRVMTCSFHKFGEFFPGTGNLTDIGIGKGKYHAINIPLRDGIDDASYKSIYEPIITKIMEWYQPSPIVLQCGGDSLTGDRLRPFNLSMRGHANCVNFVRSLGVPMMVLGGGGYTIRNVARTWAFETGVCNGEILPKELPYNGYYEYYAPTYELDVRSANMTNANSKEYLDKILTQVISNLDNTKHTPSVQMNEVPLDMEDLGDVDEDMPDAIDTKGGSQFAKDKLVQADGEFYDDDEKDKGEKNIQENGNVNTNANENGNGNGNVIITEEEQAELDKLNNNV

SEQ ID NO: 19165 - protein, 180 aa, Candida albicans
  UNSURE (169): Identity of amino acid sequences at the above locations are unknown.
RQRQRTTQVRQSLTPVTIKQINDATQPVPDGEFKVNNVELNMISFVGVVRNVENTNASIAVTIEDGTGSIDVRKWVDETISSAEEDFEKYNEMKGKYVYVGGSLKQFNNRKTVHNASISLITDSNQIVYHHLSAIEHHLKAQGITAADAASAGAGQATNSTASAGSGLXMDNPTSLSKDT

SEQ ID NO: 19166 - protein, 365 aa, Candida albicans
RKSSMVCIKPTNIIVYASLFYDTNPLFSRVEKYRPDSLEEVKGQQEIVDTVRKFVETGKLPHLLFYGPSGTGKTSTIIALAKEIYGATNYKNMILELNASDDRGIDVVRNQIKNFASTRQIFTKNTSQTASNNQFKLIILDEADAMTNVAQNSLRRVIEKFTKNCRFCILANYSHKLNPALISRCTRFRFTPIDISAIKDRLNTVIIKENVNISPEAIDALLKLSNGDMRRALNVLQSCKAALGDEEKEEDGHANDEIDVDMIYDCVGAPHPQDVETCLDSILKDDWTTAYLTLNKYKTIKGLALIDLITGFIEILNNYKLKPKTRLEILKGLSDIEYGISKGGNDKIQTSAIIGVIKDAMEFEA

SEQ ID NO: 19167 - protein, 254 aa, Candida albicans
KNKKLNMYCNLEKYTAHKKNIVVKSFCDERDPKTMNKSNKVKKPSVAKVSTKAASSSLKSQEAKRKQVFRPILDNSFTQSNQWPFIEPTIANDIVDLLEVLLKMQDSTFKYRGFNPTVSALEKQAAANRGIHKNACVQIKYVFVCKYDISPATLTNVFPTLCFTASKSAEDRVKLIQLPRGSLERLSKALGVDRVGIFGLTKDTEGAQPLFDLINENVKDIEAPWLDCIFREEMVFNQPNTKHVASTVGRKKNK

SEQ ID NO: 19168 - protein, 190 aa, Candida albicans
  UNSURE (26): Identity of amino acid sequences at the above locations are unknown.
EKQGTHGGHVHDLPLHSKFFLLASYXASYGSYRNDLHNNSKVKVVKFKKRQSTKATSVTKGHMSKRSIDTRLLSANYVDLERILAILSVIYRNYAQSVNHSDKDELLYMDDRIIEDEEKKESERSKFTLTRNIDLSNQIATLFSLGLLSKTNSSDILTAKVRWKCNIDWKTAEGIAKSVDFPISDFMMDD

SEQ ID NO: 19169 - protein, 690 aa, Candida albicans
QQEMSLSGMEEFETVLKEISTLPAPGVSGTRIKRLTDIAVKEMNAENEPKLISILYSQCKANSSTNKLGTLYVVDSIVRKFIEEANKKNEALVPSAPEGTYASAVFKINELVESLVDDAMELLINPSINIKIGKLIDIWARLETFSPEVIQNIRNKHFKSTTPPGSPPKASIALVKPDATEGTKESSSILLALASLAKASGSNNETPPSSQSSSTNNNSNNSNSNSNESGSNATNILSQLSALGGNSSNTGSASSQPPSQQQYSSYPQGGGQAGNDDLLNMLQQMQGGGTPTGASPASPVVGSNEARGGPTAEFDRRRGRDNEYGSQYGRRNRSRSPKRGSNTWVRSPPSSSVQALQQNMQNLRQQKQVNHGYPQNTNGQVDQGFVPPNAMGGELNLPGTPHYRPRTVQFDSTIPQGTVKVLSRTLFLGGVPRNMDERSLAQVLRPYAEIQSVILNSEKKHAFVKVYSRREAEQVITSFNKDGALPLRTRWGVGFGPRDCCNYQHGISIIPIQRLTEADKNWIVHAQWGGTGGQPILSGMVVDEPDIEIGSGLSSKAMSKKMPTNSARNGPKSNRPGEPDEEYVKTTLIPQGDIQMTHGAQPQFNTYLQSSVNPLQGLFGNNPQQQQQPPPPPPQPPQPQQPPMQFPAGFPQMPPQQPGQPGMNNNEAMAMLAAMMQTMQQQQQQQHPPQ

SEQ ID NO: 19170 - protein, 203 aa, Candida albicans
SASAEASTPVVKKEEQIERLKTSIEILPDNDEELLNRQENFSAITTEKINRIDDLQLQSTKLLDELKNKTKQYNELIRLDGSFKAKKAEYDSNWEKLSEIVDKNAKDFNVQISNDRVRNIAMFKTELNKRHNTLLNEQKDLLVDNKRKESERQSALQDVLNSISREEQHHEYATNVINTNNEKLLVLKRKVEVGSNNEIELEE

SEQ ID NO: 19171 - protein, 240 aa, Candida albicans
GSLFCLEIDGYVFFSLSRKSFMIHIEKLFSFILLFIALPSPASFIRMSSIYKLSIKGVRAFHPESDETIQFGFPLTLICGQNGCGKTTVIECLKYATTGTLPPNSKGGAFVHDPSLSSRTAVTGQIKLAFKNVNGKSMITTRSVQASLKSTKSATGATVTFKTLEGQLAIIEKGDKISVSSKNAELDAQIPVYLGASPAILENVIFCHQDESLWPLSEPSALKKKFGHIFGNFQFTKVLE

SEQ ID NO: 19172 - protein, 345 aa, Candida albicans
IALSRMSHSYTYTKNFIQSQVNILNEPYRINSRIRNILAEQDEITESELQTILNLLNNEIKECNDELFPSQINNQIVLQILKLEKQKLKIVNLQLFKINSFIKPITLPDFDNLTNQDQNKKLAELREQIKELPDLKYLFVSNTDTTDIQDEYDLDDDDQGQDMENEPREEQAEDNETDKANTDIVQDDQEEVASTKQMKKEFIQEIADKVNDSNAQPDQELIEKYDKLRTDLIDISDRLQYKSGKLGYLSGLQQTLSEIVGVRSTTIDTQLNQIYDSDEEVSTPNDNETSLQPGPYSTRTNIQSEINRFRMLVEKISYKVNTKNLTSDNLREKLQEINHNPNSAI

SEQ ID NO: 19173 - protein, 444 aa, Candida albicans
PKWKTDSKKQITDSVIKKSTCGVNGFKIIYSEPKKLCVAWKKSENRIKTSLEELQVDKQVKLNALRDTQNSNRDTEQKMQQEVEKCHQLLTSFTSLNDAVTYFETNIAEKYEANALEMKELSEQCTSLETKIDDHAQEIKLLEKEVMDASRIEHNILANIDYRSQLSRLEETELQLGSMDIEDAQSRKEEYQVESKKLRDALSSLTAEHAGKIGEVKQIKDQIASLKKELETEYKNVNQSYHEEWIKLQTNLLVSNDIQIYSKALDNGIMKYHSMKMEEINRILNELWSQTYKGSDISTIAIKSDVNLQAKGNRSYNYRVVMVKESSELDMRGRCSAGQKVLASILIRLALAECFGANCGMIALDEPTTNLDAENAEALAAALNRIIEYRKSQSNFQLIVITHDEKFLTHIQGDRFTDHFYRIQRDESSKSRIYSLPIGRIQEG

SEQ ID NO: 19174 - protein, 93 aa, Candida albicans
KVRSLESELQINKNSIESILKTIEENNLKIDSLKSNITKVFGEDEINDYENVVNDLEDSYRNVLEDVNSAEVTRDFKNSAISFAEENKCCLLC

SEQ ID NO: 19175 - protein, 335 aa, Candida albicans
VKKKKKKITFLILSCFFSCNPPSQPKQPSHTMATQTDKQTIGRHLEQVPKASNLISWSRNGFIAYIPPIITTTTTTPTTTTTTNNNKSNLLLTYIKNSDGKKWQLASPEPINIKLENNFLPQLSLVSWGSLNTDLAVSDIYGNFYILLAGVGLLDPNHIPSTITTTSTIKTEGNTEKNKDTKQIGNGSGTNGHGDSPINTPSFELTSYNHMEMIYRDIINPDINSAVNPGASIVAFKWLNIEKPQIVNKAATRLAENPTTTSSNSSSSIYGYGINQYQPYGVCHPIPTKQACVALRKNGQFILFYQGEHKVEYHKICCNLTDNISIIEKTMYWVQ

SEQ ID NO: 19176 - protein, 243 aa, Candida albicans
HLSIGVGKFNFISFILIMSKHIEDSLKICTVCASNNNRSMESHKQLMDAGYDVHSFGTGTAVRLPGPSVDKPNVYEFGTPYQVMYDDLISQKSRKLYESNGLIHMLERNKSVKEAPEKWHRNAPLGKFDLVITCEERCFDSVIDDLMHRMYDRDPSDNDDVKRLVHVINIDIKDDNENAIIGGKGILKLVNMIHDFRRKKKQELGHDLEDELDIILEDQMMSIITEWQRDHTNLPTLYSVSYY

SEQ ID NO: 19177 - protein, 298 aa, Candida albicans
FVKLWAISIMSTNSKQLNKKKTRLYNSRTIKSQINDQAYDKKQQVLDVNSFIHSRNFEIRSFEQSQLNSKNASSTRVFQDLPRAFRRRAASHNVKRIPKRLRKRAKQEMSSNLPVKKMPRGRRLYKLLVRNRLLKVASKMKQNKYDPLENLVNKKNLRKQFKAIRDEIKKIDQEKPKLSTVEGFTKLNNSVGSRDNTGINELAPRPKGSIKYYKRQREFVWIPTHIWFVKRFHMSKKYGYQIPYTPTQKCFKLMNRWNRQKAVCFDISYFPTFILYVSDGTMFGDIAKVFTTGPESPR

SEQ ID NO: 19178 - protein, 240 aa, Candida albicans
TVAPDIESKFITPRDALPLNPLQERIIDYFKRQFQLCGISMMNYMPCVSIFRNTFSLNDDNAIAMNTDGASQPALVMVNCHKGAKEGVLILLQANKTNPAHIIFGFKKPILVFEASQVLHTSYSNITRQTFSLNVVVLNKKQEQRELEFGMIDEKFYKVIDDFIKLQGINDATFNQEESGDDLIEIVHVNNNDDDDDEEDDDFQSEDSGSDVEEEYNSDLNEPLAAHEEDGVFERGIEIE

SEQ ID NO: 19179 - protein, 556 aa, Candida albicans
NQVLLIIPITYNIMDSDATNRFVPEYRRTNFKNKGRFQSDELRRRRETHQVDLRKQKREEVLAKRRNYANQGNESEDEEEYNPNANNDENQFYNKLKQDLPKMLEMIQAPDFDSQLAATVKFRQILSREHNPPIDLVIQSGVIPTLVEFMKEDHPDMLQLEAAWALTNIASGDSSQTRVVVEANAVPLFVQLLYSQSLEVKEQAIWALGNVAGDSSDNRDYVLSCNAMEPVLQLFNCTKMSLIRTATWTLSNLCRGKSPQPDWNIVSQAIPTLGKLIYSVDAETLVDACWAVSYLSDGTSEAIQAVIDARIPHRLVELLGHESTLVQTPALRAIGNIVTGSDYQTQIVINAGVLPALAPLLNSTKDTIRKEACWTISNITAGTTDQIQAVIDANLIPQVIRLLIHGDYKTKKEACWAISNASSGGLTKPDQIRYLVSQGCIKPLCDLLSVADSKIIEVTLDSLENILKMGEMDKEARNASVNEYALFIEEAGGMEKIFECQNNPNEKIYQKAFGIIEKYFSDDDGQIDDENIVPESYGNSFGFGMDSNQQQQNFQF

SEQ ID NO: 19180 - protein, 565 aa, Candida albicans
LHLIREEIRLDSTKAKCLNNINLLLCQLTTWMGWPAPWIKYYSIKPENIDPHTRFLLALILEAPPNLLRSLASLFTNNIVRYLTFSQLVEETETVDLLVTPRTLYVLKLFEVFVSSQYGPSAIVSLMLEFGITKDLLETYPLGISIPLKEALLICQESPEFEWTSQTLDLVGRKDLNKLLLDADFSADINTEPHTSTKDLSSLLNEVLEDNENFSPWDGQSEAERMNITKLIFEADRRYFEITTLVHQTKTQTAYLKVDENVTEYDLVLQQRELAVIVALRTLTIPLGRAALVYASRNPLLTEKFPIPKFNLNTLISPTMTNIVYSEDRVLKSFSEWGHFHNGVSSGLSIGPFAKGISGSWIIFNKPPELNAQHAGFLLGLGLNGHLKRLEEWHIYNYLGPKHPLTSIGLLIGMAASLRGTMDNKLTKVLSVHAVALLPQGANDLNVPTMVQTAGLIGIGLLYLESQHRRMSEVLLSQITASVLQNDTEQVHEGYRLAAGIALGFVNLGKGDDLRGLNDTHVIDKLMALAIAMKDYHPVQESGKSCCGAIMALAFIYMKTVNSNV

SEQ ID NO: 19181 - protein, 236 aa, Candida albicans
HKSKFDLELNPFERSFATKESSSVSLNELAAASNNDAISDVNSVATSGSSIKNGSSSNKHNLHIPNISSVNQQQGVNGKLPGITPPLFTPGGRRLPPIGLSPGGTTSRQYSNSTNSGSLQSNTDTLGSNIWGGLPTNQTFQPQPQPQPQQQQQPQQQQQTQQPHNFNQFMSGMRKTGLTPNESNIRLGLTPGGLTNFGFGSNLVPGLSTPGALLNGPITPGLPVFTRADAQSSLDC

SEQ ID NO: 19182 - protein, 536 aa, Candida albicans
VTILKNEWVESQNIVNSLSKFKSLDQICNYLAFLDALRDEKPEDILSTSTASLSPGKQNLMINTVNTALTLSQLIEPYYDTLSEQTILTYLPYTMLGLDSKIFTFSNNYTRLEIPKDINNSFSSLLREVFEFAILYKQLAIVVDRYKGTLVLAIKTAYIAILEAQLNKYVNDINNIFNNKPNSILVVYNSIFPWISILRFLYRVSNRLNRLDGYEFLTFIYSFTNHGDPKIRGIAVTAFTEVVKPYYNIVEHWIVKGELIDNNNEFFIIFDQEQNEFNSIIKLLPKKIPAFIKSSDKIFQIGKTLIFLNKYCRELKWVNQYNVKYSAILFNNHQGLASMTTNEMIKLIDLQYNEILTFLTQIIQGNNKLFTHVYNFKRFYFMETNDFIDAIMVKGKDVFNESSVNISSTYLRKVLQDAIQISSVKNFEYVDRLDSRVLNPQHGNLGWESFTIEYKIDDLPMSYLFEGHQHLQYLKMFHFLWKLRQLNNLLNWHFEMFNELNHNVVTKLSSRNRRPLAKSLSIITSIRFHFTHFLTN

SEQ ID NO: 19183 - protein, 131 aa, Candida albicans
LIFFFKIDVKGITHVINYDMPGNIEDYVHRIGRTGRGGASGTAISFFTEGNSKLGGDLCKIMREANQTVPPELQRFDRRSYGSHMRFVQGRGGRGGRGGRGGRGGRGGYGGGGGYRSTGGNSAPLGGNRRF

SEQ ID NO: 19184 - protein, 458 aa, Candida albicans
YYSFNWNYIYIYILIMSYNNGGYNNRNGGSYGGGYGGGGSRGGRDGYSGGGRGGGYGGGDRDQGGYRGGRFSGGGRGGGRFNDAPRQELTAPQWDLEQLPKFEKNFYSEHPDVAARSDRDIEQFRKENEMTVKGHDIPHPITTFDEAGFPDYVLQEVKDQGFPKPTPIQCQGWPMALSGRDMIGIAATGSGKTLSYCLPSIVHINAQPQLQYGDGPIVLVLAPTRELAVQIQTECSKFGKSSRIRNTCVYGGAPKGPQIRDLARGVEICIATPGRLIDMLEAGKTNLKRVTYLVLDEADRMLDMGFEPQIRKIVDQIRPDRQTLMWSATWPKEVQQLTRDYLNDPIQVTIGSLELAASHTITQLVEVIDEFSKRDRLVQHLESALNEKDNKILVFASTKRTCDEITTYLRSDGWPALAIHGDKEQNERDWVLDEFRKGKTSIMVATDVAARGIGMYNF

SEQ ID NO: 19185 - protein, 457 aa, Candida albicans
LNHSSTMSESESDYFTDGSEDDFVPTSKKSTKKNASSKLKQPLGDATNSTVSSSRSSTPKPTNASETYQKLSQLEHILKRPDTYIGSVEKTKTEMWCFDAETESMVFKEVTIVPGLYKIFDEILVNAADNKIRDPSMKNIRVKIDAENNIIEVMNDGKGIPIEMHTKENMYIPELIFGNLLTSSNYDDDQKKVTGGRNGFGAKLCNIFSTQFEVETADLNMGKLYKQSWTNNMSNVSKPKITTLRTKKEYTKITFRPDLSKFDMDCLDNDLLSVLRRRVYDLCGTVKNCNIYLNDKRLNISSFKGYVEMYVKAIKERSPEPEPQDGTIKNFTTIVHEVFNDRWEVAFAVSDGSFNQVSFVNSIATTSGGTHVKYVSDQIINKLVETLSKKEKGKKKLMIKPQEVRDNMFLFINCLIENPAFTSQTKEQLTTKVSQFGGKDKFVANDNLINRLLKTVF

SEQ ID NO: 19186 - protein, 161 aa, Candida albicans
LIYTEGLSPMHLAVAGLSVVGRDYYGCFPLRGKLLNVREASADQISRNAEINSLRRIIGLQHRKVYTAENIKSLRSGHIMIMTDQDQDGSHIKGLIINFLETSFPGLLDIPGFLLEFITPIVKVTVKARGAGGKRVIPFYTMPEFEHWRDTEGKQCRWTQK

SEQ ID NO: 19187 - protein, 333 aa, Candida albicans
IFQLEAKVRKFFFILFFFSHFFARIYDYLQMSAQFITPKKRPHSPLDSNELLPSFEDPQDMINAVVSTLLAPEEKTNVSIAYANEKNQATEIQAYAKIAGKDWTFYVKSLAVSIGRNIELSAPSNTNITTPLIDIDLGPAKVVSRLHAAITYNLDLRCWELKVLGRNGARIDGQKVNVDSPNVNALHSGAILDIGGTQMMFILPDAPAVVAPKMLEKCLLRYKEQQQQQNKRISSGPGIGGSTSFQMFDKAHLTHSPSSISANSLQSNLDQDLSKEEAKDIKPPYSYATMITQAILSNPQGVMSLSEIYNWIADHYAYYKYSKTGWQNSIRHN

SEQ ID NO: 19188 - protein, 519 aa, Candida albicans
EFLFGDSEGKIWTMIEVESEEDFVSDEGELARPMFSDDEDEDLEDLNAENMELYSKRLDEEERLEAEEAEKELLEAETKQPRAKVLPTAEEEEEMAKGPQDVTMVRTRMLEVVKVLENFKELAEEGTSRTDYTNRLLKDICEYFGYSEFLAEKLFNLFSPAEAMEFFEANEIARPITIRTNTLKTRRRDLAQALVNKGVNLQPIGSWTKVGLQIFDSQVPIGATPEYLAGQYILQAASSFLPVMALEPQENERILDMAAAPGGKTTYISALMKNTGCVFANDANKARTKSLIANIHRLGCKNTIVCNYDAREFPKVIGGFDRVLLDAPCSGTGVIAKDESVKVSRTEKDFMQIPHLQKQLLLSAIDSVDAHSSTGGVIVYSTCSIAVDENEAVVDYALRKRPNVKLVDTGLTIGKEGFTSYRGKHFNPKISLTRRYYPHTYNVDGFYVAKFKKIAPSPHDISKAGAKEKENAARAEAEEEGIIHGDFAEFDDEEDKEIMEKSKKHSLRKKGINPNATKK

SEQ ID NO: 19189 - protein, 120 aa, Candida albicans
AHNYVFFCSSYSLQQHLSLSRANSFESLLLQVMAPSKVKPEQETFPPQEIHLLKDAVFGSNQVEPFYQNYQQDVPIAIDLGTSSLRVGLTNSPEPNNIFPGIISRYRDKESHEDINDYRK

SEQ ID NO: 19190 - protein, 598 aa, Candida albicans
KAHSSGKSSGLVIGAGNQLTSIILVINGRGILSQAKRIDWGGEQLQQYLSKLLALKYPYFPSKLNNYHTTNLFKDYCYILEDYQQEIKHILDMDVLETKDVVVQAPVEINVSTEKKKTDEELAEQAAKRKEQGKRLQKQAQEKRLEKLAQKQEEWEYFSKFKEDNSSLSPEEFETKLIENGFDDLEDFKKYMGSLERSLKRANQGGEDDHEEEEIDPSSAWPLVDIPDDQLTAEQIKEKRKQKLHKANFEARERNKEIKRQEEEARLQFEKEQQEWRDRDLDDWCTTKRLKLAEAISKYKEKQKLLESFKDRKSAAAQQRMKYIADLANDENGSTSTQSRKRRRNANATIDNDPNDTFGANDEDWNMYREITNSSIEEEMEQINSEILKLEEELLLYDPNFHHEDTFAAASTFDWKNLVLHKFIHGPRPNITIEMQAEGLLPEEIATHPEMIRKNHQMHLNVERIRVPEILFQPSIGGIDQAGISEIADDLLNSRLDGNFTSGGQSYEILGDIFLTGGLSLLPGFKNRIMSDFRSFLPEGVPLHVRTAKDPILDPWHGMYKWANSEDSSDGYVTKEEYEEYGPEYIKEHGLGNACLKD

SEQ ID NO: 19191 - protein, 642 aa, Candida albicans
RNDTSTVIFDTKNTSGVLAAGIETSTADVETSIATPASTQLPDSPKSKPAFRIGLTKTSSSDKSQKDNDIDPKDSSKQYANENENENENAIASSSEEDDDEDIFKPPVDPSKSRRQSITQRRLSNITASGLRSRSASISLHTADSNHVPAKIGIPVSKPTKRRRSLAQARSSKRVSTTQPAKPKAVVVPTVSTEPTSSSMDKSESSTREEKKPPKKSDIKGISDDFIVGIDPKTQKLTKFRRKGATKVKKESDSVKTENESVKPEGDEVKVEVLSDTDSIPEEPDNLITTVTHIHQIPKNINDEDADLSGEVDIDLEEVTMADLCKPTLRIGKVSTNFELVREAEQQLKQKKAQRRRDRELARLEGISLEDAIQKNEEQRRGNGDDVEKQDEEPKPDSLFDEEPQQAATSLQLTFTDGKIGFNEESAIVAKPRADITSRSVEKSNPFANPITSTTYSRRVFTDKWTSQELNQFYQALSMFGTDFSLISQLFPHRSRKQIKLKFNLEERRFPEVVELALRRKLPVDFEEYCANTKNDIKSLEYYNEELRKVRIEHEQSMNAIALEREKALKEDAEASRRREIEIRTGSKPMSRAEKLKELRKNETVVGSIDDVRKKRETNVLIISILLFPGVYVLSNGSVVMF

SEQ ID NO: 19192 - protein, 476 aa, Candida albicans
IRRHPISNPELLSFFFFLHSKQNKWTIINSSSSSSSSIVLTTMSADYWNSSQRNQWQLTRFSLLEARRRVLLLERKMIQNGLIKDYPNIIYDYNMRIYLHNLLIKLGRRLNIRQIALATAEIYLTRFLTRVSLKEINVYLLITTCIYVACKIEECPQHIRLILSEARNIWPEYIPHDVTKLAEFEFYLIEEMDLYLLLHHPYKSLMQINEFLSNNYNVFGFKLTVEELQNAWSLINDSYITDLHLLLPPHTIAVAAIYITVVLKKNLSRVRQGNNNDNNININTMHISTGSSTNPININNNNNTNTSNNNGTTSTTTTTTAQETQVLGQDDNTEMNIDDLMNLTKSSNNSQDKSDDKMDIDNPLQLQVNLSQIQNQTQHQHQESTHNNTSSTNTGRNGINGQISQSNQELNNFDLDILDEDTIKINKFMNFLEHSHINLDEVVEAVQDMMNMYVLWNRYNEQGVKKALQVMLLNRI

SEQ ID NO: 19193 - protein, 162 aa, Candida albicans
LIIVKPILFYFFDWLVKMNTSSKVNKLKKVVNTTGRVSAKKAASYLHSMQNSSTTKINPAKQVTAPNWNPKHFRLFVGNLGPDGNDELLKEAFLKYPSMSQVHVPIDRKTSKNKGFGFVAFGKSEDYLHAFQEMNGKYIGQHPVQLKRAESSVPKKTKNKRK

SEQ ID NO: 19194 - protein, 518 aa, Candida albicans
INLVIQFKMSEPSQDQRQEQQFQEQQQQEQQQQQQQQQQQEHQPEQRQSTESSENESQQAQQPSSQDDEKQVNAASAKEGGREVSNKILYVGNLPKSASEETIQELFSVGGNPVKTIKILNDKNKAGFNYAFIEYDTNEVADMALNTLNGRLVDDVEIKVNWAFQSAAIAGNPNNTEEPLFNIFVGDLSPEVNDEGLRNAFSKFESLKQAHVMWDMQTSRSRGYGFVTFGNQSDAELALQTMNGEWLCGRAIRCNWASHKQQQQQQHYNNQHGGGYSRGYRNNNGGNNNNRQFRQFNNINNGNNNGFSQPLVNNNPQFIGQQPPQPDQHQHQQQQQQQQQQQSVNGANGVPQQMLQGLTNGNLGPGTPINGSNNAAGGFNNNGTAGNVAGAPVAGGPGAIPVMSPQSYDIVLRQTPSWQTTVYLGNIAHFTQQQELIPLLQNFGFIVDFKFHPERGCAFVKYDTHERAALAIIQLAGFNLNGRPLKCGWGKERPPQFQNFPRNGNMHQVPMYGPGGRP

SEQ ID NO: 19195 - protein, 347 aa, Candida albicans
NNCIMVKDKKLYDLLGVDPSANDQEIKKAYRKAALKYHPDKPTGDTEKFIEISEACDILSNADKREIYDNHGLEAARGNAPAGDAGNPFVGAGGAGGPQFNFNTGGPGGFRSSTFSNADAFNIFSQMGGFGMGDDHGFTYSSSGAGGNPFGGAGFGGGMPGGFGGGRARQRPEPDVVSMPLPVSLEDLYKGATKKLKITRKNSNGTKEQKMIEVNIKAGWKSGTKINFANEGDYQPECGARQTIQFVIEEKPNPVFKREGNNLKMNVTLTFKESLCGFDKDVTTLDGRRIPLSRSQPIQPGTTSTYPGLGMPISKSPGQRGDLEIVYKVDYPVSLTPAQKKAIQDNF

SEQ ID NO: 19196 - protein, 446 aa, Candida albicans
VEQFGIANNNNNNNASQNEYYNLPSLQQSKNDVLHQKQQSFQPPRMNWEDEQFKRADQLILQNDDKIHINDDKEYEFVFDQTQFVNYDDIEELPGNGEQEEEQSGIRDSDSTIGNKYDEVRKSLPVYSYREEFLKIINENQTLILLGETGSGKTTQLPQYLHEAGYSRNNQVIACTQPRRVAATSVANRVANEMQVKLGEQVGYNIRFDDNCKDGVTVIKYVTDGMLLREFLQDPTLGKYSAIMIDEAHERTLSTEILLSLLKDVMMTTRKDDLKIIIASATINAEKFSQFFNNAPILNIPGRRFPVKIHYTKQPEANYIQAAITTIFQIHMTQPLPGDILVFLTGQDEIETMEEILRDLILKLGDQIDPMIVCSIYANLPQELQQKIFQPTPSNTRKIVLATNIAETSITIDGISYVIESGYVKQNVYNPTNGYGKFNNGALFKS

SEQ ID NO: 19197 - protein, 108 aa, Candida albicans
KIGIEVNIRHQHRDHLLENTHNNTLLTKCLISGSFTNIVKLSPMGDCYQKLTNGKGGNNTPCYIHPSSCIYKLKPKPKYLLYYELVLTSKEYMRNCIILDEKLIKEYL

SEQ ID NO: 19198 - protein, 437 aa, Candida albicans
  UNSURE (432): Identity of amino acid sequences at the above locations are unknown.
QNQIKDTSKMQLISQQQVPHHPPPANKPRPNAAAVPTISYQPTDIIIPTQLYDKIGNLGEYKRLQEAEKKLDLLIARKSLDFQAIQQKSIHPHEYRPSTGVLRIFIYNTCENQPWQKQLLQQKGLPVPDPTLAESSWTLRIEGKFISDIPDEQQQIDETFKFSSFLSAISVDLLPNENYPNIQESQSHIIEWRDDGPNANKPPASVSFDGLDIKRNGIFNIKSKIALLVKNHSNSLKLSEEMSRFVGKQECSQQELLYIIWQYVLFKGLFKKSNAYTEVPAVETSTLPNPADDKDSSDDDLTLVEADDLLFELLKVKTFKFLDLYKLTQAHFVPREPIIVDYEVNTRKSTTLGNVVLDIPVELPLNLLKAQKELLDVNKTAFENLAKADSTILQLDQRISLAIIALQNANLREKFYRELSDDPVKFIENWFXSQPEH

SEQ ID NO: 19199 - protein, 427 aa, Candida albicans
THIFNINNNSNSSNSNNSCSHCSLNQSQSNQSPQFSQLQLQQLQRQQLLNQHLQQQQLQLQLLQVPPQLTQQLMGTPTSTNPLLAVLNGGANSNATSTGNGSLSSNPVLQQLQLQQLQQQVQLQQLQAQQQQQQQQQQQAIPIIKEVWSSNLEHEFQALRTFINDKTSKVFIAIHQEIPGIVARPVGTFKSSSDYHFQTLRANSDLLNLIQLSLCVIKISKNETISTPVIWQFNFLYDLTKEMYNEEHLAMLAQTSQINFQLLLTHGIPHFEFAELMIESGLILDDNINWVSFHAGYDLGFFVSLLLNDDLPVDEPDFYWWCAKYFPNFYDLKYIGNQILNKSTTNGAGGTNSNTLDEKTNKPSIEYLAEELHLLPISPAIRQHFTNSTFHSQQLTSTLHAYLSMECFKEFLTRFHSLRGTAIRAME

SEQ ID NO: 19200 - protein, 494 aa, Candida albicans
RIMNVNPHLQYLQQQQQQQQQQQQQQQQSQPLQSNQSQSNQSPQFSQLQLQQLQRQQLLNQHLQQQQLQLQLLQVPPQLTQQLMGTPTSTNPLLAVLNGGANSNATSTGNGSLSSNPVLQQLQLQQLQQQVQLQQLQAQQQQQQQQQQQQQAIPIIKEVWSSNLEHEFQALRTFINDKTSKVFIAIHQEIPGIVARPVGTFKSSSDYHFQTLRANSDLLNLIQLSLCVIKISKNETISTPVIWQFNFLYDLTKEMYNEEHLAMLAQTSQINFQLLLTHGIPHFEFAELMIESGLILDDNINWVSFHAGYDLGFFVSLLLNDDLPVDEPDFYWWCAKYFPNFYDLKYIGNQILNKSDSNGARRTNSNTLDEKTNKPSIEYLAEELHLLPISPAIRQHFTNSTFHSQQLTSTLHAYLSMECFKELLRRSNMTLLSSFKGTIWGLGTFSGGTSINNTNNNGVTEDEIVASRINGISTPSTPVGIISKSGMVHFGGRV

SEQ ID NO: 19201 - protein, 533 aa, Candida albicans
  UNSURE (497): Identity of amino acid sequences at the above locations are unknown.
HYTMIKSEVLSGSASKTVGNSISNGTTVLTQNQGGKQNLIRQQQQQQQQQQQQQQQQQQQQLKHRTALQNYHFASTSEEILKKYSKYPASMSLHIFETHYRFNNSQDSQVIPKDSPMIKDFMKHVLKEQIPVEMCELIKDFAIRPYDGCIILQVYDHRNMVKTAVLQNRSTSSPSKDQDKKQQMVVSKPRTYRTLLRPTSLSIYYDLLYHTDSALHRFTDYLSLQMESEILTATNRELNLSVPLNPYNYDHLRPEPEPSGDMSQNSDEEIDQVKFQHRDAVEQPRRKIHQDEMVLHKSSEYEELMLLLSNKHKRPDDCLDKRLVVVSTSALPGSSLTGTSNTSTGTAAATPTPTSTTASAASQSSKQTTADGASTTDTKGKRGDKANGTSANQALASPTSVHPPIPTIPQNLVRATGQFMRLRLIEEIRKKRELEKLQQEAKIQAQANAIQSDLVPPSQQLAPQNTINSPVVTEPTKRSSPAAQNQPAPKRAKKETXGPLPAKAQAQAKAQAQTKAKVTTETPGPTPVQGQNS

SEQ ID NO: 19202 - protein, 486 aa, Candida albicans
IMSLEDDEALFEDLYGDDEKQEEKQDTVQKEVESTEKETTVVETASATENASSAEVETTTEGESESVPPPPPPPIPASGDVNAQSNTAQDNATSTAPGSVPAGMPQFPFDPAQFQQYAAANGLQFPGNANQQNFGAAGGVPPPPPPAPTANATSAESAGGPSRKCFIGGLSWDTTEEALVSHFQKYGNIVDYTIMKDSATGRSRGFGFLTFEDAKSVDALLKDRHVLDGKLIDPKRAISKEDQEKVGKIFVGGIDPMVTEEEFDNFFSQFGKIIDCQLMIDKDTGRSRGFGFVTYDSPAAVDKVCVNKYLTLKGKAMEVKRAAPRGQHNQQVMMQQQQQQQQQQAQQQAQQQAMYPYGSYGFQQMNPGAMNPAMSQEYMRYYQWFMYQQAQAAQQQQQLGTLASPEAQPAQPLNPQQQAAEEESEKSDEQARPAIPTGPKRAPPTGPSYRGGGRGGGRGGYRRGRGYHPYSRGGRRVFTTRNDDRA

SEQ ID NO: 19203 - protein, 135 aa, Candida albicans
VNQPRNNPEKKSDITGLKGETAGAKSSPVRKVHITFMHNPTNVREIYDEFFKGYKGQEPLCELDEKYGKSEWRGDSRSKESKRFQRRKKLCDAIQRGMVKYGKNADEIIEYLESFRKDKSLTWLMNGHLPEDLQS

SEQ ID NO: 19204 - protein, 602 aa, Candida albicans
SLLSHIPLNSVPKIKMNETYNSQEPNNAMFYNNNSTPSNDAQSQNNNNSTGNSSVVNAAASMHANNGNHNNDNINTNDSINENNNNNNGNNNSNSSGNTNDNNKNKGKNKNNSGNSNNHTVNELYGLIHNLQSQFAHYQNTQFNQLMMKISFLHDSMDHMKLQVNDLSQQVLFLAKNSGMISGTNSNPNSTFNNQFKAFEVFTKHLNELNKEIEEISSSSQGMQNQLQQQQQQQQQQQQQLHQPHHQAQIPPPPSHPPQQTLQLQSNHSQFQGPSVHLGVPLNSNGPPASQFDEEVDSITRKGLSLRSPANSSPNPTSHYVFDVGPFASRNMNGNNANNLYDKGPTTSVIRPNKKRRKQQKNSQEDTPANEPESTLQLQRRLPVQQQSRQTLAQSSSTYPNSYILPMPPLLSDDKLGQNLGSSTNNDPTQFMLQRDNGTVMTSALRQPPNHTRPPPNQQTASGFSFDDEIDSIEQLENDKQNEGSSSESAKRTSKKRKQSESGKMTISVNPLNIPQYKLERSLKSLAEIWKEYAHGLNNKPPLKSLETKYGTKWRNETESRTFLRRKKIYEAIEIGISKGYTEDEVIQELEMHRSYNKNGVI

SEQ ID NO: 19205 - protein, 605 aa, Candida albicans
TRMGTKRKRENLVGKPRSKRQKKDSLLLKVDNASFLENKFETLQNHLDEESDSELIYDYDRKKSEELTDDLVLIDSEEESNDSSDGFDDINLESEKKQVLVGNDKTPENELANNEDFIGFGFLSEDDSEEILNSDNDLSNGDYAHGETPNSLYPWVKDHDHSKQKEIADWLTLEMKDFVNYISPSSEEIVTRNNVISTLKKEIGKFWPGTETHVFGSCATDLYLPGSDIDMVVVSETGDYENRSRLYQLSTFLRTKKLAKNVEVIASAKVPIIKFVDPVSELHIDVSFERTNGLDAAKRIRRWLISTPGLRELVLVIKQFLRSRRLNNVHVGGLGGYATIIMCYHFLRLHPKLSTSSMDALDNLGVLLIEFFELYGRNFSYDNLILSLDRDTEEPRYEKKGNHPILNTARNTFSIVIQDPADTTNNITRSSYNLRDLKKAFGGAYQLLVEKCYQLNAASYKQRLGQLILGDIIKYNGKERDFNDDRHKVVNHALISHEEEIDDESDGLDGNDKYYFSDMTVESNEDEYVPEKKRTTPVTNKAKDTKKLVESFLSLEDSSDVEELLAKDVAGKFEDEPYIPKLKKLKSNLDKDIKRDYWRQKGLDL

SEQ ID NO: 19206 - protein, 328 aa, Candida albicans
TSNQTMSKPVTLELPWVEKYRPKKLEDIVGNEETVERLKLIVQDGNMPNMIISGLPGIGKTTSIHCLAYELLGDEHYHQATMELNASDDRGIDVVRNKIKQFAQTKILLPPGRQKIIILDEADSMTPGAQQALRRTIEIYSNTTRFAFACNQSLKIIEPLQSRCAILRYNRLSDEEVLARLLEIIKMEDVKYNTEGLQALIFTAEGDMRQAINNLQSTVAGFGFVNDVNVFKIVDQPHPLVIQLILLSCLKDKDIDKALGLLDGLWYKGYSAIDIVTLTFKVAKTIPNISEQKRLDVIKEIGFAHMRVLEGVATYLQLCGLYAKICDL

SEQ ID NO: 19207 - protein, 867 aa, Candida albicans
ISNSVTWLMKDCISRNIPNFPPKESTTIRFIDHNNHDYFTALGSDADLIAEKIYRTQSVIKHHNQTKYVTISPQNFKELLNYCLQNHFKVEVYHSKTSQLISSGTAGNLDSLSEEFDIDFDFRDGSSSSIAAIKLGNKVGVCVIADSIVHLSEFEDNELYSNLESLLIQLGVKEVVIPANVDNKKFFQMLEKLNDLVVSAAKSFPKDNEQDISKLLDTENLELSLAAKGINSLDYALALSCCGALIDYLDLLNGDKTFEINKYNLSTFMKLDSSTMKALNILPNGTQKAITSIFELFKCKTLGGSRLLSQWLKQPLIDLSLIEERQELVKAMIDDTSLRVEIQEFLSKVPDINRLLKKIGLGVKRSGAENKKLNEVVNLYQLVLLLPNLTEILTIDYYAKPLKKDEQALSKFCELVETTIDLDTLFDKDYKIKPDFDPSLSEISNNMESAFKAINDLYLEAGDDLNLDTASNKLKLEQHQTHGWCMRVTRNDSRVLRGKSQYKELQTVKSGVFFTTIEMKRLSQEYTKAYDEYNVKQSEVIKEILSLTLTYEPVLQSLSSTLAHLDVITCFDTTAMLNSYTQPKLFPFESSRKINLIESRHPLLEVQDDINFISNDVKMDDKHFAIITGPNMGGKSTYIRQIGTIALMAQVGSFIPANDGAELPIFDAILSRVGAGDSQLKGLSTFMIEMLETSSILATATANSLIIIDELGRGTSTYDGFGLAWAISEELIKRKCFAVFATHFHELSQLSEKYDGVENLNLMAEQTNEDITLIYKVGPGISNTSFGISVAEKLHMPEKIVNMAKRKVEELSEEPPIKKQCSETEVREGMSRLREILKEWRNNPEINIADSLAKEPNKFINYIVDTL

SEQ ID NO: 19208 - protein, 565 aa, Candida albicans
FNIMDPAYDMQSHEKQVLVNDSLIPEDNAQNPSLPSRGSSNSTITQSSSSSSEVKPILKKKRTRISKACEYCRKKKVKCNGCQPCLNCLQSNNGDCEYAVNDEKKPKILKKKKSTSLKSKLNKDRQNKALDERLSKIEGILAELVAGIGTNDNTSTSKPVSRLNVPNGKEAKTDESSPLQSPKEIKEESANGHDEKHDPKVESNFHGSHSVINIFSKKSVEWLLRPVLNKCHQDIHVFKDIAIVHDFYTQAFLDTISQPIKARINRRNDLMDNTFANATIPLEILSCYDDIFLVSYVCKGDHIRKLFQTYFEEPDQNGSRRRSFLWSELLLMTAAIGICISVLIDDRNNTKDTDKPKYSCSLSNQQLIEINFKCFYSMIFYHRRLCVISEGFPTVTAFVLLIMYFDFAVPILHVTFLAVSTVMHYARQLGLHKSETYREMGLEEQRTRRILWWFCEYLHIEYCFQKGYDLDIGDQDMTSFSGDDASTKALIKSNWNLIQSTKNSDTPIDALTTNQIKETKAYPFLCFLNHAFSNQKKGLNPYPFLFSSNAPNKNLCTYLTSWGRI

SEQ ID NO: 19209 - protein, 756 aa, Candida albicans
IMDTSLSLGTHPSTFNNLTKQQELTGNDPNDTNRKRIRVACDSCRRKKIKCNGSYPCGNCIQAKNTSNCHFTERPVRKKLKPTKQDNKSTANSNGVSKRKYNDTFSGNSINIKTEKQENTTFGINDNKSSDLESRLSRIENSMSRMMHTLENFLQNFMTQAIRNNHSNSSMFNNNSLSPTPSEDFNKSAFDSEEQQTSHSYKNLKDRVKDANELLKLRNWDEFVGTHSITCIFSRESLDWMEKTLGSYGEEYLTPIRNLPLVFHSELKPYIMKWIDPPVVDKLQRKKLLESPFPTDSKLISKLIDLYYEETSMINILVDESRVRSLFAAYYNNFAEPIATKRRRFKLSELLLMTSILLISLSCLTEDDFSEERITTPASSTSSNYSAASANLLGDYNKNRLIALQNSLENSAIFYYHRISVISEGLETVEALLMFIIYVESNWLTSFFNYTIITVTIRFAQEIGLHRAETYNNLDLEEATKRRKIWWFCYFFDIEFSFKSGKPPVINTNDVTTNSDEDLLRVITQLKQYGPLSPKDRMYSPVCHTISTSLLDLSGSDSICLDILKIIQLGDILDDPFYFQFCALLQSRIRSNSYHDLFIASAEKRDFSSISNTLEKLNADMFELAMYLADEAKPRFYNDPKFTSVQASTGTSIRRDTILAMKLTFFSHLMIINRYPLMIATEDSKFDDRVIKFRNLSLDSARTILMLIKGWHRESASALFYNWAIYFPRGSISCIGGSNHKPSSITRVRNQFESID

SEQ ID NO: 19210 - protein, 249 aa, Candida albicans
  UNSURE (3),(4): Identity of amino acid sequences at the above locations are unknown.
GGXXFHCPWRVVMKTGSPALQGLALLILYFEINFVTDFHVNYSITSVLIRYAKELGIHRVETLNNDHGVETTLKRKLWWFSEYKGVDITYKSGKPILIDMDDVTTLTEVDDYFMSVPTTLFLDGKYLENANDIVLNSQIHGGEYYFAYFLLILSRIKAKSYAKIYSKLPTNINIQATLTFVNEFDYDLRILTNLMLPILAATTTISSPNSTTVKNPLNLSEGCFNYFKVELLLSQYAPQLSIKRVPFVK

SEQ ID NO: 19211 - protein, 67 aa, Candida albicans
FIHFIVAMSRQSFYADPSSAGRPMKYRKDLFPLLDTREITACLLECEFNVTPDLIIQPTADFVPNFF

SEQ ID NO: 19212 - protein, 317 aa, Candida albicans
SVVLPAAVVKTANECEASADKVSEVQAENSATMQKISAIKEKLEMDSENDESSRKNLQYISSYNRKLETKLRELKVMQERLTKEHDDYRQEKALLAKKLYDIDFLYNETQEQVANLTKYAETDLSILVKITEDLSNDLSSMQTSYKNLEKSYQNMGITIDSIQVNEINLKDLLKLAEDITRNVEKRQIDGKILKDNQDNLDELTTKQMELEGQILIVQDQLNKLNRKYQDLIVQADKKESAVKLKLEETKQEFNDILSEKEKHNEGHKRIMDQIVKIQQETTAIQDAFVKESKEVELKLINLMSIIKRYMSDLRNNI

SEQ ID NO: 19213 - protein, 284 aa, Candida albicans
LKHTLVVIFKMSQFGEFYDTYLVENNQQYDTDLNNSTNTPIVQSKQRNDNIIPSINIKQEDFDSVLSGSLDVKKQLSLSLNTAGVGIGSSYGNGGISKPQSRRNSTYIKSHEGSDNEDEDDQNDKDVGNERKRRDNINDKIQELLTLIPSEFFQSNTDNNTKTGTKVVKENSPEDDAVKNSGTKDGKPNKGQILTKSVEYLQYLQNLIDENNRKEVELIMRLKTLELKAANRPSENIPIRIGYTSAEKALGEIGVGPCSEEYFKNVLIKSASTSKSGRRGSTSG

SEQ ID NO: 19214 - protein, 272 aa, Candida albicans
RLISQQATGNANVNIGPSSTNQQQLSQIPNQQQQQQQQQQQQVPQSQPHASQQSPVLQQSQPPQQAPVQNVPQGLPGLGNMATPQMKQGITSNPTNLSSPLVPQQVPVSNNNSASQNNNINRGRPVTAPANITMSSILPPLTDEVKLRLRQLIEEVSRNNVVLRDVTSLLSNQDKTTVRDSMNRIQEQYGNVDSIISYFYLLTKNGDGTKRLIQMKYMTKNILDNLHRGIYLAGPDLLEKVRSQYAKYFEYVKEQINLRRQQVLQQGGANMM

SEQ ID NO: 19215 - protein, 438 aa, Candida albicans
PFIDTKGGSCVSGLPIMNIPPNQNSLQQMGGGSNPNASWRAMYSGEERQKVVQIIINTLTELHGSNPNFNVQRLSKMAQDFEKLVYERSASKEDYLRAIKMKVHQLRVQKQQIAANQGGQINPQQRQQQQQQQISNSNSMNPVNAPHVQFLRQQAQARSQSQAQIQARQQQLRNMVNQQLQQQQQPQPQQTVQPQSQEHQQDQQNTSSQSTQQNVASGAGSGGRGNAFFTQGQLPPQLVNLMRTSPIPPPLLNKMPKLPAGVNTWNQIFDLIRKRLIPPDMVPTIRDIHGMHLQLFIRQQQQKLSMQRNMNEGNNGDNLAQGPNANNNNNNINTSTHNNSNPTPNNFNNLTPQQRELLLRQTRMQQQLEQQKKGQQPMQQATSLSQQQQQQKQQQQQPVSQSGQTPQLVQQPNNQQQQQQQPQITITHLQPGHGRIRT

SEQ ID NO: 19216 - protein, 456 aa, Candida albicans
  UNSURE (389): Identity of amino acid sequences at the above locations are unknown.
PKNNSRTISLLLNLSRNLFCKSSKNNFHQFTHQFGCNNKNRLFFLSSPPRVFRYLNPLFVRSYSIIPMSSSDEEDIALSRLAKKSSSITSASTYEDDEDDDIPLAKKSRKKRVESDYEEDEDEVPLKQRKLSNGRAKKQVKTETKVKKEPKSASKSKSTSKKDTKVKKEKTTVKKESKATSTKVKEESKTQSDSQASVKSETLEEDQGYKWWEVNQEEEGDGYIKWQTLEHNGVMFPPPYEPLPSHVKLYYNNKPVNLPPEAEEVAGFYGAMLETDHAKNPVFQKNFFNDFLEVLKECGGCGVEIKKFEELDFNRMYAHFEKLREEKKAMSREEKKRIPEEKEKEEEPYRTCYLNGRKELVGNFRIEPPGLFRGRGAHPRTGKLKRRVXPEQVTLNLGKDAKIPEPPASHQWGEIRLDYEVSWVAMWEKKISGSLTYVRFAKNSSVKKFILIFKKI

SEQ ID NO: 19217 - protein, 102 aa, Candida albicans
CFQYFEVYPRTIQILETIANKIANMTPEQKATFKLPPGLGHNSSTIYKKIIRKIYDKDRGFEVIDALHEKPSIAVPIVLKRLKQKDEEWKRAQREWNKVWRE

SEQ ID NO: 19218 - protein, 188 aa, Candida albicans
FPKFESYEDKPQNIENITFKKHHLELSLCKAYGPSYRQLPKAETYMPCSGRDEMCWEVLNDEWVGHPTWASEDSGFIAHRKNQYEEILFKIEEERLEFDYYMESNLRTIQILETIANRIANMTPEQKATFKLPPGLGHNSSTIYKKIIRKIYDKDRGFEVIDALHENPSIAVPIVLKRLQQKDDEWKR

SEQ ID NO: 19219 - protein, 361 aa, Candida albicans
DEVTTVKVEQQNKRLHPLTPKPQEQLNYDFKDNEVLFDILKLAEVFINKSSTYSVHDREKLLQFLQFFMSLFFSIPTETIETALVARGRIEKSSEEENEKGDVEMSENGSDSSKKRSRDTDLLKDVLKKQSKSKKDDRSGSPGLQSAELAIQEANEELEKSSELWITTANTKFLLNDENIQTRRDKYNLFCNTTIYVFFRHLQTLYTRLAEIKSMNEKVGKEIRNRKFPKFAKDLNLLLHQLEDMGVEIVGTKDCYKQVLELSEKLIEGEIEHQWFEESLRQGYRNRAYKIYTIDKVVQAMIKHMHSMITDAKTSEIMVLFENDRLKPVSSAKEQILYRILVRSFMSPEENMFKISFQRKP

SEQ ID NO: 19220 - protein, 246 aa, Candida albicans
GRLCHLKRICLKYRSKESHSSVNIQFITLHDLTINDHDNVEENYNYYVTSYVMSHPTEGVPASKLNMPFARSFIESVDEESVEGRTGSGLKVSVSENSYSLFFESGSHDEFVSKAVYKKQDSNSKREDKLAHLKDLIDGENGWKSSLPEDQNLEVTEQKVAILFDKGGVEFKKFEEVLNSSDKLKESEANEPTKGATENVEVIENNNDYNTEPDAKSATTENKQEDTIVDETNDSTIQHDVDDTTA

SEQ ID NO: 19221 - protein, 315 aa, Candida albicans
QTFTFNISIDTPGVIDRVSTLFRGHPNLIQGFNTFLPPGYKIECSLDPSDPNPIRVTTPTGTTTRPNLSSATYNQRWGGEESLTINQQEQSSPQSQLAQQAQQFADQASMEAQNGASGQVGFNHAISYVNKIKTRFASQPDIYKQFLEILQTYQREQKQIAEVYEQVTVLFANSPDLLDDFKQFLPDTSNLNYQQTPAQDGYYVNNGTQLPPVGNFQPAGQATNQQYAQLQQTAAQQQNNFQGAASPESVYGAPSNEQVVGKKKSVSEPYQDNYNQESQYSNMRTGAVPQRGQKVSNKAQVPIFTTAGSEGSNAK

SEQ ID NO: 19222 - protein, 194 aa, Candida albicans
SPSDQSRQTAELRRPSNVALNPPQTTNSTHLPPPSSLGHVGNEQGAYPPTISQPAPQASPVIGGVPNRSTTTNVYRPLNVKDALSYLDQVKVQFSNQAEVYNNFLDIMKDFKSQRYVVELSGCVLVLSAIENCMVLYISGSIVPTSLVCFANNPPAHRFFLLFHFTNKHLLLILVLIHLELLIVFRHYLEDIQI

SEQ ID NO: 19223 - protein, 256 aa, Candida albicans
LYIGLWPSRGEEPAPISIFSYINRLTKFNNLKSSGLIGMIYYIDILSYMYPHFQLNSWTIHRFLLVATMISQKAMEDYFYTNDHYAKVGGVSLEELNCLELDFLKRIDWRTIPINNPNVQQLYNNKLVEMTGKISNMVDNNNSGDSDNTDTRYKHTKFIMENEDPTDDEEEEEGDLEDLEEDLEDDDDEDDEFYDSDEDINSEDNGDIEIDDYEMEEENNSNVPDLPNIPMYKYDNNGFSMDGSSSPHLKRRYSKD

SEQ ID NO: 19224 - protein, 892 aa, Candida albicans
KYFNCIIMEEFIPLKLIKTIYFYFPGGTDNKIGVWNLKKLIDLSKLVLTHNSPEVRIKLKSLEPKQYITCHKSLVNVVRFFEGDNKRFISSDVNGNVFFHTLHEQPDTKQLFPFKSIETSEVNPVVDLTISADNRLIAWSTNNGKVYLYDVVKDTFQELTSICHEKPIIQRSIAFDPSNNYLITVGDDTQINVFQYLYEKDDTSTTTYKFRLIYKISKLFSQNPLNVRYKRISWSPDGNLVSIPTASKNQTMLISLISRSEKWTNIESLVGHDFACDVVKFNPKIFSSKENDTSKVHSVIASGGSDRTMAIWNTSKSTPITVLQDAVQGEILDITWTTDGTSLLFCTSQGKLCIGNFEPNELGYTFSQETMERFVQLQNNLIEPMNFRYPHEQTVGNMKQLPPIEFLSQKNAISTTTSLSNTVENDKKNAEDNVGVSNQSKSTTTTTTTTIKGGVITPEVIPPPKLQSLDDDIDGDGDDEEHKSGGMLDSVMNDRTQSSPRKLNKPKPIAPVVSDSTTQSLSFNKQKVTTKNGKRRIQPMLISSGNSAPSDLHRSNSVIKPVVNTTKSTMEFEKPSYSVSEEFYKQNKRPRTEETTGSNNNKKLKREMEPVKFIGSVILNPNTSFSKIRLATPKVRLFFQLKSKTDDDGVFILDIKNGSGNESKPSRLTYMKKDKEIWCDFIPKYIQLATEGSNFWAVTTVDGTILTYSHVSGKRLLPSIVLGSPISFLESYDKYLMVVTCIGELYVWDMEIKKNVLKSSISPLLELYNKEGLVKSDNITLCAVTSYGIPLVTLSNGSGYLFNKDLGVWQTITESWWCFGSHYWDSTQTGNSSGGGGGGGGSGGSNNKRSLQTMNMFNDEQSIIELLEHKTNEEILRKTRTGRGKYFNKILR

SEQ ID NO: 19225 - protein, 106 aa, Candida albicans
WGIFWEFHPSNVFSRISQLQCQYMQKKTYVPRVFGFKLHEYSKLNRWRELQRLKLENRLKKNGIQIDKVVGGFITNGDEEEKQDNNNNKQLQSVSSQFKSLSPNQK

SEQ ID NO: 19226 - protein, 149 aa, Candida albicans
QKMANEEYVTDSSSDFTEYWIDLFLGIKGNEYFCDIDDEYIRDRFNLTGLNLEVSKLPILIDIITDVIDIELQPEEHKDSLEHNARILYGLIHARYILTTRGLNKMFEKFRSGDFGYCPRVHCQLNPLLPIGLNDQPRMASVKLYLSKM

SEQ ID NO: 19227 - protein, 253 aa, Candida albicans
  UNSURE (234),(249): Identity of amino acid sequences at the above locations are unknown.
VKTFRSPANKNFSKFSEKLYKENENEVTFKYAKSGLSGKIFKLGTFNPEGVFNFPLNEGYMPNVNNSDYFQAIYHFPKTKTGKSMILNGHIAPLPALTTADKNDLLYQLDKFNNRRNGGRFNSTLDNSDYINKGPAGKELYKTYSMRRGGYRSYLQYLTNGHHPDHQLQNSQYLSYGQQKPYGGQGSYNQQGYYNQQGRYNQQGNNYNQQGRYSQQSQYNQYGSNTQRFNNNQXYNQSSNNSRSGYLLXRPQR

SEQ ID NO: 19228 - protein, 183 aa, Candida albicans
PTWANSDAAAELKKLIDSKKTQVTVVQDQIATDSSANSETTTSESELEEIQSDNSLKRKLEPEEDKQTQSDDIKLWEPGYNKRYYEAKFHYQSDEEIEQTKRDVVRHYVEGIAWVALYYYQGCPSWNWYFPYHYAPFAADFTNLEELFPEGVKFKLGEPFRPFEQLMSVLPAASGHTLPQVFR

SEQ ID NO: 19229 - protein, 171 aa, Candida albicans
TTNLNVITDILPRSSPIHQTQSAPVYSKLSNSLHSTPTKQSTISPSLDRPMPMDHPIQEDELGDSTTEVDSEESNQNNSRNKNHQQFESIAHNINETISELNIIYQEIGYSLLETNNKKSKIFNTIQDTIKNFANNLNREKSNIENECEWLRQQIRIILSMINDPRGDKSL

SEQ ID NO: 19230 - protein, 622 aa, Candida albicans
HRYVIDEFERIIQALNFSDSNQIPTDHRKEKFTAFVLASPVKKNQESSESGNDGFVKLRDINYQLVRIIRGLRFTKITNELISNIKYEIEQCQAEIETRKSTVIGIIEKCIQLINVLQLNDDQILQLQKEHNPHIEALLDMETLNLILQEPQQLGLNDSHIEFLISFQNMLQETIDTKQAQWDQYSATCKSLWEKLGESDEYITNFLSKNNSLTDLSLLNFKMELNRLYIKRSEYIESVISDARTEIEKMWDKMYYSQDMRMDFEFFNYSGENDDIDKEVVLSKHEEELENLKQEYAQKKNLFQMYEELQELLKDQQFLIESSKDSSRLLSKNSCKILLNEEKIRKRINKTLPKLIDNLKKETSQYNNDAIQMGKRTLFINGEDFFEKILFIESEQFKISGGRSKSSSRVSSRQVSQSKTVAPTRQPSRGSHQHKSPIKVMSRPASRSIINKNPSPVSRTTLRWNKERTFNNPTTIKLSNAINSRLENNHNRHQQLHLHHQNTSILSEESPVRASRDNSVLGKPPATIQPLISPLKPLNVHTVGNTNLNGTPLSRTKPESTNVSYGKENCSPFELSPVKIRPGFFDHDGSRRVSGISNDTSTVIGEDYLSWRDEKIKQLRDI

SEQ ID NO: 19231 - protein, 333 aa, Candida albicans
LLLVMISSKSRPYSIARVYADVNENKPTEYWDYENHKIQWGLIKNYEIVSKIGRGKYSEVFQGVNVLNDEPCVIKVLKPVKLKKIYREVKILQNLTGGPNIIGLLDVVRDEQSKIPAFIFERVNNVDFRVLYPKFTIKDIQYYFTQLLIALDYSHSMGIIHRDVKPQNIMIDPMNKKLRLIDWGLAEFYHAGMDYNVRVASRYHKGPELLINLQQYDYSLDLWSVGCMLGAIIFKKEPLFRGDSNNDQLVQIAKVLGTENLMKYVNKYGIKLSSEYDDILGNYPRKPWKAFINNDNRHLISDEVLDLIDRLLTYDHQLRPTAKEAMEHPFFKI

SEQ ID NO: 19232 - protein, 657 aa, Candida albicans
MIPKLSISGGVGGNISGNGIKSKGNSIDFTNWNEGNNNTGYNNSITELLQNMISNGSIDLNSFSNMSNQQRRDSILKIINDQNSLRSQRSSSDQSRNTNASLREDIFDRRNPLQSQQQQQQSLEKTPQQSASSLSKQKLSPRQRKSPQQQQQQQRQQLSNLQQNQRGQVNTLGVPGDKDNVSPTSSSHTSPKFQEDPQSPKASPVAYGNIHVNEPFASGGYQQVSQMQQQQQRQHQQQQNRQQQQQQPQQPQRLFQNYSVSPQNQYQYSAYPNYNQLGYSNVQQSLANARNNSFSNYIYPVQTQQQQQQQQQQQFYPPPSQQQQQYIPPAATTTKLPGYMPQQQQPPPPSQQQLLKSTDQKKRKPSVRRTRRTKKDQNSNSTPTTNMMTTQNLSSPESRNLVPAQQFAQSEDGRPLLGATKIDQLMLVIQARDKGITNPIEQGPDGSILASPDNFSLGRSKAELDSGILPRPVSLVGGVDKPHKRDEDEIEDSDDNGDGTNQNQHHQHQHKRRKHKNQQCPYCFKFFTQSTHLEVHIRSHIGYKPFECTYCHKKFTQGGNLRTHLRLHTGEKPFTCEICKRSFNRKGNLDAHKLTHDNLKPFECKLDNCDKSFTQLGNLKSHRNRFHLDKLNELNHRLAELSGPALNNLPNEEKELL

SEQ ID NO: 19233 - protein, 698 aa, Candida albicans
FFCISSMIHLVLSSLVTTTNATPTSRSPHTNHSTPYNQNSITSNRSSPVPKNSVNSRIIPQTMNPPIDMKSNNILNPEKDADTSRGDHLESKASSISSASGTTTTNNNNVSNNNSTGKTQIVFIHKLYDMLHDESISHLIWWSPSLDSFYVTPGEEFSRVLSQYFKHTNIASFIRQLNMYGFHKVNEPFLNQDDQQQQQQLQSNRWEFRHSTNQFRKGDTESLKNIKRRSSKTLNAQKEVVNIKSLPPTSHPMEYYTGYSYQNEDSAHYFVHHHSITTMQSPADMRPRSPSTPIPMQPLAQQQQQQQQQQQQQQQQQQQLPSQPVPNGPPVFSGPIPPGAVNQSPQEYLTRPSILNNVQGSFENATNFKFVELTNQINSLRNDFFTMNNRYEILQNELKYQTADSMAVLEILEKLSNDNRIATDIRDLKNVVSQRMQRLNNQFIPQQSNFAPHIPGQQQQQQHGNSVSSNYHLESTNVSRNPSTTNLNVAPQPYPLNPHYTIYANNRALGSSEINNGVFRAREDSNNSKRNLSVYDPLQPVPSRNSSRILIEESTPTHPPTNFNPQQLQSQLQVQLGPAMPPQGFRNRAESTYSPLSHLSNKSQILNKAPTPVNHSPLVQQQQKEAKQELNDSSVAPPSQSSLPVTRPLSRQQQQQQQTLHHPSTTSSRTNSITNPVAEHPAPQSSYFMQRYSFNYCL

SEQ ID NO: 19234 - protein, 361 aa, Candida albicans
STYSVLISDTNQKEEKLFQHPLKLSNITCTYTYIATMSKKNPGDPRVKKNAFVHKLYTMLHDPALSHLIWWTNRNGEQNTFALCPGKEFADCLTQYFKHGNVASFVRQLHMYGFHKVSDPLPITYPPNGNNNNNNNKEVPPVWEFKHLSGRFKRGDETSLVYIKRRSSSNHTSGSTIYAEPIYNPLLTNPYNQPQFMYQDYSMGPPVEVQQFYNYQNQPLMYYQQPPGQVPPPPPPSLPPHQQPEMALQYHQYNNYQQPPPAPPAPPPQPGNVLFGYQQVAPPQQPGSTVQQIPANAPPTLDQTQPLLYTPSIRVPTTAVSSTNITTTTTTTTTNKHQPGNPKNLMTIYQEQPPNGTTFTI

SEQ ID NO: 19235 - protein, 173 aa, Candida albicans
GRGFPPVVKTTASNSGLPDGQLSYNTTDSLGIEIPSILREKANGTEETDKNGDGNGDDNHGLIVPKIEQADGPIFFDNKQFKSNKKLSQVDGESEFDEFESDGDLSDDINSELDSDSDKEEEDDDEEETNFALCLFDKVQRIKNKWKSTLVAGIANINGKDYVFHKANGESEW

SEQ ID NO: 19236 - protein, 297 aa, Candida albicans
IIKTKKTLSNYRFKSIIITIIIMSNTETSKLYESVIEDVINDSRQDFENNGIAKTTLQELRRIWCEKLTHSGVAKFSWDEEEEEEEPVEQVDVDVEVGQSAQQAAEQPQAAINDTGATESNTSATTETTVKKEATASNSGLPDAQLSYNTTDSLGIEIPSILREKANGTEGTDKNGDGDGGDNHGLIVPKIEQADGPIFFDNKQFKSNKKLSQVDGESEFDEFESDGDLSDDINSELDSDSDKEEEDDDEEETNFALCLFDKVQRIKNKWKSTLVAGIANINGKDYVFHKANGESEW

SEQ ID NO: 19237 - protein, 73 aa, Candida albicans
IMIIPIRCFSCGKVVGDKWQTYLDYLQDETLSEGDALDKLKLKRYCCRRMVLTHVDLIEKFLRYNPLEKKDIN

SEQ ID NO: 19238 - protein, 652 aa, Candida albicans
LGQIKKRKAQSATSLNPTKKAKLAAPQAEREVIVLDDEDDDDDDVQVISKPAKKETDRRPTKRKASAINDEDDDDDDDDTRNKLHVQRSPKKETASSVPKASPKKKTSSTLKSTAATKKSKVPAGGDSTADTAQEILATIPDAELPEVDPTKKVNFFALNAARNETTQTSVELPEAQPNCLTGLTIVFTGQMPNLDRGTAEQTAKQYGAKVTKSILGKTSLVVLGADAGPSKVQKIKQHKIKAIDEAGFIKLLELMPADGGSGAAAEAAKLKREQEEAKIIEQAKEEERKEREAEKARVAERVKATVNPKGETFGFQKKEVAPQDKLWTDRHAPTDLNQLCGNKGQIQKLKSWLENWFDNQARGFKGNASDPDSFRAVLISGPPGIGKTSAAHLVAKSLGFDIIERNASDVRSKSLLNANVKSILNNTSVVGYFKHRGDTEKNSNNKRFCIIMDEVDGMSSGDHGGAGALSQFCKITSMPMILICNDKSLPKMRTFDRTTYDLPFRRPSENEVKSRLMTIAFREKVKLDPSVIGQLVQATSNDIRQMINLLSTVSKTQKQIGANSMKEVKESWQKQVVLKPFDIAGRLLNLGIWSDPRLSLNDKLNLYFNDFDFSPLMIQENYLITNPRLPGKQIELPAKAGFHQALDGPRR

SEQ ID NO: 19239 - protein, 60 aa, Candida albicans
ISRDLVEKLSDEELQAMIDEFDLDEDGESMYYIYKANLFRILVLAMFEWKITNFILFFSQ

SEQ ID NO: 19240 - protein, 348 aa, Candida albicans
  UNSURE (11): Identity of amino acid sequences at the above locations are unknown.
PILRTGRSAVXTFGSLVKVRKEEPLITFGRLAEFCINILNDVINHKFPNQGVLSGPFLEEVDTEVYTDYLDYVTKPMSFNTILSNLEKKKLLSPKFPLLDNLKKFHDTTTLIFSNAKAYNNEDSQIYQDAVILEEYFNEQYNKLKSRIELEADKLHPSTPKLKLNLGRIGPSVAEPQLKKKRKRSIKQEFPEEQIHEEEEDIDITQSEPTNADTQDIDEPADSKELDTSKSREVVTERNAPNTMGKTLPLLPEQNSIIQESVIFSSPAVSTNITKFVQQKSSQPATILSRDQEIKKSLFPTQPGNPIATLFSYKVPANGYTDQAHTIALPNGAVPFVFSPRVADPHLQ

SEQ ID NO: 19241 - protein, 286 aa, Candida albicans
  UNSURE (13): Identity of amino acid sequences at the above locations are unknown.
MICKWKPTEKNQXGKKVWKPRVERFEEEEVQTDSNLILVKRQFPEDADDFIPPKRQKSATPGGTTTSGRGRGRGRGRGRGRGRGRGRGSLLSRYTPSVDPLTADERSTLQNQIENILGLIINYKNEHDRVLSELFLVKPPKRFYPDYYVLIKHPIALDVIKKRTASKSYSKIREFLEDIHLMFTNAKIYNEEGSIVYQDAAFLERLSMDKFKELSANLSEDEINKILDFAEFDEMFSLKPLVPSTAIKHPIEAKLEKIDKGEAIDSPLLNASTTAGTEESTPANFD

SEQ ID NO: 19242 - protein, 980 aa, Candida albicans
  UNSURE (967): Identity of amino acid sequences at the above locations are unknown.
VYYFLIMNRQPTREDIQRAIQRWHQMKQQYGDQVQLNPEFVKLTKFLNTLKMQQQRFQQQYQQQQQQQQQQQQQQQQQQQQQQQQQQQQQQSLNHSQQSPLLQNAQGQTPQQPPTPQQFSNFNQNGYNGQQFSSQVHSPAIGGSLSTSGHGTPLVTNANLMTGKKNTRTPNAQFGNQTAAGTPLQQQQQQPFPHGNNSNPMLNQTAQQPPQSQQRQQNQPPSPQSAFTNQQFQLLKSQLQAFKYFVRAPSQGQGQIPQNLIAYVSNPSSAMANDMYLPAVNRPQTNGMDRTMQMPQSIPSQPQQYALQQQNDLLNLNPKSTGGTPEIPEKKKGKRGPKPKNPKKPTKKQLREEEQRLALEKQRQELEQNRLKSSAPQAFPPQAGLQGQAPFPPQPPQQSQQHVPQPPPASTSSSPPGGLPQLQPQPQQQQQQPSRPITKPATPQPLFPDPSPPVNIKSVVPDKANNKKVIIPVTKPNIEVDTFELFDIISDEVKDIPFNTLYAPQSRFQIPSFLPDGINMEDIYVNREGYMQITIEQEKERLRKQIDSLNEKDTEKKLELETQLSQLELIPYQKDLRGKVLIQSWFGKSLLPNSHPNFLARFSSLSMDSVHMTTDLYRLQLESMMREQNKKHGKTIEEIINFSDRSSIKAVKKSDRLSRFMTKINNFHNQTAKEEQKKLEKMAKQRLQALKLNDEEAYLKLLDHTKDTRITHLLEQTNQFLDSLALAVQSQQKEAQDNLAYSGRAIEPASVAPLDDEKREKIDYYNVAHRIKEEVTKQPSILVGGTLKEYQLKGLQWMVSLFNNHLNGILADEMGLGKTIQTISLLTYLVEVKKIPGPFLVIVPLSTVTNWNLEFEKWAPSIKKITYKGTPNQRKVMQHDIRTGNFQLVLTTFEYVIKDKGLLGRIKWVHMIIDEGHRMKNANSKLSETLTQNYHSDYRLILTGTPLQNNLPELWALLNFVLPNSPXLWLSTDGRITHCW

SEQ ID NO: 19243 - protein, 196 aa, Candida albicans
LWALLNFVLPKIFNSVKSFDEWFNTPFANTGGQDKIELTEEETLLVIRRLHKVLRPFLLRRLKKDVEKDLPNKVEKVVKCKSSALQSKLYQQMLRYNMLYAGDPANGSVPVAIKNANNQIMQLKKICNHPFVYEEVENLINPNIETNDQIWRVAGKFELLDKFLPKFKATGHKVLIFFQMTQIMNIRHAVEDPKGG

SEQ ID NO: 19244 - protein, 226 aa, Candida albicans
RAGGLGLNLQTADTVIIFDTDWNPHQDLQAQDRAHRIGQKNEVRILRLITENSVEEMILERAHKKLEIDGKVIQAGKFDNKSTAEEQEAMLRALIEKEDERRQKGGTDEEEEDLDDDELNQIIARNENELVVFRKMDEERYLATKNAPYPSRLYTEEELPEIYKIDPEELFKKEDVALEEYGRGARERKILQYDDNLTEEQWLKKIEGMVSDDDVFTTGLQGPALH

SEQ ID NO: 19245 - protein, 268 aa, Candida albicans
PYITRYKGKMSIIFRKRLDSDRNIDASLYFGNIDPQVTELLMYELFIQFGPVKSINMPKDRILKTHQGYGFVEFKNSADAKYTMEILRGIRLYGKALKLKRIDAKSQSSTNNPNNQTIGTFVQSDLINPNYIDVGAKLFINNLNPLVDESFLMDTFSKFGTLIRNPIIRRDSEGHSLGYGFLTYDDFESSDLCIQKMNNTILMNNKIAISYAFKDLSVDGKKSRHGDQVERKLAESAKKNNLLVTKTSKAGTTKGNKRKNKPHKVTKP

SEQ ID NO: 19246 - protein, 589 aa, Candida albicans
APQILRIPSRPYQQQTRQNLLRQSDLPLHYPISGNTSGPNASNITGSIASTISGSRKSSISVDISRPPLLPVFPISGPTLPTLLPEPLPRNDFDFAPKYFPAPGGKSHMAFGATTVYDADESMVMNVNQIEERWGTGIKLAKLRNVHNIQNRSSSSSSTLIKVNKRTIEEVIKMITNSKATKYFALAFKYFDRPILCYLIPRGKVIKLYEEICAHKKDLATVEDILGLYPTNQFISIELIAALIASGALYDDNIDCVREYLTLLKTEMFINNSGCLVFNESSYRKLQAMLVCALLELGLGELTTAWELSGIALRMGIDLGFDSFIYDDSDKEIDNLRNLVFWGSYIIDKYAGLIFGRITMLYVDNSVPLIFLPNRQGKLPCLAQLIIDTQPMISSIYETIPETKNDPEMSKKIFLERYNLLQGYNKSLGAWKRGLSREYFWNKSILINTITDESVDHLLKIAYYLIFLIMNKPFLKLPIGSDIDTFIEIVDEMEIIMRYIPDDKHLLNLVVYYALVLMIQSLVAQVSYTNANNYTQNSKFMNQLLFFIDRMGEVLRVDIWLICKKVHSNFQQKVEYLEKLMLDLTDQMG

SEQ ID NO: 19247 - protein, 461 aa, Candida albicans
MSINSSTSTTNKRKRKNPSTTTPPPPTTPHPAPPRTEKRISCQRCRTRKIKCNYELPCFNCKRDGSQCIQPIDMRSKRLKATEVITLQKKLDLMIKFINDCKKLRNAEAKQQFISQTNLDELINDGSIVLDNVDSTDGYGDVLHVANHDEDVTHNNSAIYGPTSVYDDSLMHHHKPNTKHKQITIDKSNSNDDNNSKGEINKDENRNVGNNSSINYNNNINTLNNRIDNNSSNFINVINKMNKDPDILKCIQLFFIWQYPDHNMFIFREAFLIDFFNPKKNMLYCSKTLILSICSLGAKMSTEETIYNRSKEFYQELKYLLLNSIHQPSITSLQSFMLLAFYDICNGQNSSGWMLSGCAMRMGYDLGFQLNPELWFVKSKGENNTINNLSKLDVEIRSRIYWGCYMADHFISLLLGRPSILKIFDASIPVTSDLPDLEWIDDFTYNGHIFFTHRGWKVPRL

SEQ ID NO: 19248 - protein, 274 aa, Candida albicans
AITISIMSSFQQENQLNANNNNNNVMNEYISYSVPLSPVTTNENPQDYWMNGLIANSVPISQTTSNSDINYSQPPNPINFNSIFEGVNIFSNDDFTSSSNDISLANSPETNATSDSIAQNLDEVKVKLENHNQARLDALEFAFETKSILKEQPKIKQEPGTKAATKPKRRAPRKKLTESQKKAHNKIEKRYRININAKIAGIQKIIPWVAFEKTAFETGEENETEAEAKNNTRLNKSMILEKATEYILHLQKKEEEYMAENQKLREQVIKLGGE

SEQ ID NO: 19249 - protein, 387 aa, Candida albicans
YLNSVEKKNTIKYPPWNSVNKHSIKTKKYRKTPQNNTQTMNEDPQSEIMERYNESAYLRDEQLPQFDQNNDVIKEEQTHTQDHHHQHPSELGSHSDELQDQDIHNVIEEHEDHVSTQNIVDEDELLAAQAAAEAAAAAQQQQPGDVFNNVAQGLSGKHRDMMMQYWQETINSIEHDEHDFKNHQLPLARIKKVMKTDEDVRMISAEAPILFAKGCDVFITELTMRAWIHAEENKRRTLQKSDIAAALTKSDMFDFLIDVVPREEEKPKKSNNNLSRSDSYVNNQQSPPIPETEEEVPHMLTQDVKHSHQDVLQQQMLQEQLLQQQLHQEVQQQLQQEVQRQLQEDVPQSDHQQASQREEDITNGAENANGHNDEATYENFNGYQNNY

SEQ ID NO: 19250 - protein, 210 aa, Candida albicans
FSSPYRYFFFYFKSFAKLPTAMSETNEIKLETEPKQPPYPIEQACDSCRKRKLKCSKEFPRCSKCIQHEWCCSYSPRTIRSPLTRAHLTEVENRVSQLEGILHYLLPDHDIDEIINDHDKAILAPIRQKLQPLPKPCAPTEMHSPIDSITYPLRQSKSNPIPEEYPKSRIKQEIIDDFLLNNITTTTKNNDYITPTVFNSSVNSTAQSSS

SEQ ID NO: 19251 - protein, 487 aa, Candida albicans
  UNSURE (474): Identity of amino acid sequences at the above locations are unknown.
PLLRMKSMQLKPAMKLTKNQQLTMMETTRIISQMMNRIKTRPLLILHLKPILLMTLKKTVKPRQNREEVKEPVESKEPEQVAATDEPDVKKSTNEIVQELFADATPTADNKLSSPGNLESEDYDPESAFTDNNIEKDSKFNDNSEIQENKDNSDYEPELKEDAERKSPATANISLTKPHGPAGLPPKPPVNATVKPSTAAITEESSSQQRLKDAYDAIINSPIGRDPEFLKLPAEEQVDAIKDQLQKLGIDLSSGSHPINFDQVYSYNKPFKNLKDPIPLVPIGQFCRRPNITAPTTPEEEQEYADFIERENYYLNLQNWDEFPDKLRLFIGNLPANTISKQDLFRIFSKYGEVIQIAIKAGYGFAQFRTGEACLECIKGETNIPLHNKILRLDASRPQKSRRPGHPEINNPNMSGRGRERVRDESQDQDEQPSHKKRKGNIDCQVYVTGKSSVFFIRKVKKAFPMSQVTNRCXKMLAQVIIHQVLS

SEQ ID NO: 19252 - protein, 361 aa, Candida albicans
VLSAIILPHTTHIYTLTMKLDQLINQAAPQPVPTVTRLLSIGLSSSSSTGVTNSGNAPLLPHNHNQFNYYPKTATTSSVHNQRVNLPPISDILQQAQHYLPPPPQQQQQPQQPSQSVSSYRQAQAQLPPLPLAATANSNSNYKYYDYYQSPNSDHQQRSYTSSSSTVPSPRIPHSDNTVPSYQQPMMVRNNSYPPIQQQQMQTQYHQQPQYLGVGGDSYFRNRTPQPPVINHNHNNGSNSTLSSSSMSSPLSSPYDSQNHTSDFSATGTPTDNFMKHASGASATNGGVNNNRKTRNNLPKEITFILLQWLNDHLNHPYPSSFEKNQLMISTGLNQQQLSNWFINARRRKIKLLKQQQRLNF

SEQ ID NO: 19253 - protein, 505 aa, Candida albicans
RARFFPAAWSNKTPSIFKPKQQSIESTLRKVNLATFLAATLCTMEIGFFYLNESFLHVFCPLNNLDPLNALSNLGGYQNGLQSTDSPVCARVGKLLKPQATLYLDLKTQAYISAIEAGERSKEEILEDILPDDLHVYLMSRRNAKLLSPTETDFVWRCKQRKELLLNYTEETPLSEQYDWFTFLRDLFDYVSKNIAYLIWGKMGKTMKNRREDTPHTQELLDNTTGSTQMPNQLSSSSGQASSTPSVVDPNKMLVSEMREANIAVPKPSQRRAWSREEEKALRHALELKGPHWATILELFGQGGKISEALKNRTQVQLKDKARNWKKFFLRSGLEIPSYLRGVTGGVDDGKRKKDNVTKKTAAAPVPNMLEQLQQQQQRQQEKQEKQQQEEQQAQQLEPQQEPQQEPQQEQQQEQQQEQQQEQQQEQQQEQQQEQQQEQQQEQREETQQTEQEQPDQPQEEQQQEKEQPDQQQQEKEQPDQQQPDQQHPDRQQQEQIQQPENLDK

SEQ ID NO: 19254 - protein, 262 aa, Candida albicans
PFVNKKKWVEEKMEIEPLTDDRIGTVIFVKRKPRLFKKAHELAVLCQVDLTVIIVGNNNKVYEYSTVEANEIFNAYNKTIKVRKQVHESKSPEYYSKFRKKRHLNEPLMNKSGSVVGTNTHLNDEDYDHNVHEAGDEDSEYESDDNSPQPKRHKRSESVKKEQNPKVFNSTQLPPPLPPLHISLNNVPTFTNPQNYKKQIDETNNTSAPPATGTKNEPTMQRPVLRVQIPNDAKSNTNNSHSGVNNSDGKDIFTRRRSKSRH

SEQ ID NO: 19255 - protein, 231 aa, Candida albicans
RMSRLDRLVVLLETGSTPFIRNTAADQLSDLAKAHPEDTINLLGRVYPYLKSKKWETRISAARAFGGIVNNAPLWDPNSEKQIKLEKDAEQVFVKEEIETDPIVKKEFPEDEIIIKKEQDEELQKLTKNLSNLINFDSFSLHELIKCGTKLLASKLDDTDREDYINDVTLLGRIKRHRSSIIPKEETKSDLSKESSPNAHTKEEPIIKQETGTQQQHDNLASASTSPAPPT

SEQ ID NO: 19256 - protein, 629 aa, Candida albicans
KRKPDESTTDIPIEDLKVNIDSPIYKGDVMLVGYDKLIGMRCAASAAFGKTLSYMQSEETLLKIFEAISGYLKSCHATSVLLSAFIVEEYATALKERGLKPNEKIVTLLSGSLNKVLQEPESLPHFRELVPTLKAVRTSCLQLFDVFVTAAKLSPSRIPQIPVVVQGEAEAGPGAFGLETAEKICNETFVKLKKHLSATHRLSANQALEDAKHRILVAMEESRLAFTSRANSIFAGFAAASLALAGVPKKLNPIIKSLMESVKLEETLVLQKRSVFSVARLVQQLIEVGKKGASDKIVKNLCAFLCVDTSEVPEFHHNVIFKENILSLRKEEAQIDPTDAAAHERAVREAKIKRNGALMTLDQLVHIYGPKLFDQVTKLKEMMIEPLRYLSKTEEVSQDELKGQSVIDALGILRALFPKMDKELYPEVIDNLDLFLPGLQSEYSVFRYSTAKCLATICSVVPAKAFIFIVNSVLPMLKNAGDVKQRQGAIETVYHISAAMGASILPYVMFLIVPVMGRMSDSDHDVRVLAATTFASIIKLVPLEAGIPDPEDMPQELLEGRDRERDFIQQMMDPTKIKSFDLPVTIKATLRKYQQEGVNWLAFLNKYHLHLFRVTMSITPEPGNKCDPG

SEQ ID NO: 19257 - protein, 553 aa, Candida albicans
TRGRSAVSSSPGRIWEQEIKGYAPFMKVLVYAGSPSIRIPLRGQIPDADVVVTSYDVCRNDVESLTKHDYNYCVLDEGHIIKNASSKLSKSVKRVKAEHRLILSGTPIQNNVLELWSLFDFLMPGFLGTEKVFHEKFAKPIAASRNSKTSSKEQEAGALAMESLHKQVLPFMLRRLKEDVLSDLPPKIIQDYYCELSDLQKKLYKDFAKTQKETIKTDVQGSEKEGKTHVFQALQYMRKLCNHPALVMSEQHPKYAEINQFLISRNTDLRNIEHAPKLLSLKNLLLECGIGSQDSEYNNNVLKKKSLQQQQQQQLISADGVISEHRALIFCQLKDMLDIVENELLRKYLPSVTFMRLDGSTDPRDRQSIVRKFNEDPSIDVLLLTTKVGGLGLNLTGADTVIFVEHDWNPMNDLQAMDRAHRLGQKKVVNVYRLITKDTLEEKIMGLQKFKMNIASTIVNQQNAGLQSMDTNQLLDLFDVDDTGNGAKVEEPVKEETDTNGGGGASTNGDIPDDITGGLTGKAAGAVGELADLWDESQYEEEYNLDNFIKTLK

SEQ ID NO: 19258 - protein, 271 aa, Candida albicans
  UNSURE (228),(242),(245): Identity of amino acid sequences at the above locations are unknown.
GRVYPYLKSKKWETRISAARAFGGIVNNAPLWDPNSEKQIKLEKDAEQVFVKEEIETDPIVKKEFPEDEIIIKKEQDEELQKLTKNLSNLINFDSFSLHELIKCGTKLLASKLDDIDPEDYTNDVTLLGRIKRHRSSIIPKEETKSDLSKESSPDAHTKDEPIVKQEPGTQQQHDNLASASASPAPPTGSNKPVSSARLKAMQRKKAKANAKNGANKIRPSDISQNSXSKTNDKKMGKEWIXIPXDSTSPIWMLLPQQRWGINLNGLKTKN

SEQ ID NO: 19259 - protein, 211 aa, Candida albicans
ELRHGAALGLRELVKKHGKGAGRVMNKTVQANDTNNAATLEDLAVRICVIFVLDRFGDYVSDTVVAPVRESAAQTLAALLIHLNEETVIRIFHCLNSMVLQKDMVAKCWEAKHGGILGVRYLVSVRTDILLANPEMFDDVVTMVLSGLKESDDDVQSVAALTLTPIASQFVTTRKNVIGTLLTVIWDCLVNLRDDLSASTGLFARAANPRI

SEQ ID NO: 19260 - protein, 759 aa, Candida albicans
  UNSURE (737),(749): Identity of amino acid sequences at the above locations are unknown.
TNTIMSEEDVNKSNVMVESVDLKQESVKNQDDGLDRKTLFVRSIPFEATSEELSEFFSQFVPVKHAVIVTDNERKSRGFGFVSFTLDDDCLTALVESRKTKFKDRLLRVDVAKRRDRKPQEGNERQEKSHVEPIEKRRARLIIRNLPWSCKKPDELKKIFSKYGAVFDAYIPKKKGGQMCGFAFVIMKKNSAAEKAVEGCQGLKIDGREVAVDFAVEKSKWEQMKDEEVEEEEDNESSEEQEEADSTNKDENDEEEEDKDDESDNDDASSEFDELNEVNSDKELDSSDEEMEEPEKKEESLHPKKKSNRQEPFSIFVRNIPYDADAESLKEHFSTFGTVKYALPVVDKKTGLAKGSAFVVFAKEDAYLDCLDNAPTVASTSMLIADDVSPSYVYQGRILSIASAVDRDSASKLADRNSLKRKEALGKAPGEKDKRNLFLLNEGRITENSKLAQYISKTDLELREKSYKLRTQQLKKNPTLHLSLTRLAIRNLPRAMNAKALKALGRKAVVQFATEVKEGKRQPLSKEEVNRSVKFKHSIYGADAEEEIAKSKNSKHKGVVKQAKVIMEVKGSGETGRSRGYGFIEFRDHKAALMGLRWLNAHEVSIPEILEGLTDEEKKLAELEGLNKRRLIVEFAIENAQVVKRRREKEMIARNQNKDNSKKRKRDDNEEEDNGDAESTSKGKKFGSSDKKQKKARKGSQKKGNMNKGAPKSEELQKEPTNKSGLSENVKKIIGLXRKRRKFKKLGEXKTNMYIYMGK

SEQ ID NO: 19261 - protein, 103 aa, Candida albicans
QPFSAVKYVRSTRDEPVESEIELNEQSNIQSKIILLLYAFPKLKIIWSSSPYETAQIFLELKANQEEPDVGTALDKGANRTIETGDGNPPMYNDDAIDFIHHQ

SEQ ID NO: 19262 - protein, 864 aa, Candida albicans
KRNRTLRNEENLKEKTKEAKEAKERRDTEKLLVNFEFTLSDHHYTIHIMSLFVHDDEENDKSTIPLNFSEPDIVPVYPEKAINCILPLKYQQEIVEDTLTKDGLLIMGCGLGWDIITANLLYALSTPFVDSRTKKKKRGLIFVLNAQDDELIRLQEEMNDLNWEDESQHERLVIINGDSQPLRRKKLYAEGGVIAISSRVLVVDLLSLIVSANDITGLFVFHAERIKETSNDAFIINLYRDNNNWGFIKAFSDDPESFSGFTPLATKLKLLRLSNVFLWPRFHVTISQSFNIKNKKDILRKLVTEISVKLTHNMNKIQSAILTCIQSCLGELKRHNPTLATEYWDIENVHDRDFVGRIRGSMNSIWHRVSVTSKNIVSDLSTLTNMLVGLINLDCIGFYQNVQRIVSESQKVQAGSKYRSQSPWLNLDEAVTVISCAKERAFGKRDGNYMFEELPKWNELGKLVHNILQEKRTSNLKNQGPILVVCSSKWVARDLTRLLETMQEEKIGDKRVFSCRRFMKDQLREYAHWRKEINPVVRRIWEEMEAEEQKEDESDIVITKTFTRNGQPVSKRRRTRGGSVAARVNQLRAPENFEAVDIDQEMLLELNEDEPIDQESDSLEFEKTQEENQEVLDLINETEQFQHDFDFVHIDKEEQIIVQAYNDKFNASILQELHPSHIIMYEQNLPFIRRVEVYQAINYENPAHAYFMYYGDSVEEQKYLLRVKREKEAFTKLIKEKATLGKHFETKDDNAKFQINRNNIVNTRIAGGSKFKTETDESNVIVDAREFGSSTPNLLYRIGINVIPCMLTIGDYILSPKMCVERKSISDLVQSFSSGRLFQQCKQMFRHYELPVLLIEFDGTQSFS

SEQ ID NO: 19263 - protein, 519 aa, Candida albicans
IMSDWLNENAFADSNSNDDFLNSIFDQSQGEQQAPQVAQVSTSMSNPPLQSQSALSTSRISQAHTPMYQQSPVTAHTIPQNSPQSMPNQVAQPQQQIPPPPLQHLQQTTAQMLPQQQQQQQQQQQQQQKQEQLYRMKQQIYQQQMLKKQQENMSRQPSPMNSAGHNTQQNTPITQNAKTPQNNSKLQSMQMELFFSVLYDFLQRSGISIPQSLAINGKRVNLFILYILSQRLGGYRVMKAFLLMSPEQQRMQQQNPWALMADKMGFHDKGEDPMAKERIARELCNCYSNFILPYEEYYATPEGNKDIEASKHRFQQQIVQKYLSNVPTPAPNQQSPMISSAPTPHQQRKLSRTSNSVNNSPNVSSPFHNTPRQVPAPAPAPVQTAASMPPPTPVTAKSQTTKADAHILKNYTPFKKIVETHGPFNIKELSQLSTEIEVTKPVYLFAPELGIINLQALTMSVKSNSGIQSSEVVNALNTLLVATSDVNYAFQIKDIMELLDALSSLGKDVLNKIVRVNTE

SEQ ID NO: 19264 - protein, 489 aa, Candida albicans
PPPILSADAACLVVKTRRGCVNADVTKLSANGRIDDIFNRYVKGQGEDILYVVNSLTGEVVSDDEDIEELFSVCDDGNLESPIDKLTDLLDVLEFHLDDYLTALKNFKSENKHHFSKLQTRSATDDQILLVDELITITMILRNISFAEYNKEPMAGNRLFKDLLFSTVKSVALNNDKFVFSRKRLCLLKDCLLMLDNISLFTHLHTLEEAFLSFVLVASFGPKIEDQYKIPRCNIETHSYFAFGLDAFTKLMVREPYNRSLIQAVLNGTLNSSMTGYSVSLQDQEYTRKLIKAYNKDYKSASLLSQAFQMYMSILPFDANTFELSKFIFMRSPTISQMLFGAKLLIDMVPVDDLNTHHNKLSLYWLLENRELLLGNFARIVVALSTETGKFPRESPEHKVLSLVLRKALVVINSLVDNAVLAKEIGDLRHTDLMESLTDCLAFPRIIPDAILTLDTFLAPTIDTNLGKEVVRLLRYLKANFFSKACEGI

SEQ ID NO: 19265 - protein, 271 aa, Candida albicans
LKLMVSESCSRNYNHPYTPYDIQIQLMDAIYNTIENGYKIGLFESPTGTGKTLSIICSSMTWLRTFKRNNTFLETNNEVEDVYESESEEDEPEWVKKAYQSSIVNRSKNKLIEYEHYLDKIEKEHAQNKRKEEELEIKVHKRRKAMTAAGTDLSEESYLPMDYYSDSEVGKIEDQNLAITKEINRLLKKVENKEEVSYINECPIKIFFSSRTHSQLNQFSSQLRLTNFQASFEDLEERTKYIPLGSRKQLCINEKVRFFISGTAGSAPYWG

SEQ ID NO: 19266 - protein, 408 aa, Candida albicans
RQRFADLSLAKIRDIEDLNELGIELNICPYYSVRKGIEMTEIISLPYQMIFQDTTRKILNLDIKDSIIIIDEAHNIIDVITSMYSIKITLDQLNKVIKSLKIYLNKFLKRLNSGNRINLMKLIKICQILLKFLNTNLEKVKSGDEVQIQDIFKDSTGDLVNIHKLDQFLTKSKIAYKIESYIEKTEMETDNGEKKGRITNSGGSSSSSSSSSNPLLFTIIKFLRTLTNLSKEGKFFWDNENGTISLNYMLLDPNAVFKEIVDQAKCVLLCGGTMEPMSDYMDYLFPSVPTNKINTFACGHVIPKENLQVFPISQWNDTNFEFLYQKRNDSKQLMALGEFLIEITKRVPYGVVIFFPSYKYLDQVLQFWRDTKILTSIESEKTIFREPKDPSNVEKILNEYGYLIQTGT

SEQ ID NO: 19267 - protein, 76 aa, Candida albicans
FKLERKGAIVFSVVGGKMCEGINFSDDLPRAVIMLGLPYHIAYSGEMLTKRKYIETSELSHGGTTTDAKEISRKLL

SEQ ID NO: 19268 - protein, 71 aa, Candida albicans
RAVNQSIGRSIRHINDYSIIYLVDRRFSTPRIQNKLSQWVKERISITTTNNNNNNSIYIMESTTDFFNIIR

SEQ ID NO: 19269 - protein, 403 aa, Candida albicans
RQNCNQSNGRPSSIGGLEIVFHQSGSTIYFQLNLTYPICGDAETIYGYKDLDIFLCFDHYTFKPFLNIKYSAKLTDDPEIIDIKKTIDEFLPKLTIFKDEVKWVDSIKEEKDNGYKIPGKLIDSFSENDKEYDIYKIDLKSDNGYELHQRLQILVLLFIEAGSFIDAKDELWNLYVLYEKDNKSTSNNEPSIVGFTTAYNYWKYPGAKKLDSTEQELRIKISQFIILPIYQGQGLGQLFYSHLFDKWLAQDDIIEVVVEDPNESFDDLRDRADLKRLNTSEQFDFKAVTPKVDKEWVEKTRRALKLEKRQFARLLEIILLYKLKHGYPGITKRDVRLFIKKRLYDKNKEGLATLDDNTKKDKLQTAYQALEDDYYRILGDLKLNIKRENDEEETDTVSKKQKV

SEQ ID NO: 19270 - protein, 375 aa, Candida albicans
  UNSURE (371): Identity of amino acid sequences at the above locations are unknown.
NQIMSEVKNELETETTPAPAKKQRLSNDDLYRNSTQYELWSFTQETLQDAKREANEKGVKISKERFKSAFENAKKEHPDAFEQFPDELNENMVSLLTLEEESTYLDFYIQNITTTCNFFKMPTQVRLTAASFFKKFYLVNSVMEFHPKNVLYTCIFLAAKSENYFISIESYVKALKGTDTSHILDLEFIVLQSLKFTLLVHHPIRALYGFFLDFQAVLLHPEQVMYDVSVDTLGNMYNQAKEWLNKYFMVSDVAFLFTPPQIALAAMYDTDKRITDKYLRRKYLSNEEKLDPIKEQENENEKQNGEDKSVVASEEASKDVSKEKTKSSNRQQYETLVTLLRKCVKLAKQSRVADREASKELDKKFRRATAXHLPK

SEQ ID NO: 19271 - protein, 91 aa, Candida albicans
LIKKFITMAPGERKKSSRKKKDPDAPKRSLSAYMFFANENIYIVRAENPGISFGQVGKLLGEKWKALNSEDKLPYENKAEADKKRYEKEKG

SEQ ID NO: 19272 - protein, 254 aa, Candida albicans
FSILALLGFIYEDCYQLTFLQLKAHIDSRKMINEDEEEFVYAQKQALPISSESEDPISQYLLAVRKESLAGPPVTFITNRQAPQITSTPKSTPQNNRDQISDHWSSELMTQFVFLKEELLKTQHSIPINPHIPETTANWRKYFLEPPPEISYFFTVIDRQTVFKLLVYITRWLSITSRHTLSQWIWKLFLRIDKVLDPNECSVIRDLGKKALTIKSKQLKDENKATVDSISKYTTDMILVIVGNYYGQSDLLKW

SEQ ID NO: 19273 - protein, 618 aa, Candida albicans
TKYLFANHHTIKNNQFIMSTAIYYSTHNNMHTNDDITNGSGSTTSGNPGANPSNPNHTNAGATINNNSNIGLNSANKNHTTLLPSLAHIMPSNSNNTTNSGSSIDISSTLINPYSSGAAAAAAAVGGGNGGYYHPPPPHSQQQQQQQFDTSYSNQTTPTSAYTNFNNDSTHSPTDILMQQNMNNLASSSGNMSIGGGIDGNFSHNNNNNNNNNNNNNNKCICKSKVNKIPRPRNAFILFRQKYHQMVLDEGTVIRTNPEVSRELGRRWRGLSPQEKEHWNNLAEEEKKNHAKKYPGYRYTPRRNGRNKNCPVCKNKPLPNNKSNSISGMSGSGGGGGSISGASSLSGGLTSRDNSITNANAIDYQQQQLQQQQQQQQQQAIQFQSLPPDQYQQLIKQQQQQLQLQAQLNGGGGGGGITSNPQTIPQYITNGNYPSYIISPNPYSTTSTTAPTTTTTTTTNASSIGLSVPPTATTTSTSSQPTSANSQLHFYEAEKLSPVSSTHHQSSISEIAAQQQQQQQQQQFMYNTNYSTIPPNNTTTMQQHSAGTGNDYSLNGNNSGNTGYDNRYGYGQPMIITGQSQQGLQVQQQGQHYNSGLHAAQHYQQQQQQHHHQQQPPQ

SEQ ID NO: 19274 - protein, 142 aa, Candida albicans
  UNSURE (131): Identity of amino acid sequences at the above locations are unknown.
MSNSNINNKKFTGPNLNVTLICPDCKQFPPDLIERFSEGDIICGQCGLVLSDRIVDTRSEWRTFQNDDKNTDDPSRVGDASNSLYDTEDLTTMISYAPNSNSGSSKNSLNKIQQKSLVDKKNYALQTGSPXFTSDQPDPNYR

SEQ ID NO: 19275 - protein, 187 aa, Candida albicans
IFEREKFKISFMVAIFLLGCTRADVPRTLEEIRALTNVPTKQIAKVTGLIKKIIRSHLNNDDASTSIVDETSSLTTHSAEDLIRRFCSHLGLSLAITSASEYVARKCHDLGVLAGRSPTTIAATSIFLAAKLLGDTKLTQQQIRDKTGVSIGTIKNSYKILQENAKDLIDPAWEANSKVKRENTPKS

SEQ ID NO: 19276 - protein, 351 aa, Candida albicans
ACITKHIMSPSTSTAVQEYIGPNLNVTLTCPECKIFPPDLVERFSEGDIVCGSCGLVLSDRVVDTRSEWRTFSNDDQNGDDPSRVGDAGNPLLDTEDLSTMISYAPDSTKAGRELSRAQSKSLVDKKDNALAAAYIKISQMCDGYQLPKIVLDGAKEVYKMVYDEKPLRGKSQESIMAASIFIGCRKANVARSFKEIWALTNVPRKEIGKVFKIMDKIIREKNAANPNAAYYGQDSIQTTQTSAEDLIRRFCSHLGVNTQVTNGAEYIARRCKEVGVLAGRSPTTIAATVIYMASLVFGFDLPPSKISDKTGVSDGTIKTSYKYMYEEKEQLIDPSWIESGKVKLEKIPKN

SEQ ID NO: 19277 - protein, 1006 aa, Candida albicans
  UNSURE (997),(1001): Identity of amino acid sequences at the above locations are unknown.
IAMSHIDGDDHMTKDLIDSLESKDNDLSLVTSNTQIPDVEVANLTHDADEINQLFDTATNNVLPESNKKDKPIDTQDLHEDDPKAVPKTTSNGESTSNSNSVSPKLLPNDGKSTPKIQKELRRKSTFVPVTSNSKLLEPSEDDNNNNNNNSRISAYARLDFENFTFFVQTLQVVLGRKSNDETLQQNVDVHLSSKKAISRRHAKILYNFGTQRFEISILGRNGALVDNVFVDKGLTIPLTDGNKIQIGDIPFKFVLPSNEPNEENNNQDSSEKQFNPSDAINLRSNLYSKSSSPQSSPKRKPQPSKKVKKEPVSASNTSKDIKPTPPVPTTAISPTASISTSTNAATAATATTPATTTAARKNSINRRNSLLKIRRLSNARRKSLAANDEINELLKDLGVTSIDEINEEDSELLDAQIQSLLDEDNENLGGIEDSLMKLAEFNESAIDDDDDDEEGNENSQADLDRLEKTMEHDAIDDEIKAIDSNLTLLDDEISKLTPLINDTNQGLLEEKETKKKQLEEEKRKKQLQQLQHKNSLAKFPRRSAPLMGKPASIQPPASSSIYSRINGLDKIGKTVSPRPPPPKLIAPVLRVTAEPSAIRSRPPLRAITVSDSSYIATFSYPKTIEEPSKYPKPKVKKEHHKKHSKKVYSLDEIPEPYRSKPNISFQIMITNVLKTEAARNGLIINEITEAIKEVYPYYKYCTDGWQFSINHCIKFTKIYKRLQKRGSEWLYAMDELYINERENIRIKQREIAKAKAKAEALRQEEIRQRQRLEAQKSLPHNIVGRNFALPYANTRVPPNQYNQFSQSSSSSSSSATTTTNGQYGSTTMVGGTSPQAGSIRAQLAAVRGNGNTPATTSTTPSLPAMNDPKTKKSLEYLQKELFTLYKARKLTYDTQTATSLITKAVATTIAQVNSIGAKAGAGDNALVFLVERAPEKVSKILDIALTKSIKEHEGIASKSPSQPATPGMRPEQLTTTSQSAATPTTTPQISNSQSLXVKPXAHGSA

SEQ ID NO: 19278 - protein, 275 aa, Candida albicans
SFHPGGEDKNSAYARLDFENFTFFVQTLQVVLGRKSNDETLQQNVDVHLSSKKAISRRHAKIFYNFGTQRFEISILGRNGAFVDNVFVEKGLTIPLTDGNKIQIGDIPFKFVLPSNEPNEENNNQDSSEKQFNPSDAINLRSNLYSKSSSPQSSPKRKSQPSKKVKKEPVSASNTPKDIKPTPPVPTTAISPTTSSSSPTASISTSTNAATAATTTTPATTTAARKNSINRRNSLLKIRRLSNARRKSLAANDEINELLKDLSVTSIDEINEEDS

SEQ ID NO: 19279 - protein, 809 aa, Candida albicans
KQSIVRTTTEGKLELIDLSTNTSKGVLYRSELPLRDTVFINQGNRVLCGGDENKLVIVDLQTTGEEDSNNKVSTISLPDQVVNISYNTSGELSAISLSNGNVQIYSVVNEQPNLIYTINSVIPTKIHTSMDKVDYNDEHHDELFSTKTQWSTNGQLLLVPTIDNQIHVYDRQDWTKVVKEFNNDNVKIIDFNLLAQGNLAIMSLNSFKVYNFSSEKLINEDDFEFDEDGYPLNIIWKDNNLFVGSTVGETLHLRNVVKGKTDDVLNSLFISDAEEEEEEEEREVGRKKLGVEEDEGNDTDALLRDSDIEQDINVEDRIGQRKRNRRPYKLHEEDDLVIDEDDNENLGFDDRVVSNGYSTNGHKRYKSRSPSEAIPKISKIKPYSPGSTPFEHRGASADRRYLTMNNIGYTWVVQNKDTLDDVTSGSGSGGNSITVSFFDRSLNTEYHFTDYHNFDLASMNQRGVLLGTSSTGHIYYRSHNEATNDSWDRKLPLLVSEYITSICITNNASATNTIIVGTNLGYLRFFNQFGVCINILKTLPVVTLIASATVNAKLFVINQVTTNVYSYLILDINQDYKYIQHNAPMPLKDHTPLIKGIFFNEFNDPCIVGGEDDTLLILHSWRESNNAKWIPILNCHKVLTEYGTNSNKKNWKCWPLGFIGDKLNCLILKNNSQYPGFPLPLPIELEVELPIKIKFEEDEAEENFLRSLTLGKLISDSLNDELPGEIEEDEVMERLNQYSMLFDKSLLKLFGESCKESKLGKAFSIARLIKTDKALLAASRIAERMEFLNLASKIGQLRELLVDIDGDSD

SEQ ID NO: 19280 - protein, 333 aa, Candida albicans
  UNSURE (15): Identity of amino acid sequences at the above locations are unknown.
GKVVHVHRRRRLLLXEIYFNMKLRRILLMNPKQELLFTVNINNNFSILRFLFDKIFEREQSNDLVFEELSQLIQCSLDGTNVCVFAYGQTGSGKTFTMSHPTNGMIPLSLKKIFNDIEELKEKGWSYTVRGKFIEIYNEAIIDLLNPKIDPNTKYEIKHDDIAGKTTVTNVSTIDIKSPEQAITILNQANKKRSTAATKSNDHSSRSHSIFIIDLQGYNSLTKESSCGTLNLIDLAGSERLNNSRAEGDRLKETQAINKSLSCLGDVIHSLNLKDGSHVPYRNSKLTYLLKHSLGGNSKTLMFVNISPLTKDLNETINSLRFATKVNNTRINK

SEQ ID NO: 19281 - protein, 170 aa, Candida albicans
MTTGALPSTPANEPLIKSADNVANLIESFIELGVLVHDNQGTPQSNQALMNKLNQLILQLSQTSTTANDPNDANTNLKQFLIPIDVISYIEDGRNPDIYTREFIEVNAKSNARLKGKMLGFKKLRDVFGDKLKQEFPQLEKGVDDIINRTNDNSSHTASVITDTANNNNS

SEQ ID NO: 19282 - protein, 228 aa, Candida albicans
PTIDKMENPRVWINCGIRHVEQFYCKKNSLLKGMVVRNYHTAKDYRKFNNACKVPVSKLSLHHTYIEESYFKLRTTGSNGVQDLVTSLSDLELLLVIAAVRWIEKFELQTINFNLAYTEYQEMVKNFNTGNAIVSSTSLDSRIAANIKVDRKVLSRKVSLNSWSTLYKLGILLDPKGDYVEGQSNNYSYHINKNLIIEENQMVLVDITLDELNGFIEDKHVFKRFVRL

SEQ ID NO: 19283 - protein, 320 aa, Candida albicans
IVQDLSIFKKTPSGFHNEKISGLSWNNNDNQLVSGGNEGTINIWNVNENNNNNNNNNNNNNNEKDQNGLLLSSPIVSIKQAHNDRITNTLFHPINNLIIYTSLIQTWKLWDLHKLSGQRDDLQCLVEQEGHSKPIFTGEIHPDGGLFMSGGLDGIVHIWDLRSGRSIVTLQKHMAGVYCLDWSPNGYQFVTGSGDCSLKIWDLRKLENNNSNNELYSIPAHTKLITDVKFYHQSRDIMQKQQQQQDQQQDQDHLLGSEFNDGKFLVSCSYDGDVNIWSSDNWIKIKSLRGHTDKVMSCDINSTGKWIVSSGWDRSIKLWK

SEQ ID NO: 19284 - protein, 154 aa, Candida albicans
KKHHIFITMEVDKLDHEIRVKEQEEEEEEEEEEVFYTPGPKELYDVRLEVLNYSLKQSAIRLQKLRQLKQSTTTTTPTTTLTTGIPSQDEINILKSRRQLNSNLSKYEIYGSQFIPGTTRTISNIKISNNDKYIACGSWDGSINLLNSARFINF

SEQ ID NO: 19285 - protein, 125 aa, Candida albicans
QFQPINPTPFLKSLIGKTIIVRLKWNKTQYKGTLVSIDNYMNLQLDQTYEIILESTDTDATKEELIGEIFIRCNNVLFIREYKEQQQPVDSKPIENGDKNGKIDKESVEEEEKVTNNEDIEIDKE

SEQ ID NO: 19286 - protein, 131 aa, Candida albicans
LIIVCSCGSDTTKYILFLEKKNISPSPKITANHIHNQSSMADNTEFEKTDPSKFLSGIIGSSVSVKLHNGVEYKGNLQTIDGFMNVVLDEGKETVNGKVTKKYGDVFIRGNNGMYKENYWDINSVLLTFRF

SEQ ID NO: 19287 - protein, 208 aa, Candida albicans
VKGLCLGKKGLSSHMLSHDDFTMIKIWTCDYCDVGKFAKKNELVEHYNIFHDGNIPDDLLKETEVKKLENLLDQGSKLNNLHELETEKLKVEEDEEDSLDERRSDVRSDSMSAQRSIKSFTASLEGSKSVSKLILNSGKKINCPKNNCDRMFSREYDLRRHLKWHDDNLQRIESFLNSIEKEETPEGEPLVKKARMDLLPNETSVISR

SEQ ID NO: 19288 - protein, 141 aa, Candida albicans
KQHHHLVQQMSKRVREEKEEEEQSTSSKITSDQSILCNYHPCFNQAFEDYQQYHLHVVSIHEHTCESCLKVFPDKKFLSLHIDENHNPILQIKQERGDKIFKCYTESCKAVFSNPKERKHHLIEIHNYPTDYPFNIVNDGI

SEQ ID NO: 19289 - protein, 153 aa, Candida albicans
TADLISFFQIHFLLLYSMSESDETKSISSLISSSSSSRPKKYICTYEGCDKAYNRPSLLEQHLRTHSNDRPYKCTVEDCDKAFFRKSHLETHIVSHSEKKPFHCSVCGKGVNSRQHLKRHEITHTKSFKCTFENCQETFYKTSIFKTSYIICS

SEQ ID NO: 19290 - protein, 364 aa, Candida albicans
HDFEEVRKHGQSEEKNEEEKVVLDKIEIPELAPIDQVDSESLESGSPLEKLETATKDESPLQEDELTRLLTPELQSQLMNLQYEQQSDSEESSVESETESTLETTSLVKEAEISESTDSKNHLIEDSATPQSELDSKDIEENVPENEQFENINLDRIFKNSLNDASSEREEEVREDTPKDLDEEELGGAKPTVPKNYEEVELEIVNQENVTDEEDMEPLVQEVKIDMNFDDDDQDDVEVESESESESESELYSDSSVDKIHDDIQVPKLENIEDSQVSSLSEDSGEISSKSENDEEQDVDEEDLGNQITSDYKTHNLVPVSSEDEVDSSNDSSEEEDVEQLNVEQESSSDEEQIIFTTRWKIQL

SEQ ID NO: 19291 - protein, 753 aa, Candida albicans
YYKTKAVNITFIDSIIFPVMSSIKKYLKSAKASIEANDPESTLDFANDALEEDPNCYFAYVFKGKAYQLLRDIPKAIKAFQKATEIEPNNLLAWKGYFQVLKVSDDYKLFFQVLTNLVRLLTDQGISIAETLKDMRNYLDRQKYKSNDNLYEFYLRSILPGSELGDLIGTAIEPTDVTVKKLLDFKTSQTEKTVVNRVSKERVKFGRVITTDQKAKLDNIAWSYYEDGDILELYEMFLNVCDDEELRHKYEEKLLKFKYELLKVCPDKQAMHQDIKNQMEDMILINTKSLFCWNLYFDWCDAKTINDLDENKVISYLQIFQNEGLGLILFAYVMSDISPFSKEKIVKSLSAYDINKRKPDSSQLNPEDDKDAELLEELADDATLEDETSSSQYYLPQDEVLGLILEGYSKTKNSVLASRIIVNYYIHLREYNLASEKCRDGIKTLADIQRTFGIDLTNTKEDFLCSLAIVYTYYEAPKNYNRAIQLYEKILESNPDNVKAQVGKGLIYVERGELEEARTILGAVVKKYPTNIEAESEYYWCLVKLGEYSQGRKGLEGFLSKITGGDLHSRETRAVARWRIAKSYFLENADNNDNVKECYNNLIKSLKDSDLYAPSYTLLGILFQDYYGDTERAQKCFYKAFDLDTNEIVAARYLVQQATLKNEWEVAQVLAKRVVSNESSRRLIMRGDVDTDKAWPYRVLGSGALNSQDDAKAVEWFQNALRLDANDFDCWVGLGEAYYHCGRFDGAASSPRD

SEQ ID NO: 19292 - protein, 609 aa, Candida albicans
NPSGFFGRSNQRRIWKPYLFNKTVYSPQNSTFAKRRGSHLGEVLKVFNRNQQNINQVPFNDVFDIFESLGYNETVSLVADIDLDESINLTNAQELYAQGEKAQSLFVLIIVAAVAGVKSLSLKANKLLRATAYYNLGLALLEAYQNDDQMLVYRDTSILFFKKSIQLEQSNANYWIALGNAYFTSNPQISQHCYIKATTLEVKDAEIWVNLASLFLRYGDTELSKDTFLRAQSVAPQDAQSWLGHAVAADILGEENKASGYYVHAFTLSKGRLALAQFLYGLSVVNKSQGRDPRDIETAQEFSISNQAMQQYLKYYPDDEAGLSIALSIAERCKDFELAIALGTKLSELYERQYEANESEVVLQKFATVKSQLARIHLGLGDYEQALDNAQMALQLNETSEILLSSKITMGLSYFFLNDFLSALEELKVVLGEYSDSSRIVSLIAQVLHAHGTEETKQAAVDQLFAFIEEYGSSLLVVLTLGAISLVDQLDDYLPAIKEELSTLGLNEIVCDTHREVPRLLNEINTRLDDGNNENAWLRYAFLFPFDYNIWKNINSTMAKQVISLHDVKVNGVQYSDALLKTGQLRDIQRSLLFNPGNNEAIKALHGCL

SEQ ID NO: 19293 - protein, 519 aa, Candida albicans
  UNSURE (4): Identity of amino acid sequences at the above locations are unknown.
FNIXETPFTKLVLKFHSLVSIQRAICSLKIDITHRTWGMNNHNLFLNSSGDNNNHNNDDNNYYSHTNNSDNLLALGQGDSMSTFNSASPTSSISPSSNNPGLSNNSNQAPSESVLSNFFHTTNNSNPSLKKLTNRHTTSKKPKRKRATNIRACDTCAAKKVKCDANRPCGQCRTNNLECTHTRERKKTGPKTPTQKALESINNLTEVIEINANGKRKNLSRTGSNNSAVTQCSSNELTHDRTETENSNQPLSSRNSASPPISTGSSIKQCDTLKQIVGDNGNGDGNGTTDNNSVHQQNLEQLQGKLSLNDTSTSKTKEFATSPMAVPSATTIEDYIVTPFHLMENINLIGEEPSILELVRPLTVDSVILNYVRLVEFLVSNYPDSRDGNYQNNPRYQELNLIDHHDNSLYLSTLLIILTLNQIIAEVLIKLKKQKFKKFVRYPKKYLLSRPFKNFKNLCHFKVLEIFTLIEKNFIVPPVIPQNRAHRSSFTSSSTEVHTSSSIASTNNHHHNNNNNNNN

SEQ ID NO: 19294 - protein, 789 aa, Candida albicans
GRLGDSGPVSRMWLEQTLIFSTIYLQSSLHILRLALFNLLECSRFPFFISYLEICLKEFCMIMKLDNANKLFKIFKFEILRNWWKYDSIDAFPFVLFLYTDLSSFYRDNYRELIAVALSTKSRSPEISNAFVEQLADLKQSHSETLVAESLSIIVPLSYSKDGVRNDVFQILLDYLKNSFKQEFIDKLPLIVLEIIKFTEISNEKSFESLGTDGLVTMLLNDTGFSSTIQTAGEMVISFDSSVQLLKKLVEKYHQPEHETFWSSRQIYFLIRRLSISLKLATTFEQKVIFLRKFKFVLVLGGKKSIDYAVSRLLVDTLCPLLLNEPKMSADVFLILQSLTDVYLHRYTYDKSILLIIQIINSLLETEAVDRSRALLDCIDDFVNTGDQDRAICQLLKSSVAILKGQAVEIESSLIELCLEESGPDYIKQMILISRIFGNVVFATTHSGSKLPVVEKLLALSKNQIQEFSDGYKLWIANYLSDFYIEGGCKEQIKALTFDEYEGIPVNDFENEVRSFDFTLKSIEQYIYKDDFEAAACAESIIGVLIRKYETSKREVSKFLNFETTLEKHSDSILPIDFHTCVILNDKADVEYLGDELIDIINNFESFLLNGTELWCTKLYLALLQELAVETSIAPLLSTFVIMVPEFAKTSLPVLVCNYLAIKRTHSQDRIISLLNEFLHTSKKSESSIKVFLQILILIRVGAKIFKKPVFGNVFAKIDKLKFHQLACEVKQFKTGLMWFEDVASDTNSDVHLQEHYQTLANVYESLDDDKLVLEWRERTTWEYSISMD

SEQ ID NO: 19295 - protein, 799 aa, Candida albicans
GSPPLVKTNIVGSLSAAGLLGVSRALSKNTSFASNDDSQYEWSWKLSKWDLPISKNATKENEVIYKTLKQIHDFPMNLQDICLSSLLNAVDNKVSATNMSVKEFKQEGINWLKTISTVASIAEIANATGDNIIPMTNQFSEKTQWFGEVEFSMFENLLLARQTTFGLINDRPISSLPSDTAWMGALCDLVRYNNLARTNGEYQKMVTSTMLVDVVSKKLQSSSLDMVAFNANNLASFQTAQTLWCQGNTNVPVMIMKDLYAAGGIDMSENILKVDKCLIRAMMVDWMSQSRQEVASSIMEKYVMPTEELSNHMIDLQQQSKIFSILARFCEEQYKFKSLSEKISKLEKRVLNKENEIKDLKKQYEKVTVTHAEQKQVQQYYNRLKKQFVSESKDLESLRKSKQLFSSKAVQYYMKSIIVDDFEEENLDKFFSLWLEQSGNNELNQSLQSDLLALPSYKLVSWCTQLISRLSNETNNFQILLKKLIINMCLDHPHHSLYLLLSLKKHKPNTNEVLNPLLLSRCAAAQAIWDQLLLQDHRYVLGVLLPIDGFTDQCITLAAYKVSKGKSIDLTKFSAGDYWLNELPAIPPPTETIRVDPSKQYKNVPVLHSIDKKILIATSGLSLPKIANFILSNGTEHRVLLKHGTDGIRQDSIMEQVFNKVNNIFAKDRECNKRGLTIRTYNAVPLGPLSGIIEFVPNSMAFIDVISGYHQMHDKISYDKAREMMKLCQSGDKQKRIHSFEQIEAKIKPVMRYFFQETFLTYDSWFESRVKYTHGIATSSIVGHILGLGDRHCNNILID

SEQ ID NO: 19296 - protein, 184 aa, Candida albicans
KTLYTIIIFLVNIRTTIVFVDVYVIMSTSDINKTIALLQSSKIKERNDALNNLENIAASKFRLNPKQFRQLTQAILALIKHESQIYFNNKSTTVDSRLSQASYNLRLLTEKSIEDTRIDFKYRTYLDLCMGIKDQFFVHSELLEPCSIDFIKTITSIWNLSYVKEHLIRKEWSILYFFLGFINQ

SEQ ID NO: 19297 - protein, 948 aa, Candida albicans
GSFSNNGNNEKLLIDLYTALQNLLQCESSVSINYLQLYDNDNYFKLLRILDKTSELLKKENVIIIIIFRIINKLITVIATEKFKFVNKLIKIGIRLMVYFHHSHWEKLQEQFLIFINLPGTHDLINLHNLPKLIGDRYILSEISTQEDGDSINSQADNQDEVFLYNLGVLIHHLMKKLMSGSFELKTEDIGMCTINNSITWFNLKTIYSDSQNYKPWLLTLGVSRLLKSYYDLKQFINKQSNDPQTSLLLYSNGSPNKNKRQKLGSIADTISDSNSAIELCNKLIHSKESSDNQVLGLKLLTFYLELYTFEKPKEQSTESDSMDTTIGENTTFDFVISTTDNTFIDKNVVMKNILITFDDNSMNFWSSLCARSVLLDEILQLNHGGYKFKKSFSIQLLKLSLLLLKEPEVANIACNIIFKLVFEQKTNLSELIDDSVIIQLETLIDLSEINGPYKITEESFQFWYAINKLAIEVNLSKKNFLGRRIQDWMLAKWDITFSPGADFVSVGSSLANFMYWLLGNSISYSPATTQKSTYEGDIYEFYYFAQSYDSLEKFLCLKSVSDSSETIKFDIISIASSDRIDAILNKVNLTFMVFDRSLVTSGSLFCWIIVLLNIVAKVRSMKFVTHELTGLQFQLSAGLNSFKDITLSCEEIIDVMEMVNKFLPTDPDTIQIFIQNFPLEKLVNIIKFDYPGLADKDNRKSVPEDGFGWEFSRVRDATTPPSTTSTSTISLAKLNYKKIQSLEVSKFIMFTADIEGKLQSDILTAFLNYVETLESDDFLPSLLFVVENIFTDHLAHFIDEIQLAKLLRIINEKLLSTQNYERNEFVLVVISRFLSATAQVWINSSDNSLASDFYSLVLRLYLSGRDDLILTETSIVEYCRFLAHFITHNDERVLSNTDIKNELLEKFSKSPNNIKDRLANSFGELVSLSPVLHHGTGRIRAKIYAGQ

SEQ ID NO: 19298 - protein, 447 aa, Candida albicans
SSLDNNKISYDPMWNTTDTIDLTNDGSEKINEVDNIHEDTPVEESAIDEKTQQNYRVWKKNAPLLYDYLVTNSLLWPSLSVQFFPDITHINDLGENKNEEQIIAQRILLGTFTLGQAIDHISILQIPSFKNLNQNIKINKLDFNPEREEFELTTPSLNKTKTLQKINHLGDVNKVRYMPQKPNILASANNLGNLVIYERTRHKSFKNTILDDTDLSKVQVRLVNKHIPSTTDIFAIDWNRNSEGLLLSADMNGLVNLYDLKKYESETLNESQYWENNAIGVNDIEWFPTHDSLFCTADDNGWLKLYDTRNQSAAVQNANIGNSVNSVACNPGYATGLATGDSNGVIKMWDIRNFDNSLSELHGHSDSVTQLKWNPKCHNILGSSSSDHLVKLHDMSNDSTIFTHLGHMLGVNDFDWSYADPWMVASVADDNSLHVWKPTHSVTDKFK

SEQ ID NO: 19299 - protein, 174 aa, Candida albicans
NLKFTIPNQSISKNIMGSKKESKSKSSSDDVSTEDNYEKRMSAILPFAKPLASKKLNKKILKTVKKASKAKHVKRGVKEVVKSLRKGEKGLVIIAGDISPADVISHIPVLCEDNSVAYIFIPSKEDLGSAGATKRPTSCVMIVPGGGKSKKNADKTDEYRDGFDDIVKEINASE

SEQ ID NO: 19300 - protein, 294 aa, Candida albicans
ICWRFLYTNNLFKEVRFKQKCKELRKRVLEIEENNEIATIALSRTQATIRRLRLEYAILLERLEDRATQLPDGIVAFEEMACPPTPTILDDSLVKSKTGNKKSKSSSSSSSSSSTTSSSAMKIALASGSSKSSNGPSDVASTTMGKQKARDPDLPKRPTNAYLIFCEMEKERIKQDDPNASDLSKSMTEAWKNLSEERRRPYYKLYEDDRIRYQREMAEYNQKKGGGGTGGGGGEPDLKKQKLAPQPEQEEDDEANETRNSPIVKQTTETASSNENKQTTNVIKSEENGAIAAE

SEQ ID NO: 19301 - protein, 400 aa, Candida albicans
PPASYFSSPSGVTLNLFHARFRSLKPISVGHKTKMKGDKKKNFSLVFLLLLSISCCSRSLFFSRSTFFDYSLLSSLSSPVVLLSSFFLAPPKSLSNKFFFLFFKTLIIRSVHQPPPDFLTRFYFSNKLFCCHHFFLPPTSTTITTTNPLVPEHTQYTLSPLTRHTYNSQKKKTNNTPMSDLKTTKDTLVSTLFELSKAAQDAANAAIEFYKVASGGSDHVSAEQLKAVSEALNTVATLSSGNGAKIEATESKKKRKQEKDPNAPKKPLTMFFQFSYDLRKKIGIERKKKDLPSLSAIDMNSMIKDRWDSISEAEKAGYKKRYDDAMIIYNIEKKKYEESLKDGSAYYPPPSVQTPIVGHGIEQDFDDDATDIVSSPEEPKKKKKKTEKKEKKKKSGHGSP

SEQ ID NO: 19302 - protein, 133 aa, Candida albicans
SELNYLQMSAPNPKAFPLADSALTQQILDVVQQSQNLRQLKKGANEATKTLNRGISEFIIMAADTEPIEILLHLPLLCEDKNVPYVFVPSKAALGRACGVSRPVIAASVTSNDASSIKNQIYGIKDKIETLLI

SEQ ID NO: 19303 - protein, 205 aa, Candida albicans
FFFYIGKNFFEFLKLFTCTKGQNIISLNTTNFFLTGLIFFFFFYVWHVRVFLDKIIKTRMSNLQDLINHDDDEYLPSPSPPQQPEPQHASSLELKTSTTEDLPDSVTQEHILTSFEKIKTHFPAARIKKIMQSDEEIGKVAQATPVIVGRALEIFMANLVEVSLLEAKKQGVKRITASHVKSAIENTEQFDFLVEAVEKYPSLRN

SEQ ID NO: 19304 - protein, 577 aa, Candida albicans
  UNSURE (238): Identity of amino acid sequences at the above locations are unknown.
IKISTQLHIINKRTQTMSAEPEIPKVEVPKLEESVTEDTPAPTTDDQNNQTPQVIDVEKLQHEFQESAKRYLVEQTAQVIVPSFAKWFDLSKIHDIEKKSLPDFFVEDGSGYKSSQDYKYIRDFIVNTFRLNPKEYLTITAVRRNLSGDVTNIIRIHQFLEQWGLINYQIDPKTKSSVLGPQYTGHFQITLDAPQGLVPFVPENAELTKATPSNVTKTDDLNNENIPTAKENELPLNXEIRRNVYATGEKKTNYKTNNIVHYSCSICGKDTTEVRYHNLKIKSYMYNPTSTINNASVLCEICYDQGLFPLSFHSSDFIQLKRTEEGEKWSEQEILLLLEGIEMFGTYEPPSSTGPVNVNANLNNQWDKISEHVATKTREQCIIKFIQLPIEDKFLTKLIKEENEKDTTKSVVSQSLVQDIAAKLVSTTEGREFILQNAEENLKHAQLEQTNLVNQVIELTLEKFNLKLKKIDELQANLLKYENQLNLERKQILLERWVQFEKISKLKESNPELSTVLDDLLKPVKINEIHKSVKQSNQTENGDDKMDVDESSNENDDNTSKLPVSVKEPKAYQFWSG

SEQ ID NO: 19305 - protein, 454 aa, Candida albicans
MTILISETDTFTTDTKTRENTPIYDPNHPGTNNKYNVSYHYNPEVSRFHYGALHPMKPFRLMLTDHLVISYKLYEKMDLYTPRRATKDELLEFHSEDYIDFLQSITPEKCKTISNDTLAQFNIGDECPIFDGMYDYSAIYAGASLDATRKLISGMSDIAINWSGGLHHAKKFEPSGFCYVNDIVLSIINLLRVHPRVMYIDIDLHHGDGVQEAFYNTDRVMTVSFHKYNGEFFPGTGSVDEVGIGSGKNYAINVPLRDGIDDESYIRLFKLIMEPLITKFQPTCIVQQCGADSLGYDRLGCFNLNIRAHGECVKFIKSFGIPMLVVGGGGYTPRNVSRLWCYETSVLNDVNLDHKIPNYLPTYDWFGPDYSLHPQLDGRIDNKNSKKYLQSVQTTIMEQIRYLNHAPSVQMYEIPPDLTGLTEDEDKAIQELNEDMERDEKIMKDETKLGELMT

SEQ ID NO: 19306 - protein, 388 aa, Candida albicans
LLFKGEKDSSGLYRSCLGSLYSLVCIIVNRLMNSVCLLYTIYPQKENVCSVCKQKKNAPQKKPCPPPCKYCQTLPMATKRKVYITLSESATKIVDLLPSNKGRQSLVLGLIEAYKLIDLCDGTIDIYPAQTKDLTTYHDDEFVKHLMGPRTFLDKNFNKIDKAETDLTNVVIEENDLDEKYGLTFDCYPFPSLDLYVQLTAASSINAARKIVQQVKETNDQIIAVNWYGGRHHCHKSHAAGFCYVNDVVLSINILRKNLGSVFYLDLDLHHGDGVENAFKFSKKVATCSIHRYDIGFYPGTGSLKSSRENTYNIPTEKGLNDSSMLWIIKEIVAPLILNFGPRAIVIQCGCDGLALDTHKEWNMTIKGYRDSIDWILSHFSEICSKTA

SEQ ID NO: 19307 - protein, 93 aa, Candida albicans
LPSDKKREPLSGILCIHLESLLLLCTTREAREYLREKQVYAIIKELHKAIEVEQVADLCDRVVQMLKRDEAPQSADIEEIESDSDDDKIVEIV

SEQ ID NO: 19308 - protein, 180 aa, Candida albicans
IFVPSQHLELQKRRTKIQEKNFYNSFSYLIPTVLTMPTELEELVSFLHSPQPAVSQIALDNLVGYSTGPHQKVFSYNNYEAIKDLKNISKSNGKTLVNQSVTILANLCDDLVMRKLIVEDEEYLKYLAIQIINIKNTNADLMCILLTNLAKNDAINKVLDFEVELDDEHKKVFFTTGWKV

SEQ ID NO: 19309 - protein, 96 aa, Candida albicans
  UNSURE (6): Identity of amino acid sequences at the above locations are unknown.
VRLFPXAWCPSSAFENLGEVQLINFLKVLTTVYNDLFKFKSVLRDFLVQLKEFGGDPTDYLFAEDKQIEREEQDRLQRERDMQVGGLIRPSEMDDE

SEQ ID NO: 19310 - protein, 571 aa, Candida albicans
LPVHNEKILIYFKNTLEQIYCIVPLITNLKQTYKVASYSDQSFLQDLAMFLCTFLTNNLELLEKHKEAGELLQNSLLYLLELSRIEERELFKTCLDLWSTFVYGLFKEIRDLPSNELTPMMQLAYGNSLRPTSSGGAPDPALLQKFPLRQHQYAEILSKLRLVIIENMARPEEVLIVENDEGEIVREFVKESDTIQLYKSMREVLVYLTHLNVIDTEQIMIEKLARQIDESEWSWQNINTLCWAIGSISGAMNEDMEKRFLVSVIKDLLSLTEMKRGKDNKAVVASNIMYIVGQYPRFLKAHWKFLKTVVNKLFEFMHETHEGVQDMACDTFIKITHKCKKHFVAVQANETEPFINEIIREIQQITEDLQPQQVHTFYEACGIIVSAEYNKTARDKLLSELMALPNMAWTAIIQQAGQDPELLSNTETVKIIANIIKTNVAVCKALGPGFYSQLGGLYVDMLSLYKAVSQMISDAVAKDGIIATKTPKVRGLRTIKKEILKMIETYINQADNLQEIVRDLVQPLFGAVLEDYSSNVPDARDAEVLRCLTALVSKAGHLIPDGVVLILQKCV

SEQ ID NO: 19311 - protein, 126 aa, Candida albicans
VTMDAILDFSTDLDIKLLDQTVDTFFKGSGNDQNNAQLVLNKFQEHPDSWKFADKILSNSNNAQSKYIALSSLNKLIQYRWKTIPDNERIGIRNFIVNMIISLCDNVQEFATQLVISHAAGKSTWR

SEQ ID NO: 19312 - protein, 491 aa, Candida albicans
NQPTELMNIVLLIYCLAMVIAHDLQLFGDFKFELSENWRNDCAKKALEPIINQCAEGIEKITPIQQKLIAIQLSICEFENAEISYPSECRSQNLDTCILLLEKSPQYWTTFSGYYREIRNICHQISLPFAKDQILQVYENITKFYRTLMEEMTNSSKYTENMQNELKAKFDKLIGVIDLILADREKNREDLKSSFNMFKNNFEKSLNNALVVIKYSYEDANSNINELESHLNYFINDMLQVYILINEKASEMISEQDKIILHNADILDQIDKIKNIIDSVREETLEAHISNNQLTQDLQSSLDYSLFMVSKLDSHLQLSIDNLVEQNEDLRNQNSMVFEEIFELFLKHLNESGQIALGSFEAALDLSLNMLHQKLNQTEKSIDNLNTKVSELFQFGESLKKYASSFVNIPGTVKNLFNDRIKQIKAFGNAAFMGLVFIFVTIILLLSSLLKSQFTKILRFTFIGIPMITGIALALIILRIMSTPTKVVDID

SEQ ID NO: 19313 - protein, 1173 aa, Candida albicans
  UNSURE (210): Identity of amino acid sequences at the above locations are unknown.
SSGTGMSAYVEIIFDNTDGRFPINKPEISIRRTIGLKKDDYSLDGKSATRSDIMNLLESAGFSRSNPYYIVPQGRITSLTNSKNHERLNLLKEVSGANVFENKLKESMKEMNQSNLKRARIDETLVSIEERLKDLQIESADLKDFQKLDKLKKILEFNIFDREYNELNESLEELEEKHQSILQESKQDLIELEKTQKLCVELQDSINELXISAKVLKLEKEQSDLDCDQLLKVIAEKEIKLRELSLNNELSKEQNIHINEQIGILQLEINQHKQEISRYKPELNKLQQQESSLKQQLLEISSKQRALYAKQSRFLKFVNKKDRDSWLNTEISKLKRQITDKDQEMRHISNEVKTRESSLEELSESIKKLNDSLNDEEHIKTLANLKTTINDSKQQITQLVDQRKILWRDEIRLKSVHDSLTNDLTNATNIVNQTMDRAQAQGIAAVKQIAQRLNLSDRVYGTVAELFNVNDKYKTAAEVIAGNSLFHIVVDTDVTAATIMEELIRNKAGRVTFVPLNRIDNIEVEYPDSHENQCLPLIKKLKYNEQVYKAINQIFGKTLVVSELLKGGELSRKYKLSCITLDGDRVDTRGVLSGGYRDYKNSRIDALKIQTRKKQELEKTDRELVKVTEEIESTNSQLNKLNNELQLNVRDLDRLSVSKEPIKIELSQLTNKKFNLDQEISSLKSNLQNLQNTKNSIKVNLKQHELELNSEFTQVLTQDEQNELDELSKLAIELESKLDHIVTRSSELDTKISGIESEVINNLQPKLNKYRQEQQKQHQQQLQLQQESSKSSDTKSNLEYEELQQELENLHIQLDTSQLRNSQVVENLTKINEEINNCEQELAQANKQQIKIIKNIEKFLKQTNNLLNQKLIKSQMRDDANQKIRELGVLPEEAFQSEKYDQYSSDQLLSKLNGINQELTKYSHINKKAIEQFNLFNRQKEDLMARRIDLNNSKASIENLITNLQQQKNDAIKKSFNQVAKSFKQIFEKLVPRGTGNLIMQKKNDNNNNVNATDDFNSDNDDDDDDDDIDNYSGVAISVSFNSKNDEQQRIEQLSGGQKSLCAIALIFAIQNCDPAPFYLFDEIDSNLDTQYRISVARLIHELSRNNEDNNNNEGRSRGAQFICTTFRPELLQLSGDKFYGVTFSNKVSSVNEINKEEAMSFVEGQQQQQQQL

SEQ ID NO: 19314 - protein, 201 aa, Candida albicans
SRTQPILTMTEQPINTKKKNGDISKAPTPQNTPASVTNSYMRSKPPTVSTIQESNNEDGTGAAAAAGGLANNPVLLSMIQGKLGDLVGKQSGYIDNLSKPVKNRVYGLKSLQLNQMKLEAQFQKELLELEKKFFAKYQPLYVKRKQIINGELEPTVEEIEEGQQLEEEEKGIDKEDGEEEEEVVEDDEEEDELFHQTAGRS

SEQ ID NO: 19315 - protein, 359 aa, Candida albicans
ISLQISSMATSQELTADIQALATSFPKRLANDSDNSLLINVAPTGRQAKRHIQQINYSEEFGDDLDFDEFPSSTPGTRSLNENKAQIEAQRYSLAKNTPTPKRILEKPVLSELVEKPVVLIPIKIMIENLNTNQKLIDSFMWNLNESLITPTEFAEIVCSDLDLPFSMAAQIADSINQQIEEYSYASNLQLPNKGPYNVTIDLSVNLNKQLYQDRFEWDMNQNEVTPEIFAEIVVDDLGLSLEFKNAISHALHEIIIRVKKEVIDGTFDNEMHNLHLVKGIMFEQGIRIFTENSVQNGNDRWEPLVEVLTSSEIERRENERVRNLRRLKRENMRRDYDDHSRRRQAGKRRYDELEGAWV

SEQ ID NO: 19316 - protein, 481 aa, Candida albicans
NKSSNRSFIHISLKLEQHKLLMEATILTVHWHNDNQPIYSVDFQPEQSGLVNSSPTKSAESTRLATGGGDNNIRIWKITSSNSVEYMSTLQKHSQAVNAVRFNPRGDILASAGDDGTLLLWKKSENIIKTLESEEDEDLKESWQVVGTIRSSTAEIMDICWSPNGEQIVTGSMDNILRVYQLEFSPGKITGTFIRSFSDHTHYIQGVFWDPLNKFIVSQSADRSVNVYQILPSESNSIEINFRHKFQKFGNLYLYYPETLQSFFRRLAFSPDGSILVTPAGLEETSSNETLNNVLYIYSRASLFTSPIYKITGLSKPAIAVSFNPVKYKLDGPSTLKLPYKLVFAVATQDGVVLYSTQDNFKPLGLVSNLHYSSITDLKWTVDGSRVIISSTDGFCSTINFPGSAFGERYIGVPHDNDILSGEILQAKTELKAEPVPSSEIPNEKLPNLKSDNSKTSIPTIDLFFDKNQKVKKRITPTLIL

SEQ ID NO: 19317 - protein, 96 aa, Candida albicans
VKRTIRITTEQHVLTDVPLVDNFPMRKWSVQISMLDSQGKEHPAKILDKVTYTLHPTFANPIRTLKQQPFRVEEQGWGEFDIPIAVHILGILRESW

SEQ ID NO: 19318 - protein, 198 aa, Candida albicans
LLLSPYIKPSEDAQNISNENALPSSKDITLCIEDLHDTLEMYPHLVESEGPKLRLSNVMLENDDMINDDLNYYLPPKSIEYLAKERQAATTNDASTGTTKPGNNKGSSAGGSSAGATTNSPVVNKTDSTAAVSEKTDTNQPLQTPTATQTPVQTSAQAPASAPAQTPAPVSTPILRPDAHIGTTDELKWVLHDLVSTM

SEQ ID NO: 19319 - protein, 148 aa, Candida albicans
LKIVVLLSSRQALKKYVQSNNDIKTANFDSLFNTALRKGVETGDFLQPKGPSGPVKLAKKEKPASSAAAGKVAKKATTKKATAAAPKKAATKKAAAPKKVTKPAKKATKAKAEASTKETKAAPKKKAAAAAPKKKAAAPKKVTKKSTK

SEQ ID NO: 19320 - protein, 167 aa, Candida albicans
SFKAIKKKFITLTVINKWNNEENSQDFQSFATVKLVDIAGSIDPFHNYWATQNEPQVQEVSTTQDSMKPVANILINKTTPTVGTSSSPNILIAQKKTIKDSLVLANLIKFVENNNDFTIGTLVELSKKEFKDFTKALIKNTIQEIAVYDKKSSKWEIKAEMKEKYCS

SEQ ID NO: 19321 - protein, 422 aa, Candida albicans
KNCLSPFVFFFFTNQITLSKSYFIENHSNMASQLEIIDLTNETTDLSELSTTQTEPIRTKRVASLTVEVNNEEDLSPTKKYKTDSKSNSAEVNQNKSTEEKSLSKKELEKAEKEKQKQEEKLRKEQEKLEKKRKQEEERELKRKRLEEEKELKKQKQEEERRAKELKKEEERLQKEKEKQEKERLRLEKKQKLEEQRLAKEAEKKRLEEEKRKIEEAKERSQMKISSFFQIGQKRKEKKVSLDSSETDATKATPKSFYETEFLPFFVQKNVSLMSIDNQDILGFKSILDDFINGKLQKELSFKSYLSKFTKSSPSTTNDITPEEIINALNSPTTTENQVYQLIQDLPPIKYISFYENSKPPYIGTYCSLAHQKCHDAIIQNPLDNEITGLDYGYDSDLEWNKEDEEGEAIALHHGTAGARYG

SEQ ID NO: 19322 - protein, 233 aa, Candida albicans
FKYNNNNYYNNPQPTATITPIMSAEDTKPKTEESTSIPKPPTSNVFSMFGAKKEKKPEQEDSDNKKESDKKEEKDTSKSTGDDNEVAEEEEADVEFTPVVQLDKKVDVKTNEEDEEVLYKVRAKLFRFHGDSKEWKERGTGDVKFLKHKTTGKVRILMRRDKTLKICANHLISADYELKPNIGSDRSWVYTVTADVSEGEPEAQTLAIRFGNKENADLFKEHFDNAKKEAKKD

SEQ ID NO: 19323 - protein, 85 aa, Candida albicans
YGSNNELIVNQTPKIVEVFAGAFKADAERIKLINESTLGREENIDSLNQFSSDDLKNRVVELLKYLDQKFSGVVSSNEILKSLVA

SEQ ID NO: 19324 - protein, 209 aa, Candida albicans
KLLWYERRCYEPAYSKLPKTNVLLLFQGENFKAPKGVPKQSYVEANILQLIQNLRKVSISLLEEEFESTMVASILDGVATALFTFGPIFVVDEPSNTELLEKLCTTLMLLLKQEHQCQIDDDEMPNEEEDSSETEVMLNEATLEVLINLSLALQSDFVQIFGSFKDIILAKFNSKSKPLRVGSIGAIAEMVEGMKEANPYSEELLQIFE

SEQ ID NO: 19325 - protein, 750 aa, Candida albicans
SHMDAQFVSSLEETLKQTLVPDSSVIKQASSKLTKDFYPNLIALPALLQISQTTKQDEIKQLSLVEARKLALDQWETVDASLKPTLRESLLKGTFEEQNKRLRNLSAYVIAAIGEVDLDKNEWQDLLPTLFSAVQNTDVHTREVGTFVLFALLESQIATVIPHISDLLSLFGTLLNDSESKEVRINSIMSLDVISQIIEEDEERTVELAGKFQSTVPSMINIFKDVISGDDVELAKSVFNVFNSLILVDSKLVGDHLITMIQIIAEMVTNQQLDEEFKIFGLQFLISCVSYRKSKISGNKLGPQITLVALKVASGEIDIEDELGNEDEENENEENSPPSLALRLLAVLSAELPPSQVVNPLFDALPQVLTSTNQFERRAGLLAIGVSSAGAPDFISLQIQKIIPSIVNGLKDTELIVKVAALRTLGQLTSELQDIVTEYHEQLLPLIIEIIDSASSVVAYRYACVALDGLIEFMSHNAMGKYIEPLTHKLFHMLQQANSATLKSAIVSAIGSTAFASGKAYTPYFEASVQQLEPFIANSASVEGLTEDDIELRAVTFENISTMARAVGSESFSAYAKPLVEAAYNSLSSEHSRIRESGFAFIANMAKVYGTEFAGFLDQIVPKILECLKQEEFSFNLGDPEGDEPEFDEDDEDADPLKIHTGITIEKEMASVALGELAVGTGNQFFPYVESTIAVLQDQIENSYGMREGAMSLLIQNYPKPMFCCCSKVKTLKLQKVFQNNLMLKPIFCN

SEQ ID NO: 19326 - protein, 205 aa, Candida albicans
NTFNFFTYYKRLDSFSSIYPSQNMMSTNFQWPGTNKNDNTEVSVETPSSTDPHVPRYPFTAMSHATASTTMKKRKRDDFDGDKSTTITMNTTTTRKYIQSSLGSSKFKKAKTPKISGQPLPLPRLIESLDKSNLQKLVQDLITVHPELQCTLIKISPRPSIQDSIQLLQDKFDMIISHLPYKCDVESDYSYLSIKLLLARMVLIF

SEQ ID NO: 19327 - protein, 354 aa, Candida albicans
RKNITWLPLFTITPASNHCIFTTEIMASVEVELGVTPETTYSISGKQLKFDSESDIAPYIKELTEKENVKKVDFSGDTIGIEASKALSEALLRHKDTIVEINFSDLYTGRLNTEIPQSLEYLLPALLKLPNLKLINLSDNAFGLQTIDPIEAYLAKAVSIEHLILSNNGMGPFAGSRIGGSLFKLAKAKKAEGKESLKTFICGRNRLENGSVNYLSVGLRNHKDLEVVRLYQNGIRPAGISKLVEQGLSNNKKLKVLDLQDNTITTRGAIHIAESLSNWPLLVELNLNDSLLKNKGSLKLVEAFHAGDEKPQLITLKLQYNELETDSLRVLADAIASKLPQLNLHHGAGRTRAS

SEQ ID NO: 19328 - protein, 739 aa, Candida albicans
  UNSURE (48): Identity of amino acid sequences at the above locations are unknown.
KNPNLTDSEFNQRTQELISDNVEQFMMILKNLTESNTNNNASMNSSIXDCLNSWIKECAVEQVLQINSLVSLVFQSLSNDQTFEKAIECLVTIIRETRDIDNYEIIDALYQQVLQLNKYMHENTPDKLEDPEYVDGLTRLYVECGESWHVLIGKNPAHFKPLVLIILECTKYDEDLDIVKYTFQFWYQLKQLITLPKFQESKAVFGDIYLQLITVIIKHLTYPISGNDNDLFNGDKEQEDKFKEFRYEMGDVLKDCCAVAGATKALQVPFEQIQNIISNSQGHWQYLEAPLFSMRTMAKEVPLKENTILPTIMSYLVQLPEHPKIRYAATLVLGRYTEWTSKHPEFLEPQLNYITKGFEVADKNNDIIMATSHALMYFCQDCSEFLVNYLEQLYMLYGQVKDQMDLESNYELADGLAHVIAKVPIDSLYKTTEMFIEPTMNYLSKVLAENPTDESNKLIADQIEVISIFIEVLKCPDSDWEKPKYPVAGLFVDKIWPLTTQILSKFGSSVIVSERCMKLLKNAIKSFGLFLSSILPDLANLLHQGLQSTQFGCYIWVTGVLIREFGDEYSPEAIKNAVYEFGLQQSLTVFDLLFSKSEEQLKQIPDVIEDFFHMINDLLMFYPFQLIPKFDILKNVFKVVDLTLSYVNEFEPIISCIHFMIDLISWGLPNPPISLFDMGDTSPLREAVQQSLLIDNQRGELSRVTLNGILFKFHNDIQQDANDLMLKISIVVPNNDIAL

SEQ ID NO: 19329 - protein, 187 aa, Candida albicans
SLQSRADPGYSRRVKTVSFDIDANGILNVSALEKGTGKTQKITITNDKGRLSKEEIDKMVSEAEKFKEEDEKEAARVQAKNQLESYAYPLKNTINDGEMKDKIGADDKEKLTKAIDETISWLDASQAASTEEYEDKRKELESVANPIISGAYGAAGGAPGGAGGFPRAGGFPGGAPRCRWSRWCYWW

SEQ ID NO: 19330 - protein, 366 aa, Candida albicans
  UNSURE (94): Identity of amino acid sequences at the above locations are unknown.
FYMIVCKHLLKKMGYENLSLKPEYPQTLLPPLLSKWEQLDDDDTDLWPLLECMASIAASLREIFAPYAVPVYERATKILSNCILLDQECHTDPXIDPPEKDFMVTSLDLIDGLVQGFEYHSVDLINQNHKSNLIELMLICFEDYNGDVRQSAYALLGDLAIFTIELLKPYLRQIFISIGNEINNRTYETYPVYNNAIWALGEMIIRLPIEETKPYIDNLVDLLIPVLNSNDIQSTVAENAAICLGRMGINAAELVNGKLNQFIEAWCSRFLYLIDNNEKETGFQGIINMINLNPDNGFGGLSTQHGKKNLAAFLACIGNYQEIPSNELQHLFIDLINNYKSLLGNENWNQILQFIDPEIRNRLNSI

SEQ ID NO: 19331 - protein, 555 aa, Candida albicans
VFEINMSWTPDPQALEQLKHIFKGTLSSNNEERRLANEALIQAKQQPEIENYLFTLLIDDGNGSSNGSSNGSTTATTGTTTTTRSDVRAAAGINLKNNILKNKSIDRTYLINNIMKGLMSPDSLVRNITGNVITSMFSIYGLDNWSSALTDLLNLIQQPPIGDNNNNSYIPQEAAMSALSKICEDSYLELDREFQNNRPLNYLIGEFLKLIEQHPSGKIKAGAIHCINQFIPLNTQSFLIVLDDYLNKIFNLAGHDGQQNNEVRKNICTSFLLNVETRPDKLLPHLDGVINYCLHLMQQDTSTEVSLEACEFMLALATNKELNVFTPEKLKIILPILLDKMVYSEEEIFLIEIADSKDDANVVDKDEDIKPTNAKSKETRNGNSRNSGSGDDNGNDDDDDDDDDDDDDDGELEQWSLRKCAAATLDVLSESLAQEVLLVTLPILQEKIVSPNWPIREAAILAFGAMSNSFMKLSGNELPSLVPFLVDRLQDNEPRVRQITCGTLSRYSTWVSEEAHEGGQYANYFQPTFQSIVACCLDSKKIVPRSCIFSIIINY

SEQ ID NO: 19332 - protein, 247 aa, Candida albicans
SSMCRHGPKGMCEYCSPLPPWDENYRKDHAIRHISFHAYLKQQLEKLKSSGGSYFPPLDPVDYSIDLTCNQGHKPYPNGICSKCQPSPITLQLQKFRMVDHLEFADSFILNDFINVWRVSGVQRFGYLYGRYAKSEKTPLGIKAIVETIIEPPQHDELDGITLLDWDQQEEKMVDQVANKFGLYKVGIIFTDLTDAGTKNGKVLCKRHKDSYFLTNLEIIMAAKFQLKYPNISNYRSLTTKQPDRLF

SEQ ID NO: 19333 - protein, 128 aa, Candida albicans
QRLAFIVDFNAVATEFCNFYYNQFDSDRSQLGNLYRNESMLTFETSQLQGARDIVEKLASLPFQKVAHRISTLDAQPASANGDILVMVTGELLIDEEQNAQRYSQVFHLIPDNGSYYVFNDIFRLNYS

SEQ ID NO: 19334 - protein, 376 aa, Candida albicans
STGLFSLFFFFSLVQLIHLETELKSSIIKKYSIQMPDESPSKRKIDSDELTSVQLKRTKSIAHDDLRQSIVKEITKTFEERILKLEARILKLEEEFPNEEEEKSEEEKEEEKETKKENAASIDNQQPDRRILNKEPPPLPKRQATFGSNSFSFSPGKITPLNSFNDTNTVPNSPKPVFGATTSFGNMNKLSASSTPEPAKSTITTTSSSSTTLSKPTTSTPATFGSAFGSNTRFSNAFQDSIKKKSFLDKEDDKQSTVDNNNNDKDKENDNNTNNVSKPQEFKQVDLVPVEQTTGEEDEISHFNCTAKIFELNLSKISEGWKERGVGPLHLDQSKADKRQIRLVMRSQGLLRVVLNYKITADTVFTTGGRSACLSN

SEQ ID NO: 19335 - protein, 80 aa, Candida albicans
VTLDPQMSSSESVARSAAGLLGDIAAMYPNGEFKQVFTEEWVTDFIKRTRSNPLFDNKTKDAARWARDQQKRQQQQVFGQ

SEQ ID NO: 19336 - protein, 86 aa, Candida albicans
  UNSURE (19): Identity of amino acid sequences at the above locations are unknown.
KPAVVSALGDIATAMGPDXAPYLEFVGRTCTEAGNIQPQDGSIDTLDFVFNVRESVLDCFVGIVGGFINQPQALAPAIVTILQYLQ

SEQ ID NO: 19337 - protein, 413 aa, Candida albicans
FLILFYFKTMDILQILEAALGTADPNQRTQAEIQLNEAANNHFPEYLQLLIEALVNEDAKTEVRMLAGLALKNQLVAKDNKTKLAQQERWLKLDGELKSKIKQTALQGLNITDQKVANTAAQLVAAIADIELPRAEWSELIPTIMENTKTDNPENVKRSSLLAIGYICESADPNDPNILSQASGILIAVVQGAQSSEPSKQVRLTALNALVNSLEFIKFNFENEGERNYIMQVVCEATQADDSELQASAFGCLARIMSLYYRFMSLYMEKALYGLTISGMQSADEKVSCMAVEFWSTVCEEELEIALQKHELGLDSLQAAQNPDLITFNFALIASGEVLPTLLTLLTRQNEDPEDDDWSVAMAAGACLQLFAQNIGNYVVEPTIHFVGSNLANKENWRARVSAVMAFGSILDG

SEQ ID NO: 19338 - protein, 438 aa, Candida albicans
SESIIYETLRSAIAMSFEIGQSVVVKNDIGSIKYIGTTKFAPGVWYGIELLQPKGKNNGSVQGVKYFDCKEDDNGFYGIFVKGSMLNALEDNKNSKSEDVAQYNKTIEKLKLKLKAVTDESIRHREKLIAIQLELQTKIEIMKSMESKLEMQTVENEYLKLIKLDLEEKLRQLSVEHQELKNEFELIQEELEINREIEREMELLDSDHYSPGDVRMIFEKNRRLEDTLALLTRNSKETEIKLKHELEHLQSEQLNMNELQKKLDQAESVVRMLQERIETTEDMDKMMERLTVENEDLTNKIHTLMMTIDDLNEIHELDKKLEEDQKQVELDLRQEIDSLQQIIRQDKLKINELESNRLAQLPHTDKSLESPSRSDQESELQVLRQTISDLRLKSRSDSVQLKLVKARYEILQQRIVYSQASMKFPGLIDLIFMLKLGC

SEQ ID NO: 19339 - protein, 823 aa, Candida albicans
KFVNINPKFLTGSVCSTKKEFCQTRIRMFTLFFFTTDQMNVRPNAPFRPPRPIKGGVAVVQKVVKRKLPTTTNPKPAKILTTDPGSTKYVIQWRKKTSKKNKTWDGDGYAVIKQLENGACEISIKNSDGKPMGKRVFTATPNLDDVISVGPYELELDEKVGSNSTSQTVTRVTHQFKKVAPPTASSRKPLYDDCADAIALPPPPKAKDYVKVNIDPHLAKVFRPHQVEGVKFMYECLMGYRGFGGHGCLLADEMGLGKTLMTITTIWTLLKQNPFMEKGAVVNKVLVVCPVTLISNWRQEFRKWLGANKLNVLTLNNPMSNEKQDILNFGKLNVYQVLVVNYEKLVAHFDELSAVKFDLLVCDEGHRLKNSANKVLNNLIKLNIPKKIVLTGTPIQNELVEFHTLISFLNPGVLPELKLFQRNFITPISRARDINCFDPEVKKRGEEISQQLIELTQSFILRRTQAILANYLTQKTDILLFVPPTSLQLKLFDYITNLKKFNQFEAFTMINLFKKICNSPSLLADDELFKKIVEEKFNLGMASGKINILVPLLLEIASLGEKIVLISNYTKTLDLLEQVLRKVSLTFSRLDGSTPNNVRSKLVNQFNTNPDINVFLLSSKSGGMGINLVGASRLILFDNDWNPATDLQSMSRIHRDGQLKPCFIYRLFTTGCIDEKIFQRQLVKNKLSSKFLDNDATSKSDVFDNDDLKNIFEIDTSTISNTHDLLECVCEGDGSMLSQPTIEESEPPPKQAWVTALELKKKIDDGEALKRTAVKFALNDYRHYNPEVNRNLDFDSALHRIANNSSYENKQLPITFIMLRVTN

SEQ ID NO: 19340 - protein, 593 aa, Candida albicans
KMSTLFGGQQLTQPSLFNTSFNSAFIQQQQQQQQQNQQNQQPQQPQQPQQQQTQQIQQQQPQLFNTQQYYQQPQQQQQPLWLQNQKKRTIPNHLVPKKKQSFQLGTTNNNNHNNKLNSKNKNKTGKNRSNNGDLNGGDLIISNDDNDNGQFNLLSFGSNLNRRVTSGSGSGTSGSLLDRNTSIASLFDNSIGDLSRIDDSFIGGDNTIDDINDDGNGNNNGDGFGNDLPPKNSMYDLSNINGSGKGTRDKNGINSDSKFESFINKDPKTFDSVFNKFQEFTPILDPNNVNVNTNGFGGTSGVDEKPNTTNNNDILQNQKHYNLAIIVFGYPENLSIEIIKFFQSFGRILEKFDTTSTIGSSGSTNNNNNIKEILINLAANSNNNNNNNNTITNKIVPIFSGKHWIKLTFDNPNSALQALQENGNVFNGSIIGVVPYHKSIIEKLENRKIFINDNDSTIMGEGNLDIPLDKVNQIINQQSKLVSTPGGTLNKNNNNSNNNIIGETIPTSSTTTTTTTTTGGGSLYNRLDIKPISKDQIFLKDNLNSSSTTTNTNGGDSQNGGNNDGNKTINNNNKEKLGVWGNLSKYIFGFHDL

SEQ ID NO: 19341 - protein, 191 aa, Candida albicans
KPQSWKSVIKVNGILRKTGSGVTFFDINNKIGISSPELHALVPQHNKTMKDIIYNGLVKNVGNSNFYFKGDPNNITARGQKYLQYFADRIDKYGDTIFNELSLTDQKLALFLRAIIKEPELLILDEAFSCMDDENVMIKCHELIEKELNDTTVISIGHLEWELCKYDYMIQLINDNNGRDYKTFKINWEMA

SEQ ID NO: 19342 - protein, 306 aa, Candida albicans
RESIQVIGIMSKTSTLKKCLVSFQNAKFKKDTLLKTPYIYPNPISNINIYPANVQNGSSMWAVTGNSKTTMLKIIAGEYILYPPLSRQYPLINDRPTQLQFLNFRDGSGLDKVHMSARYETYSYKGVLEMLDDVNSVYNYVTGLNNYNTQHTSISQEFVNELLDYFKLQHLKHKWINSLSNGQLRRARIAKSLINKPKLLIIDDPFLGLDPINTQGVSEALKTVSEELDTSIVLGLRVQDDIPDWINSLCYVDESGVKLSGNKLEILNEYNELVSQITTTHKSHVSRHNKQQQQQQSKPIEISWNQ

SEQ ID NO: 19343 - protein, 210 aa, Candida albicans
LKKKLILGKKYQQYIIKLKKISPGDLQGYNRYLENIEDIIFKLSYSDDKQEIETVETELNKYEQEHKLEILERNMRESQRNDDLMKYKEARERLKQEKLKIQKQMELEDLEYQREQQQELLDKLTNSSTTSEELIKQQQNQMLKRSNLRRKQLQTINNQLDQQFNKINPFAKNNGVDSDDEQNGGGGGVNGSSKIPFTPLQSSLRSAGPR

SEQ ID NO: 19344 - protein, 128 aa, Candida albicans
KMLQTGEGMSTVYPLVASYNSLTNHIIDDQLKDMCPICKTDKYLSPNMKLLINPECYHKICESCVDRIFSLGPAQCPYHKCGKILRKNKFIQQIFEDLIIEKEIDIRKKVSAIYNKTEEDFPWRFTRI

SEQ ID NO: 19345 - protein, 283 aa, Candida albicans
HGKQNKTKRKTMSQTLDDAPDEVLPSNLSLPASIPLKRELLREYEDQFRDTTTDSLFRDQILQTKQMAEYYIDYILENDHLNFSEKILQQYLNAFENFMKLEGKLNKLKQVRNLPTIEGYSSNLTSLTLDNLDNQHTLNQVYFPEAIKEEYAKLGVPTISDSTITKQGYQFLKQVLFLFKNPEDAIPDETEDDELNVSGGKIFLKDPLTLNYFVKPVKSKRCNHVYEELSILLHLNTQRVCPISGCSAVLTRNDLILDKLMLIRIRSVNRVERHDDGNMETVV

SEQ ID NO: 19346 - protein, 205 aa, Candida albicans
HKHFLFYKDSRAIANRNYMTSEKYTCLTCSEQFSEAGQIQKHLSTTRHKSVRLESLDETLECEECSDSNIHQLSIVRYGFNDMSLLCQICLEKDNKKTGETPSASYTLSNGAFFNKLPQYLKFRDIECMECGDDTHLSVANTSSGQLVICRKCLPKYESDNVKFISEDSDDFLSELLGIKEVIIKKSSRKRKSGKNGGGKRGGKA

SEQ ID NO: 19347 - protein, 917 aa, Candida albicans
RRTRKPDPDAEARKAHYLQSKQTAKDIKSGTTVKAIGSNGAANNKTSTTGTKNNTKPTSRYGKSPSVSGKSTPKPGKSPATSGKSTPHFGKSPSVSGTTTPKDRWSTPVNDPKNKPKPDSKPKNKAVNEKLENASNTKPKPKIDKKTPTEKAENKSKLKENNTLSPKEPKGQAPTKLGSKKSPEKDKTKESSSKTGKKPESAVKSDKKQKSNVPQLYSKTKSGSKAQQTANDNKKSGANLPSSKESSLVLPPYITKFHPSEKPKLTYDSMNEYFKEISFNVFLEDQLNNELNIIDSSNFTISWYEDLDKKNNQFQLHIPMRPEIIDKFLSQKLKKFKKNPFLVDQAIFLILDDEIMWSGYIATVDEIASKKGRRVKKDVIELIIMLHPWSQALPRTVHVSNLKILPASQPVSRVLNAMKTINNASFTRMLLGKEPIKQIDFKNFLKFQGQNLNESQKKGVQSVLNNSITVLQGPPGTGKTSTIYEIILQLLDSLNTYPILVVAASNIAIDNIAEKLMTKHGKDILRITAAEKERDYNRSHPLASICLHHKMYDAMPMKYQQVMDEMKRGMAPSIGTTAYKKYAQERFFLSNQIVTQAKVVLATPVVAGGIKSLNNVRVVIIDEATQSSEPTTLIPLALPSVEKLVLVGDQKQLSCFSLIPNLSLSLFERVLLNGTYKTPHMLDTQYRMHPEISEFPRTKFYGGLLKDGIDANARQLEGVISSPLYFWDTKGNAREQSVRNFLREDGGYTYTNRDEIGYIQQVLRTLIITKGVKPEQIGIITPYSGQRDLISATLVKDDVINPSNEQMKTEVDIDDLKNDSKPVTIHIVSGIMIASIDAFQGREKDYMIMSCVRSNTKGVIGFLRDERRLNVALTRAKYGLIMVGDKKCLQNGDKLWKEYLQYLDSKKAIHDNDTFGE

SEQ ID NO: 19348 - protein, 202 aa, Candida albicans
YWISTGGEDGLQWLITLFQNGLNGILADEMGLGKTLQCISFLSHLIENGINGPFLVVVPVSTLSNWYNEIRKFAPKIKVTKYIGTKQERNDIDLLQQQETTNIILTSYEISIRDFNKLVKINWKYLIVDEGHRLKNSQCLLIKILKKLNVSNRLLLTGTPLQNNLNELWSLLNFILPDIFHDLELFQQWFNFDELTELSREL

SEQ ID NO: 19349 - protein, 407 aa, Candida albicans
KLQKKIYYDAVNDKLFDSLVDTNLKAFIKFNHEELFNGFDVDEYLKTRRQRDSFMETGGLSKLRGSRSDRNSLKRSYKEADSDEEFEIMDAEDDSLTGRGNTTPSYDEALVKIRHIKSKTKIQSILIDAIYQDILKEAKHLKLQNLKMIQLRNICNSPFIYYNYPILDQAEVIRNSAKFQVLNQLLPPLLSSGHKVLIFAQFTKVLDLLEDWLEESPLLHGKICRLDGSTNHQIRDEQISQFNNNPKFKVFLSSTRAGGLGINLVAADTVILMDNDWNPQMDLQAIDRVHRIGQINPVKIFRFVIKDSIEEVLISRSGSKRFLERLVIQMGQFKFSNFNKKLTAATTSNEQGAIKNDWSINDMMELSKLHFKSTQNGQTSQDSAEEDEKILLSDQEIDESLDRSVGM

SEQ ID NO: 19350 - protein, 668 aa, Candida albicans
ILVDPFWVRFATHCDSFSMISDIFFPFLSFIIENFYFSFRKPTTTTTTTTRSKILHQTPKQMLEHNIPILINQYIAASSGNDEEAVSNYIFELSNLISNDELSLLQFIQHLGPSLTSDKDSIRSKSIECLSKTIISLSDSKLTKQDINVLIEFLLNKLIDNDQICLQYSLMGINSLICKKNFLGDTNIEKILQQLYKNYDPKKNLAKVRYETFQILLNLLNQFNQYLNSSSIQLSNLYIKTFIHIASGEKDPRNLLISFELNNKINANFQFDNKNNELHQQFITDLFDICFCYFPISFKPPSNDPYKITSEQLKLALRETIASQSKFAPEAFPSLIEKLNSSNPTIRNDTLKTIELCIKNYSKNDATVIEEYWMTIWNALKFEILHNDISSNFNPTNNTIVASDYDEIDDNDEFKPLVLTLVILNRLILTLLQPEIMLHTVVEELKPNLEVMKEKSIKSSLILSSLGSTSVDNLNYIVDFLFQYQIWGKFLNIDKKEENEEQQEFDTNEDVSLNIAKQRDLIDSIGFVLTAYQVLKPTAHCHLLDYKDYILIFLGQLLTITSNLEKTLKCKIIQQLIKLIKLPGYLNTNELELILGNYFKQFFLDTTKTSGKKDVILQEIINGLIEVSQDSQITSLTIEFIINPILNQLLTTEDNDGGDVNIETFQFQ

SEQ ID NO: 19351 - protein, 533 aa, Candida albicans
SSREKQFSLWHILKYIPEEIKLHIVKMDDSDEEYMGSKSPSSKLPSTAPEKSASPGGAKSGMSARTRSSRRGEVSDLKGANGYAWEDEYQRSWDIVKDDEQGGNSFEAMVQSIIENRKKKIMKNPSTPFQRGIIRTLIIIIDGSLAMSEKDLRPTRLSMTLNYLQEFVVEFFDQNPISRLGIILMRNGVANLVSEVSGLPQYHVDKIRNLKARQHNRFEPKGDPSLQNSLEMARSLLKFNFGSTSNNSKNSKEILVIFGALFTSDPGDIHKTIDSLVKDEIKASVIGLSAQVAICQELVNRTNNEPRNSQSKHYGVIMNESHFKELLMESVTPLPLTESEKQIQESEQNGVPVLRMGFPTKVQPTLTSAIGGSDYIVEFPHLNASFPTQGSEDSKDVVEIQTNKPAAAVATTSSSVIGYQCPQCKCKVCNLPTICPVCGLMLILSTHLARSYHHLVPLAPYKEVKVSPIYDSTYCFGCQLKFPEGVKLGTHKGTLESMTSSRYRCLKCSQDFCINCDVFVHEVLHNCPGCENN

SEQ ID NO: 19352 - protein, 232 aa, Candida albicans
VNSSLWTGRGILYASSRESGCIHISYTLFPERRITLTNNKWRVYHPIFRKMKLKLMTKSSEKLKETLSLISHVRKFVVLKFTPSELSVILINGQAVKLEPQVWCKLPVSELFQSCEIQSVRDNTILMEINIDLLVQTLKNFDKANSEGLNIRLQRTDTSGAKGTSNTTGRTASLALFYSNLNINANVVNHTFRIPVKILRDAQDMLHEPTHSDLGLILRLPNELVCLTEHES

SEQ ID NO: 19353 - protein, 304 aa, Candida albicans
  UNSURE (238),(297): Identity of amino acid sequences at the above locations are unknown.
SVKKILMKVTKRAISDTSGSSKRIKLEHIEVEIESETTELAPNVFTKVDPEDMAKCNGPPKWSEIYNQLVWMRSKFFAPVDTQGCERMPNTINRNIKTRNPKIYRFQLLISLMLSSQTKDEVNYEAMKNLHNGLLKVHPDGLCIESVLKLSESEIDAYIKKVGFHNRKAQYIRKTCSILMENHGGDIPKTIEEIVALPGVGPKMGFLLLQSGWGINAGIGVDVHLHRLALMWGWVSPXANTPEKARIKLQEWLPKDYWTDINPLVVGFGQVICVTRAANCDICTLATERLCNGVNNXLAKNPLS

SEQ ID NO: 19354 - protein, 283 aa, Candida albicans
  UNSURE (37): Identity of amino acid sequences at the above locations are unknown.
GYKTIYNWQYCHSLDFWSRVLSQHCNHEKELQNHKSXESPLRQLIYPLVQVTLGAIRLIHTAQFFPLRFYLIRSLIRLSQSTGVFIPLFPLISEILSSTAMTKAPKASTLQAVDFEHNIKVNQAYLGTRVYQDGLCEQFIELSGEFFGLYAKSIAFPELVTPAVLALRRFVKKSKNVKFNKQLQQLIEKLNANAVFITGKRSNVEYGPSNKAEVQQFLSDFEWEKTPLGQYVSVQRQLKAERLRILKEAQEEEAKAQAEQKKKEEEEDEQEDEDIVMEEEDDE

SEQ ID NO: 19355 - protein, 304 aa, Candida albicans
LFSTQGTMAKASKQTKKFQNKHLKHTIEQRKKVQAQNKKIASRKKSGSSSSGESNAPKRADGKAKEVFEDMSVDDFFGGGFEVPKEKNKNKNKQDTIEENEEEDSSSEEEDEEAMKENLKKLEADDPEFYKYLKDNDNDLLDFEAVNPLDAISDDEGDEDDDEEIEKEVPSDDDSEEEPTLGKVKGSKIEITKSLVKKWNQQLDKPTPKITRNILIAFKAAVNIHNSDSEDYKFSITDPKAFSELMLLVLKKVPISVQKLVKYKTNTQGVRSYPAKESICHSNCSYFEITCRFIHHFIKRYHQY

SEQ ID NO: 19356 - protein, 189 aa, Candida albicans
  UNSURE (184),(185): Identity of amino acid sequences at the above locations are unknown.
DLIPQKNQYATQIAAILKSHAGSFITLLNDITNTETAALILASIYEVFPFYLSHRRLLKQILTAVVNVWSSSSDIDTQISTFAFLNNVSREYPKSVLETVLKLTYSSFLQNCRKTNVHTMAQINFCKNSAVELFGINETLGYQVGFEYVRQLAIHLRNSINATSNAKEGYKTTSSPGSGRANAXXNSPP

SEQ ID NO: 19357 - protein, 381 aa, Candida albicans
WKNVTLRQEIVSPEIGQHVLAMLFVESDSESVNNTDICQVEDSFTASTTQIAHLSDIFQSLVSINNQAIIRIKETGIAIYSSYNHTFNVNVNIDPLLFSIYSITGEEFTLGVDLSLIGECFTSVASTLKFEKSVTCYLNYQGEGSPLVIEFEDTYILEKLEFYTYIIELGMEDDNLGIDSERVEMEAMVRSDVLTNILLDLWQIDTENLFIYAEADTLTFISNGPIGTSKLIFPNDKDVLEKLEISGDKRYVVSQFSYETFYRIFRAVRLSSKCKLIKDAHGCFSIQLLCKKLPLSGYSGTLVTINMMELNHDEFMIGWIEEQEKPVLFTSFKKVEVQSSVVDKRNVNGAVECRYFYKISIQVCSFQLYFFGFGQYTRRSK

SEQ ID NO: 19358 - protein, 507 aa, Candida albicans
LPSFFLSPQPIRTMSSHLFKATVNEYLEGLPKTVQSKLYEAPATCLSIFRLLSPMAKFYIMSMIFNEKPIALRDLDKWCKPLARKLEFEALKRLESLHLIEYDSKGSHVRLHSIFRKNFRDCLTGSQNPNAFGSISTTVDKHKVDIPFLDLFASQKWETILHFMVGTESTATPSDSVLSLLKLGGLMEGPNNDLRITNSGFQFLLQDVNAQIWTLLLQYLNLTQELNMDPVDVLNFIFVLGSLELGKSYSVLSLSETQVSMLADLKDYGLVYQRSDTSGRFYPTRLATTLTSDSAALKTPSMAMDEEEQQVATKESIIIETNFKIYAYTKSPLEIAILNLFVHFKTRFANMVCGQITRESIRNALYNGITADQIIKFLETHAHPQMKILAKEKLDKKIEFDTSHNINTAGGAPQSKTDGMVSQHKLEILPPNVVDQIKLWQLELDRVQTFDGYLFKDFSNQQEYDILSNYASELGVLIWADKVKKKFFVTKDGMTQVADFANRKLKR

SEQ ID NO: 19359 - protein, 375 aa, Candida albicans
KTLNILLTLNTIMEAISDRLFNENANTIESGNDDPSLLTIILDLSMKGWYNIKEMISIQDITKSLLVFLNGHLSLNNSNQVAFLVSSTMGSKFLYPDLTMVGNPNVSEHSEHFPDMYRLFKMVDQSVLQRLNEYIEEIIKFETGNEKKGFNCLTGAISMALTYTNRMLTLDQSITTTTAAAMTASTLESTSNNNNTSGTSGSSSTSSSTSMKSRVLIVSANDDDDLRYIPLMNCIFAAQKMKVSIDVAKLGHNNSSYLQQVSDATKGVYLHIEDPKGIIQVLSTAFFIEPNLRPYIILPTNSNVNYRASCFITGKSVDLGYVCSVCLCIMSQLPQSGKCPACDSEFDKKIIQDLNREPQVISKKKRKLENGSLTK

SEQ ID NO: 19360 - protein, 262 aa, Candida albicans
SNMGKQYISTVSASQAHKLDILGVAITNKFTVSVSSDGYAKFWDNKQDEVHLPKEFVQLVFIDKSGIHAVAAYENVLPSSTLKVTLLAFACFNGSIIFRYYINDDFSTIESLTDDIKSFESNCWTPGFYRDPESKQDYFITTKTNGTTEVHLLNIVDENEKAVITFEKFGQLKGNSSSFPNSLAICPTENKKCAVGYINGDVLLYDFVSLKLIYTFRSSDLVTSRNSQSTSIPRVLAFSPWWNLVGCGKRQSSCWVNYIIRR

SEQ ID NO: 19361 - protein, 164 aa, Candida albicans
PVEIPNRRLYLGCWHFPPGGTLLAVARDNQAAGSITLYDVEHGENVGSLATPSHSAKSVVGGFAHQGWILGLSFDEEGKHLASCGFDKCIRVWNLETSEREATISISISDLDDTTHNDQDESVASGVAFIKKGVRGGSGGDSNEGLCVVSFDRGIRWYREAGGI

SEQ ID NO: 19362 - protein, 221 aa, Candida albicans
FNPYSDNGGTVLGIAGEDFAVLAGDTRQVEGYSIQSRYESKIHDVGDDILMTANGFAADGVALIDRFKQLLIWYKFDNNGKKLAIKSAARYIQQLLYGKRFFPYYVSTLIAGLDEEGKGAVYSYDPVGSYEREQCRAGGAAASLIMPFLDNQVNFKNQFVPGTDGKEKKPLKFLTLEEVIQLVRDAFTSAGERHIYVGDGLEIKIVTKDGIRTEYYPLKRD

SEQ ID NO: 19363 - protein, 198 aa, Candida albicans
EPRCIKSLYHTGNSNAEDAMNWIFAHMDDADIDDPFNPNDSHGGASTTTTDDSGPSQDLIDNVAAMGFSTQLANKALVLNNNDISAAVEWLFANPYDDGILEDNNQSGPVVNVKQEKSELITKLNADTQSNGKYELQSVICHKGTSPHTGHYVVFIKKLIDNEYKWVLFNDEKVVVCDDANLQDIKNNAYVYVFRKVE

SEQ ID NO: 19364 - protein, 225 aa, Candida albicans
QERNYARMTLELPSDIPLTIPANTKIYKDDCMYSFDTPENNLLGLDIDLKTYRAYSRNKDFNYTKQNYDKTGNYLYLNIKKTLKPQEERNKLLYDDNGEKSPKIQKLEIKNVSDDDYYNTEISIYDIKDDKSYSRDELSDEFNNLIDLILSANSSATEDEIKQWEQEIVPCPHSIDVEQFETDNLDLTKCSQCDLRENLWICLHCGALGCGRQQYGSTLKGNGHA

SEQ ID NO: 19365 - protein, 145 aa, Candida albicans
SKYTNSFIFFFDRDPPSSCSAGPVGDDLYHWQASIMGPPDSPYAGGVFFLSIHFPTDYPFKPPKIAFTTKIYHPNINSNGNICLDILKDQWSPALTISKVLLSICSLLTDANPDDPLVPEIAHIYKQDRKKYEATAKEWTKKYAV

SEQ ID NO: 19366 - protein, 1081 aa, Candida albicans
  UNSURE (495): Identity of amino acid sequences at the above locations are unknown.
SLKKETMSSADDVRAKRLAKLASSANTTPNRQQSPTADTSTTNVATTVATNDNNTKSEKTTPNTPKPILEPPAKPTVSGHTPVDQTLLKEDQISSWIKLELEYIFRATTTKLSDSSKGLIFLPNLAYELSDSNVKLNEDHIESIFMEILTELGVPKQYKTPMEYLYTVYHNAFKTKRTLAVKSLFYEDKVAILNKIISLVAAYGNMSFQMPDMFVNNDLRKSLDLFIDRFGDLSSFLSDIIQVSIEEESLLELLNLFFPYLSARLYQANLNERNYLNYISVFQFLVSIKPVAAIFSQIKGFQPPDKTKALDYEHKTLLGPLLRISPLLDNMASFYFGQETNSMSPVQINNLYGSMQTEYKVIIDHLFVIIDKLIRGSTKTREDLLQWLGNLINLSHLRRGSHADFKKLASDGIMYNISVVFIRLSLPFLDYPTFGKIDKIDVDDFFKSDLIDIKEESRVNSTMEESNEYYAKRIHESSSDNLTPTPPPNFISDCXNLTLAYLHHGVGGIYVKYDRVKRQLDQMEPRLEAIESEHPIPGMIPMIQQLMRTELPDLKNAIINMRAQRHVIKAIFDDRDHQLEIFDFVVGATTFITRLIDPQHKYPQVKLSIPILKISNVSQLDDHEFLKTKTPEPWKYYPEFILEGIINYCKFSTRFIGCPLVSNENKLNIFVEFLTILLRCPELIGNPHMKANLVELLFMGSLPMQNGAPGFISNIFNGNQLVMDNLLYSLLDFYVMVEKTGASSQFYDKFNSRYYISVILEELWQNPRYRFQLTDYSKNNVDFFIRFIARMLNDTTYLLDETFNLLNSIHDYQQEIKKRESGGEANETMGTDEELAQNLEEDERRVKSYMGLSNKTMELFKLFTKEVPRGFVLPEIVDRLAGMLDYNLSILVGPRCSNLKVAEPEKYQFEPKKILSDLCEIYVSLSAQPEFVIAVARDGRSFNIVYFQKAEKILTTKTFIKNEIINGLIEFANKAEKARLDEENEELELGEIPDEFLDPLMFTLMEDPVILPSSRVSIDRSTIKAHLLSDSTDPFNRVPLKLEDVIDDVELKQKIQDFKQQKESSQKQSNNDEDEDVVMKE

SEQ ID NO: 19367 - protein, 239 aa, Candida albicans
SMSSTLPPFSDLNATWTFIQPGLEYILGAHGEQGVTATVYMNCYTAVYNYCVNKSRRGTTPVSISNNSDNNSYSLAGAEIYKKLEEYLTEFIKNLKRLPNESFLEFYVRKWTRFTIGAVYMNNVFDYMNRYWVQKERSDGRKDVYDVNTLSFIKWKDEMFKPNSKLLIEQILTCIQQQRDNMIVDTNLISSAIKSLVFLSIDIQDLKKPNLIIYVNSFEIPFLEATMEYYAKESAAFLA

SEQ ID NO: 19368 - protein, 621 aa, Candida albicans
SQEFVSHNLGTKYLQLTTQFIKDEDNRVRFYLPPSTYPKLVELMNNIMIKDKIDKMILSLNQGLEYWLKPVVSNIFEDTNIETYHYADLKMLYNLIGRFDDEYQLLRLRLKEAIVAQGNSLPDYVRSSIENSGKKQSNNSPAFATKWIETILKYRDQLMQVWKNSFDENLMIEQTFTFAMRDFINGSNKRGPASVNAPELLSVYMDYFIKQLTKGSSSNKDISLKSGDQTEDLISNSIQFLRFIKDKDAFEANYANHFAKRFLNSKTGNSPSSNKDIEEIILAKLSEEMGTSSLDKVIKMNRDVRLSKDTTNDWKRYLNKQSKSTDLVEMELKICNVTDWPKSMTKDYKWFSRTENEETPFKWPRQLRNTIKQFDEFWSNGKKNDNKSLYWSPKFGSMDLRITYPSRTYEINLSTFAAIIMLLFAPQLTNADGSTVLAFDEMKELTYEEILELTGIPEPELKRHLQSIAVAPKLRLLVKVPMSKDVNKNDVFKLNAKFKSPSVKVKVLTVSASSSSSASSSSSSSKNTNKSVAKTEQEEELEEVNANIMEGRKIEVNAAIVRILKSRQSIKHNDLIEELLKQLSNRFQPLIILIKQRIEDLIDKEYLKRDTDDRNLYHYIA

SEQ ID NO: 19369 - protein, 210 aa, Candida albicans
KLSLKDGMNVLFDYSPMVLARSTWPFHSSQDYNDLTLAHELKVTIDSFKAMYLQQGKGKQIEWLWNHGRAELKAHLTKGKGGKPFNFIVSQIQLMVLLAYNYSKTYTLDDLVKIVGIKKELLQNHVTPFVKYKLLKEEGDQLVIVDHYPSKKNKVSFIGAITKTKEEDVEEITKEVQQSRTIFLEASIVRIMKLKKLMALSSPRRAGRSN

SEQ ID NO: 19370 - protein, 114 aa, Candida albicans
VEPPRGVLLYGPPGCGKTTIANALAGELKVPFINISAPSVVSGMSGESEKKLREIFEEAKQIAPCLIFMDEIDAITPKRDGGAQREMEKRIVAQLLTLLDDQTFSPRQEAPNCL

SEQ ID NO: 19371 - protein, 842 aa, Candida albicans
FIFLFLHHKFLQITQIMTGEEDKKQHFDASGASAVDDKTATAILRRKKKDNALVVDDATNDDNSVITMSSNTMELLQLFRGDTVLVKGKKRKDTVLIVLADDDMPDGVARVNRCVRNNLRVRLGDIVTVHPCPDIKYANRISVLPIADTVEGINGSLFDLYLKPYFVEAYRPVRKGDLFTVRGGMRQVEFKVVEVDPEEIAIVAQDTIIHCEGEPINREDEENSLNEVGYDDIGGCKKQMAQIRELVELPLRHPQLFKSIGIKPPKGILMYGPPGTGKTIMARAVANETGAFFFLINGPEIMSKMAGESESNLRKAFEEAEKNSPSIIFIDEIDSIAPKRDKTNGEVERRVVSQLLTLMDGMKARSNVVVIAATNRPNSIDPALRRFGRFDREVDIGVPDAEGRLEILRIHTKNMKLADDVDLEAIASETHGFVGADIASLCSEAAMQQIREKMDLIDLEEETIDTEVLNSLGVTQDNFRFALGNSNPSALRETVVENVNVTWDDIGGLDNIKNELKETVEYPVLHPDQYQKFGLAPTKGVLFFGPPGTGKTLLAKAVATEVSANFISVKGPELLSMWYGESESNIRDIFDKARAAAPTVVFLDELDSIAKARGGSHGDAGGASDRVVNQLLTEMDGMNAKKNVFVIGATNRPDQIDPALLRPGRLDQLIYVPLPDEPARLSILQAQLRNTPLEPGLDLNEIAKITHGFSGADLSYIVQRSAKFAIKDSIEAQVKINKIKEEKEKVKTEDVDMKVDEVEEEDPVPYITRAHFEKAMKTAKRSVSDAELRRYESYAQQLQASRGQFSSFRFNENAGATDNGSAAGANSGAAFGNVEDEDDLCS

SEQ ID NO: 19372 - protein, 305 aa, Candida albicans
SHNIVEPKDINMDARLPFRKQDEHFMSENSHKNGPIGRKSDGNLELELELEPVSPSSSSTSPISSPHSSDSSTSSTGFDKAKYESETFTTGTVTVTTDLSNNNNNKTPQNGLLLNSKLLYNLKAVISHYGTHNYGHYICYRKFRGTWWRISDESVYVVTEEEVLSGQGTFMLFYEYDDGFKEVLQDVTDEEEEEKEKEEKAPVVKESNENKLNRNNLAGSLNSNENEQGAEADSDSETDADADADIDENDVEKEEDDDHIESLNSSLVNIHDGTESDHLLDKNDSDNENNNAVAQFNIAEAQVHL

SEQ ID NO: 19373 - protein, 231 aa, Candida albicans
PILIPINTLFCHFFFNFQPLHLQFASFRSFSDSPHFMFLSRRIILFLIINFTLLLQLFKLTLFTKNKLVATVSTSLLLFISLYYLTTSTTSTLGSKLSSTFNINIIIPKFLRNIMNSARFGSSRPFSRFSYNNNSKKSKEQNFAIKNGGEIGGISNDGNTCFMNSVIQSLASSRELLKFIDLYLYTEIELDKKPNGESIIMKSNQPKSELVFTNALKKLLDNINGKYGSRS

SEQ ID NO: 19374 - protein, 195 aa, Candida albicans
EFNTKPLLNKMPNGPKQNFFSGYNQEDAQEFYQLVMNLLEREYKKMNSSRLPTPEPEDMNNDKLQDNSTATSGGSKFIDVRNIKSDVVSGCDKLGKLGTVYVPAAQVDPNLSDAEHKVLPLELITPVDGISAERIGCLTCGEVGGIRYSVISGLSLNLPSTSSSSSYYSGYDLYQLLNEWINPEVIEHVNCNRCG

SEQ ID NO: 19375 - protein, 221 aa, Candida albicans
YGMECVGEKKKFWSRKRERKGKKERKKKSNGMKKKYAHLILEVDCLSFSFFFFWVCFLSSTTLMSLCLIRLQEERKQWRKTHPFGFFAKPNKASDGSLDLKHWTAGIPGKEGTIWEGAVYPVTLEFPDEYPSKPPKVKFRPKFYHPNVYPSGTVCLSILNELQDWKPAITLTQILLGVQELLDTPNKESPAQEDAYRHFVHDMNTYVKRVKAEVKKYMTQE

SEQ ID NO: 19376 - protein, 233 aa, Candida albicans
ILGEKWVSAFQKGGNNMGFPERVRIFWPKPFPNSNKCQFFGGLSDSELIQKYLGDGPRLCRQIFQIAADHAPSIVFIDEIDAIGTKRYESTSGGEREIQRTMLELLNQLDGFDDRGDIKVIMATNKIESLDPALIRPGRIDRKILFENPDANTKKKILTIHTSKMSLADDVNLDEIVTGKDDLSGADIKAICTEAGLLALRERRMQVKAEDFKSAKERVLKNKVEENLEGLYL

SEQ ID NO: 19377 - protein, 291 aa, Candida albicans
PAKTQLFASTARTSKVGGVTFGSNSISFLSNTHLLLGIFFFLCELLISWWRVFQIKHYLYIPYSKQAIMGQGPSGIPGGDNLNKKKDDKKKEKPKYEPPVESKFGKKKRRGPDTAVKLPSVYPNTRCKLKLLKLERIKDHLLLEEEFVTNQEAFQPTEARQAEEREKVDELRGYPMAIGTLEEIIDDDHAIVSSTASSEYYVSIMSFVDKGLLEPGCSVLLHHKTVAVVGVLQDDADPMVSVMKLDKSPTESYADIGGLESQIQEIKESVELPLTHPELYEEMGIKPPVFT

SEQ ID NO: 19378 - protein, 537 aa, Candida albicans
  UNSURE (482): Identity of amino acid sequences at the above locations are unknown.
RKYWGVSLSEEAFSEVFNLGTSWNGWSSIIITMASTSKERLYGILDLLEKENPFTSLIGILLNNKYISSRLKIAPLFLSGGILNWYHTLGADYLETSSIKNGDCLKEETRYLTSFSDYLSNSKESLPSEVTLANENNSAYIRPVQKKVEQFDSIPPKSTATVYSSPKVELPLTPTSSTPNSPAPPLQPLLSNGKLPNNVTAKDVTVSSKKSQFLELYATGLVNLGNSCYMNCVIQCLAATPQLTSFFFPTITESFSDHSYKRHINVNNKLGTKGMLTTSFVELILSMLNNNGRSFSPSKFKKIMGSLSPARQFASFDQQDCIEFLNFLLDALHEDLNQVTIADPQERKMITELTPEQEKNREILPVRLASTIEWERYLKLNFSIIVDYFQGQYLSQLKCLECGFTSTTYNAFSILSLPIPEKLNKLMKVSLDECLQEFVTTELLDDNNKWYCPNCKKFTKLTKKIAITRLPQVLIINFKRFXMTASGGFHKLETFVTYPVNEELDMTPYWADVGSTISANNSMSIERGKKKFEYFPI

SEQ ID NO: 19379 - protein, 188 aa, Candida albicans
IRPTLTNTSSTPPMARHPFYKRLLKEYQQISLNKLPGIKLVTNDDNLTEFIFQIKVANNPLYPDDEDYYLSIKITENYPVDSPQVKFVIHEEDNDDDSIIILDDDSLEIISHSVIPIHPHIYSNGHICLNLLGDDWTPACSIESILLSIQSMLSTNDKRERPPDDTSYIKHAPTNPKNSKFIYHDDNV

SEQ ID NO: 19380 - protein, 87 aa, Candida albicans
YKKNIDIPQEYPFKPPQMKFITKIYHPNISSVTGAICLDILKDAWTPILTLKSSLISLQSLLQSPEPSDPQDAEVAKHYLSNKSGFV

SEQ ID NO: 19381 - protein, 68 aa, Candida albicans
TTKQMSRVKRIAKELEECRQDTQSGVSLNLNNENDLTHLTGYFKGPPGTPYESGLFQVAIDIPQEISI

SEQ ID NO: 19382 - protein, 373 aa, Candida albicans
EMEDPVLLDNVNSVLSKLNNVSATNSNETDVYLKLKKLEKELDLLLLQEEYIKDEQRHLKRELVRAQEEVKRIKSVPLVIGQFLEPIDENTGIVSSTTGSNYVVRILSTLDRELLKASSSVALHRHSNALVDILPPEADSSISIVGEDQKPDVTYADVGGLDMQKQEIKEAVELPLTQGDLYSQIGIDPPRGVLLYGPPGTGKTMLVKAVANSTTASFIRINGSEFVQKYLGEGPRMVRDVFRLARENSPAIIFIDEIDAIATKRFDAQTGADREVQRILLELLNQMDGFDQTSTVKVIMATNRADTLDPALLRPGRLDRKIEFPSLKDRRERRLIFSTIASKMSLAPEADLDSLIIRNDPLSFSHTAADGSH

SEQ ID NO: 19383 - protein, 206 aa, Candida albicans
ITLISTNQPTMDIILGIKVSDGTLIATSKAATRGISILKDTDDKTRHLNAHNLIAYTGEAGDTVQFAEYVQANIQLYSMRENDIELSPKATASFVRNQLASSLRSRKPYQVNCLIGGYDVKKNEPSLNWIDYLGTQVELPYGAHGYAAFYTTSLLDKHYRKDMTVEDGLKLMDMCVKELQTRMPIDFKGVYIKVVDKDGIRQIESN

SEQ ID NO: 19384 - protein, 429 aa, Candida albicans
RLGSIEKKLVRNGNSVLATVINNTYPQTHNSKTYLLKYLNESPTSVGNDAMDVDNTTLIPEIELYIHLLVQVYLLDTGKLEELNSLGEHVVQLMKSFNRRSLDFIQAKVWFYVCRAKELIGDLYSIRPELLYSLRTATLRHDIETTASVITLLLRNYLLTHDISQASDLVEKVEFPENAGNALVARYYYYLARINAIQLDYSTANECVITAIRKAPQTSLANGFVQAATKLSIVIELLMGDIPELKVFKNKSGNLEPYFNVTKAVRLGDIKLFGEVLHKFEADFKKDDNFTLVSRLRQNVIKTGIRIISLSYSKISLKDICIKLHLDSEESTEYIVSKAIRDGVIEASINHQKGYMQSKELLDVYYTKLPQAEFDQRIKFCLSLHNESVKSMRYPNDNEKENANKEIEPSEEVELLKAIEEGDLDDFMD

SEQ ID NO: 19385 - protein, 208 aa, Candida albicans
HIMSDPFSINGSAAVAMIGTECIAIASDLRLGQQSLGVSNNFEKIFSVGDKTFLGLTGLATDVISLKELFRFKTNLYKLREERNIEPSTLANLVSSSLYERRFGPWFVSPIVAGLSSKDNKPFICGFDSIGCIDFSHDFIVSGTASDQLYGMCESLYEPNLEPEDLFETISQALLNAVDRDALSGWGAVVYIVTKDKVIKRVLKTRQD

SEQ ID NO: 19386 - protein, 314 aa, Candida albicans
YYKQPTMGNSETDNLLFGDGSDKIFGMENFGNTCYCNSILQCLYYTESFRLKLIQHNQTKHDPKLIVTGVKPHSFTSKYEQLVQKKLREQGGKLASLNSNTATEERPKQGSRKGSIFGIKFNNSVNTSTTTVPVAIDDSKKLYMKYIDKAKDCEALSLEQRIKISKSPEFQKLDILVTRPSINQTAKKPVDDDNRNDYSQSSSMVVNDQPQQTIQEGSISNTSSAIIVGIPLPESNLNTPINPFNSDPSGDQRKRSALINGPIINLDTSLQLPSEQQEDTALLYALKDLFESMVENKSTLGVVSIFHHGLERSA

SEQ ID NO: 19387 - protein, 245 aa, Candida albicans
TNEQDVKLFDSINYPFKLRLFNTTDDESLTDLLYELYALVIHIGGGPMHGHYVSLCKIKAGLWLLFDDETVELVEDSYVMRFFGNGPGLASAYILFYRQAKYDPEFGFNPEDIYNGNDDYSFKQTEDESSTFATSVNNDYLDTKSEASSIASFNVNEATKKTNVFKNFKFDKDDKPPAPISRSNSMNANLAPGAPVKEVKEKKSWVGNLKRRNTETSNSGNIPPMERKPSTSSPRGAASAIIIPP

SEQ ID NO: 19388 - protein, 258 aa, Candida albicans
TLISPFSIFLLFFCIMASRQATKRLNKEYKSIQANPPPYIIAHPSEDNILEWHYVLTGPQDTPYEGGQYHGLLRFPPQYPFQPPSILMITPSGRFKPNTRICLSMSDYHPDTWNPAWSVLTILTGMLSFFTGEESTTGSINTSVNHRKVLAQKSKKFNVDNDRFCREFPDLVKQYHEEIAAEKVKLEQQEKEQQLNGQQQGDQKEQLANLEDLDPEDRIRVMQQLEQEQKQKQKRKQNQDDENLNQDNDNSNRMCVIM

SEQ ID NO: 19389 - protein, 347 aa, Candida albicans
KKRPFPTVELIIPCSNPMTSSSSNSGSLRFRGDAASFSPSQYPNYHQQQFHPQQYMAQQIPAQQQFYYQFPQTYPMMMNQMYPVFPYPPDPFFQQQQHQRRQQQQQQQFVMQPQYMYHPPPKRPKSNKPPKVNGSAPPPPPTPPKIELVDLPLYINTSKTEFLQRYSITQESRSIDELQRANTLEEYNENTNRLIISTNVMKIIDENDHKTTITNGQPEEPKPAAKAVAPPVPISNWASFLQSTAPPTPKKIAKPKPPPTPPTPVQAVTPVPQFDMSNESAQPLGTLLLKIMFDSNYSVFSSLPTFDIKPRGLTNTGNICYMNSILQILIHCEPFNRLLKLIENKSI

SEQ ID NO: 19390 - protein, 91 aa, Candida albicans
RKRLEYNHDLIIPKEVMARDTGMPIKYQLVSVVYHHGSSADAGHYTSDIYNAGQWWRIDDTAVKQIQNEEVLNAGTEENIKNAYILLYRRI

SEQ ID NO: 19391 - protein, 287 aa, Candida albicans
KTGRKQSRKMNHDPYIWGRPSNDIYAPYNYKIAHANNNQVEQTTHNFPKMNTQQPIITGTSVIASKFKNGVIMAADHVGSYGSLLRFNNIERLIKVGKETVVGISGDISDLQYIVRLLDELEIDEEVYDNDGGEYLRAPNVHEYLSRVLYNRRSKMNPLWNAIIVGGFNKDRTPFLKYVDLLGVTYHASTMATGFGSHLAIPLLRNLIPEDKDYVKVDEQQVSKAIEDSMRVLFYRDARSGENYSVVIIKIDENTGELSFQFIKDAKVQNQSWKFAGDIRGYGSSQQ

SEQ ID NO: 19392 - protein, 295 aa, Candida albicans
NQQKVISSHSFQLSYSSIMSLQKLTAEIYSLFGKGDYQGCQQLLAPIKLELVKHDLLVPLPSNTTDKNQINDLRIAQRILEIGALSSLLTNNYSGFENYFAQLRPFYSNPKLHNLQKVHINTDITKIISLYLLYLLSQGLISKFHVELEVIYNSSQYDAQQDKYLQFPINLESNLMEGNYIKIWKLLKEEKNLPCQEYTHFVDTLINALRFEIAKSLEKTYDSIPISNCKNLLYLPQELSDANFEKTLKETYQVDNWKFEDGVIYFTKNENETNVDNQSVIKNLLGYAEQIESIV

SEQ ID NO: 19393 - protein, 149 aa, Candida albicans
FTFYTNFYSFYFNLNSPRNFKLLQKLEKGEKGLGAESITYGLTNQDDITMTYWNGTILGPPHLNHENRIYSLNIICDESYPDKPPIVTFVSKINLPCVDKNGHVLVEEFDTLKNWKRSYTMETILLELRKSMASPTNKKLQQPREGSTY

SEQ ID NO: 19394 - protein, 138 aa, Candida albicans
  UNSURE (127): Identity of amino acid sequences at the above locations are unknown.
LHHPIEEMTTSIDKSYVHEGGIRPYFEQQIQDTEIRIQQTTQNLRRLEAQRNKLNNKVRQLKDELKLLQEPGSYVGEVVKVMGLKKVLVKIHPEGKFIVNVTKDIDVKKLTPSIRVCLKADSHDLYXILPTKLIPWFH

SEQ ID NO: 19395 - protein, 319 aa, Candida albicans
LHHPKEEMTTSIDKPYVHEGGIRPYFEQQIQDTEIRIQQTTQNLRRLEAQRNKLNNKVRQLKDELRLLQEPGSYVGEVVKVMGLKKVLVKIHPEGKFIVNVTKDIDVKKLTPSIRVCLKADSHDLYKILPNKVDPLVSLMMVEKVPDSTYDMVGGLDKQIKEIKEVIELPVKHPELFESLGIAQPKGVILYGPPGTGKTLLARAVAHHTECKFIRVSGSELVQKYIGEGSRMVRELFVMAREHAPSIIFMDEIDSIGSSRVEGSSGGDSEVQRTMLELLNQLDGFESSKDIKIIMATNRLDILDPALLRPGRIDRKIEF

SEQ ID NO: 19396 - protein, 82 aa, Candida albicans
RTDMVKIHSRSMNLTRGINLRKIAEKMNGCSGADVKGVCTEAGMYALRERRIHVTQEDFELAVAKVMSKNDDGAVSLQKLFK

SEQ ID NO: 19397 - protein, 243 aa, Candida albicans
TMSYSAGFDRHITIFSPEGRLYQVEYAFKAINSANITSLGITGQDSAVIISQKKIPDKLLDPKTVSYIFKITPSIGMVATGSIADARAQAMRARSEATEFRYKYGYEMPVESLSRRMANISQLYTQRAYMRPLGVALTFIQVDFADEGRGPQIFKCDPAGYFTGVKAVATGPKQQEATTYLEKKFKKTDAVKGDWQKTVEFAIIALSSVIGTEFRKNDIEIGVATEGEFTILTPEEIDERWIQ

SEQ ID NO: 19398 - protein, 353 aa, Candida albicans
VRLFCSFYFLYDSLTLSIIIGYGYRETKLNGCSDIFQLKRTRLRSIILRTTRISLSARKKRESKPTHKRNYTQLLLLNITIFFLNHHILTMFSGFGSSIYGSGFGSSGFPSNKFEEYFRCYPIAMMPDLIRKDDANYGGKIFLPPSALNKLTMLHIRYPMLFEIKNEQNEKLTHSGVLEFIAEEGRTYLPQWMMNTLELTPGSLIKITNCDLNLGKFVKIEPQSVDFLDISDPKAVLENVLRKFSTLTVNDIIEVNYNDAIYGIRVLEVKPDSTSKGICVVETDLETDFAPLVGYVEPEYKPKTVEPLSKPIDPSKVNKSAGAATMAKSINYAKLVAEAGKTTKYSGSGQKLS

SEQ ID NO: 19399 - protein, 77 aa, Candida albicans
STPVRSSLPENQLFFGFPVVLPTQEEIDEESKEELKKQQAFSGSGQSLRQSKKRKDKNTNYPSLKNHTRSPDAIEID

SEQ ID NO: 19400 - protein, 256 aa, Candida albicans
TRPYTMSRRYDSRTTIFSPEGRLYQVEYAQEAISNAGTAIGILSPEGVVLACEKKVTSKLLDDDGSAEKLYIINDQMICAVAGMTADASILVNNARIQAQQYLKLYDEEIPCEMLINRVCDVKQGYTQHGGLRPFGVSFLYAGYDDRYQFQLFTSNPSGNYSGWKATSIGANNSAAQTLLKKDYKDDLTLKDACELAIKVLSKTMDASNINSEKLEFATLSLGKDNKVLHKIWNDKDIDILIKASGVLNEKNSDDE

SEQ ID NO: 19401 - protein, 435 aa, Candida albicans
  UNSURE (11): Identity of amino acid sequences at the above locations are unknown.
PAHDLPAGWLXTIDYVLDVSNFTIMTLPLIHTELNEQYPKLDIRELSDYLSLPEESYSGASDVNSTNRWALILWNDEFHNLTEAVTAIKAGTGVDDRNAYKIAEKIDIKGFCVLKEDDNPQKLIQAKRLVESNGLVATIVSARDLLREKIASSIIDWIIAISNSSNSQVRKAAQSYFAELLLEPHFRFSKVIPSSVFQETLASKSTQDQFLAYFKNGLPYNGELISFNYHQLRATANQISLYEPISSLLDLTRSTERLKGSRLQYLLAFQIRFPKLTRQKLGTLLVPPLVTTSTLKREFANQFVELFPALLTIMGLTDREEDLNLMSDITSQLFTCPQTVRSILDKGGVKNLLGPLAKLIEEHSTTRDTNTGYRLYCEIGSDSQQKRAIKKAIVHGIYNLSYFSNHGLSGDSITKFLQPDHFSLLVFATGLEDPR

SEQ ID NO: 19402 - protein, 817 aa, Candida albicans
TVKRESGQSRGEELLAEEFKFSHTKIRSIFKIFNQKYPSFIPTLKARRSEFDISKVDLSSDDANSEDELGKKKRIAKERQAKLMAKFKKQQSLFLKKNQFETIACGSDTEMEELDDHAAWKFPEHHCMLCQNAAEDAGPFGIIAYISKSCEFRNVPFSDEYWFLKAFSDNVDLNGNEYELDINQSLHNSPHTQTWNSFMQQASNSSVIGPGFKLNEFIESHFVALSCGHGMHYQCYVNYISNSRNRQNQITRSTPENMDRKEFLCPLCKALNNIFVPILWSSNNRSLQEFLKPYAGTSPFLDLDMKIAKDRGWTERFQSFSEQEFDSRSILTGISKEMISMDLTKELTKQQRDFRLMLSDMFQTLTLFTFPQVFKADSGFVLIDTIKSIEISLRGVSSGGQLIIHQLSNNILLTLRTLNEFKNSSTLMKVKNWIDLPNLRKSAYSKIFAYIFALSKKSINNYMLEVDFFEHLVNTDTFPSLGFSFNSVLETCFIGHLIQSLSIMVNEMSANCLKKNWAYTVSDIPTIADIPQGISEAAISCFKKLSNSNDVRCIGNDESRKFGEVIYSMLVKIATPFLRRAAIYAYVQCANIDGIDFAASPETEIEADRLCSFLNLKPVCEYLRLFNEESSYEGSVFYDFLTFSSALPKANDVLRIKKQVEYPGIVKLVDLPERLDFFFTKYYYLDRHNNPNKKVEDPAICLFCGDVVDIQKQAIGCKEGQCTTHYLKECSNDVGIFLLPKDRSLLLLHKNGGTFYNAPFLDEHGEIAEESKKAKALHLMKPRYDDFIRNIWLLHNVQNCIVRSLESVLDPGGWETL

SEQ ID NO: 19403 - protein, 631 aa, Candida albicans
SADFPARWSILGVDMPRNKEIPTVVAQLIELLSKKKNEFIEPGVIKFQVSKEPVAIVNPLNSLLSYFLQFQNIDNFKHLLQQNQSELVNFTDISLRSIVLGSQVKAGFWIRNGSSVSRQATAYFDSLMTEYAFMRDFHLNQIAILFEDQEKVLMNFLERWELRSWFKNEVDFDKTIYEERFFSIVERFIAFAYNLFVDRSMFINETPEDATLRKLNHAIGYALCEEAMAFSELHQYIDTNIASSSKFEDVLYEVADYQPPSALTDSGLYRLKESTYEKLDPLNILVDPGKFQIISEMVIKNSSKQKKRKSENLIVTPVIEKAGNDFVDENIGNFAKSLPFVKLIYKLMQVSIDTSDETYLPHLLHLVHAIMLDDEMIHGKEYLNKHFVDIPITDLLLTILESTMSKYVCQKADYLVEQLVGKDKRIIASLVDCFGEDYIQRYKKRKNSLFESDAERKKRKAEKRKNNIFKKFSKQREKFLNQNQEFQLDIPQDSNIPMEGEDSRKLRTCVACGELESFEKPLAIMAASTKAPVFWKVPVQTGEVVSNAFKTWDKNILLDYKDTEYGVGYDPVSRLSLDSNRFESYVLSTCGHSIHHSCLNRRIIGSAQYSCPLCHNLHDMIILTLLGNQRQ

SEQ ID NO: 19404 - protein, 496 aa, Candida albicans
LFLPFWGTRDSNIPAEVFNGSPNHLKYNQIVESADPNRKLGYLLDVFFKPEYFDAPSKTVTMASLGEAPLNDFKNQKYLPPGINSSYGIIFNRLMNWTVVLADTIRMNEISTRLNGVDGYSDFLSQIPGSAKTLLICMFQMRVLNAASSLLPLLADESNTFQSEFKLFWNSDLILDGVFNEVLVLFFQTDESLATLTRVGMSKLIAIVIKSLTARHEKDNLYLKCIDVDNGNQVSDVSLERFHRLFTGVMHGNDCEIPEVDKSISLIIYCAIERILGIFLRQVIIFKDILTCKQTGENNYESIPELLDLQKKIKLQDRLTDTKPLTDALGVPSFDELIETLLESSDALEGNVFDIIWLAKIPKYHDKGILTLEYPGIVHLVNLPVDYNSCVLNASQIATRDNSKCLICGQWTNASRNVAHMLNCSSQIGILFISKSNMLRICVYIGTSPITIELPAPYLTKHGEIKVIDKRGRATLSGLRFAYLIFATRLQNPRDG

SEQ ID NO: 19405 - protein, 100 aa, Candida albicans
YHAEPSGTFYRYEAKAIGSGSEGAQAELNNEYHKSLTLKEAELLALKILKQVMEEKLDCKNAQLASVTKDGGFQIYSDEKTDAIIKELNAQATDEDTVIS

SEQ ID NO: 19406 - protein, 105 aa, Candida albicans
TNMFLTRSEYDRGVSTFSPEGRLFQVEYSLEAIKLGSTAIGISTSEGVILGVEKRVTSSLLESSSIEKIVEIDHHIGCAMSGLTADARSMIDHARVSSLTHNLYY

SEQ ID NO: 19407 - protein, 408 aa, Candida albicans
LTKMGRRGRQRRVIHDEDDDLDHTYDKLPSRRATKTVSYKETDEDEDVVEELGGIKDVPDDAALNINEVEAPDLKDEDAVGGVEYGGNGEDGFPELRGRRGRRKRSHIESDDDEFKEDQVEESEDDDIVLSADDEEFVEKKRTDNFIVKDDNEWGNDDEEDDGEYGVKPKRRKTSRTRKNKSNSSWTGSKRATRSGRALDDPDNTLADGTVESEGELDIQKEIAELYDSSPIHEDVGQPHKLRQRAKVDYTIPPPITADFQLEHEYRQATPTTVRSRRGRTGAPKNEFRKILYPTAGPFGGSDVISLFGKNIPPGGIPIPGMTGAPNMTAIGQNFSDSDSSEDEIAPINGVATISKKQPKDKKPNVGGPKLITGGSDDTSGKKKKSTLSDTDPLGVDMNIDFLGSSWS

SEQ ID NO: 19408 - protein, 919 aa, Candida albicans
ILIFSVVRGLDNYINQLKEMVALPLLYPELYQNFAITPPTGVLFHGPPGTGKTLMARALAASCSTSERKITFFMRKGADCLSKWVGEAERQLRLLFEEAKNQQPSIIFFDEIDGLAPVRSSKQEQIHASIVSTLLALMDGMDNRGQVIVIGATNRPDAIDPALRRPGRFDREFYFPLPDLGSRKEILKIHTRKWNPELPDLFLERLAQLTKGYGGADLRALCTEAALNSIQRKYPQIYGTNEKLKVNPSKVKVIAKDFMKAIEKIVPSSARSTSSGSAPLSEHLKPLLESEYQEIIEKLNQLLPNTVGLDGRKKFTALDEAKYLDPTINDEDGGFAKQQLLKNLENSRICRPHLLISGNEGNGQQYLSAAVLNHLEGFQVQSLDLGTMFGEPTRTPELTIVQAFIEARRHQPAILFIPNIDIWFHVLPDPARATLTSLLRGLKSNEKVLLLGISETPIEDLSHEIKLVFGFQNATNNVILHNPQRSARAEFFETLKKTLLMKPYEFVNDLENRPKRKLKELKVVQNTAEISNDELNKKKLKEQEYKDTKLKNVLKIKLAGLMDLFKVRYKKFRKPIIDENLLAHLFEPSILENNPFNNYVVQYVRSEDPAHQNMIQELATGKYYYNMDLDLIEERLWNGYYSEPKQFLKDLKMIVKDCIVSGDRERILKANEMMTNAQFGVDDFSTPEFLQACKEVRERDLLKQQKLLEEHKKLQEEWNKKQEELQAQQQQQQQQQQAAEEEVPNGVLPVAELMNGTTENANETDSKVVVENEPVIENEKTGNNTEDIIEIEQNVIPKEVNSPTKQAEVEIQEVETKISEDSNGKDVSMSVDDVDESESESEAEEELNIDLTKEVEIDLQELDSITTELLDVTEDYNVERLEVCMARLMDVIWKDRNNWNKIGTLENLKQTIKSLETTL

SEQ ID NO: 19409 - protein, 219 aa, Candida albicans
RTNPQMKVFETLSRYSHDPDLEVAQNSIYSMGLVGAGTNNARLAQLLRQLASYYIKSPDTLFMVRIAQGILHLGKGTLTLTPYNSERTILSKVSLASLLTIAIALLDPRSFILNDSTTETTHQLLYYLTPAVKPRMLVTVDEELKPIKVNVRVGQAVDVVGQAGKPKTITGWVTQSTPVLLNYGERAELENTDEWISLSSSLEGVVILKKNPEYMEIDS

SEQ ID NO: 19410 - protein, 155 aa, Candida albicans
RMVNKLVKLALQIVPFFLKHNAEADAVDLLLEIECIDKLPQFVDENTFARVCLYVTSCVPYLAPPDDVSFLNTAYSIYLSHNQLTQALTLAIKLHDNELIKQVFDSTTDESLHKQLGFILSQQNSNFKYPGENPEVQECISNVKLAEYFQYLVKE

SEQ ID NO: 19411 - protein, 82 aa, Candida albicans
  UNSURE (52): Identity of amino acid sequences at the above locations are unknown.
DPKVPEDVYKSHLENSKFGLGTSGSIDSAKQNLAASFVNGYLNLGFGNDKLXQTEEDNKSWIYRTKRSGMASTTASLGSIHQ

SEQ ID NO: 19412 - protein, 326 aa, Candida albicans
NINEGLQVLDKYTYSEDSEVKAGALLGTGVVSANVHDEVDAAFALLQEYVHEPNKLYQTAAINGLGIAFAGSANEDVLNLLLPLVSDLDISLEISCLAALALGHIFVGTCHGDVTSTILQTLLERDYTQLTNKFIKFMSLGLGLLYMGRTEQAEDVLETIDAIEHPISKTLKVLVNICAFAGTGNVLQIQALLQMCTAKPKDQLEEEKKLEQSEEEQQQQQQQNKDTKSNGEGGEEEEDVEMEDAESKNETSENTTASATSTTSSSKEKGDSSSSAAAAAAAGDEKAQEGGDDKEDEEEIDEEEELYQGIAVLGLACSSPRLENHL

SEQ ID NO: 19413 - protein, 70 aa, Candida albicans
LKKKKKMAPSQEQSKEQIQSQTSKDQQPTKSDKSKVQKEEELSEEDQHLKDELELLVERLNEPNQERGII

SEQ ID NO: 19414 - protein, 246 aa, Candida albicans
NVQYYIKETKMVLEATMIAIDNSEYMRNGDFLTSRYEAQLTATEFIFQNKINSNPENTVGLLAYGGSGPQVLSTLTTDFGKILAGVHETKIQGENNFSSGIQVAALALKHRQNKVQQQRIIIFVGSPIKESEKELEKLAKKMKKNNVAVDIIYFGEDSVNTAKLERFQSTINNHDNSHLVTISPVPTLLFEVVASSPILVEDGGFGAGVSGGDMDFFGGAGGAGYIFESKMEPDLAMALTLSLERG

SEQ ID NO: 19415 - protein, 961 aa, Candida albicans
HFPRNIIYNIRHMERIKHKTRLPTANVNKSLPETPQPPSKPAPPNGMPRSQPQVFTTSTVGSSTVRHQFPKTNTPPTAVMQPLITEDDMQAYYSRLINYEFRNLQLDSEVKSKSLFDLIDYCELQYETANVQLQTGATDPNATLKGIKTYIKGYLVFNYFINSFIMVHFKGFDTFIESNEQDFIIYLNIFAFYNSNEYFQNGNYSIQSEDLREYVKKYLVDKNLLSFNIEELYSWLNEYITYLKEKDKSTEEQASVSSSSSSFSFVEEVYAMPDLRQSTHSRNSSITSENEFKQKYPSIKRVDSPPSEFISKQIPPPIPTQLPPSLLESITDLKSVSPNASPPSPTPTPPSPPPHRVSTSEYPISSDTFVTKERNRTSYPVQDNILGAAVLSEEQAYFQPKSYSRPKNEVPDGYLRPTDYTKTRMYHKSNNLVSSNGNMNGYDPRLAQGHQIDSPIVQGSNVHFPPPPPQQQPIYHQPVQPIPYQPNMQLAQPIHQPYSYYQQPNQPIYHARNTQPQMYQPPAHYNNTHSHVPAHVVQQQEQIKHQKNSILKEYFICGLRNFGSSCYINSTIQLLFGVYPFKSIFNHGYQKYVKDPKYLKILAKRNSHTKESVLLSEAISGLLRTFQQNGGVSVSPTKFIRVTSLLKPDFNIPHEQQDAQEFLLFVLDRLHEELADKRQDNYDPELSVQKWRININMENKDKYMEWCKSLHEHEGSSPIMDLFQGHLQNKLKCNKCGYESVSYSPFSILSLPIPNNYKNEVNLSDCLRYYIQDEVLSGENAWHCPKCNGEVQTLENHPVFENKRSGIFRLGGKKKHTKSQQTQNNSTNTISTKSINFVKLPTILFIHLSRFSMYNLTDKLDTMIKYPLLLKFNNQGHEIVYKLTGMINHFGNVKSGHYTSLVNKSTVHEKLQNSDNLKRPCWCLFDDEHVRSNLAHGALNHPHDELVSRDVYVLCYERIDV

SEQ ID NO: 19416 - protein, 180 aa, Candida albicans
FVMPFQNISNILQKWKRPIEKQPDKLATAVLSTTAKAKTRAKKKQSQKEGGDIKAEDKMDVDEETKPKVDAKESNDDEKKETKKQPVSDEPVTVRYARTPYKISNLSRVLPVQSNFISFIKDDRFVPVRKYRGSSGIVVLQDNKPEEKVEFIKTVRQLNITEAPVPEPFTLSGEDLQDDE

SEQ ID NO: 19417 - protein, 693 aa, Candida albicans
TMALVSAAPYLALLGEPDSTLKWYALSSLNQVVDQLWAEIANNITELEELYEDDSFDRKELAALVISKVYNNLGDFDAAVKYALYAGNEFNLEEKSQYMETIVSQCINLYNSLSQQKFNDSTTKIDPRLTAIFEKMLNKCLKANEVKLSLGVALESYRLDLVESILQDQIKNNEEQALNLINYVLVCSNNTVSNTNFRVQVLNSLISLLLSLKKHQDFFTIIKIIVQLNDSELAVKLFQELINQNEDLIAYQAAFDLVNAASQELLDLVMEKLSNAKESENGTLKKILNILSGVPTCDLDNTFLFKNNNADITILNKTKNLLDGRSSIFHSAVTFANAFMHAGTTDDSFFRKNLEWLGRATNWSKFSATAALGVIHKGNLSQGRTILKPYLPGSSGSANNKGGSLFALGLIFAGHGREVIGTLKSFIDDNGNAAGSNDIDIQLHGAALGAGVAGMGSKSESLYESLKVVLYSDSAISSQAAALGMGLVMLGSGNEEAIKDMLTYALETQHENIIRGLAIGIALLSYGREEKADEIIDQLMNQESSILRYGGAFTIALAYAGTGNNNAIKKLLHFAVSDPSDDVRRASVLSLGFLLIRDYTAAPQIVKLLSQSHNPHVRYGTALALGISCAGRAYPAAIEVLEPLTKDAVDFVRQGALMASSMILIQQNEFIYPKVKEFTKQYADTIKNKHEEF

SEQ ID NO: 19418 - protein, 320 aa, Candida albicans
  UNSURE (10),(14),(19),(207): Identity of amino acid sequences at the above locations are unknown.
ICQSNILVNXKINXVLLNXTPYLMKQGNLYPENEEPVTFCHVSPEVFQHLGEWFGILGQPIIRAIIINPDTKEKQIERFPPLFWVHQLGKKTQPTYLRHRHNGSNHNHHHHGHHDSPIPVLLSKTSTFHRLMDVIRYNVLKAPRKSTKDFRIWFIVPQDKGLQYLISIQTFMFDISKKTLVSPNMLEDALKDHGIMASSYDIMVEAXEKHHTGFPIDRFILSHSYAYEEVSQGGGHIGLSNMGYTCYMNSALQCLLHVPEINYYFFYNIYKKELNFDNPLGYHGDVANAFGSLLKQAFDHVKNSSSISPREFKSTIGRYS

SEQ ID NO: 19419 - protein, 714 aa, Candida albicans
KMTKLMTPKPSPKLANTCWNQHKARNDSVIIDLFTGLYQSTLICPDCGKKSITFDPFNDLTLPLPISKKWYHTFTIVDLSNQGVIPERIMKLEVELNKTSNFDDLLSYLSNFLNVPSTELFAYEIFQNAIYSDFQLDYTKNKFLPISDIIRDTDDVIVYIVPHNPAVDIIVPVFNAVEDADSSYQMVNFFGIPLFVVMNKEVDVNSFGFIRKKLLETVSLLSKIDLVDEYEKIKRSNEDYVEKVFYKKLDFPALSQPLETSDCEKNNNNTSDNDDDEDADNDEGYDSEVSLANPYLGANFGFKIMYVHDYSPKLNSNLRSRYNHDQTTKFKQTERVINVPTHKPTFSDFKPLSDQLSESKRNYYFYPDYKKMDDEMDQLVEEVNQNLAEQEEARSSGSENSSRALEEQDGFVLINKEDTLKQQSTVPAAAETVPPPLPVRNNTGVHIPSSDEETESEANLGSLFDSTSNLPLPPPSTYSESTKPSNVNSPMESNFESSSADLNSGTTLISKDTVLLCDWDKEIYQKCFGDKELQAWENISNLPNPELEKNRAHFERQRKAKITLSDCLKSFSTPEILGEHDLWYCPRCTEHKRAAKTIQLWSTGDILTIHLKRFHSARAFSDKIDVLVDFPIEGLDISSYVANTDLTPEDCLYDLIAVDNHYGGLGGGHYTASVKNFRDDKWYYFNDSRVTEINNPQEIVANSAYLLFYRRISS

SEQ ID NO: 19420 - protein, 114 aa, Candida albicans
STMNGISVDINHLKKGEVNLGTSIMAVTFKDGVILGADSRTTTGSYIANRVTDKLTQIHDTIYCCRSGSAADTQAVADMVKYYLQIYSITIASLVKFQQQILLLMYFKEMCYYK

SEQ ID NO: 19421 - protein, 270 aa, Candida albicans
SLQFKSKLLLIMTKGDSKRVIPLESNPFLFTELAYQLGLSPILQFHDVYSLTDPDLLAMLPTPIYAIILLFPLSPNYEKYRQQQDNNNNNNFNSTNLIKYDNNNDIEWFKQTIGNGCGLYALLHILTNLPQDLIISNSKLSQLRNNLTKVKEFSIDDRAKIIENLENDIKLDENFGEKGDTKAPDINESVDLHFISFIKSTKNGHLYELDGRRTGPIDLGESNNKDNNNNNNNIINDPLLIEKIQFYIDNADEANKNNFAILHHAVEGAR

SEQ ID NO: 19422 - protein, 289 aa, Candida albicans
VTFINTSFASLLQCFFIAVAATLERRFLKVATVLCSTTNLFFFFCSDNLTLFTILFFQKFVINMSYKLSSTLLGHEQDVKDVATTEYGGLVSVLRDGTTRIWSDIYTTHSEATIVFHSPTNSFINSVACINGLIASGGQDTMIYLSDEHGEDKYQLIGHEGNVCSMSYSHGQLISSSWDCTAIVWNLKEFVPKYILSGHESSVWDCQVLGEDHYLTCSADKTIRFWHGKSEVKQFVGHLDVIRKLLILEGGEQFLSCSNDGTIKLWDLQTGKKLQTFYGHESFVYDLAL

SEQ ID NO: 19423 - protein, 509 aa, Candida albicans
VKTTWPCISVWCVTALPNGDFAVGGSDNLVRVFTAHPEKVAPEEELLKFKEAVQSSSIAEQSLDDLKKTDIPGYEALSQPGKQEGSTIMVKNPDNGTIEAHQWSGGEWHKIGDVVGSSSSGKKQTYQGKEYDFVFDVDIKDGEPPLKLPYNVNDNPYTVAEKFLSDNDLPASYTDEVVRFLQKNTEGVSLQESTNDSNNPSAGRVIDPYSDAYNKQQKQQGNLALKVIPSKSYIYFTDYKRELLVNGLKKLNLSQDSELQLSDQDFLAVESSLLELNSKQALELITKYCSHIIRKWTASAKLIGFDLLRVSIPKVTTVDILTSTDAAEIILDVVNLGLENINVENPALLMMILKVLNNLVGTTLFVQLYIDPCGTDNKLYEYNTFFQNLLKKLQNSTAKLTQLAKLYTSTMTALTTLVYNLSAYQLQTSALKNNMGSAKPVIEFMDNLGNQIVASSSEAAYRLAVAYGNFKYGKLYTNETPSWLAEAGTLYAINGEQRFLDIAEDLKNI

SEQ ID NO: 19424 - protein, 119 aa, Candida albicans
VTFINTSFASLLQCFFIAVAATLERRFLKVATVLCSTTNLFFFFCSDNLTLFTILFFQTFVINMSYKLSSTLLGHEQDVKDVATTEYGGLVSVLRDGTTRIWSDIYTTHSEATIVFHSP

SEQ ID NO: 19425 - protein, 423 aa, Candida albicans
  UNSURE (21),(411): Identity of amino acid sequences at the above locations are unknown.
QVLFLPGPGVKTTTFRKKRPXEKITPLTEGDIQVLKTYGTAPYADSLKEIEKDLKTIEERIKTNQGIKESDTGLAPPHLWDVLGDKQRMQEEQSLQVARCTKIIEASQPQQPTGLQNADTKSKYVINIKQIAKFVVGLGERLSPTDIEEGMRVGVDRHKYEIQLPLPPRIDPSVTMMTVEEKPDVTYSDVGGCKEQIEKLREVVELPLLSPERFVKLGIDPPKGILLYGPPGTGKTLCARAVANRTDATFIRVIGSELVQKYVGEGARMVRELFEMARTKKACIIFFDEVDAIGGARFDDGAGGDNEVQRTMLELITQLDGFDPRGNIKVMFATNRPNTLDPALLRPGRIDRKVEFSLPDLEGRANIFRIHSKTMSVEKDIRWELISRLCPNATGAELRSVCTEAGMYAIXARRKVANEKDFL

SEQ ID NO: 19426 - protein, 333 aa, Candida albicans
YEYEEFSILYSRGTSSIQSSTSSLPEDVNKLNSLMLLLSSLKIIKVLLEKAPFTIIGLFEKEGLINDVLRLLKTLSDKADLNEKDPRASINLMMSAYSNKFIDSEFTKEYEYKLTSRVIYSNIVSIATDINSLYQQSKNEGLQNISENMKVLQEVKTTLSNHKNIKSFSYNQWLELWNNLKLAFCGSSSPVSSFELISSGAIESLTKLFSTDFGLESSDCYKAFTEAFWKDDSATFLVQKLQEALTRSESFDIVSATSSTNNQSSFARDQNQAAIMANQIKLKLIAEEENSDQSKLPGNMPNMILSVHAIATFKSVFAFLKQRLNFLKNYDVH

SEQ ID NO: 19427 - protein, 305 aa, Candida albicans
SFEGNCAVTGGNRNSSNGDTSSIVNGFVDVMQRLMGGGVIFDGGSARDSGEIDALVNNLSQREDTYIVLESMNELSERLLMMNGLTAERLIPANKLARSLIEIMEDPKLEEELELHLVACRCLYNFLEVNQDFIHDALNNNAIPALCNKLLEIKYIDLTEQALQTLEMISRDPISHNSIISNNGLTACLQYLDFLTIHAQRKCLTIVANSCSNISIGNFPKVKEAFNGIAEVVRNHNDKVVVENAWLTISRIVMCFKNKPDLLNELFADKELLFKELTKVILVSCNKSLNTSSESNQVTLNHGSN

SEQ ID NO: 19428 - protein, 136 aa, Candida albicans
YFRHVELVELFGNAEEDWSMDTLTSSIVANHGYTKESEAIKSLIDILMNFSIEEKREFLQFLTGAPKLPIGGFKALRPELTVVRKHAEDGLKDDDYLPSVMTCANYLKLPNYSSKEMMKEKLIQAMKEGAGAFLLS

SEQ ID NO: 19429 - protein, 440 aa, Candida albicans
NITYRKVSSEVSKEAPFTNFNLHYNTDRELSLYDDTTINILKLLKILFRMNNNFSNGGGHNVATKEFTNWKLTVKLNRQLEEPLVVASGTLPGWSIHLTKQFPFIFPFETRIFFLQSTSFGYSRLIHQWQLRTNQGGDDNVGSTSTNQGNNQRMQLGRPTRHKVRISRKMMLQSAVKVLGMYGSTPGILEIEYFDEEGSGLGPTLEFYSTVSKEFSKKKLRLWRDEEPRQASDVDVDVDESYVVNKYGLFPKPMDKTQLSSENGRKVLYFFSSLGKFIARALLDSRIIDFNFNPVFLLLIQLLNKTNGINSTSRTNTSKLSKKMATISNLRLVDPTLADSLQHLNKYIELFESNSDIHNVTVDGARVEDLALFFELPGNPDYELIPNGSDTLVTADNLELYINKVIEATLFSGILTQTKAFMDGFSKVFPINSLIIFSSR

SEQ ID NO: 19430 - protein, 206 aa, Candida albicans
PAQNNFSSSFFFLMRYKYWCATNIVFKTFFHFFFFTNPTFLVRKKHSYLPTSQFKMQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKHRKHKLAVLTYYKVDNEGNVERLRRECPAPTCGAGIFMANMKDRQYCGKCHLTLKAN

SEQ ID NO: 19431 - protein, 201 aa, Candida albicans
QISILKIMLKIRQLQKKKQEEAERLAKSQFTTPTPGDSTSTSNQRVSPAQIRVQKDISELDLPSSIRVTFPNPNDLFNFNLQLIPQAGYYKNGKFEFKIEINSNFPIDPPKIKCLQKIYHPNIDLQGNICLNILREDWSPVLSLTGVFMGLNFLFLDPNATDPLNKDAANVLVKNRKQFEINVFNSMRGGYLDLVYYDRVI

SEQ ID NO: 19432 - protein, 456 aa, Candida albicans
KINSPPIIKLHKPLRKSYPYSFSLESAIEKMKDLQLDVELVNTVTCISYSFKSEVSLALIEQFYKARLLHSPADITRSGAKSNVALQPTPRGIAIVQEFCERIGMEREEFPEVLLAHDFNTMELFNFDRDARSDRILYSEYLLYLLFNLMMGPEPNVWTLSNTQDALPSLNFSDSESFDKLYKVFSNSQDAKNAKQNNDDSSDVEGFSFTSYRHFSKTHQSSETHSVTDSKEMATSPFHHRYFTNPESDAHSQYYVSSVGVRLLKDKIVLVGPNKSVTVDYCISGKAIYQWILDCTDIINPNHAHEIARLLVKHNLIKPVSFSSSLSFSRDAFYQLSTLGLALSLWDFFDRNLQDSSSLQPGTKILRLASNVTLQNILNDPGMRLQFRKHLIKDHCVENLEAYIQLMQFEETYKAWEDLSDIIDNQNHSCIPVKSSDVNIHLKNLQVTCMSFAFQI

SEQ ID NO: 19433 - protein, 468 aa, Candida albicans
THSRIGRLPVVKTNDHALSKHVELPPTMGLSRWETAHFPERAINKIKDFTLLNTSVSYGVMARFIGRKSTWEVDFGKIDTPSNSTRIVNSQGDEYIILKELTNYFRVVKKTPIPTDNERLMKLLENKLMYNNFILRIKEKIDAGKRLIESIESSNFTGSIDIGKELTQTELELAKCKQFYKPDSIRDTKLNPNRIEHYETFLPLVRKSLTGNKPLGTLRVSTPKKEFCVSYIPPLRFRQQSIENLVSSWKFEIPVDMSIAYSSLNTKPSQLPNIVDVKAELAVLTIRSDSKPIPIEFNHDLIFNKQCNGQFIDSDNFNENIIKPFRKYSTDLYKIYKKLGSENFKIEQSLVDDLKSICKLEHKTFNLRVKDIMIDGKPGKPSSKGVTQWSIDENGAKSSFTVGINLENLELKGDTNSNKSKKSYDNFTLVPDFQSCFMCRLYHVKLTMALSNDRYVNIKVPVRVQKVV

SEQ ID NO: 19434 - protein, 385 aa, Candida albicans
HCELFTLRNKMSPDNEPQPPNEDELLNNILPSYHMFQSTVSKNLTPTNENYSIDPPTYEMTPITSETPSLLTFSRMQSPVDERLETDNYFPQSDNDSVTYNQESEDMWKNSILANADKLPNLTHKKNSMSECLQIDIQVTEKVCQSGIKPIFMDPSNREFKQGDYLHGYVTIRNTSDQPIPFDMVYVVFEGTFTTLDTLSGTISTEMPALRFKFLTMLDLFASWSYANIDRLITDNGDPHDWCNGETDPYDNTLLSIDVKRLFQPNVTYKRFFTFKIPDKLLDSTCDQYNLPTHTEIPPTLGIDRNSFPPSFLLANQHLIVKDLSFLDSCLAYRIDARVIGKASDYKYKVDKDQYVVSKEASCPIRVVPTPYIGIGNIICQPSQQ

SEQ ID NO: 19435 - protein, 90 aa, Candida albicans
KATAICKSSILPKTILEKRWNDNLQLEDGIHVALLALKECIDGELNGDNLDIAIISDPQEQLLGFKGTDIPGPRFKKLSPEEINDTLDSL

SEQ ID NO: 19436 - protein, 166 aa, Candida albicans
MLSIEEFCYILTFTNYSGKLVQIEYALNAVRQGVTAIGIKCGNGVVLATERKANSPLIRNDTNIKVEYITPNIGMTYSGMGPDFRVLVDRARKLAHTNYKRIYNEYPPVKIMVQEIVKVMQESTQSGGIRPFGVSLLVGGYDESNEGKFQLYQVDPSGSYFPLESY

SEQ ID NO: 19437 - protein, 177 aa, Candida albicans
YYHHTAHAPLMPPRSTAQKRLLKEYQQLSRDPPPGIIAGPVSEDNLYKWECLLEGPSDTPYENGVFPAVLTFPKDYPLSPPTLKFDPPLLHPNIYADGTVCISILHPPGEDPNQYERPEERWSPVQSIEKILLSVMSMLAEPNPESGANIDACKLWRDNRAEYDRQIRQHVKESLGL

SEQ ID NO: 19438 - protein, 403 aa, Candida albicans
KKDGSIIPIEKLINSKNLVLKCHQCHLNNFGNSMICLQCPHVGCCFNDYNHSYSHYKSTRHMFSIDSSCGLLYCFKCNDFINHPELEKIRLQIVLGVHDEEKKKKKKKTTTTTTVDDDDDDDDDFIKQNYVDPGQIAIKGLKGFVNLGATCFMSSILQTLIHNPLIKYQFFNNDLHYFNCEKFHNQFINQGNIDENNACITCSIDNIFQSFYTSTTNEGFGMTNLLTTAWYKQKSLAGFEEQDAHEFWQFLLNEFHMDYQRIINNLNLNLNLNLNLNQDNNEKNTHSSNDDSVVNSCGCIMHSTFSFELQSCIKCDSCDSITETVDPMIDLSLEVNFTNLYQSLQSFTIDEKLYDYNCKNCNNSNNNMSTTTTSAIKKLLLKTLPQILSIQLKRFRHDILGSF

SEQ ID NO: 19439 - protein, 84 aa, Candida albicans
STKIQSHINFPLFLNVTEYSVINDTDYIYQLFAVVCHQGSINTGHYTVFIKNNSNWYKFDDSVVTMVSQDVVINSEAYLLYYIV

SEQ ID NO: 19440 - protein, 325 aa, Candida albicans
YHNQFLIIIIIIIIIILININNNTNNNNYKSIYKLKKDGSIIPIEKLINSKNLVLKCHQCHLNNFGNSMICLQCPHVGCCFNDYNHSYSHYKSTKHMFSIDSSCGLLYCFKCNDFINHPELEKIRLQIVLGEHDEEKKKKTTTTTTVDDDDDDDFIKQNYVDPGQIAIKGLKGFVNLGATCFMSSILQTLIHNPLIKYQFFNNDLHYFNCEKFHNQFINQGNIDENNACITCSIDNIFQSFYTSTTNEGFGMTNLLTTAWYKQKSLAGFEEQDAHEFWQFLLNEFHMDYQRIINNLNLNLNLNLNQDNNEKNTHSFFTTEPAGPR

SEQ ID NO: 19441 - protein, 189 aa, Candida albicans
YLDPSAGPASPVVKNEIIKDPVEITRNNLQILKDQVSNYISFVKDNKISLSRDAFLYLKSIKSLGVKKDTIKDYFQIVTDNNLLNREGSWKVEQLSNSTSTSNSNSNTSNNSNNNNNNNNSKSFRYTKNLTIPLTILNKNNVNLLPSFQSCLVGRLYCLQIMVRYKGTNNDQNEFADNIVKLDVPILVG

SEQ ID NO: 19442 - protein, 405 aa, Candida albicans
RNRGPSAPVVKIHKREYFDVLPSFQMFQSILKRDDRQFQEDLSSLPPGYGDVTNSSPTPPPLPPPPACSAPTLSPSSSKDHTIDEAIQRLNEYGLAQERDEMNNDEYLFEEHNNDPHNNTNNTLLPVGSSVNANVHNQNIEVTQDDTYGHSPLDNIDKLHKLPHSPIDIQIYVTKQIPQPNVNNDLETRLKAYTSGDFVNGYITVINNSHEPIEFGLFTVSYEGTIKSVERNPHAMGLTHKFLKILMKKFLKMYDLNASYGYVQVPNSAGIQYEPFSHDTSDGSVIGLPTDRLLQPNIKYKKFFTFKFPHRLLDNACINSLLPHLLPPPSMGIDRTCFYNRGEAIQLNKALGYGFLNVRGTPMLTKDYSFDDLSISYTIEAKFIDRLNSAQPMFSSRTSPDPHSS

SEQ ID NO: 19443 - protein, 390 aa, Candida albicans
ERDLPPAVVDERNRFKLKLSSLSLKNTPSRQASVSSRNQGDDEANELINILPSYQMYRSTITKNLTPSVEDLRTAPPSYEVTPDLSTVQLHDYFASVPTSPTLDPMLSEPLDAESAAVQQDGEQDDETILENAHKLKRLTSTNKEISKLLEVKIRLTEHIGKVGEPYTLVDPLTLELKQGDYIYGFVLITNKTSNVIPFDMFSVQLEGCAIFGKTNNSTLVEQPSHIDRFLNMFDFNALWNDAFLDRLVTEHNDPTHIGTIYDPIDGTYYHLDHRKILEPGITYKKYFTFKIPEKLLDSACEHLLIKHLQIPPTFGVCKNEVISSLRHKWKDQQNGAPEETASKKYKYASLTNDFAFNDTSISYCVSARVIGRALRVSTLVWFTWGCSCH

SEQ ID NO: 19444 - protein, 335 aa, Candida albicans
FAMNEFKLSVTPDEDVSAILPSYFMYKATVGVSVMTAEQMETQNIDPPTYINENNPGWSSSLISPILSENLSTSPVYAQQFVPSSESPVPITNEHQEVGSEEKILDNVYRLPNLSLYPNKVGDSIRLQIHFTKEIGELGKKPEFINPYVYEYQQGDVISGYIVIENASSKPIPFDMFVVLFEGVFMITNSDHGKSAIPVKIKKFLELFDFSASWTEATINRLRSESRNPYIWLDLVDPVDGISISLSNEKFLTPYKKYKRFFTFKIPHNLLDSECNNHNLSKHVKLPPTIGNISDNEQQIKTSTRSNYFFEDFSFSDTSISYGVTARFIGQSASE

SEQ ID NO: 19445 - protein, 284 aa, Candida albicans
AMFRNNYDNDSVTYSPTGRLFQVEYALEAIKQGSAAVGLTSNDYVVLVALKRNAEELGSYQKKIIKIDDHMGVALAGLAPDATVLSNFLRKQAMQCKMVFNRPIQTYKAVLSIADKAQENTQTYGSRPYGVGLLIAGYDETGAHLFEFQPSGSVLEYFGAAIGARSQAARTYLERNLEEIKKCDDVEKLVLHGLYALRDTLSQDVELTFKNTSVSIVGKDQSFVSYDDENVQQWLDKLDSVSNARNRDGDDDEDGDEQEEGNATQAQEGEGTEAPAEDRMETDE

SEQ ID NO: 19446 - protein, 537 aa, Candida albicans
IGLIFLILKAIFGSFHLFLPKLANINQVMGSNTSKTIMPASTKSPLPETEEEIFNEKPYSSTSTFDNFREQFEGLELENAENEINPISENILSKWEDDFKSQTKNLLAQNALAKNAIVDVIAKNSVGKQSLKDRYLFNITVDTIGSPAHLNNQKLSGRCWIFASSNVLRTHVIKNYNLKEDDFQLSQSYLYFYDKLEKANFFLENIEDTSSEDLDSRLISYLFSNPVNDGGQWDMIVNLVNKYGVVPNEVFPDNAQSTNSSKLNYVVTEKLREYGLKLRSLIAKDAPKNVISSFKASAIKSIYKTIALALGTPPKPTDEFLWEFIDKDGKYKSFKTNPLDFYKTYVRFDASEHFSLIHDPRNEYNKLYTVERLNNIFGGKPIEYINLEIDEIKQVAIKMLKDNEPVFFGSDVGKFSDSKSGILDTTAYDYSTAFDFSLDITKLQRLKVGSSQMTHAMVITGVHIDPQTNKPVRWKIENSWGEDSGQKGWFMMTDEWFDEYVFQIVTNKKYSGKKAYDIWKSKEFNTLPYYDPMGALA

SEQ ID NO: 19447 - protein, 244 aa, Candida albicans
GKEYTNSFYFNLEVEYASEAVKRGTCAVGVKGKNTVVLGCEKRTALKLQDPRITPSKICKVDHHILLAFAGLNADARILVDKARVEAQSHKLTLEDPVSVEYLTKYVAGVQQKYTQLGGVRPFGIATLIAGFDVRDDVPKLFQTEPSGVFNAWKAHAIGRSSKTVKEFLEKHYEEDLSEEETIKLTVKSLLEVVQTGAKNIEVSVLKPGAVIKKLDVDEIKKYVDAIEAEKAAEAEKKKQKSKD

SEQ ID NO: 19448 - protein, 323 aa, Candida albicans
EELDLSQVQNTTTVSTMVTLEDLENNQQQEENVIDQEILNSSTSDIINRTKLLDNDIKVMRSESQRLNHEKTVMLERIKDNQEKINNNKQLPYLVGNVVELLNLDADKEASEQGANIDIDAARAGKSAVIKTSTRQTIFLPMIGLVDPSKLKPNDLIGVNKDSYLVLDTLPSEYDSRVKAMEVDEKPTEDYSDIGGLDKQIEELIEAVVLPMKQADKFKNLGIKPPKGALMYGPPGTGKTLLARACAAQSGATFLKLAAPQLVQMFIGDGAKLVRDAFALAKEKAPTIIFIDELDAIGTKRFDSDKSGDRESSRRDGPQRLLY

SEQ ID NO: 19449 - protein, 635 aa, Candida albicans
LDQLIRRPLCVKKKLMAESKKSEILLSFLRTGKIDTSLLPAQNWPAGLDNIGNTCYLNSLLQYYFCIKPLRELILTFNENNFSANDYPETRKIGGRKVENMELQRSNQFVYQLRRLFQEMIYSNKRCVQPSKELAYLSFLPLSQPVNFKNQKKTDYLGRTTIEENKQVQLAETKDNQSVGTEFVHGELEGVLYQQSENGLSTDKDVTMTDGDDEINTEVKDIIDMDREVETGMEIETDVDESNKNYSMAVESPLSSRSMIEDEVETPDTSSSEDDVVGSSPKILPILSDQIESTIEVGRQQDVTECIENVTYQIETALPPQLIDKDGEQHDLIKQLFCGKTKQTITPLDKPDEPPRVSLERFFSLIINVSDHPKSIYDALDYYFNEDVVKLDEGLVKKSITILELPQILQFHVQRVLFDREKLMAYKSIEPIPFSDKIYLDRYLDTDDEEILYKRNQVFEWKREILKLQQYKFDLLKIDPETSVSLIDSLKITEKYLENKIILDDSLSIELSTIQTINDEIRKLTSNLEDIDNRLNELNHLISIQFQDYKSIAYNIFAVFIHRGEASYGHYWVYIKDPHYNNIIRKYNDEMVTEVLAIEIFNFLETNTATPYHIVYITEKLESSYIETFKREIKE

SEQ ID NO: 19450 - protein, 631 aa, Candida albicans
FIMMDNEATIPSSLASTEAENVDTETANSDKSLSHINRSSNSPETTSNQLQSNNPFRSSTLTVSVPSLESVPISQLRTRIANAELVSYPFKTLNRILDDLKWTIPVQEKYNFSMLNSKPIDYSEELSKVVNSSVTHFETLILNNDLEYCKSVEKVEYSNSQQVLYIMRGILLDKKHGTYHFRLAALETDSNPFVTKLIDKHQYHVIPKSSISAHDLQILLENTIDVDKIIDDAFFKSLNSPNGQILRVTLFKAEFTQEDLVPLTDEEIIRERYLEGIKRHPNLSPETIPNQLHCIKTLIKVLRGPVTLKPEDTIKTINLKNTVMDAQIDVNLLFEKLSFTLNGDEAVPPDLNNLPDLKESYIRKILELIFFAKNVMVPNNEFQTLYSFSDNMSQVFHTIVEYDKNVSVRHFSSNYSNRFPYFINLSASAYFSDELIIKCFELTVQSDSINQLYYVDSLKQIRSFRNNNGGYSVNNKLDIYFRQRNLIGYSDFLESMKILGLAVESNETETIDDDVIIAMYRSQFKNDPKNYQYYNNHLKRIAGIKNSEKLDDFIQKELLPIDLALEELSIEEITEDDVVITAYEFKLDELLELNGINGNANEVIFLNNALLSVAVHRKNYILLEYLENQIT

SEQ ID NO: 19451 - protein, 154 aa, Candida albicans
LFGRQKYINHYSSHIQSPQLLSMPGLNFDNYQRNAFLTSKGFATPKATSTGTTIVGCKFKDGVVIAADTRATSGPIVADKNCEKLHRLAPKIWCAGAGTAADTEMVTQLIASNLELHALSQNRQPRVIAALTMLKQHLFKYQGHLGGVFDCCWC

SEQ ID NO: 19452 - protein, 160 aa, Candida albicans
NNTCSNTRVTWGAYLIVAGVDPTGAHLMSVQAHGSTDIGKYQSLGSGSLNAMAVLETNFKEDMTRDEAIKLCSDAILAGVWNDLGSGSNVDVCVMEVGKDAELYRNYITPNVRIKKCKDYKFPRGTTAVLKQSIRDICDVEETVVNFNDNGDNMEVDTQA

SEQ ID NO: 19453 - protein, 398 aa, Candida albicans
MLIPITTKIPTTQMVDSTTTSAPAEPIDPERERALSKFKDKLLEHRKWDARLKDLRLSIRDLDKDYEKTENDIKALQSVGQIIGEVLKQLDDERYIVKTSSGPRYIVGCRNTIKKENLKNGVRVSLDMTTLTIMRILPREVDPLVYNMTTFEPGEISFNGIGGLTEQIRELREVIELPLKNPELFTRVGIKPPKGVLLYGPPGTGKTLLAKAVAATIGANFIFSPASAIVDKYIGESARLIREMFAYAKEHEPCIIFMDEVDAIGGRRFSEGTSADREIQRTLMELLNQMDGFDTLGQTKIIMATNRPDTLDPALLRAGRLDRKIEIGLPNEAGRLEIFKIHTSKVAKQGEFDFEAAVKMSDGFNGADIRNVVTEAGFFAIRDDRDSSPRAWKEPRLA

SEQ ID NO: 19454 - protein, 342 aa, Candida albicans
KNTYSSRILPLIMSTTATSTNELALLDKSVVVSPLVLLSVVDHYNRVAKDSKKRVVGVILGDNSTDTIKVTNSYAIPFEEDEKNPGVWFLDHNFIDSMGEMFKKINAKEKLIGWYHSGPKLKPSDLKINEVFRRYTDNPLLLIVDVQPREVGIPTDAYFAVDDIKNDGSAAEKTFIHVPSLIEAEEAEEIGVEHLLRDIRDQAAGNLSLRVSETHQSLLGLHQKLGEIANYLDKVYQKKLPMNHTILGKLQNVFNLLPNLMQQLGSDLDGGSDSSHALATAFTVKTNDELMIIYISTLVRAIIAFHDLIENKLENKKLNENKAQASVAELSLNSEKKDSIED

SEQ ID NO: 19455 - protein, 80 aa, Candida albicans
LYIDGRNFQVEYAMKAVENGGTSIGIKCKDGIVLAVEKIIQSKLLIPKKNKRIQTVDRNIGVIYSGLLPDGHHFVNRCRD

SEQ ID NO: 19456 - protein, 171 aa, Candida albicans
CQSFKSIFKIMMPISNLMDRMGIYVQNYTCYNSVRPFGIVSIIGGVDNEDGEPYLYMIEPSGSYWGYNGAATGKGRQIAKSELEKLNYEELTCLEAINHAARIIHLSHEDNKDKDYELEISWCSKEHTGGKHQFISDDLLEQARKLAEEEEEEEDDDEEEEAGADDEEMAP

SEQ ID NO: 19457 - protein, 83 aa, Candida albicans
DYNKLIELTKGFSGSDITALAKDSAMGPLRSLGDKLLSTPTEQIRPISLEDFENSLKYIRPSVSSDGLKEYEDWALKFGSSGA

SEQ ID NO: 19458 - protein, 179 aa, Candida albicans
NLILTNEKHQDKLIACIRGIDPTAAKQILNDVVVHGDEVYWDDIVGLEGAKNSLKEAVVYPFLRPDLFRGLREPTRGMLLFGPPGTGKTMLARAVGTESNCTFFSISSSSLTSKYLGESEKLVKALFLLAKKLAPLIVFMDEIDSLLGARTEGEIESTRRIRNEFFFNHGVWKEPRSGE

SEQ ID NO: 19459 - protein, 280 aa, Candida albicans
FVILKLKKKNREKIRNYYKQQIETNQPTNLYNYYHHPIQLLYISILDSLFIFLIFICLIVLFPHITMSIDKSAKYDRQLRLWASTGQSNLENSHICLINATSTGSEILKNLILPGIGQFTIIDEKKVTKQDLSSNFFLKNQDLNEDLAVAIQKNLNELNNDVNGHAIVESLSTILAQESNLFWDQFNVVIVSDYTPNLEPLINLLWSKQIPLFIVNTIGFYGSLNIIANETTVIETHDPSKLYDLRIDHPWPELQEFADSFDLDKLNDVEHAHVPYIVIC

SEQ ID NO: 19460 - protein, 348 aa, Candida albicans
GYIYSSSSSLFFSFIKIMAFDNVRDISSIEPLISNIGPYNEFSEEYNIENSFKALYESKILIIGAGGLGCEILKNLAMVGFKNLYIIDMDTIELSNLNRQFLFRMKDIGKSKAEIAAQFVRDRIDDPSLHIKSYFNKIQDKPIEFYQQFNLVISGLDSIEARRWINATLISLVPQGYMIPLIDGGTEGFRGQSRVIIPTVTSCFECSLDLLSTKVTYPVCTIANTPRLPEHCIEWATQIEWNDKFLGKKLDGDNPEHIEWVYQTALERANEFNIGGVTKHLTLGVVKNIIPAIASTNAIIAASCCNEAFILITDSNPILNNYMMYTGDDSIHTYTFEHSKKLICICSS

SEQ ID NO: 19461 - protein, 313 aa, Candida albicans
ITNQHIYTIDNRKTHNNNNNNLHTYIHTMNSIAQRYSHASQNDIVKEINSVHESLSSSSNIPQLELAPSIAIPPISQPTDFLRAHTDDSVNPDCKIKIAHGTTTLAFRFQGGIIVAVDSRATAGNWIASQTVNKVIRINPFLLGTMAGGAADCQFWETWLGTQCRLHELREKERISVAAASKILSNLVYQYKGMGLSMGTMVCGHTAKEGPTIYYVDSDGTRLKGDVFCVGSGQTFAYGVLDSEYKWDLSVEDALYLGKRSILAATHRDAYSGGSVNLYHVTEQGWTYHGNFNVGDLFWEVKEKEQSFVNVDG

SEQ ID NO: 19462 - protein, 304 aa, Candida albicans
FSNKETNNKFQRRTEGDVKNKRERESILFPIHSITMSEQLSADEIALYDRQIRLWGTSTQLKLRSTKILVINLGAIGSEIVKNLVLGGINTIEILDNSTIQPQDFAAQFFLPNNDAKVNENGDGGSGDESSYIGQLKLPLVIEKIRELNNRVNLSINTDMTIDQLNGDYLKKFDLIIATEINNKQEIFQLNKLTRDLNIPMYLTGMHGLFGYIITDLIEHESIVTKPKGNVSRQSGVQLSPNKTIINVTTHSSSSSSTTTTTTNDNEGSGSGKNELITIKDQFVPIESIFVSKKLPTQLTKKQL

SEQ ID NO: 19463 - protein, 104 aa, Candida albicans
SLIRPARRGENKMTEPDLPSIDIELLKQKSLEICHKFEIPQEIITEQYYEMFSRCAFTEFAPISAIVGGTVAQDVIQYLSGKESPINNVLILDSITLEMPIYLL

SEQ ID NO: 19464 - protein, 704 aa, Candida albicans
DIKRFFRGHENGSNKLANMFSNITKVGSSFNKIESLLISPTKLIILITTLNSLEIFEIVGNHINQIYHVPDSKNSLSFYVLYNDRRLFFVGTKKKLTIFQIINKSRNIFQFNKLKEVVMKDKIRSIDKFDEDSIIIGLVNNYVICEFADFGVSSLAIEKNDNMLSQGTSFSYFGLSSSTPVMWTIQISDDLFLLVKDTQIVKIDRRNGPSMILSSIKLSGIPIEVLFIYPIYLFVVYPKKIEIVDVTSGDLIQKLGHSINSGHSSIILTNSVISIASGADILQFNILPFQAQIDQFLSISGKGTLGNIKDPRNDLKYMGIEKAITLVSNIDDANSLFNDAKNKLMKLRYLYSLKATLLFESYSKYHEALVDISSEWLVSFADVLNLFPAFINGQLRSKDVTSDGNENKKNSSLNVIKRITVEELELNNYSESEYDTDNTTKKGMALKQPHGQSVKAQNIRKFIKAVNNLIIYLTDQRRILSTFMDKDVLTWKNIEINPSDIYPEFDGNLETVATVIDTSLFLCYFYCKPMLLGPLLRLPNNYCDSKIVNECLLSNIHNHVQQRNSKQPNFIKELLDFYYTRSLHEEALEMLYKLAHDEGTIEHSNEDDNKFDDFIKGPDLTIQYLRKLTDDNLYLVLKYSSWVIDQDKNAARPIFMNDSYECESYDNTKVLQFLCKKDQDLGIMYLEWLLFPSSSPRTADQRLL

SEQ ID NO: 19465 - protein, 60 aa, Candida albicans
YGNKPGLHMSGAGGNDNDDVCQYSPGKSPLVPITIGALNIGDEKASFSNWGSCVDLFVTW

SEQ ID NO: 19466 - protein, 356 aa, Candida albicans
KKEKNLLTLLLLDFFLKKFLSSHFIYIMRLSKAVAISILTSLIGVQGLLIPSVGDIIDVFGDSVQKQITNKLEPLKDAAHHAAEHLGMTLQEKLAPIVNSESTRDIIPHKYIVVFKQDVGANEIAFHQEWVALTHTNSLNGLDDQHSFFAATKDIKPEGGGITDTFDIGNLLNGYTGFFLDETIDLIRKNPLVAFVEKDSLVHANEFDIEKGAPWGLARVSHRQPLSLSSFDQYLYDSEAGAGVTAYVIDTGVNVKHEEFSGRAKWGKTIPQGDSDIDGNGHGTHCAGTIGSNDYGVAKKAEIVAVKVLRSNGSGTMSDVVKGVKYAAKSHQEAVKSSKKGFKGSTANMSLGGGKS

SEQ ID NO: 19467 - protein, 347 aa, Candida albicans
FGNINMYWVPIERGFLIIRKEGANPVLIELTEMLINLACVFIALIDKCFSNDLYFVSLKASESIDHFMEYDKRYPKHLQVRDFISNSIAIGDFKGFSGRFSKDIIDRLKRCPLVQEITEDIMFNALEFEIQEDAPRHLARISRRRRMKPNKPYPYMYETEYLGQGVNAYVIDSGIEVDHPEFEGRASAGYDFTEEGSGDNNGHGTHVAGLIGSVTYGVAKNVRIVEVKALNSKGAGSLSTILAAIDFAVNHRIESGRKGVANLSLGAYKNHILNKAIEQATNTGLVFVVAAGNSNINACMTSPASSKYAITVGAIDDYTDSVTAFSNWGECVDIFASSPRGWKIQRY

SEQ ID NO: 19468 - protein, 402 aa, Candida albicans
LIQIFVLQPFFFHISHLLSTTKTMVKLLLSIWISIYFMAGSSFASSSYLVSLHSQETIDTFMAYDATYPQDLQVGELINSKFKIGNFSGFSGSFSKDIIKRLERCPLVDEIVPDITVKAYDAVFQDLAPRHLARISRRKRMKPIKKYSYIYESDFIGKKVSAYVIDSGIAIGHPEFQGRARTGKDFTDEGPGDNNGHGTHVAGLIGSHTYGVAKGVQIIDVKALNSKGTGSLSTILVAIEFAVNHMLRSGRMGVANLSLGAYKNKLLNKAIDQATQTGLVFVVAAGNNNINACLTSPSSSPYAITVGAIDDYNDSIASFSNWGECVDLFASGAYVKSVNIRSDFRPLVLLGTSMAAPIVTGLVANLLNEGVDPELIKGQLIEMSTKHRMSKSSLFLKKRNPN

SEQ ID NO: 19469 - protein, 172 aa, Candida albicans
KSTGNVSIGGGISDALDLAVNAGTKAGLHISVAAGNDNADACQYSPARATGPITIGASNIRDEKASFSNWGSCVDLFAPGEDIESTFIWSDTTVMSGTSMASPHIAGLLSYYLSLQPDVTSEFYTQAIEPADLKNKLIKYGTKGVLTGLDSVSPNILAFNGAGGNLTDFWSL

SEQ ID NO: 19470 - protein, 80 aa, Candida albicans
SGTSMASPHICGLLSYFVSLQPGADSEFFVAADGISPSQLKKNLIAYGTSDVLSDIPEDTPNILAFNGAGHNLTKFWGNN

SEQ ID NO: 19471 - protein, 279 aa, Candida albicans
IVMTSIRYDYFKESGGSDGGLPTRTIISYKRFIYVGTLLAILIYGSSFLITTIENFTLKFESQSISSIDSFKGERPDYASPSLKSTDFKGKIPFSKEVYDKHILSPKLHSIQWIRAPESIHDDRGTYVIKEDKDDKSFRVVVKSIADEEYEKELIGNSIFKYKGEEHEIVDYFASPDLQKVILKTDVTSLWRYSSIAYYWVLDINNGDIKPVFNDVDKISTASWSPDSSKIAFIYENNLYYKSLQHDEIVQITFDGSTEIFNGKPDWVYEEEVMGPIMY

SEQ ID NO: 19472 - protein, 494 aa, Candida albicans
ASADPSSPRGRRNRLITEVVWIGDSLKVKTSNRHSDLLEIFLVDKHEKVNLIRTLTASDSWFEATSSTLYIPANKTLGRKYDGYLDIVVENGYNHLSYFSPPDNSEYELLTKGNWEVTGGVTFDFTSNTVYFTSTAKSPIERHIHSINLLDRSDNGLPYIKDITTKEGWYQSSFSSGARFLFLSELGPGVPTQRVNDLKMHKNVKTIEDNSELVETLRNYVVPEVKYSQVELDDKETGQPFLVTAMETLPLNFDKTKKYPVLFYIYGGPGSQTVTKKWALSFSSLIAAELDAIVVTIDGRGTGFNNLNYKLGSKFKFIVRDRLGQYEPIDVISAANKWAEKSYVDPERIAVWGWSYGGFLTLKTLETDIDNPIFNYAVAIAPVTRWRLYDSIYTERYLNTPQENPKGYETGSIHNVTNFKHVKKFFIGHGSGDDNVHVQNSLQLLDEFNLAEVENFEFMIFPDSNHGMNYHNGFNVVYDRILDFFKRAFDWEFV

SEQ ID NO: 19473 - protein, 291 aa, Candida albicans
  UNSURE (12): Identity of amino acid sequences at the above locations are unknown.
LVSSGENDKEEXQPTEEEKNAPLYGTHPLKLLRYIAKLANVSVGDILQWDLQLYDVQKGTKGGLNKEFVFAPRVDDRVCSFAALNALIDSTVDNNLAEDSFSIVGLFDNEEIGSLTRQGARGGLIELVVDRVLSSNFYNPEVLDIQESLRLTYANSIVLSADVNHLFNPNFPGVYLEHHKPLPNIGVTLSLDPNGHMATDSIGLALAEELAKKNGDKVQYFQIRNDSRSGGTIGPAISTSTGARTIDLGIPQLSMHSIRATLGSKDIGLGIKFFYGFFKNWRDVYDNFADL

SEQ ID NO: 19474 - protein, 291 aa, Candida albicans
  UNSURE (275): Identity of amino acid sequences at the above locations are unknown.
RKKGAQLINAISNSTFFPSFFPPKFYCNRYTNITFKMSNIDDILLSISESLKQLQKASQEKPIEQTQPVQIQNLEVNSTKKFTDDYYSKIADDYIEFTYKNPTIYHVVNFFKSQLELKGFTYLPESKSWADLKAGKYFTTRNGSSLAAFVVGKDWQASKGVGAIGSHIDSLTTVLKPNSTKAKVDGYELLGVAPYAGTLGSVWWDRDLGIGGRLLVKDGKGKVSQHLVDSTPHPIAHIPTLAPHFGAPANGPFNTETQAVPSSWFLLVKMIKKKXNLLKKKRMLHYMVHIH

SEQ ID NO: 19475 - protein, 318 aa, Candida albicans
ALLGLSLVKDNDTGKISRKLIKSHPDPIAFIPQLPEVFPESPKEYNTQTQMVPICGYTTETLVHTDEEKRSKFYTRHSLSLLRYVSKLAEVPLASIVDLDLDLVDIQTSCRGGLDNEFIYLGSLDDRLCAFDSVYGLIEYSQRFYLDKDIKTFDGLNGIYLANHEEIGSGSRTGAKGGFLIDVLKSIVSDKYKTHTPEAVANLTTNTIFLSSDVTHALNPNFKNVYLENNFPVPNTGPSIKFDSNFHVLSDSKGNEFLTRIIDDLPGIKLQHFHIRNDSRSGGTIGPIMSDSRRGINGAKSIIDVIRRRRWQVHAPPP

SEQ ID NO: 19476 - protein, 283 aa, Candida albicans
LSESLIFFCWFSYGNKLSQVNVTFFFILIIQLNMNPAYNPNPKETFVLITRDSDDSLISTTPDISETEFEDGENLSTPDISIIDDEYTDNEPIDEFENENQIPADLMFQFQLPDMSTTIPRLPSNQDVPSAKDDTFDNYYESYSEKYIEFMNNNPTTYHTISHFKSLLENNGFIFLPDNKPISDLSPGFYFTSKDDQCLVAFIIGGNWKPEKGSCFVGSHCDALSVKINPRGLLRDNVNGYELLGVAPYSGSLNKLWLSRDLGLAGSVLGKRQRYRKNITEID

SEQ ID NO: 19477 - protein, 578 aa, Candida albicans
APRKTHQNCNYKKIPSHFLSFFLFFSQLTSRTTKNIMKLSKSTLIATLALTATSTNALVVQNPFSNIQQALKLDLSYDKLTSKLTDTFEQGKANIISTIAKVMNEPLDGLTPEIKNIWLEMLMKFPNSITELNFKAPPKKGKITTQQFDFHVTDAQVPNHKLRIKSTPKDLGIDTVKQYSGYLDVVDEDKHFFYYFFESRNDPKNDPVILWLNGGPGCSSLTGLFFELGPSSIDKNLKPVYNPHSWNANASVIFLDQPINVGYSYSSQSVSNTIAAGKDVYAFLQLFFKNFPEYANLDFHIAGESYAGHYIPAFASEILTHPERNFNLTSVLIGNGLTDPLVQYEYYEPMACGEGGEPSVLEPEECDGMLNLLPRCLSLIESCYESGSVWSCVPATIYCNNGQMGPYQKTGRNVYDIRTMCEGSSLCYSQLEYIDQYLNLPEVKKALGAEVDEYQSCNFDINRNFMFAGDWMKPYQKNVIDLLEKELPVLIYAGDKDFICNWLGNQAWTNRLEWSGSKGFSKAPVKTWKVGKNAAGEVKNYKHFTFLRVFGGGHMVPYDQPENALDMVNRWISGDYKY

SEQ ID NO: 19478 - protein, 532 aa, Candida albicans
LIKIPPSFILTTLSKIWLFLALTFFSYLHNCTRNMKALLLLYTVITVVLALLSQTPFSLSPLQQLIDELAGKVSQTQILDMERIWINYQRQNGLETILKEFNQFKSQFQYSLASQDKSESTYSIEVSKASPELLGFDTVKQYTGYFNVNDKDKNYFFWFFESRNDPKNDPLVIWLNGGPGCSSLCGLALELGPSIINATLQPEYNPHAWNSNASVLFLDQPANVGFSYGGNIPITSDQASQDFVEFIKLFYERFPEYVDLDLHISGESYAGHYVPSFANAVHKAGIPLNSILIGNGVTDPVVQLGEVSNMGCGQGGIGKIYTDKECTEYPEKYEKFVPYGELCYKNPNALTCFIAALASPKTPDTGDLNPYDSRVKCGNNSLCYDQIDYLNDYFNLQSVQEALGVEKTYTMCSSNVGSRFVSDFMRPYHTYVADLLDDGIPVLIYVGDKDLVCDWLGNLAWVNKLNYTGHDQFEKTEFKPWYTADGKLAGEVKNHDHFTYLRIYESGHMVPMDQPENSLDMVNRWVRGDFKF

SEQ ID NO: 19479 - protein, 552 aa, Candida albicans
IKMQLSTLVTWLAALTVGAQAVSFGNNLKDQIILDSEESSPDLYLESVFKDLGSLPVDLITAWAEMQSELSPEQIAKLINQYDSKNEKPKKNKFNPMSTFSSPSSKFEKLSNDKFAGYSMRVKESFPEILGLDTVKQYTGYLDIDSLDKHLFYWFFESRNDPKNDPIILWLNGGPGCSSSTGLFFELGPSSINKTLHPVYNPYSWNSNASVIFLDQPVGVGYSYTGGDEVKNTLTAAKDVYVFLELFFQKFPQFLTNKFHIAGESYAGHYIPAFASEIINNADRSFELASVLIGNGITDPLIQDGSYKPMGCGEGGYKPVLTTEQCDQMERDYPRCAKLTKLCYSFQSALTCVPAQYYCDSRLFQPYAQTGLNPYDIRKDCAEQGGNCYVEMDYLDEYLNLDYVKEAVGASNIDIFTSCDDTVFRNFILDGDEMKPFQQYVAELLDNNVPVLIYAGDKDYICNWLGNLAWVNELEYSDSEHFAPKPLQLWKPDGKKAAGEVKNHKHFTFLRIYDAGHMVPFDQPENALSMVNTWVQGDYSFGLEGNKLSEAD

SEQ ID NO: 19480 - protein, 335 aa, Candida albicans
YNMSLRSKLSSLREYLTPINHNSNFVTTGEISPEEFVKAGDYLVYKFPTWQWGNDCPKNLQKSFLPPDKQYLVTRHVPSYQRASNYLTGEDKKGANPEEDDEEEEEEDEEGWVKSKKIHKVIDDTHDSQINKGEEINDIDDFIDENAEEQEHDQIGDHELDDDEFDDLDIINDSKNNKLRRFDLYITYSTSYRVPKLYLVGFDSNGIPLLPQQMFEDINSDYKDKTATIENLPVAHNTTSVSIHPCKHSSVMKVLMKHSKLNKKNLQQKDESLSDDLSKLSVNEKKTQDEHSQINNDDKEEEEEGIRVDHYLIIFLKFIASVTPGIEYDYTMDAL

SEQ ID NO: 19481 - protein, 381 aa, Candida albicans
LVLFFSISQSIKQTENNMIFNILSFISLAIFVDAVALKSNPKVISFDFELRFSDPIKRDTNFGTGTAAPVKDTHWSFPLKIGSNQDPVTLAADTGSWLIQINDANATCPNCHKHGTYNSSGSLTVVKLGKTARSFFTRLAYYIGELVSDSIQIGNLQIPQVTFNDVYNSTAGDGIFGLARPPSDKNQSIVWAAKYHGLVDKAAYSIYLQNLDGTPGALTVGGYDAAKVDGDITWTSIRNANVQAHLGHIEINEEIIDVNKNYTIDTGGRYGFLPEAAYNQVIANLPEDPKFGADRGQITCSLLEGKNFTYNLNGVDYTFPLRTLYVPTENTDHCYLALLKGNAAQLGAYVFRNLFVAVDFEDDLIGLASLKNTTATNIRPF

SEQ ID NO: 19482 - protein, 336 aa, Candida albicans
SPHKKGGKYDAPLTNYLNAQYFTEIQIGTPGQPFKVILDTGSSNLWVPSQDCTSLACFLHAKYDHDASSTYKVNGSEFSIQYGSGSMEGYISQDVLTIGDLVIPGQDFAEATSEPGLAFAFGKFDGILGLAYDTISVNHIVPPIYNAINQGLLEKPQFGFYLGSTDKDENDGGLATFGGYDASLFQGKITWLPIRRKAYWEVSFEGIGLGDEYAELHKTGAAIDTGTSLITLPSSLAEIINAKIGATKSWSGQYQVDCAKRDSLPDLTLTFAGYNFTLTPYDYILEVSGSCISVFTPMDFPQPIGDLAIVGDAFLRKYYSIYDLDKNAVGLAPSKV

SEQ ID NO: 19483 - protein, 241 aa, Candida albicans
LSPTLVLLAAVVENEELKVLKDFKKKDLETRGLEPEESFYSWDYNYYNERLLEQKYKVDHVKIAEYFPLESTVAKMLGFYEKIFDIKFVKVVKPDSASVWHEDVQQYAIYQNVKTKGKELEFMGWIYFDLHPREGKYGHAANFGLGPGYLEKDGKTRHTPITVLVCNFTKPSKDKPSLLKHDEVTTFFHELGHGIHNILSKTKYSRFHGTHVERDFVETPSQMLEYWTWSKNELKELFFTL

SEQ ID NO: 19484 - protein, 67 aa, Candida albicans
NIGLGLRMSSKNCSSHYRTGEPISDELIGQLIRTKHVNTGLFNLSQLFFGIFDMKLPPLAIKKIWTL

SEQ ID NO: 19485 - protein, 484 aa, Candida albicans
TSSSNPEDMESPTPGVNVQNYQPYIIPYLNLLEASGEFVTDDISFNLTTGDPIEFKNMTFLDVNDSNALVGGLGLAGTPKGSGFLYSLVDQGIIESPGYSLWFSNDSNPDTAIAQLLPGVINQKYYVGNFYQFDMIPHTGFRYNASYQEQNQDLFNLILPVIQISDILMVNLNSGQKLTMKSNDDQIPVLLDSRASNFYLPLEVIINLAIQTRAYYSSELTRWLVTCHPLLDVKAAIEIQIGGLTVSVPISKFIGRAVYNGSSLNFENGAEACVLKVVPSSVTGYNMLGLPFLKQIYLAVDNEGIKIALANLNKYLKRSKQDIFNDVANPDQHVYNNTAGELADITNSNSSSSDTTSSIESGHSGISGNSIDYIKSGKIPFATVYSESTEGTFIYSSLSQTSGATVILDIPARFSGASIKSGLIYLNGDSLTSVTTSAINSTSTSKAQANLNGQMNYVEVGTMKFPTAILSLVLSIFLIIITLL

SEQ ID NO: 19486 - protein, 225 aa, Candida albicans
LLTKMASTSTSKELKYAPEFVDFVNASHTPYHAVNSVKSLLSEAGFEEIHERTNWFKSHTLQKGGKYFVTRNGSSIIAFTIGEQFKNGNGIAIVGAHTDSPCLRIKPISKKTSEGFIQIGVEQYGGLIAHSWFDRDLSIAGRVYVNENGQFVPKLLKIDKPLLRIPTLAIHLDREVNTKFEFNKETKLVPIAGQTSIDKNEKESSASASEPVFTMGTAGPHYFRM

SEQ ID NO: 19487 - protein, 249 aa, Candida albicans
HKIEDFELILFDHQKSTIGGLNDEFIFSPRLDNLTSCFTAAKGLVESIENLPKEEGISLISLFDHEEIGSVSAQGADSTFLPDIIQRLTKFDFDNTNSSDNVDYFHETMSKSFLLSSDMAHGVHPNYADKYEGQNRPQLNLGPVIKINANQRYATNSPGIVLLKKVADKVQVPLQLFVVRNDSPCGSTIGPILAAKLGIRTLDLGNPQLSMHSIRETGGTFDILKLTDLFKSFFENYIELDRKILVDHL

SEQ ID NO: 19488 - protein, 290 aa, Candida albicans
LSMDLVIMNFVFLLYLTSVVKCSIKLDFNKVLTPSKYTKRDALPMPLINDKILYTTELEIGSNKDKVSVSIDTGSYDLWVMSNDAVCYKVSEFQTEGAPQLPDIFNDIDQDYSCTFNGTYNSKSSKTFKNTSEDFSIGYVDGSAAQGVWGYDSVQFGQYGVTGLKIGIANRSSVSDGILGIGIANGYDNFPVLLQKQGLINKIAYSVYLNSSNSTTGTILFGAIDHAKYKGALSTVPVDSKSQLSVNVTNLKTKNGNVASGGHSILLDTGSTFSIFPDDLHQTGQGPCRG

SEQ ID NO: 19489 - protein, 187 aa, Candida albicans
HDMISNTFKIRCPLPLKRISSTSIRTYRVMAIESSCDDSCVALLEKSHPKTPPKIIDQFKRTLHSADIGGILPTAAYNYHMATIANMVQEFCHKHQISALNPPDLLCVTRGPGMAGSLSTSTEFAKGLSVAWDVPLVGVHHMLGHLLTANLPNLEQPKLPPPNYPFLSLLCSGGHTMLVLLKSLTEP

SEQ ID NO: 19490 - protein, 182 aa, Candida albicans
  UNSURE (176): Identity of amino acid sequences at the above locations are unknown.
LSVNTRIANPYNFRLTLPYSAPKYGIPGDVKFAFSHFLSNIQEYKAMHYNKNRGEGESEGEGEIDLTLDEETKQFIAYKTQEFIFDHIVDRINIAFKKHGIKNRNSDGTFIGVKDFICSGGVAANNRLRQKLREKLDFQEIGTDNVNVNFHFPDLSLCTDNPILIGALFDHAARNXHAPPMR

SEQ ID NO: 19491 - protein, 170 aa, Candida albicans
NASADLAARGEDPYNTLEFHWYSAEEGGLLGSIDVFTRYSESNQVVVGMLQQDMTGYTQGSIDQGIEPHFGLIADYTSVELNNFLKQIITNYNSIPYHESECGYACSDHASALENGYPSSFLIESEMKYSNKYIHSTMDTIDRLDWAHIKEHVKLTVAYAYELSLARNLY

SEQ ID NO: 19492 - protein, 430 aa, Candida albicans
YHTHINAIITKMKSEIPPIKNTNYNCKIPRSTFFVVCVFSLLIYSLSTIYRSSGLVLPPLSFIDQIPENLSRSDPYLTLHVDISDDPLSDKIGQPELNPSPKHLHVGSKAMVASDVPLCSTMGKEILLRGGNAADAAVTVALCIGSVNSHSSGIRGGGFIVSRNNGDAISIDAREMAPGSAYKEMYGNLLVLSKIGGLSIAIPGELKGLYELFKLHGSGNLSWKQLFEPVIKLNRNGFKCLKIFETVLAKEYDLVLLRVPVLKDSWDFIFKPNGELLQEGDVITRPNYANTLELIANNGSSSIFYDPNGPIVQSLVSTIQKWGGIATVQDFSNYEVNLEKPLISTINNYTFYTSNGISSGLGLLAGLNFFDRVFNESDDDTLFTHKLVENFKWLSSIRTRFGDIDNRQDLIDKYTNSTWIDDVLDEEKVL

SEQ ID NO: 19493 - protein, 223 aa, Candida albicans
TKKKYSDEKTFHWKHYDPKYDIAEPQGTSHFSVVDENDNSVAMTTTVNLLFGSMIYDSKTGIILNDEMDDFALPNVSNAFNLTPSIFNFIHPGKRPLSSTAPTIIINDATNSTDFVIGAAGGSRITSAILQAIVRTYYRKYDLLSTIAFPRLHHQLIPESVMSENLTVWDQEHTGIASSMKKLGHTFLETGSLTAMNGIKRVKGGKLHGVSDWWRKRGELDGY

SEQ ID NO: 19494 - protein, 219 aa, Candida albicans
KTNNQLSTMADQEVLVLRGTLEGHNGWVTSLATTPAHPDLLLSGSRNKTLIKWKLTGGEDNQYGIPKKSFKGHSHIVQDVTISADGAYALSASWDRTLRLWDLETGETTQRFVGHKGDVLSVSIAKNLRQIVSASRDKTVKVWNTIGECMATLTGHNDWVSAVRISPSDQSSTVISASWDKTVKVCYSLFVLFFSFIVIYYCDDFLLYLLLQTLLASFE

SEQ ID NO: 19495 - protein, 141 aa, Candida albicans
SWDLADYSVNADFIGHTGYISCITLSPDGSLCASAGKDGVIILWDLNKNKTLYTLEAKAEVHALAFSPNRYWLAAATTSGIKIFKLQERSLLDELKPEFAVGATAKDPEAISLAWSADGQNLFAGYTDNVIKVWQVMTPSA

SEQ ID NO: 19496 - protein, 281 aa, Candida albicans
RILWIRGNRRSRFPNSITGKTEFIVSDNGKVGSRSKKGGTNVNGENNMDVEDNETPEFEDEKPTVQEEGEEEEEEEEEEEEEEEEEEELAGFEDDENNQEDANTSERVSNNDKDDKLAESNDELNAVSFANLDLPLPDDNEINLPNWQEGDLGSSISAYTLYGLSQLDFKKPTPIQKETIPIALLGKDVIGKATTGSGKTLAYGIPILEKYIQSLNLIKQNNKDKKINHPTGIIFAPTRELAHQVVDHLNKLAKYSPLSTRGIVSITGVFPYKSSPEGESW

SEQ ID NO: 19497 - protein, 365 aa, Candida albicans
TMAKQGKNKVSKPRKPPTLKQKLKKESKVVKAKDLQWKPVEIPDNLGDYEGFYGLEEIDGVDVQIVNGKTEFIVRDNGKVENKSKKEETNENGENNMDVEDNETPEVEDEKPTEQEEEEEEEFAGFEDDDNNQEDANTSERVSNNDKDDKLAESNDELNAVSFANLDLPLPDDNEINLPNWQEGDLGSSISAYTLYGLSQLDFKKPTPIQKETIPIALLGKDVIGKATTGSGKTLAYGIPILEKYIQSLNLIKQNNKDKKINHPTGIIFAPTRELAHQVVDHLNKLAKYSPLSTRGIVSITGGLSIQKQQRLLRHGPGIIVATPGRMLELVQGDSELAKRLASTDIIVLDEADRLLQDGHFDEFE

SEQ ID NO: 19498 - protein, 402 aa, Candida albicans
ILELFGKNRPKSKSIEWKWQTLVFSATFSRDLFRKLDRHQKGKSSSLMGNDEIVQLLNEKLKFKDKKPTLVDANPKEIVSGQITEALVECGPTERDLYLYYFLLMYKGSTLVFANSIDSVKRLVPLLNNLNIPAFSIHSSMIQKQRLRALEKFKEASQKNEVAVLVASDVAARGLDIPNIDHVVHYHLPRSADVYIHRSGRTARAGKEGVSAMFCSPQEASGPLRKLRRLGTGNSNKESRLNMHNDVKLLPIEMDLVSQIKPRVEISSKLADASISSTATRKEDSWVKQAAEDLGLDDLSGLEDFEDDIIKKQRKRKEGKMLSKDETKALKYELKTLLANPIKKNTRKSYITSGLQNLAHQMVTGAHHDDVLGHEKVNALSDLKGSKNKNKKIEKKRISKKK

SEQ ID NO: 19499 - protein, 112 aa, Candida albicans
TFIKMANEEKRSNKRQKLIDNYEAEKIAEASEESLRTHPHPSDKIELIHHDQGEFKGLIRHQTTAEQAQKLEDGPKNPFTGHDFTTKYFDILKTRRDLPVHAQREEIYLAPR

SEQ ID NO: 19500 - protein, 254 aa, Candida albicans
IKCGSLQPRGEDILKYMTDGMLLREAMEDHDLTRYPCIILDEAHERTLATDILMGLLKQVSVRRPDLKIIIMSATLDAEKFQNYFNNAPLLAVPGTTHPVEIYYTPEFQRDYLDAAIRTVLQIHATEGEGDILLFLTGEEEIEDACRKISLEGDELVREQNCGPLKVYPLYGSLPPHQQQKIFEPAPTNPNPNGRPGRKVIISTNIAETSLTIDGIVYVVDPGFSKQKVYNPRVRVESLLVSPISQASAQQRAG

SEQ ID NO: 19501 - protein, 170 aa, Candida albicans
  UNSURE (162): Identity of amino acid sequences at the above locations are unknown.
MLSVPNVFVRPALARKRADEAKLSFAQADGDHLTLINVYEAFISPEASEIGTHKWCRDNFLSYRSLTSAKNVRNQLQRLMQKYDLQLISQYNQVSEFEYWENVKKALVAGFFMQVAKKKLGNKGYLTVKDNQDVLIHPSTVLSKEGEWLIYNEFVLTCLHPXGLEGSALR

SEQ ID NO: 19502 - protein, 468 aa, Candida albicans
QPPKSSILTSTFIYLHMSTYQNSGYRPRGYSSGYPSRSRGGGSGGGNNRGGSSRGRFNNGYQQTSHTSYRQRQTPATSSYKARQNVYQQHSTPLRNNDFQMWMGDLDPQWTEESIDNLWTKLVSKPHHVKIMRDRLQPLKPSYCFVTFRDQESIDLAIQRNGQKVPDSNRVFKLNYSGRNSTGSHDRSTNLSNEYSIFIGDLAPEVSDAALYNKFNMKYPNQIKQAKVITDSSTRKSKGFGFVKFHSPDIMNRALKEMQGYNIGSKAIRVGLAAGSHVDTSFKPVTKLDHHRVPVPQLQPALNQFTDPNNTSFTIGGLSGRITESELEQHFIGFGDLVYCRVSKDYQTGYIKFYSRSAAESALLNMYGFMINDCRLQITWGSCVQVSGASVNYLPNVAGEIYEKAKKSPAIYHHPNYPYLRFDKLSSDEIKKLPQRLDGSDVLTTSQIDEFYLNNKRYREKLLNDALY

SEQ ID NO: 19503 - protein, 495 aa, Candida albicans
MPNYLVISLIMLLFYTLKVKCFPFPPFYLEAESEDIVDTMIRSIIQINLNEPEGDILCFLPGQEEIDNCVKSLEQLAPQLPREAPLIVPLPLYAALSPGQQSKIFEKLPKGRRKVILATNIAETSITVSGVKYVIDSGLRKIKVWKHNLGLSTLLTTPISQASARQRAGRAGRESEGKVFRLYPESTYMALPKQQESEIKRNDIILPVLTLKKLGVDDLLNWSWLEYPGQDAILSALNTLYTLGALNDSGKVTTLGYKMSILPLPPQLSVVLITAAEFGVLSPVIDIASCLSVDNLITNVTGEARDEINFKRRQHCPLGNIHGDLIALYEYFQAYQAQGKEWCKELAFSFKGFKNVEKIKYQLQEYMMTTIKQDDSLTNAEKNKQLAKLRAQLDNEETDKQLDVPSILKSFLKGYITNTAVGMPDRSFRTFNTGQLISVHPSSTLFGKPNMDAIMYIEYVFTTKGYARNVSGIELSWLQEIAPHVIGGVKVNIND

SEQ ID NO: 19504 - protein, 375 aa, Candida albicans
TYKAPKPMTDQIKGDEHNQVNGSKKRKRKRNKNKKNDNNTPVETSEPIPTPVYEDDIHRQNKKFKFNEEGEMEKPQESPEEEQLELVADQGEPCTEEPLPQHEGFEEIEVTDDIDETEEPENLPTRTQQEKHQHSKNKFKQKLEFKRKTVVYKDQDDEDDEEENNTFNFSQNSFQLAATAQQLLQIREKLPIYHHKDKIIEYINNNQVTIVIGETGSGKSTQIPQFLMPENPKMIGVTQPRRVAAASLAARVSEEYGCKLGQDVGYQVRFTNMTNRQTKLKYLTDGMLLREIMLDLNLTKYSTIILDEAHERTILTDLIMGFLKQIITSGKRKDLKIVVMSATLNAELFSNFFDNAPILYIEGKMFPISTILLRS

SEQ ID NO: 19505 - protein, 312 aa, Candida albicans
NSMMLDSELAAIFYEYTDKLREQHEKLLQTKKNQALIELSTYLRQVNSSLVEKSQTWESLYENLINDSRFQSNKNFQNLTKLNILQLYENEIFPRRIDDIKSQITVISKINYRNDRKARESYKKLLGELEIDADTEFKDIIDKIENNDAFIEICGRNGSSALELFWDIVDEKKQILKVKKNLVDSVISTMKNGNTYDEKMWESLETFSNALKSTRDERLANLDLTLGDGGKGKEITMIYTLLKEEFELKKQQEREKYLKKMDEDIAKLARWIYDNDRNLGENFLRMEGTRFVISNRVNYEDEYEKLLKFDQF

SEQ ID NO: 19506 - protein, 198 aa, Candida albicans
  UNSURE (188): Identity of amino acid sequences at the above locations are unknown.
RLNNPSIIMSSDWEELRTETGEVYYYNYKTNETSWTFPETEETLPVSEKQETITTSTTTGKWEEYTTDDGKKYYYNAITGETTWEKPNEIIEEELSNEKLAEKTELSELDKTLKSKPVELTGPTSKTDNEAKQSFLKLLSDNKVNSTWSFQAVMENLVDKPEYWSVKDPVTRKQLYEEYLVSKFQSDXHARPGWKINA

SEQ ID NO: 19507 - protein, 287 aa, Candida albicans
NQNSKKVFSLLTMDDDDELLLNFAAPDTSSVAASKNQNVKVLGGRWKDRRKLQLALQGRTKKRQPETGVNLIPVDESKRKRDSEDKVQLDSNKRSKFTESKGENGGKGDSYVSSLFTNNQPTSHLAPTSTTKELTYLPSNAPMKDATNFSGLGLNEKLSIHLTDHLRFMHPTKIQQLVIPSLISTENDLFVKAQTGSGKTLAFVLPIFHKLMRENKFKINRESGLFAIILTPTRELATQIYGVLETLTRCHHWIVPGIVIGGEKKKSEKARLRKGCNILVATPGEIG

SEQ ID NO: 19508 - protein, 79 aa, Candida albicans
LLHRGKLADHLENTKTLDISQLRWLVLDEGDKLMELGFEDTIAQITAKIDSNSKIADTAEKWQGLPSTKNKYVMFSYIA

SEQ ID NO: 19509 - protein, 227 aa, Candida albicans
IQIPKLLIPPRNGKGYHRRRINMLCSATLHSNVKKLGSIVLKDPEMISVETASVAGTVSFDETIATTTSTAPDQLIQNVVVVPPKLRLVTLDALLLKISKHSAERTIVFFSCSDSVDFHFDVFTRDGKKFKKVTDEETGEVKTVLVLPEDDENDGLLTAPQLSDNTIIYKLHGSLSQQTRASTLQSFVKDNNSYFKILFCPEVASPGLDLPNVANVLEYDPPFTIDD

SEQ ID NO: 19510 - protein, 153 aa, Candida albicans
GKLRVAHPREGNLRVKNYEKILQEGFAQGNIKSKDNKLGKWDIHATTWHLDVERWLLEDQASHDEAVRAFTSHIRAYATHLSSEREFFNVKLLHLGHLAKSFGLRETPKKLGKSVGNNSNYSESKKGKKEDPRKKMLRMAKMAVKSASSEFNY

SEQ ID NO: 19511 - protein, 272 aa, Candida albicans
LSTLESIDLSELDPRLVLDKASQRWLFEEGDQEYEYDYIKEQWVNTSKRSLSEDDTNKEDIKRQRKQDMSKLKEELNSLKQKKKNSSIFISNLPVDSGFSEIEEAFSKYGKISVGKDEKPRIKMYTNEKGSFKGEALIIYSNPESALLAIEMMDNAQYNGNTIRVEEAKFDNKKENPKKKQDSLSKAVIIRNMVRKKELANDIHIKQDIIDDIKEECKNIGISDIEDIVFNEENATVLVKFSKEELLLLCIKKFHNRYYDGLTLDVQESKVI

SEQ ID NO: 19512 - protein, 91 aa, Candida albicans
SIPLIMSSKQTKQTNLPPINLIFKFLQQLSVVTIWLYEQTQSRIQGKIRGFDEFMNIVIDDAVEWSNGKKSELGRILLKGDNITLISSLDV

SEQ ID NO: 19513 - protein, 634 aa, Candida albicans
ETDKVVVINQVPHQNHQMFHLEDLNVVDLTQMDSTTTEVDSTMVATTTTEVGSTTVGSITEVTGNQSFGGRGGRGGFNNGGGRYQRPTPGVGKWQDGKHEPAPRNEKLEVELFGTADDSHFQSSGINFDNYDDIPVEASGDKVPEPITSFTAPPLDELLVENIQLSRFTKPTPVQKYSVPIVAAGRDLMACAQTGSGKTGGFLFPVLSESYMKGPAPVPESNGAFSSHKVYPTILVMAPTRELVSQIYEESKKFSYRSWVRACVVYGGADIGQQMRNMDRGCDLLVATPGCFKDLLDRGKVSLANIRYLVLDEADRMLDMGFEPQIRYIVEECDMPAVKDRQTLMFSGTFPRDIQMLARDFLKDYVFLSVGRVGSTSENITQKILYVEDDEKKSVILDLLSANENGLTIVFTETKRMADNLADYLYDQGFPATAIHGDRSQYEREKALAAFKNGAAPILVATAVAARGLDIPNVSHVINYDLPSDIDDYVHRIGRTGRAGNVGIATAFFNRNNKNVVKGLIELLSEANQEVPDFLTKIAREGAFGKMTRGGGRGGSSRGPSRDFRRSGNSGWGNSGNSGWGNSGNASSSGWGGNSSSSYSNTNSNYGGGYNNNQRSNFSSGGSYGNQTGSNSWW

SEQ ID NO: 19514 - protein, 401 aa, Candida albicans
  UNSURE (87): Identity of amino acid sequences at the above locations are unknown.
KSKPIPHKNKNSDSFNEVFIHKTLLSSIKQHNDTDYVRCSIFNANGDMIQHGKEILKSQFIKRYNLTPRDFRKFNWQRSATGTTTIXFSSFSSAGQTSSGTSKSSSSSSLSSSPHSTISALSLSNSSLGSSTNVDIVPNITIRRNSILVQLLNIRALINHDQLIIFDNSSSFQNSHVSSYTHLQCLKDLSQRLKSTNLDGLPFEFKALEGILIYIVSNLNMEMKVHNTVLQNIITGLEDSIDRNKLRYLLIELKKIHQFHRKITLIKNCLEDLLENDDELNDLYITEKFNSEGDGQPRQGTNHEEIEMLLENYYQTIDEIVQIVENLKNQIKTTEDLINVVLDSNRNQLMLLGFKSSTGLLSMGVALYVSSIYGMTLESFIQDIDGGFEIVTVVSTIALNA

SEQ ID NO: 19515 - protein, 130 aa, Candida albicans
PRRRKKKITLRCHYQQTPAMLTFCPNCSNMLLISAGDDGLNRFYCSTCPYEFKINGLQMYDRKKLNRKEVDDVLGGEGTWDNVDQTAAQCPIDSCGGDKAYFFQLQIRSADEPMTTFYKCVKCGHRWKEN

SEQ ID NO: 19516 - protein, 394 aa, Candida albicans
RQNQNQNQIQGVQSAGQTPQQQSFSPQLQAAQQQQQQQQQQLRNANKSALQGQAPSQAPTPLPVRPTPQSQPTAQAGVASQAATSGFRASQPTPSQTSRTGSALQQRAPSRQASSTPQSQFQPPLPLESRHPSATTSEKPLPQQPGSGTAKSPSVAATPAQNNGTVTARSASPVATTTDSATTGRSGTPQQQSRSRSGSSLNLAGITRQSVPSLPISSSINVKQPTITTFNSINDTRPSLTGGAANPMSILLDTPAITKLPTFDIEGDTGVIDSSTSGRVLNKRKLGDLINTIGVDEGDGKTSIDGNVEEFLLDLADEFIHSVTSFACRLAKHRKVDSIEARDVQLHLDKNWNIKIPGYAMDEIRNTRKIQPSNSYSQKVQGVEVSKAVNDDNA

SEQ ID NO: 19517 - protein, 516 aa, Candida albicans
IMDSSAASSQEKRVGTSTPEAELNPHRAKALLAKFKEEMALAKAATDLQEREKHSELVEKIKRILIRYQEQQKQAKNNSPATKSNLTNQDSTTNTPSPLATNNNSATNVIEPKTETPDSTPMEQKPIQAPTPQHPNNASTSSATMLTTQFQPQPQPQQQTVTVEKYNHVKNTLKDMWKQVKTLEASSINETQTKKEEIDRKITELRNQMQKYHTAALRMKSKLIEQGTIPANSTPIGSPTPVSNTDPTPIANTTNTSNGTPPTEKAEGNSKPNVEPPSTTKARTSKSKPKPLSTTATNSTTKTSTPSKGSGSSKSNNRSSSQNTPGTSTSASATKTASVSTEKDAPLTATTSTSAVAPAAATVAATTAPTAAAAATSLSTASAITTKSTADPKVTPSNIPDNDGRVLTKRKLVEMINNISIDQGDAKIPIDNDVEDIFLDLADEFVRNVVQFSGRLAKHRKLDRIDVRDVQLNLERNWGLRIPGYSTDEIRAARKWQPEGEYAENVKKISKLNKDQ

SEQ ID NO: 19518 - protein, 241 aa, Candida albicans
  UNSURE (36),(39): Identity of amino acid sequences at the above locations are unknown.
PINKPEDEEMNVEFNNVDDQISPDDLPEQAQKQDDXQPXQSQSQTAETKIDTGDSAKPQNDDISSTAHPTGTANGTPPASVIPELPDLTRKDKSLKEVLDLMDGDFAPIIPDAVTDYYLAKNGFETSDIKIKRLLALATQKFISDIAQDAYEYSRIRSASAVYNSSNPQVRAKLLLQGQQYANQQTLTGNANNNGEGDQQQSLQSHSNAGNQQGKIVLTMEDLSNALSEYGMNTSRPDFYR

SEQ ID NO: 19519 - protein, 166 aa, Candida albicans
KGNISMYDAVNRKTNLLDRLKIAKQQGNLEKVQEIIEKLKDIDEILESQTSNQPTSKSLNTMTLVNERNRKLNSTNIRKAEIKFKSTAAQQQSDGDPFSRLKTATRMFYQDLINQENEKALKNVNMQQMIDEKTENEAKIAKSTYRDLGEMDKLIKTIDFDFELAV

SEQ ID NO: 19520 - protein, 427 aa, Candida albicans
NMSDLEDDLLALAGGEDNTYESDEEITSSKRKPIVADDYNEDDDEDTVLSKRRRVESGDDDDYEPQQPQQGEEEEGEEFQENELIDPYPLEGKYKDEADREALDNMDEMEREQILFERMQEMDKYRERKYLQERMIQQQQQQKNVVGRIEPTRSSGRSKTGLKPAKKDKLTELRKQRAQHSKRKSRREADYAEGSEDEEDEDDKEPEEEEEEDDDEEGFEEDYYDDYDGTVAWGGPSKVKKKRSTELAKLEDINRIKVGRTILTQYCFHSGFEDTIVDTFGKINLGMDRSTRQPIYRMVKIIDVKSRPERAYKLGHSNFDIFLTVSQNKDQKKDFPMSIFSDSPINQDEFDRYLKELNKTDEMIEFLDDVNSKFDELTKFYSKGLTDKDINDMIARKQKIQEKKGNISMYDAVVFTSAAGRTTFQRQ

SEQ ID NO: 19521 - protein, 334 aa, Candida albicans
KLAWMISGSLLLHDIIVLSIFLCSKSRSQENLPQRIRMSTENVSISNNCCLRYFVSNMLSAPEQDTTIPPGTESPHTEHVVENEYQDDDYVSLDEEDEELIWRVFFQKLEKHNKKSNNNDSELDESEESEDTSEEEEEETGDEDFDEDDLSDLSDIDDPALVATYKALMSEKVNKNLGEEEQRRLLISNFTDDQMERFEAYRRMTVNKPGVKKICNGIVGHTIPQIIAVVMAGVSKLFLGEIISKAFEIQERNSKGRLLMDIETKKKQKREIISSLQRGEEIEVDERALKFEGDEIHPLQPEHIREAWRLYQLENSVFSGSRKRKMGDDGPFYV

SEQ ID NO: 19522 - protein, 439 aa, Candida albicans
SLYIGLLTTYQLQTIATVSYRVLPPHLTKYTIMTITTASVPEELKTDKSVTPFIIRSIELSQANPIVSYYCKIYVLEHILTNKLHTTSKEIELFTIELLDDTESIKNNTEDEDFHKILNNKQLSLNVALSFTYKLFNSCLETLLNLTSSKQQQSALISKMKATLNFLSLLAVFKSLEDIDWEKISGGKANDWDSFDKLNKEKIKILKYQLSRLLKGEIQVKDELNDEELEKELDKELEEISGEDVEPEHHEQSGIEKETTEEINLPGAPNDMPKFIEEKDEHSPQLPRAPSTLNESNKGEEEDNDYDDSVKLPGVPHFPPDEEDDTVKLPGAPKYLPDDDLSHINKSSTIQVFPPTDGTQKKSDSPIKKPSATKHHPPLTKEGIKQILNRDDTITQVQKHAKFAQSALQFEDFSEAEKQLTQGLELLKILRKQEEEEGN

SEQ ID NO: 19523 - protein, 415 aa, Candida albicans
LKYSKTVDRKNVFKTLDICQILLVLHVVDPAKLNIDTDFEVPQEFLFNHPFYKYVKNNEIKKKRMVLKDGLLQPFQDVYRRFRPTKVDHRVILDIESKVDELIKLDNEADESHFELLDSKTAQQSRFGTSATPSAVNSPVAMRMEGPEVEPGRFSNVQDHENEEDDEEEDEEDYDDDDLQDDDMELHLEQELEKVLDGELSESEVTIPTLMAGILTNDVGNGISIMTNGEQSEDIDGDEQDDEEEEEEEEEDGDDEEEEEEEEEEENEEGDSESGKQHVKLLEEEIFELEKAVAHHQKNLSTASSKMLRMKFQNTYTSLKASLDLKKRDLAKLLDEQEQQQEQKQPKTTVDEKSQEAEHSVEAEAEIEAQVEADAEDGDEDEDIDQGDDMNQENNNNNGDLDIDEDNADDLDDLF

SEQ ID NO: 19524 - protein, 66 aa, Candida albicans
VYPKPKRMDVPKVCHHLELNLPEFLAEGYDSEAPDLEEDPLIEQRIIIRFLNDSKSDFLHNAVGSR

SEQ ID NO: 19525 - protein, 112 aa, Candida albicans
IQSFDTQFCIIQMSLLNTEFVTLVSSDNFKFVISKDVASISSVLRNSQGFEEGKTGKIKLDMDGDILECIVEYLYYHYKYKDSVTEGKDIPEFNIPTHLALELLVKADYLDI

SEQ ID NO: 19526 - protein, 451 aa, Candida albicans
SHLIMNLSLQDPFSVAKEFPETLTNTLNYGHSVAIQFNHKGDYLASGLSDGSIVIYEMVSSGVIAHLNQYCHIRPITSITWSKCGRYLLTSSQDWWVKLWDLSKVNITDAKDIDESPVIREVKFDGPIWLACMHPTNPFVFTASLFEDSPVYVDFTAKDQPPQITRLTTTPLEMNEPTEGDDEEEIARKRRKKMEKHMTLVLIFTHEGNYIFTGTSKGWLNIFDTTSSNLNLVRSIKITNSNIKNLMISQNGRKLAVNSSDRIIRQIDLPDLINVEDSNDWDFEIDHKYQDVVNRLQWNSISFNHNVEFLVASTHGQSSHDLYLWDTSMASLVKILEGSNEELVDVKWNYSRCTIGSIGLDSGIIYLWSVQFPQKWSALAPDFVEIEENIEYLEKEDEFDIIDEDELHKKRLEEEDYVADVLKMDTTDARGFDITQDSFIIPINYEKNFYE

SEQ ID NO: 19527 - protein, 342 aa, Candida albicans
  UNSURE (339): Identity of amino acid sequences at the above locations are unknown.
NACLNLTHFPLPFFFAFYLSIYKVILYFLINFIIHYFTNFPVLVYIFTHTNIHTHFYSTHQQRLIQDSSTMIMTTIPVKNRLKLIIPQPPKGGRILKTCTRCRRHKTKCDAQDTNPYPCSHCFKRNLDCTLETISKTGGKITSLDVVERLSVQVTDLKEVLDNIINRRNQMVELLIQRGKLLENFDDDINSTTTSIPEPPKLDSPKVYTPPVAEIQSCISTPALSPEVFPSKADFESPASNSKFIIACNKQFKAVTLTHKQALKHFTNYENNFNHYLPIFPHEFFTSLDLVAFHKENELLFWCIMLTSLLNQKQMYHEYQCLAEHVKHLVVSFNRRRAXVLV

SEQ ID NO: 19528 - protein, 541 aa, Candida albicans
LHCGGEFIQEFSRNQVSLGPDAERWRTRSWLAVFFCEQFWSSLLGLPPSINTTDYLLENARVDKSLPKNFRCLISLSIFQCKLVNIMGISVTRPDGLLEPLNRAGSLSLLDRELERLRFKLQFEEGGPIEVYYLYIKLMICCFAFLPGTPIEDQVKYVSFAYLSATRIVTIVSKMVNDISLIELPIYIRQAVTYSVFMLFKLHLSRYLIDKYVDSARQLIVTVHRLFRNTLSSWKDLQNDISRTAKVLENLNMVLYNYPEIFLNDLENEDSSIITRMRSHLTASLFYDLVWCVHEARRRSVLDKGKRQAQPNKKILPLPFYNQITKDDFKTITTTSPNGTTITTLVPTDQAMNQAKLKSFDSSKPLEINGIPLPMLEATGSTREVLDSLPSQSLPSQAPTLQQYPMQQDQQQQEPSQQQQQKHLQQLQQYQQQQQSNQQQPHLQHQRQFQQSPPPQFSMISSTPPLQQPPFILANSPLPQTYLPKIDEMNMSPEVKQENSVAPFASQITNFFDQQTSGWFNNDNQDDDFLGWFDVNMMQEK

SEQ ID NO: 19529 - protein, 177 aa, Candida albicans
  UNSURE (162),(175): Identity of amino acid sequences at the above locations are unknown.
TSIQQNAPLTHENSDNSPYALNTPENIEELQPISEFILGDVTLPLNRANELHDKFMTTHLPFLPIIISRSATELYHKSQLLFWAVILTASLSEPEPKLYMSLASLIKQLAIETCWIKTPRSTHVIQALIILSIWPLPNEKVLDDCSYRFVGLAKNLSVRSGXLRYRPGGRKINVXPP

SEQ ID NO: 19530 - protein, 733 aa, Candida albicans
FINNIQDTFESIMVLHLLNQLKITNNHIYSNIVPQDLDKRTIRAKPTNDYSLKSMIKNNTHQKLTIPITNTTKIKSVHDDSNSNIKRVKRSFKHNNIFVKLTKKKCIVVINYDKTKLSTITRSKLDTVPLLPNSTSFILENQNQNQVDTSILSEIQLPYKGILKYPDCIINDTDPTKLDTERFNKYLDEGIKLRNKTTCHLETETETETETETETKTEIETESQSQVSSNLLHPILNESNQSTESTPVPNYSNLNKSKINRIVLRDFEINTWYIAPYPEEYSQCEVLYICEYCLKYMNSPMSYRRHQLKNCNFSNNHPPGLEIYRDQKSKILIWEVDGRKNINYCQNLCLLAKLFLNSKTLYYDVEPFIFYVLTEIDEKNPSNYHFVGYFLKEKLNSSDYNVSCILTLPIYQRKGYGNLLIDFSYLLSRNEFKYGTPEKPLSDLGLLSYRNYWKVTIAYKLKQIYDKYFSCNANGDGDSVSDNARLSLSIDTLCKLTGMIPSDVIVGLEQLDSLARNPITHNYAIVINLDKINTEIAKWEKKLYTKLVYEKLLWKPMLFGPSGGINSAPSIQPPQPQSTSVTTTTMSAREGTTNSHPKPVIPQNSISLITNFLKDDINNPYTFEEEGFKEIEARRETENEEIKNASLVEYVTCYPGIVVNNHFVNGGGGGDGELNGSNDQIKGHKKMLKKRKRIIDDDDDDDDDDDEIEKIFEIDEIPSNDENFHYAVPAHAY

SEQ ID NO: 19531 - protein, 971 aa, Candida albicans
CTWMFISHMSAPPSIPTITTPGTSSTNTRRVARRACLSCREKKIKCNGEPMTTITAADGTNRIIPEKTRTCSNCRFLGIPCVFVQSNRGGKRKKRSTEHQLSDSEATTAPATHPNQLGQHQQLPPIKKTKSTPSIHNLDSGVVIPSINQQQERHQDGYRNEELASTERVSSYILDGNNSTKLPSPVLTHTTFDSRRDEGQRFNNQLRRSSTTTAGFLLPPPQELLGRRLVSYSPGPSSIKSQLPHLTSSSTTTSSVQSPPPPPPPPQPPRGMGIQFHEASHQPGIFPPPPPPPPPPPPHPDHLHHQYYGYPPPPPPPPPPPLHHHHHYPPSHHPGFGFSPPPPGPPGPPGPPPVPPKPHYHQSAPPESPPKEFKHRHPKYFHKQNNKGHRHRHHPHLHHHHPPPPHHHHHHPRDFQQHNGQDDIKSKHTDENSQNSKPSLPRWLDNMSVSSLDSSRSVSSPQSQHNDKSQYSNHKSSTQMSSCTNSVTQTLDRLPKIVSTQQNNLTPTSKILSNSPFTESELAKYDLPKWEVLNKIFNYYYIYNQPSHQIFPGKAILLENLALNTDSSIIHAIIATTCLIISKYDSSINIVADELYWINKMHKFWDNLNDLGILCCYKLLVKCTSIRFNIKKMNDINIKLWEMINNNQYVDIFKQKKFDFQESRIIPTFGTKRQNYERELTLKIIWSFYINNIILLRFNQGRPYYKLSSIMNGFKFDYDRDQYSNNILLPMSDIDYLSLKSAGNRANWNQLYEKSHIPTDATSLILSLKSFENSLSKLSNKDITFSNLISKDEFHVDLRNKLKTKYYEIIHDEKLVVINTNYWFSNIILRLSELIQYNYILCDIMVFKMCKYDWKTDLGCNSDDRGDSKDTNTTQGEKCRDADGNSIQHKEDYKDSVSNPGLLQHPLISDEIQLVEGLTTKLKSLNNNDWKILIEMIKSTNEYVDLIKLIPLSEYTDYSIVVGPTTFDEQL

SEQ ID NO: 19532 - protein, 315 aa, Candida albicans
LHDNFFFFSFYHLIKPGCKFIIMGKASKDKRDLYYRRAKEEGWRARSAFKLLQLNEEFNLFKDITRVVDLCAAPGSWSQVLSQKLGPDSTIVAVDLQPMTPIDGVTTIQADITHPKTLQRIRDCFGGEPADFVCSDGAPDVTGLHDLDEYIQSQLILSALQLTTCVLKPAGNFVAKIFRGRDIDLLYSQLSYLFDKVICAKPRSSRGTSLEAFIVCLGYKPRPGWKPTLDLTKSTEEFFEGADIGKQTTTQILEYSEEERKIAPFIACGDINDIDSDATYSLDLSTLTLDPVQKPTAPPYKKALEMKRRGDLHRR

SEQ ID NO: 19533 - protein, 148 aa, Candida albicans
TCRRKIRWGIMHPKSKSAIDVMDDMIDDEDDDDNEDDDDIIEIVENQPPPSPLPSHQIQQSKLAQGANGNSGTSLNQQQKGKELTEEQLYRQHEVKMIRKVGKYDFEDPFIDDQELQMEEEISSTKEGFFVYWGPLVDDRNSNKKKKR

SEQ ID NO: 19534 - protein, 484 aa, Candida albicans
GYQWTPFVITPKSTLDNWQREFNRWIPDIKFLVLQGDKDERAELIKNKVMTCDLDVIVSSYEIVIREKATLKKFDWQYIIIDEAHRIKNEESLLSQIIRMFHSRNRLLITGTPLQNNLRELWALLNFIVPDVFAENESFDEWFQKDSNNENGGEDQVVSQLHKVLKPFLLRRIKADVEKSLLPKKELNVYVKMSPMQKNLYQKILEKDIDAVNGANGKKESKTRLLNIVMQLRKCCNHPYLFEGVEPGPPYTTDEHLVYNSQKMLILDQLLKKFQQEGSRVLIFSQMSRMLDILEDYCYFREYQYCRIDGQTEHSDRINAIDEYNKPGSEKFIFLLTTRAGGLGINLTSADIVILFDSDWNPQADLQAMDRAHRIGQTKQVKVFRFITERAIEEKVLERAAQKLRLDQLVIQQGRNTGGLDGQQSSKAASKNELLDMIQFGAADMFQKTDGEGESIDIEQILKRSEERTQELNILQPPGLEGTE

SEQ ID NO: 19535 - protein, 109 aa, Candida albicans
LHYQNQTPSLDLNDVLNDRNKLSFQDNASKYFTKTEKQQVDIEKTSNRFKYLLGLTGLFRHFIEAKANKDPLFRKIVDNLHDSELKANKKKSDSAKKRKNGKGGRCLNC

SEQ ID NO: 19536 - protein, 285 aa, Candida albicans
  UNSURE (10): Identity of amino acid sequences at the above locations are unknown.
LVEERHSDGXNSGLKPPKQLNVYDHQSYPAKVLELYELEKNYYRKQVHYKVPLKAGTDEASQKENELEQKLEQEEIENSRPWTDEEKQLKEELMQKGYSNWNRRDFHHFILLSTKYGRNYIRLIALEFEDKTEEEVREYAKAFWQNYQEIDGYERYINQIEQGEEKIIKVKIQKEALRRKLSQYRYPLQELVLKFPPASTNKRVFSEEEDRFLLVQLYRFGIDLPDVYDRIREAIRQSPLFQLDFFFQSRNAGEISRRCNTLLGCILKEISPEQSSMPATNGRTF

SEQ ID NO: 19537 - protein, 222 aa, Candida albicans
LYISTLFFLSLQSMSTTTIDKLLELHQDLFLQSISHPLTNELCEGLLADFKLFTYLNQDLKFFQIGLNLFGKTLAYCDDSKSAIILGKQIGFISTDENDYFTRTLKELEQNDLTNVLNLKNNKTLILPKVQQYIDYLQYLTFESNSYVEIITFMYTMEKVYLGWAEYNVAQKTIPSNLPYKYQEWINLHYVPDFSKWFNFYKMKWKEWLKLKKILLFVKNHL

SEQ ID NO: 19538 - protein, 465 aa, Candida albicans
FDTSNSTIIIQPTMARRNRNKTVNEEEIELDEVDSFNANREKILLDEAGEYGRDDQSEEDDSEEEVMQVEEDSEGDEEDQEDEEEEEEEEEGEEEEEEKGWGGRQNYYGGDDVSDDEDAKQMTEEALRLQKKHLQELAMDDYKEEEKKEERQKKADSYDYKDTLSSTQQQQQQQLIIESNSSIANLEDSDKLKLLQQSFPEFIPLLKELNSLKVKLEDLQKLEDKNKCIETKIVALSAYLGAISSYFAIFVDNLNNEESFVSMKDNPIMETILSSREIWRQANELPDDIKLDDVKVHVSDVVSSSDIDDEDNFVDAKEEQSEDEEISEEEVSQDEDEDQSDDLDIDANSERIIKHVSKKHGDDFTEADIEDIDMEDKQRRKKTLRFYTSKIDKAAAKKDQSYSGDIDVPYKERLFERQQRLLEEARKRGLQKQDDENISDNDNDKAGVKDLERCLSTATIRSTIC

SEQ ID NO: 19539 - protein, 320 aa, Candida albicans
HKIEYIFRGAGPVTKSKKRNPFKFVFFLGKLVGDISIYFFLVTFARFLTMVLIVVDVLRKKNFDTGVVMNNITTSQMQPFKNKVGGHTPIFSISKQEICKELNNTERNFYKKISKNHPLFYYMPRYKGSNGSQIILEDLTSQMRTPCILDLKMGTRQYGCNATITKQQSHRAKARSTTTRKLGVRICGLQIFNYQNKYFYQDKYLGRKITVGKQFGKILAKFLYNGHDIYSLLNRIPHLIDQLKELYTIFTGLPGYRMYGSLILLMYEGGEDNLENQVKVKIIDFANAVIAGAEHIDNVTVAPQHPDSPKLGLFTKGKIP

SEQ ID NO: 19540 - protein, 491 aa, Candida albicans
  UNSURE (451): Identity of amino acid sequences at the above locations are unknown.
RTIILYKEKIAANTCKDLLPTIFTMKENQHESGAHALLKLGTKRENDNDNEAAQNNHINDAVEAAVMKYVGGTLGSHDSKKKRKHDADDYAFAQWTGFLDDNFMNEASSDAVVPSSTPPKKKKKKDKKKDKEKDKEKKKDKEKKKEKKKKKEKKKDKKDKKKKKKHRHRDHDEHAKNEEGPEQGDELTRHIEVEDNAVKENADTGYAADRNTVEKSTEERNIKARNVDQGNTRAGPTVEEKNQFHDIDEAQSKLIEAAIQNAHGLTHELNEAQEQRILEAANDVVASESFLNNDITLPNMGSQSNFSFTLNTFPVPVTATQDETKTRKRDIPKEPHKLPEYDFSTLSDVQTLTKDIYKKTLEWYNQNVKPEDRKKPRAFSPEEESYLDYYLAGYCHLTKMNREDLCQRVWASGVIKDGFWRNIYKVFSYRSVSSVYKHVRRKFHIFDVRAXWTKSDDEQLKQLTLTYPSKWKHIGKSWEECGQISRQTRGW

SEQ ID NO: 19541 - protein, 234 aa, Candida albicans
FPPHLGPVPGHSRGGGRLGKFNRDPKIPVFILSTRSGGLGINLTGADTVIFYDSDWNPAMDKQCQDRCHRIGQVRDVHIYRFVSEYTIESNIIKKANQKRQLDNVVIQEGEFTTDYFGKFSVRDLVSDSNIGKEITDRTIDFSGDAKMGNVLAQAEDEEDRVAAGAALKEVAIDDDDFKEETRSATTGATPAPTETNALSTTDGDAGFIDVDYEDGIGHIDEYMLRFISDGYYL

SEQ ID NO: 19542 - protein, 899 aa, Candida albicans
TGGLNSIKKFSPRSSKIINFDPTPLEIIQLKDEVIDAPKLTEKLQNFLNNDFKTPIIDESNVPDYNFTRDEYNTIMSQQEKLLRKLYHKVNIENSLELNGDKIERRKVILPQSNIKLTDPFRNTFSVKPKLHGAANNATHQDYLLAQGMAFSKVHQQMRKQHHLRTRKIAAMIDQHFKKKKGEKERLAKEREQNLKKMSRLTMQAVKKRWNQAQKVYQIIQNEKEEELKKIKGRQHLSEMLEHSTQLLEAQLTSSREPTVEAESDDNSTTFDDNTNDSDNFLSSEEEENEEDNTQQQINGNKKYDVNGKSNDENDMSLSVEELRKKYADLETSVEPLSSNVTSDKERESETSSEDAELSDDDDTDVTRGLASLYQNDEVADFATTTFEYSAEEKKLIEDLNQESDSRMNSLLDSDSVSSISDSESLEESSSDTEMDQLTVSEPPRLSETGSNTGLASLFTNGTIVLDEEDDASISSNFENESDESMNLSDRELEVNGNGKIDKIASTDEDDSNVEIVNGSKVKDVPIPLLLRGTLRPYQKQGLNWLASLYNNNTNGILADEMGLGKTIQTISLLAYLACEHHKWGPHLIIVPTSVMLNWEMEFKKFAPGFKVLTYYGSPQQRAQKRKGWNKPDAFHVCITSYQLVVQDQQSFKRRRWTYMILDEAHNIKNFRSTRWRALLNFNTENRLLLTGTPLQNNLMELWSLLYFLMPSSKVNQAMPEGFANLDDFQQWFGKPVNRILEQTSAGNSDLIDENERTTQKMDEETRNTVARLHQVLRPYLLRRLKKDVEKQMPGKYEHIVYCRLSKRQRFLYDDFMSRAKTKETLASGNFLSIINCLMQLRKVCNHPDLFEVRPIVTSFAMPRSIPSYYQSTNELVKRQFNKDEKVSFQALNLDVTGC

SEQ ID NO: 19543 - protein, 1323 aa, Candida albicans
NLPIMDAGTGALTSKARLRQHLLHGEQDIDTLSESLQQHQYQQQQQNPKYNRFQPAYMQQQQQQFMNVPGAVSHTNLITSASTTNYDIMTPLPTSGSPFTSNSNPSYTNINTNSSRKSSMTSQTAAGVNRFFRRNKGADLNFNEDSGADIMDLTNGSSVSFDDITHMRNRGPYAMNSHKALDTAPIIPTLGAGGTLCGLGPASGSKVNNVQYRKQMNQQKKLAMINGARANSLATGNPMMGQQSQYMGGGPNDPRTMSMVNSNPRTMSLNSQGPRTMSMRSGPFPQRLPYNPQLQQQQQPPPPPQQQVYGPGGAAPRTQSLRTGPYPPQQMPMGNGVPPNGPRTMSLMNGGMPNNGPRSMSLMNGGMPQNYPRTKSLGTLGPPLGYQGPPLRSQNLVPANPSQQQQQQMDHGYGVPPQEQQYSQPTQQAFAPGQQPFIPRNAPQLRQQQQKQQPPQQQQYSQWQNLQPQPQQLSQNSSDSLQEAIVEEEEEEEPQLLRANNFSVDPASQNKSEKRDEENMIYNFENEDPDAALSRKSTLKKNNSMRVRKLNLFNDEKPQTGKKALSRKKPPVSPADANFGPVSSNDSVQNSVKDLPRIPDTSNEDLHQKSPTPNEEEEDLNEVPGSPTFNVSAPPTRESYLDDEDANPSNDGYKALGANARASTHDIFVTALDFNSPQKSNRSMKIGSPHTSPQKSRILGTSDFPSPNVEKDQSDEQSTIQEDTVGADTSVEDTVSKTSPPLNNSSINRTILDSNLKFRNIVANTVFSKFRSPSAESTPKFSSPAIANRFADGDERQQQGSETSSVYESNTPRKMLKYDLNNSDTDDSEIRRRDQNGFFEQSTNGETTPPTSSTSNISHKVGEKYTYMGEEQEGNNTNSFDQFSSLLQHSQQEEKQQGRSNSHSSNANSYDGSFYQNFSEPIHDIPEEQRRSQDKTPDFTQFNNNNNNSKLGNVELEQDSLPKSILARRSSSGESMKMLLTSHGSATKLSSAAAAAPASGQAINKRSSFSLNGTKNIFKRFSKSGRRTSSIDENDSTLNPILSRNSSMTQASKQPLFNKRVSSSGNMSLSDLSVIKTATNQKQPLTFTKEEMSIMNCNNDLLNELELVTTELASSIKRELALESKLRNSPQQQQNSPKLDEELKSEITEKSRVIADLQEKLSKERRLRFISEEHALLGEHGQAPSALKLNYEKTELYKQLLIKNDLVHQLEDKLSEYERRNSGLFQHERPSHDIDLLEKYNELLKENTNLKVHVIPDLERKLTEKNQVDDYDESQLEIQTLKMQRDELREVVNKLTSLNNAELKLAQDKIKHLQLFATAEVPT

SEQ ID NO: 19544 - protein, 404 aa, Candida albicans
ALYFPARRSRVGCHFFFSTPAMSEQPTEPLSIKEEYQLWRKNCRYMYEFVSETALMWPSLTIQWLPNYTTTNGLIDAKLLLGTHTSNQSANQLKVASTQLLADPNVKANSKIKTVQKLENNAEICRARYMPQDANIVATINGLGEVDLYNLDTETRYSHFAPHTKNGYGLSWNPKQKGLLVTGADDNFVCVTDTTTNKTTFKSDIQKDIVNDVKWHQFNGNLFASVSEDSHVYLFDARDNKVVSQYYAESSNGINSLAFSPFAENLVAIGNTSSNINLLDLRKLGENSGLLHTMMGHSEGITCMEFSPHHDGILATGSQDRRIIIWDLFKVGEEQQQEDAEHGCPELFMMHAGHTAGVSDLSWCSFQRLDDPAQLLTNNIVHLWEGTKKLITNEETEVDVSILE

SEQ ID NO: 19545 - protein, 498 aa, Candida albicans
KYSTLSKGKYTDPMFSRPLEEMSKEQDMTKEKKMDYKTNNFRKTISQHLLLFRYQQLHIMPSSTNEFAKAERELVEEQQLQEKIVNEEFKIWKKTVPLLYDFIHTFALDNPSLVFQWLPTTSVSQSDLELKFLIGTNAINKSENYLKLTSISLPSTLVGATDSIPVPSDGIDTSNFKVVTQWKQTQEINKLKVSPNGSLAVGFSADGVIRSYNLDNFDSVDYKYHKQGGIALDWVDNNGFLSGSNDAQIALWQVDKSSTPLQLFKGHHGAINDISSIKEKHLFGSVSDDSTTQFHDTRVNATDINPVITVENSHIQNCIQFHPDIQTLYATGGKDNVVSLYDIRNYSTPFRKFYGHNDSVRQLQWDWNNPDILVSCGLDKRIIFWDLKNLDEDFTYPDATSNGKDTNSKRKQAVKTDPCLKYVHGGHTRRTNDFDIHPKVKNIFGSVGDDKLLEIWKPKSLPGDEPEQESTEVQEDEEMKDAETKGVKDGEEDTKMKD

SEQ ID NO: 19546 - protein, 425 aa, Candida albicans
FLLTYYFGDIDIAMLSPKSTNQEAPATAPLDDINTTKDVSMVDVSKAEGENQQPPRRKSTIILTDEIDLDRMNIDNKESDKSNEQGDKMHIDRSLSNLNQQQHSQSSQSEPSQPEQQQQQQQQQQQQQQQPVAPDANIAVPVDIKWVQGGQKVYVTGSFTGWRKMIGLVKQPDDNFMITLGLPVGTHRFRFVVDNELRFSDFLPTATDQMGNFVNYIEITPENVQQHLLQEKEESNNESQQQELEKQQAKTGDKTSSQQASRRYSVSRSRSNSMWGLTNDDDDMGDGYSRYHDDESNALDEKTYQYIKDIPPIFTDPKVMEQYYVAIDKQSRNNNGQQQAWLHPPQLPPHLESVILNNFNNTENNSGALPIPNHVVLNHLATTSIKHNTLAVASIVRYNRKYLTQVLYAPLQQASLSSTTQEQQL

SEQ ID NO: 19547 - protein, 443 aa, Candida albicans
  UNSURE (443): Identity of amino acid sequences at the above locations are unknown.
HLHNTWEKYQDLKLFKGFRKLDNYIKQFIIYDDEIRNDPLTTKEDLEAMDIERERKRDEQDEYTHVERIVDSKRVETDDGETKLQYFVKWKRLYYDECSWEDAEEIAKIAPEQVTKYQQRLNSKILPSLSANYPLSQRPRFEKLFKQPVFIKNGELRDFQLTGLNWMAFLWSRNENGILADEMGLGKTVQTVAFLSWLIYARRQNGPHLVVVPLSTVPAWQETFEKWAPDVNCVYYLGNGEARKTIREYELYNQNIKPKFNVLLTTYEYILKDKNELGAFKWQFLAVDEAHRLKDAESSLYEALKGFKVSNRLLITGTPLLNNVKELAALCNFLMPGKFTIDQEIDFETIDSEQEQYIKDLQKKISPFILRRLKKDVEKSLPSKSERILRVELSDIQIEYYKNIITKNYAALNAGNRGSQISLLNIMSELKKVSFHRSGLMFX

SEQ ID NO: 19548 - protein, 214 aa, Candida albicans
DYMFIKGYQFQRLDGTVPSSKRKIAIDHFNAPGSKDFAFLLSTRAGGLGINLMTADTVIIFDSDWNPQADLQAMARAHRIGQKNHVSVYRFVSKDTVEEQILERARKKMVLEYAIISLGITDPSAKNGSKTEPSTNELSQILKFGAGTMFKENNNQQKLENLNLDDVLSHAEDHVTTPELGESNLGSEEFLKQFEVTDYKADVEWVFTTGLEGT

SEQ ID NO: 19549 - protein, 417 aa, Candida albicans
RSILKWGDLSGKWEQLVEEGSITNENPVLVKHAYNEIISTSKQLVKEEEARRAVVLAELERKAEEQKRRPPVPGEPNQTALWIAKKKEKKAVLFEYQGVKNINAEIVLNRPVDMKLLEKIVTKTDSTNFVLPRHPKLVQAWSCEWTAKDDAMLLVGVYKFGYGSWVQIRDDPLLGLQNKLFLENPAAGKDATANQDGKESVKKVPGSVHLGRRVDYLFTLLRDEESDSSVGGSTPVGSVRKRIRKSTPVPHNSGSSNGSHNTLSGNSNGGTANNTGKHRKPVKLESSEKLAKQKRMNQQRSSASASPALGHAKFKEEKRDLEYESMDEGSCKSIMQPVTSSLHKLHKGSKGLDKHEWAKILKSELLNIGDFIESEVSKVQNKDKLRKHLWSFTGLYWPSKVPSNKIGAMYNRLKQSN

SEQ ID NO: 19550 - protein, 350 aa, Candida albicans
WLIYSTDEFTQCSEFLRHQTFMVSPAYLEKHGIRVNHTIHREGEFIITYPYGYHAGFNYDYNLAESVNFALDDWFEFGKRTKKCECISDSVGINIKHLWEKYYGTKYEAVKEEDGRDGGLEADSDGSIEVVKVEKIQRKCRKRKQDNVHTTNTHERVSTKRPHKQPDIPHECALCPNTLQHTKYSHSALFELLQADTYGTTPERPRRVHKICASMFPHQLKCDFKTNTVHGLDDITKNQKKLRCGVCRQSEMGACFQCSYKKCTRAFHGTCGLVDGVQYDFDSGEAFCKFHRQGPTSAEFKVGMYVQFLFNHGVYFGQLVNLGDGDVEVEVYPSTRDVIEIPTTSIINVV

SEQ ID NO: 19551 - protein, 81 aa, Candida albicans
TTNNHPLSYLTVQKFYPTALADKTWDNTGLLVDSSSFEDSDSETNTKLPVKVLLTIDLTQAVADEAISKTSIHYSPAAEIK

SEQ ID NO: 19552 - protein, 74 aa, Candida albicans
TTNNHPLSYLTVQKFYPTALADKTWDNTGLLVDSSSFEDSDSETNTKLPVKVLLTIDLTQPVADEALNRRLRSN

SEQ ID NO: 19553 - protein, 101 aa, Candida albicans
PSSFIQKDGIGTRHLRQIAICAWFWKVPFLKGVEADLYYTGELSHHEALFSKKSGSSVICCNHSHTERAFLKVIQEQLKNELNEADQVIISETDKDPFETW

SEQ ID NO: 19554 - protein, 233 aa, Candida albicans
NIPYTTTTYVPTDPPFLPMFSIKQQKEKERQLIEAVNSRGNDNKCGECGASHPTWASYTLGILLCGRCASVHKRVLGPPNHNISKVKSLTLDNWTEEQINQLRRIGNKKAKRKWNSKRIPFPYDGDDDVSAVEQYLRDKYIAGKFRDDGIDNSEYDDRSSKFSDADQGSSYSQRALTRLRSNSARSQSASIPRLTHRKLTTFEYTQYYTQAMKIRLYGYHDREFSTAGAIQEG

SEQ ID NO: 19555 - protein, 1394 aa, Candida albicans
SILISIMNISSMLSSDNNVSLKESMTTATDQQQQQQRTELVDHASINGNGQTSVLAVNNVQENHLSEFHSLNQQHSSIPPVGTTVEHATTTTTTATNHQPVNLSPLKHSVDENSNPTTISSLKKDTNSIIASILPESYQFDNSYTPTIDQKYKSVFESNINVINQLDQYQQMGHHLKLMKFDEVKLNNYLINTGQFASNYIDRVVAEDISSRNNKISETNKNKELIAIDYSKPLHHNSTRGKEFKWGSTRKIHKVEHKSRRRKPAATTSTTDDSNKAVAAAANGTKDHSATAGTTASANGSDTPDRRHQRQSSKPSTPILIKPKTEPGKGLPEIQPRRSSRPKVKRKAFEDELETADKQSSTQQVKKSQESTGRDHKRVKIENKQEEQQQHQQQQQADEEDEAEAEAEAEQKPKSGALSEAAAAGMTAKEFKAFMRQYDNTYIAIWKDLSRKDGPKGSRLMQQATQGRLINLRKTALLAAREAKRWQLKNTKNQKDLTTKARRAMREMFNFWKRNERLERDLKKKHEKELLDKAKKEEEEREAKRQLRKLNFLITQTELYSHFIGKKIKTDELEGTNADDNLKSNTKEHLDKYADVDGSATHDINAVDFDNDDEEALRRMAAQNAQNALIEVQNKAKQFDNSEESFKNPDTNGEEMNFQNPTLLGDITIPQPNMLKCTLKEYQLKGLNWLANLYEQGINGILADEMGLGKTVQSISVLAYLAETYNMWGPFLVVTPASTLHNWQQEITKFVPEFKVLPYWGNAKDRKILRKFWDRKSLRYDKDSPFHVLVTSYQLIVADIAYFQKMKWQYMILDEAQAIKSSSSSRWKSLLNLTCRNRLLLTGTPIQNSMQELWALLHFIMPSIFDSHDEFSDWFAKDIESHAQSNTSLDEQQLRRLHMILKPFMLRRIKKNVQSELGDKVEIDVYCDLTTRQKKLYQQLRSQISMLDTDLLELESNSTSSDSSLANLVMQFRKVCNHPDLFERADVNSPFSFGKFAETGSFLRETNELDVNYSTENIVQYDLPRLIYDELLTPNYNKLTRDSIYSKFSIYNPENMNATGWLQGINVSPNELKHYSQMDILSRAIEMQNKPTETEKLERINYLYEGDYIPKNKKLLITDHSTSTNSSFISNSLVFSDLVSIKEKVGEDMYLNKLEPAVTPIASAPPITVNCSSMNFTNKMNNTLFDSNIRSSLIPLSLSTELKLMKDQIPLEQYPKSNMLPMPIFDYSNIRMPSMDRFIAESGKLAKLDELLIDLKRGGHRILIYFQMTRMMQIFEEYLAYKSYKYIRLDGSTTIESRREMVQAWQTNPEIFIFMLSTRAGGLGLNLTSADTVIFYDSDWNPTIDSQAMDRAHRIGQTKQVKVFRLVTRNTIEQKILERAKEKEEIQKLVVGNM

SEQ ID NO: 19556 - protein, 568 aa, Candida albicans
PNFLLNQTSTRKIPPRKKRNTRSQTKIHQQLEGDEYNSNDYKDLIDLDKPPVVEPSPPFFVESDTTPEFVIPTPTLEQQQQQHHKLIAQDYQRSNNSNQFGNLTHYEPNFPPLPPLSESILPQTNTFHPLVLPHDPRHAITAGPANNSQQQQQRQQQDSLIPSDGISSKIQQLHAPSLSNNQSASQRKKKESSGPKTRPAFVMKIWSMVNDPANHEFIRWNDDGKTFQVFHREDFMKVILPKYFKHNNFASFVRQLNMYGWHKVQDVANGTLNQNSDKNGPDEIWQFENPNFIKDREDLLDKIVRYKSSSNQDDVSGVSFNGINNSANLSLILQELDTIKTNQYVISEDLRRVRQDNKMLWQENYLNRERNQVQGRTLDKILKFLSVVYGNNANKILNGHGFADFSDSNNIMTQYRPSPMGSPLILRPQTQPPPSNSRFARDNNQTAQPTYESPLSTSDTNNNNNNSTFEYQQAVNRPRLMLTNRAHSRRPSMSRTKSTPEGSIEEIIRSYSNDKAAESNVNRMYEQLVGHQPGATTNNNNHSSLTAISAPSPRHSFLQELDPTRHFS

SEQ ID NO: 19557 - protein, 496 aa, Candida albicans
YLAKGLREKKKKSKHTYLLQRVEYTTVTVFWNEINCGISIPSMSTSQANIRSVIHEYEILYTTRIQQKSKNWNDGKLTFYEFNKKIEIHNDDGMLLATDFYRSRLISSVLNSVLVDNSEFRLPNANYLIQIQDKIRVFEREVNLRAKTSDSQKVEKLATKNESVPKRDTIISKSPSLGHPSMSHRKVTSRNLVTTDTKNQNLSINGILTKLIYSSMGATRMKKTHSPKNNRIHNIAKPSSSGSNINKGLTASKPLRYQGSNVTKTTQNISGTTTGAKISQYKVHSNDLLTIDSKVSKRLPLRIPPRTSTCFQYIYTPRNDIEKFDVAANDISIYKPLIISGNEPSGEEPIQEKENGQEYVGSKGYDENQKKNENMHNSHDKEMKVNSRPSQPKIVDEYTNTDSVTFSNNEISRISVKKEQPLIVSNTTVDDTDIVYDLSDYEENEKFNAMIKKIKQTQNLQDNSSTSVVNKKPNIVKTGLEAVEFCLSTDSEMEEI

SEQ ID NO: 19558 - protein, 208 aa, Candida albicans
YLLLMFRLFARRNYSIHWRFKDVCPSPRYDTGCTYCQPEFPTNLAIDFDKNLNKTGAIPTKHVMVLTNPINQISELHSKTEFIPNSIPSEITKYRTMIQTDDQRVTISVIHLNNNRHQQILDQYNIKPGSSQQLVFLYPSMKIIRFDLSVLDQFVKKYLYSKPTAPVYNPFVQTKPSAPNNDLFDSIIVDESNFIEDEASSPRNEVRV

SEQ ID NO: 19559 - protein, 382 aa, Candida albicans
LKDQDPAIWILKHFLKSMSEICDWVQFVDPKDETNERHFLRRLYNNWDSEQQGVLTFSDLVVGLNSLVDPDLMASMSNYFELYDTNHNGKLNSEAILQISEDLLYITSPWKEGYLLDEITRLAVENEVAEEVFKNQVANGDGLTIDLPQHVEVNREKIEQQQIERYLRAASTFIQRAFEYAQPEDQELLIKDLAIDEKLSHNAALNPNTPVYLNLPTFRMVILADETYELLFSHTLREATHLNRPLDSSFNPMRNLRDMFDGLLADGRKVANKVRLRMDSRASNPGGSSSALVKSNKSTSKTGAGDEDDERDDDFGMISIDEQDKDLLLGAEAQSLVDPIKSEVATANTLERFHRAALEARNHIHKDGANGNHTENLIEFEQ

SEQ ID NO: 19560 - protein, 360 aa, Candida albicans
  UNSURE (13): Identity of amino acid sequences at the above locations are unknown.
GRGSDARIGEHEXPTKLKMWFDLFQTDGRNLSLVRKPLFYKLIRVGLPNRLRGEIWELTCGSMYLRLEHQGEYIQLLEEHKDKKSFAIEEIEKDLNRSLPEYAAYQSPEGIERLRRVLTAYSWKNPDVGYCQAMNIVVAALLIYMSEEQAFWALNVLCDRIVPGYYSKTMYGTLLDQKVFESLVQNTMPMLWEHITKNDIQLSVVSLPWFLSLYLSSMPLVFAFRILDIFFMQGPKTLFQVALAILKQNGEELLQTEDDGTFISIIKDYFHTLDQSAHPNSPNPKYRSVTKFQELLVTAFKEFSTVNEDMINTHRNKHRDSIYQNISTFVKRTEIRNLPRTSNIPPDTLDILYDTFYSQV

SEQ ID NO: 19561 - protein, 99 aa, Candida albicans
TTTITSTNTTNILIMAFFDSLKDKALNTLNQVLSTNNKNQMVLTKDQLFCQQYNLPDNEVVIYESAAEINIVSAYSHDSYKNNNDPFSQGRLYLTPHFS

SEQ ID NO: 19562 - protein, 635 aa, Candida albicans
  UNSURE (581),(602),(604): Identity of amino acid sequences at the above locations are unknown.
SYGVPYNLCSAPKTHMRPIDSIVSKFRVQKHTSNLADNPAVLKHPEDMPKLTSCLRCRKLKKKCDKSTPHCLNCENANEECTYVKRKPRQSKNGKTTTLESSLDPPSPMVNETFTGFSYLNQSQPNDLFRHIPSATTNTSTTTSTVAAAVPPTTNTSESVSSSRSHTPPILNSIDATAPNFHSYPKQISKVLISAVGIKTNSNVSIIPPIVDKDLLTSIIGLFMQHNYRICPVIHKKEFLENFQKLFKEDGIVDLDSHHDPYELYMVLAVGSTGLERTGIISRDKKLSEYFVSMALSHVHNNLSTNSLTNVRNLTLLALYSFFNPAEYTSWEIMGKLTRLAIHLGMNHKILDQDARNLSSKEIEMRSRLFWSVYNIDRLSSVSLGRPVALQDDDINVPFPQVLEEDETEDIAVNRLVINLRRLEGKILRRVHSVNIYKNFINKDKLQEEVCQEILSDLRKEIEDWYYQVKSVDNANTSVRQSVSFHLLVPWYTARYNHLLILLYRPSYLNPRPSQDLLDILGKSCVETLSYTYKLFKAKLLPLNWTTLYRFLMVCTTILYCVCKWAIDLMESKTEICYCIXIFQACGSDWIVAKKCAEVFRXIXNKLVEITLSDGHVSDMDNWSKKTIRCKLIIS

SEQ ID NO: 19563 - protein, 671 aa, Candida albicans
  UNSURE (670): Identity of amino acid sequences at the above locations are unknown.
RNSSFLFPCQTTFNLNFHSNMESNLSNTESPSPSPSSPSSSATPTTTNISTNTTNNENPGIHTSATTNTTPSSADTTTKPKRQRRSYSCGPCKLLKIKCDLQIPCTACKKFNRVNRCLLQPPQPPSQQELSKIQERKKRTTIKKMKLSNEFVQAYNVNPNALPSMISTMETTSKNYEKKTQKHKMNQILLDKDSSPKENTSKTLKQLNNFNGNRKDTQLTKNSNSMSPHSLIEIQRHHLSFQQPQMNKQQLHPISYITSVSSPSSALTSTSLNFPQGSQQEDVIQYLLTMDSQKTIDLTMVDIKRIKRLLPNDFGLFKSMFDCYLNTVNPIAIDMQDFSEIFKQSNLVYNKLLSIDDENPKNLSINVLFTLIELRNLSLFFLILVNGLLFDFRGEKPPLDSTRQTHNNRYTNFLLERSIYKSKHDVIEDWIKISKFIKLKVLAYESLTDIIFLIDWYMILKNYYDYENMVVENYLEFNNLLNYLVLNNDFINTIEDPYNEVGRNSNEEEEEEDAATTSVDENEVVYPDTRQFKVLSKYWIQLRLIEIDYTFFQFKGSLLFANQLKGTVVPHKKILKTLYKDVELDPITTHLMKIWGLYYKRSKNTTSVREIIKDYLLLYCNMMGTLKDELNEFETNKPLELPNLRSINLKDIELLIKNQRLLHLFASGYXS

SEQ ID NO: 19564 - protein, 236 aa, Candida albicans
TMSTDTTANDEGKNEFSKQWRQLRACTRCRRFKKKCSFENPSFKSCARCFKNGYECSFNEDPAMQPSRKKKRKIQIDDNTHSSIANQLLLTSENTLKLLPEKLNDLSEDSIQHLISNYESIMDKLKLKIKPDTSNEFPYIPYSKNLAKELIYRYNYLTLAEVKTRLDFFLNEILPYYPTIPLSRKLKNFDYMLEKFPLLLIASIFVTVLNDNNLGTTPILKDNLKLCNLLSYYLYS

SEQ ID NO: 19565 - protein, 408 aa, Candida albicans
SSLSGRIPYLSYALHPIPRSFSRFLNLSYVLIRSLPLLSLLPTSRRTYCKLASCQPPGEDSKYVLNDERFQYHREKTKKLAELQENLTDKESLNTLELELEQILNDYKTRFNKNYKETPSIYQYSISIDKIDPLVEVNSAPENYNPKLINSFINIGGDTNSSQNNINGNMPSQNNNGAVSEMGNFNNIDNGVDDDALGGFQFSNNIDTSKFNGINGMAINQFGNNFEVPMNNKPDAININNNNKILINKSDSDGNIENNNSNSRSNTPSNINTNNINSQGPSENISSINHNTSNSIPNYSTNGSDNDNIEQDDINIDDEGDNIINNDDDNNNIASPNRIDNDENDNNNDSNGLDMNQLFEDNAHADLDHLEMVNDDIGDLYNFETGGGGDDDDNGLMDGLEFEQDFLN

SEQ ID NO: 19566 - protein, 195 aa, Candida albicans
KINFPGKISRDQLNPNVHRYLLKPWLPDIKMIPMDGQKVDVLLLPPQHEIKKQSLGGTDSSNKVGSSRPPLGQSNANGFRNDMRTNKGNSSSNQQNSRQQPPASIPPSPPPPLPPIQHHRGRNDYGNSRGYQSNRDNYGRHSNSRNDSRPASSRTPTYDNRARNQGNRDNRNTGRNEKRNADSFGGRGYDKRPRH

SEQ ID NO: 19567 - protein, 730 aa, Candida albicans
IIVEYWIHLEKTKATNGNKQPMPAVPAAAAVTLSMSTMILVVLKILLNGNPRGSILTADSSYNNSFPNNIINNKPQTVDGEEKDSIAKTSLGMICQSLQTALSNDDNSNVISFFKKKQDQEARQERLSNLDGQHTRILTSETGVLRFFGESSALSLISECRALFYEVLGPSTFTNDPAQNFIHDELISFERNTTPDGINGDGDGKQITTTSNSGVAVQLPLKKDALIMIELFKSNINDTFYVFNMKYFIENIVDKVYNNPIIANSKQLCLLNFVFAIGSLFIEYSSDTNNNEIDYLPNSIEFLQSGQLYMRNNVYDGKLWMVEANFLKYFYYQACCNRSNSWINLGSAIRLAQALGMHRKIINDKIENQEISIHRRRLWRSLYVCDCVSSVNLGRPLMINTYDYDDINYPVEKLLLDENDNVERIRIIAQNATSDSAVLNRSIVQNLYNGGSINIKDSNSLALQLKLWSIELPNFLQLTSDMENQLRDPTNPNNYLFVFVHIGQLYGIMALTRPFLVHVVNRKLRPNMYKPQVTDEKQLMPFCKASIKAAFLTIKLFKFYCTFNKSRKEVFTIQSATFFALILLGFTLLEQINSKKPDHHYISVIKESIRDAISIFKLFNFNATCNRWAQHLIYMMEALNRPPAIIPSSLQQTTKTSTTTTTPVLSTHPITSTNLNYQQQQQQVPPPPPPPPGSGNVKFPFQNKNNSSPSASSISSEIDRFSQDGGRIMV

SEQ ID NO: 19568 - protein, 534 aa, Candida albicans
FLFPCFKFSNFLSFLPNMSDDHSIHSHTQGLHHIKKKRVGKACDSCRIKKTKCDGKKPCNRCTLDNKICVFTEKKKTKEKKHPSGYVELLEARLDILTRLLEKLIELSRPHLQFIDDIITEEKLVNQEKSSPASSTPNSSSSDHHDDVEEQNSTGVVAPINKVVSYLIKEQGLLKNIPLEWEQGTEIAANFDPNRNLKLSSRLFAEHKGEAFIGSPVTSLQQMPSSNPFRRTSMFKEELESPSSDHDNALIFSQSVDEPYIKKEPNSVQFSKGTFSPQQQQLQQQQQMLNQFSLNTFRDISDIESDSSNKEDGLNSGSVSPPTSNYRSFSLFSDSNGEPILGKTSSLTSLTNKYENHSLSSPQTAINPVFNNSTTGPILTTLRRNSSSHSQKTLGSIQLQQKPRGSVHKPVRNHSRVSSFDKRMESTDTAADTVAAVSGSVQLLQNTTPQNVPHLDNSQNNNYLRDNGMNNIGAGSVGGGLTFGAPSFTQPLSPSDDAIVYRTNQFTNRPATVSTFGGGLDVLVDNSLDPFFNI

SEQ ID NO: 19569 - protein, 263 aa, Candida albicans
  UNSURE (144): Identity of amino acid sequences at the above locations are unknown.
LSLSLFLSFAFNSVFFFFLNSFPSFYYTIEVFNYYTHYSVIDQFTTNIFFFAMPKREIEDTQSPYSSTGLVSTGESPKTSTSTPTSSTNNRAATTTTNNTSTTSTSLLKSNSNLQPIAMTPSVSSTSLAINKPKSQENKRRRVXRACDTCRQKKVKCDGKQPCIHCTVYSYKCSYDQTNIRNKKNSGIPIPSQPSPAILQMAAQAAVAFGSNNNSSNQQLLQLLQKQQQNVGTQHSKQPLTADEPISNTNLIIFQQIINGLLT

SEQ ID NO: 19570 - protein, 109 aa, Candida albicans
LLKKMSQDQTPPVKRPKGRPRILPIPKRTKVSRACDLCKRHKRKCNGDNPCLYCQEKSLQCTYLKLDGRSKKSKIQSHNNNNGDLESVVVAKEIEPDLHHAAGRNRNWR

SEQ ID NO: 19571 - protein, 263 aa, Candida albicans
EEKRLKKLQRQNKLQLENDDAYDEDDIDVDRTDRSFHGNNDGMDQDDDSNANVQNNDNIDNDDEEEDDDEDDEMKNKYLANVLAFHGTNIPGISLQSYLGRVLKYCPVTNEVFLSLLVYFDRIAKKANNLNQKKKNSNSNGNSTGGTGSDNQSSEAEQLFVMDSYNIHRLIISGITVSSKFFLDIFYKNLRYAKVGGLPLEELNYLELQFLLLLDFKLMISVEDLQNYGDLLLRFWKREQIANELVPNNNDNETKEHQTQTQS

SEQ ID NO: 19572 - protein, 106 aa, Candida albicans
  UNSURE (105): Identity of amino acid sequences at the above locations are unknown.
IHISSLHPIFIQHISFIESLTQEPNSIFICINMSIVSLTGIEVLNNPAKFTDPYEFQITFECVDPLKEDLEWTLTYVGSSHSLDLDQELDSILIGTCPRRDKFLXI

SEQ ID NO: 19573 - protein, 525 aa, Candida albicans
EMSDSEEEEVFESLIATRSRRSNAGLRLKQLIALEEQSNELAATTQFLTEDDENVNLLFQEDGEDEEFIDEEVDNANLEGIDEESGTENENENTTRKRKHTSSDGEEEEEEENDTSNINADEILSDSELSATDSDESEGEKELLKQEKLKKKRLKKQSLIPTIKQPLVKSATLKKKQKRTPLVTADSLLLANRRSSSRAAAVESKQALVDKLKESEARRAKYVHVERKQQVELTQEERLAEAVETEKANVESLHRFREQEIVKKERQRQLLLLKRIKLHNVIRLVSSETFVKPIEEVNDARRQYEQYMKIKKKLGKKKKNQLAEMMDFPTRMPFTIDYDSPYQRKLLAEKKAQEQQNEIKKLESMNEKLHELIESGDSKKNDNDEENIQLVPSTNINADNHNNIECEPIKVEDSTQEIKADETDNKDESSDKTNTLISEVAPSDETESTKQEKISDTEFNEELENTSQTEENGLTNDNPSEVKKEENEQTNKIKETPVDNNKPDVQNLTTDTPLDETKSTETIKS

SEQ ID NO: 19574 - protein, 240 aa, Candida albicans
  UNSURE (24): Identity of amino acid sequences at the above locations are unknown.
YKGVSLIANVSTIYGDQRINKRIXGENLSDDLSHPFKLCMANNGDVNCNGSQFFITTSKQSQIAGKYSVFGHVIHGKSIIREIERVKTNKDDVPESNVVIDQCGVWTDDMPVPIFNASYDTIGGDIYEEYPEDDNSNFNQESTEEAFSVASKIKESGTLLYKKGDKENARFKYIKALRYIMEFIPDPDQDPEWYKKFIDLKKKTYLNLSLCCLQLKDYHRCIDYCSYLLDMDDSILTRPD

SEQ ID NO: 19575 - protein, 406 aa, Candida albicans
GEFFFSPFQFQFNFFIFATTIFVTFPTNKLFTMQIEKVQPKAYFDITNGSKKLGRAVFELYDDLAPKATENFLNLCKGITLNDKTYSYQDTIFDKVIKNFMIQGGSLNANVSTIYGDQGINKPIPGENLSDDLSHPFKLCMANNGDVNCNGSQFFITTSKQSHMAGKYSVFGHVIHGKSIIREIERVKTNKDDVPESNVVIDQCGVWTDDMPVPIFNASYDTIGGDIYEEYPEDDNSNFNQESTEEAFSVASKIKESGTLVFKKGDKENARFKYIKALRYIMEFIPDPDQDPEWYKKFIDLKKKTYLNLSLCCLQLKDYHRCIDYCSYLLDMDDSVLTKQDKTKTLFRKGSANVGLKKYKLGLDDLKLANKLTPDDVSIQKSIESTEKLLQQQKQNEKATYSKFFG

SEQ ID NO: 19576 - protein, 508 aa, Candida albicans
VEVGKDIPNYINGSGFVKMGDDLINYKNYLNSEHLNLSHAKLGPHNSSNSIKTGNTTVNQFVQFDLQRFNDDQYIKKLFKSALHPWNLHNLPILPNALLGALNKTDVNDYDLNESRINIGMTFSTENWTCEDHFTNLINFQFFGAVKKWYFIPELEFEKFERLLENIQMKDQLRSNINNKKQVDIDKVMNLLKKLDEDVDYEVVLKTLDNLINVDKDVRLNIGNEGFANFIGEGAKFNYNQEFMITPELLDRFGIRYTTTIQEPGECIIKFPKTFSSTISFGFNLSEEVNLATKSWLNYALESEKWLAKQNIIPGFLTFKLLVNLALMYEGGTNLLFDSDIFYKAASMYDQLYQEEINLRNEVRKFRIKEVVVDDTVDMLSDDFFANLYPSRIVVTDPKSKKSIIISMQKFIQCQQQEQEEQQNSIKQFQLELQLCYSDEKLRYFSRVLNGYSVDFESWVTNYEQLMRENSDILLKTYKGILSDGEKIYSSIVSSAVKQQDIDQEKFK

SEQ ID NO: 19577 - protein, 130 aa, Candida albicans
NFIYVKDCQTFAVHQGISKMLFDKRLLTPCPVLTPTDQEFNDPVGYLSSDKVSKLGATYGLVKIVPPPNWKPSFHINPDFKFHVRKQVLSDLGITTRSRDFFRENINRFLKMRRKRQLKLYFNVQGTRVY

SEQ ID NO: 19578 - protein, 599 aa, Candida albicans
  UNSURE (145),(584): Identity of amino acid sequences at the above locations are unknown.
YDLYREVENLGEPMDKEKWEKLGARFGVKASALEREYDSTIKYYATYLHTNCTYDFPESDSEDEYDSCLVCGQHDHPLETLLCDNCDNPYHMKCLNPPLELFLGTSWYCDKCLIGTGEYGLDEDFDVQVYDPVSFYKMCQDFDAXFIRDYNQNNRCSVDDIERKFCSIVDAEKSDLEVKYGADIHNLRPGEVSGFPMADTPSLDTTDPAIQYYINHPWNLNKLPFSNGSLLNFINTSISGMTIPWIYIGSLLSTFCWHVEDHYTLSANYCHFGATKKWYGIPSLFADKFEKLMRDSAPDLFKRQPDLLHQLVTLMSPLKLVEHGIPCVYADQNPNEFVITYPLVYHAGFNCGFNFNEAVNFAIDEWLEFGEKSVNDYRPIKKENVFNHYELLENILSRFNAKHDVSLDLVKRSLWSFERYVSRLEELLAQLKDKSTVEYKPSVDNNDEDDLCDSCKTHIGFQYFVLEPENSKQLLTPDASPQEIETKPNKNEEAKKVANSQASHDLASLNERKAMVDEFNSLIEKAKKDVDNDESTKVRRSKRIHSLKATEFPQRPTKRAKKNIIKKKAAQSKLCSECVCPMEXKLIHGKLVLRKNSPL

SEQ ID NO: 19579 - protein, 219 aa, Candida albicans
RMLKIFPDIVECAGRVIITIVKSANSPHLHYSCTNKQHPPPPPHLPVQGLLPVPAPPVSHFSSSYTTPQAPTFYHPPSQQQQQTPPPQTLHHQQPQPPISTHKFIPISPPSAKKYRSDLLKSPPKHHHHHAPRVCISCGSDQSPCWRPSWSIKQGQLCNSCGLRYKKTKARCLNDKCKKIPAKGEWTLMQSKGKETFEDGIEGYSCIACGWRVEVLPKS

SEQ ID NO: 19580 - protein, 327 aa, Candida albicans
RLGSSDVPKDPFDFENFMIAIGQFQRQYKLDKTRKLDMETLNKLFTVTNARLLPQKNTNYFYSQVSTGSDLDPQSFDIISQSGNPKGLDSTSQKRRYGKELKKLTNVMKSSVLDRINAASVRDIDDMLAPSKASSGRIRNKIAKLADTVSPLDVETLDLEFLVKKHLNGKTLIRLFYGTQSSNTFLSVEKSSDPQNKGHRHNLVNTHNSHLAFPKRRGRTMVENSSTLQYKFESLRDKIAQTQELVMINDPSRYSRGLNRMKLGLQSKKNPLTGGEKNSMLLTPGGNYYSSPMQTASLVDSFLQISNDDASGVESVCSKPNSINRRS

SEQ ID NO: 19581 - protein, 147 aa, Candida albicans
PTLADSDNVLVIFQSADSYITPNYYPGKPETHKYVPTWDFACVHIYGSSKIIDNFDFVRSQITHLTDQQEAGKPDSWKVSDAPEKYLKVMQKAIAGLQIEIKSTQCKYKFEQDMKSADIQGVVDGLQKDGKSQMSNFVKESNLTKIG

SEQ ID NO: 19582 - protein, 266 aa, Candida albicans
FLNIEYYIMLSTKFTLRSHKSSVAYIYQDPRTPFNLFTADSSGLIINWDLTIRRPKKSWQAHTDTILTISTIHNHLLTHSRDNTIKIWDESYSCVLEIPCNALNFSNICIIYDLLITPASINSNNLDVYKIDKDWQITRLISDFDVYKLVNKGEIIEEIGSSGTSRNDFGIIMQMKIIHTNTTTTTSENNSDYIIYVGFESGDIVGLQLILPRARILSTTGNTNDKTLINQSAKFILQYHNSIHVPNPLICLLNLDSLLVSGSTTN

SEQ ID NO: 19583 - protein, 216 aa, Candida albicans
YIMLSTKFTLRSHKSSVTYIYQDPRTPFNLFTADSSGLIINWDLAIRRPKKSWQAHTDTILTISTIHNHLLTHSRDNTIKIWDESYICILEIPCNALNFSNICIIYDLLITPASINSNNLDVYKIDKDWLITRLISDLDVYKLVNKGEIIEEIGSSGTSRNDFGIIMQMKIITTNTTTTTSENDSDYIIYVGFESGDIVWLQLILPRARILSTTGN

SEQ ID NO: 19584 - protein, 103 aa, Candida albicans
FSIGNGNVYCKLLKRSIAHTPYGDNLKVLKERNPQVGKRKKVSTVCTNCGKRKLRGDLQHPCNNCIKSKKHNACVYDDGQVSPAGFLTNGSSHGKHCPRITSI

SEQ ID NO: 19585 - protein, 175 aa, Candida albicans
RFDDLLPDLWQTSSNESDIKHSSQSLFNSPHHYLFQQQPQQNWFNVSVSPANSVSSPLRSTSSLWEDPPAEQQQQQPQPIFYLPQDDDLFNFEQVHHPQHHTKTQINTQLYKTELCASFMKTGVCPYANKCQFAHGENELKHVERPPKWRSKPCANWTKYGSCRYGNRCCFKHGD

SEQ ID NO: 19586 - protein, 407 aa, Candida albicans
QMCKVVSVFENIPPVFFPNLYKNEIKFSFLVFFFFHQLMTATPVYFDISCNGKPKGRVVFKLYDDVVPKTAANFRSLCTGDKGISPKSGKPLSYKDSIFHRVIKDFMCQGGDFTAPSDHLGTGGESIYGEKFEDENFKLNHNKPFLLSMANSGPNTNGSQFFITTVPTPHLDGKHVVFGEVIEGKSIVRQLERSEKGANDRPVEDWKIADCGELPANYEPVALGADDGTGDTYEEILTDNDTIDINNPQSVFAAVSKIKDIGTKLLKEGKLEKSYEKYTKANSYLNDYFPEGLSPEDLSTLHGLKLSCYLNAALVALKLKHGKDAIAAANNALEVEQIDDKSKTKALYRKGMGYILVKDEEQAQKILEEALELEPNDAAIQKGLQEAKHNIKLRRDKQKKAMAKFFS

SEQ ID NO: 19587 - protein, 252 aa, Candida albicans
RYSFQPLLLPFYFLKFFFSTKKPFMMMTVKQESPNSTLNTSEFSSDENLKTNNSEPPKKVSKSSTGKRKYHQKSRNGCSTCKKRRVKCDEQRPVCGNCTKLKLDCGYLHEPLENILNTKKDIANNEPPSKKRKRKVSTVSDASDSESTTQQATPSLTPSPNHSQDIKTQPVIPPTNPLSALSSGLLSAGNLNNLNVAHLVNNLSGLGDLSNLASLGNLASLSNLPSLAQLPIDLIIWGPFGLPAASNIAASF

SEQ ID NO: 19588 - protein, 403 aa, Candida albicans
VRTVRPVVKTFGRTSDKSLPNISPNMSIPANPLSDPLTQGMRSNLNMLDLKLMFHYTSVVANTITGAGISDTNIWNCDIPKLAFEHPFLMHSILAFSATHLSRTEKGLDQCVTCHRGDALRLLREAVLNINADNTDALVASALILIMDSLANASFPSSTSPKSLPASAWIFHVKGAATILTAVWPLTEASRFYKFISVDLGDLGDIINQGVNMNKSKGIDRENSAYYTDLECHDADIADLFPVLLDSPYLITLAYLNKLHKERYKSDFILRIFAFPALLDKQFMGLLMSGDVKAMRIMRSYYKLLRSFTTEMKDKVWFLEGVSQVLPVNVEEYAGGAGGMHMMMDFLGGGPAIVDDNEIDAEITKFDPSGTLTNKLIDTDNLPSVLTSNLDLMQGDNGFMNMK

SEQ ID NO: 19589 - protein, 383 aa, Candida albicans
NHIQDIYKMNMQPSVSVNSPLSTMSNGSILLDIMPPIPKQPIPKKSQQIRTDKPRPHVCTICTRAFARLEHLKRHERAHTNEKPYQCAACGRCFARRDLVLRHQQKLHTDLPHVIRRGSSKDGEINEHINVLHNNTNANAPLPDGTCPAAALDNEKPVFRTSLFENNPTAGLPHGPTSSIIIDDDANSMSNSPRPSITLHSSHHRDSVSFGPSNTPPTTASTVLGMPAQPTPTTTTAATANQIEAKQGSRSNSRVKLQHQQQQQPTPDSPQLKKFKPSASPMGNTSGIPSHLSNNYRHASYSAASGPCYSSFKEADFFGISGQVEFATPQFGPQNEDFGKLLESNGLLDWDSIDHLDLNDEGNLVLNSKIPSTILHDFLHRIT

SEQ ID NO: 19590 - protein, 673 aa, Candida albicans
RLNDEGKLAMKQKSIKNLHDFFTDNLKVSSMNHSQSSDVRLHNDMNHKTITQSVPQQPQQQPPIKHSLASDITPTLIPGSQQEQQQQQQQQHLPPNSHLNSVSSKASINPQHLNQTKKAEEPNQNDWFRDLVFPPFDLNIPFSAHASSEDLKGFFGPTSLLADTNDNYRKQLNHQQQQQQQQQQMNGNYNHKPNVTAKSNGNEIPLALRTHINSVADFSVEYPTSFFLEDATLITEELRNKILAMSNIEDKDLPSLSDLKRYFQLYEYGFNKYFPFIHLPSLKNSKNHNLETVPLLLAIAAIGALYAYHDNDPLILFNLSKFHIQNFFEKEITLNNLHFKKVPIMAHQCLVLHIFISLFLNEPNMVDITSRQIKSMIGLIKSTNFNEPLEKLIIPPQPAIPGSAGDKSLIQKNFDYFIMAQSRIRTLHVFYFLQAFRSAFGGVPILFSFNMLKSGSFCTNEKLWWCEGSSKWYNLVGQTYPSKWSLIDVSNGAGIDVLVSFLNDPTNVNTPISYNNLLVLLFTIHERIIKAVDNVQPFTHLRWLEKKRPLQALIMNWEVLFHQNHGSSKIITSTRGSLSAKHELKLILPMLALVKMKLEVRLNFAVSSVLQRNWVAMNSDLDRLVYRERKYNVLTTSLPHCRDILELWMHNMETINYDVRETAKRTPPFFCCT

SEQ ID NO: 19591 - protein, 421 aa, Candida albicans
RVMSNTPTTTTTSQTSRDNISHSTTSPETSKDEKDMKTKINTKAESEESSAAATLGSMGTAREHLHAQYQPSPPGPIPSHLTSSFGGTAHHTQPQGPPPSTQYGYSQPIQQLHPIQQYPVLNQASSQPQPQPQPQASSPSPIHPATHSPVTTSTTHTPDQNGASKQRMRVVKACDRCRSHKIKCSGECPCATCLKQAKECTFSNKVFQKRTKGIELPEPKRAKYAEPFGLPEVKKDDQQEYINHLENRVHYLESLLTNTSTDTFKTPLSNEPESEFVTETLFCTSSKWRFSRRHQNLLIAELCRSMYSNLSEELKQLVTLPRYQYFGWNMSGVKYVSSEELPPLPDLGAKLDSKFLTQYYFEEINPLFAILHETVFKEQIVAYEKVLRDQIMLHKDDHDSKGNQTRLFSAMLYLVYALAIR

SEQ ID NO: 19592 - protein, 370 aa, Candida albicans
LKMLDVNDTLNPGYTQDGEKRLRTKVACDYCRKRKSKCNGEQPCSKCLDKNRNCTYTFVQKERKRKQRKPTAGAENKNNGAIRKARTTSAATIRQLTSRINVLESLLGRLIDKLDPNVKSELSEELKSSPFTNENNDSREKHNGSSSNSSDNGDEEENDLQEAHEGDDSDDKNNSDGSIEYNHNDENSKQIDTKGSNDNEVRKLRDMLAPAEKSCVSNIKNRLMQYFGSHALFFSISGRAVEWLRSRVQGSNANNLNDIFAPLRHVPLSLNDAVQKSTKLLNGPDVETDKKRQFDDLEKSLIFEIIDKYYKDLYWAPFLCDVSTIRELFQIYFYGAQRNDAAILGNITYSDLLIMNIALVFTHGRWQVHV

SEQ ID NO: 19593 - protein, 312 aa, Candida albicans
QLEEHANSKSVLIMGQKRNRISKVCDFCKRRKVKCDLGNPCSMCVKYKKSPCVYSEQPTEAPKSKQKKPRVVKSEITNNNDTSSGVASNGSSNSGYTNSSASTAVSIPSSMTYANSYAIESNNNNSTGVSINNSQSCPTLFQSATTVGGGSAIVHNELSFLKEKLKSLEDSILLKQDTLQGNNNAVISSSCSPNDSVHSQKPYFIPSLTNTPIDLTSLLGINPVASDTETINFYRGYNGTTDKEPLQKRNHGPLSWIALTKSDNAMRTLWAHIHIVKEQIRARMLAISDNAPQVDKEFTESSPAVAIHICGY

SEQ ID NO: 19594 - protein, 262 aa, Candida albicans
  UNSURE (5),(10): Identity of amino acid sequences at the above locations are unknown.
QSRIXRGDLXGLLITVYLTMTHRQTSCSHALGQAMDMVKSMGLGFAHDNAKFYSSTAYERLKAKRIFWCVFTFDRVFGLQTGRYCGIRDEDFNNEFPSYDFKHETEKDDWLTLPALGLIHIARVSNFVHTAATDNPHLIKYQQVNAELVKLHEWFNANGFRNDLFFNKKNDSSSLVKAQVKLHYYDLVLCIHSKILFNYIGRRIASHGLKVEMVIDACNGVIEVLDKTNKAGLLYTPWYSVLLLLFNVGVNAITLINGGAYC

SEQ ID NO: 19595 - protein, 207 aa, Candida albicans
NSPYSRFNQGLNYNSRLSNQLVYGESSSLNGSVDSNVLRVNLGSNSNPNDFITYIIPDFDAVTYFQKDFQALNEFHLCEESEASGFEIYLVEQWMNDRNISSVVTTFTGNESSKISVVRFTILKKPAKYYPLRFQEYLNELIQNHSRMKRIEKEKPTYQHSRTNSNSEMLTLSKLSTTLIPKRESSSDYTSEVLLCKFIICPRKASR

SEQ ID NO: 19596 - protein, 358 aa, Candida albicans
YHKSSCMLVTTTTNIIKASPKRKTKTDTKDQDNSYYGQLNKRNINKVTFGIYEFPTWYGNAAYFYPHDLSHSSLGYEYANKVASEGSIARKIHKKDIFDENLHEFWLDHLFVCEYCFKYTSNETILNQHVTACTYNRKRPSKGKLLYHDQANGYIIREVRGFQDPLFCQNLCLFGKLFLDDKSVYYNIDHFDFYIVFGKDDSSYIPMGFFSKEVLSYDNDNNLACICVFPPFQRRHLGSLLIEFLYQLAAVTPGQLKSSGPEFPLSPYGKVTYLRFWSKRLATKIHELQGSFTLSHLSKETGFRKEDILLTLEYMQILVTDDLGNVTLSLERLENWCSQNKVVPGVDINILNSECLIL

SEQ ID NO: 19597 - protein, 255 aa, Candida albicans
SMSSTHSRRIKFVSISVPILYGNHAIKLTPEKRKPTTPPEHTHEWTVFFKPVLGDIDLTPLIKKVTFKLHETYENPVRTLESPPYQVTETGWGEFEIIIKLHFQPGVELGINEKNFQIFHALKLHPYNPQAPQAQQPQVQQSQAQPPQQQFGGEGGSVGTVIRERENGEVHLVLYDELVFNEPTEKTFEILTSKPVNLIPYKLLNLDKRDQEYIRPDEIDELNRMDIYIDKVKQEIENQRNQYKLLEQEKLALLQ

SEQ ID NO: 19598 - protein, 118 aa, Candida albicans
LFQFFLEVELKEPTTEPTTEPTSKPSSKPRFEVKKWTAVAFWSWDMQIENCAICRNHLMEPCIECQPNAMGNIPSEECIPAWGVCNHAFHLHCIRRWLKTRNACPLDSTNWTYQKLGN

SEQ ID NO: 19599 - protein, 339 aa, Candida albicans
ILNHAIIKVKSIRERREDITTINDALKLIENSKNIMVITGAGISTSLGIPDFRSSQGFYSMIQHLGLSDPQEVFDLDLFLNDPNIFYSIAHMILPPNHIYSPLHSFIKLLQDKNTLLRNYTQNIDNLESYAGIHKENLIQCHGSFATASCITCGYKVDGEIIFPEIKNKEIPYCPKCNEVKQSILKKGKKTKSKSKKKKKKKNKPYDDEEEEEGETYFHESFGVMKPDITFFGEQLPENFKIAINQDINKVDLVLVIGTSLKVAPVADIVGKIPEHIPQILLNKDPINHCQFDVSLLGYCDDVASYIANELRESWELPHPDYKKIPWRKKRRKFTGSIT

SEQ ID NO: 19600 - protein, 547 aa, Candida albicans
NLQLNKSIMTMETKIIQLKEPSLSLFKVDLNAVMTIAGSDSSGGAGIEADLKTFSAFGVYGLTCITALTAQNTTGVRRFDKTGQKLAKEILAANLEDMLYAYTPDTAPLKVIKTGMLTNEAIAELIDQMPKINEYKVKLIVDPVMISTSGSKLSDDNGMKLCVDKLMNQAFLVTPNFPEAMALYELTDGTERKITINSMNDFIEFVISLQKSLGCKNILVKGGHIPFTKNNKPVTNYNHSNAQIRDILYESELERVTVFQSAYIDSNNNHGSGCTLASAISANVAKGLLLEDSILISIDFIHRGMISLANKLGFGNSPLNHTVTPAHVASSVIKTSNSMPTTFLNQSGEFLDYLINHPDVNNNWKNYTEHKFVKDLAENNLPFNKFLYFLKQDYHYLVNYAQVHGLAASLAPTYQQTHAQATIIAEIVEEIERHKQKLATTYNIDYETDIDLDLELSPGPACMAYCNYLLEVGKREDFLGVKVALAPCLHGYAEAAVMGQKIRIRMQNDGVVDNEQAAVYQSWLDDYTSDWYTHAESEGRKALPLLV

SEQ ID NO: 19601 - protein, 488 aa, Candida albicans
TMILIDLLDNSGTSMPAETSIKLHEVIKFISKSKKMTVLTGAGISCNAGIPDFRSSDGLYNMVKAKHPKAVVRGQDLFDISIFRDEMSLSVFCTFMESLYKSSLNAKPTETHKFIKILKDKNKLLRCYTQNIDCIEQHINLKLGINLQEFDNNKFKQVWNQLDVVQLHGNLHKLSCTNCFSQFNWNEEFQTLLANGLNPECSKCMDKYQQRLYLGKRLTGQTIGLLRPDIVLYGEHHSQMEILTQGLNSDLKSRPDCLIIMGTSLKVAGVKSLVKSLSKIIHNKGGKVIYVNKTKLSASSWKNYIDYEVVSDCDEFVRMLKTEIPDLFLTQEQLDSEKLNQVAVKGSSLNKPIVKPEAKVKIEPGIKQEDAIQYSPEREVTIKQEVNIKQEPIVKREVESVSVKEEPIPTPPTTPHKPKQATKLKRKLPDEISANEVHSRVKRLRPRNDQLSSPASSINGSEEEEEEDEPVAKVLFENARKGITLDQH

SEQ ID NO: 19602 - protein, 608 aa, Candida albicans
EGKTRLLNIVMQLRKCCNHPYLFDGAEPGPPYTTDEHLVYNSGKMIILDKMLKKFKAEGSRVLIFSQMSRVLDILEDYCYFRDYEYCRIDGSTSHEDRIEAIDEYNAPDSEKFIFLLTTRAGGLGINLTSADIVILYDSDWNPQADLQAMDRAHRIGQKKQVKVFRFVTEKAIEEKVLERAAQKLRLDQLVIQQGRQMNSNNNVGNSKDDLIGMIQHGAKEVFENSKGTMLDDDVEEILKRGAEKTAELNNKFNKLGLDDIQNFTSDASAYEWNGQDFTKKGNNASLGLNWINPSKRVRKELTYSVDNYYKDVLKQPAVVKEKVVKQPVVKPKAPKSYNVQDHQFFADELVTLLEREQLAFKKEISYQYSVDDFGDSDEEFLEQDDEDDMTRDEKRKIAQEKINNAVALTEEEIATRDRLLEESFHNWSRRDFTNFIHATAKYGRNEYKKIAKALGNKKRSEIERYSKMFWQNYQKIEGYEKYLSQIEAVEKKREKLINQQKLLAKKIESLQDPLEDLKIQYPPNNSKRVYSKTEDKFLLYCVHKYGLSTENLYDKIKDEILTSDIFKFDWYIRSRTPQEIGRRISTLLLAITRENERAIHGKKESNG

SEQ ID NO: 19603 - protein, 78 aa, Candida albicans
  UNSURE (31): Identity of amino acid sequences at the above locations are unknown.
YPLHEINLSGILADEMGLGKTLQTMSFLGYXRFIRGINGPHLSSHPSQHWTIGNVNLIVGYPILSSWYCKGTRMKEPS

SEQ ID NO: 19604 - protein, 91 aa, Candida albicans
  UNSURE (85): Identity of amino acid sequences at the above locations are unknown.
ATNSRRRKTEKEEDAELLQDEEHLDDEDHQHTVMTESPSYIIEGKLREYQIQGLNWLISLYENRLSGILADEMGLGKTLQTISFXRLLEIH

SEQ ID NO: 19605 - protein, 90 aa, Candida albicans
IYFFGAEMTTTSTTTTNTTNGQFCLDESLVERSKRFLLEVDAIHERAHDKDDATKRFQYLLGLSALFRKFINLNASKDPAFKKRIREIDS

SEQ ID NO: 19606 - protein, 284 aa, Candida albicans
  UNSURE (253),(275): Identity of amino acid sequences at the above locations are unknown.
TMPSLDDILKPVAKAVKNGKKVTFFNGAGISTGAGIPDFRSPDTGLYANLAKLNLPFAEAVFDIDFFKENPKPFYTLAEELYPGNFAPTKFHHFIKLLQDQDSLKRVYTQNIDTLERLAGVEDKYIVEAHGSFASNHCVDCHKEMTTETLKTYMKDKKIPSCQHCEGYVKPDIVFFGEGLPVKFFDLWEDDCEDVKVAIVAGTSLTVFPFASLPGEVNKKCLRVLVNKEKVGTFKHEPRKSDIIALHDCDIVXERLCTLLGLDDKLNEVYEKEKXKYSKAETNE

SEQ ID NO: 19607 - protein, 264 aa, Candida albicans
TMSSPPPFHFEKQSVLPSSDPKSPFFCNLPSYESKPIDHLIDFFKYWKYFIKAILYYFKEIALVKELEANLNYQLINAVQFPGFKDLPNKILQEISASNNAGVVSPKNGTPTNELKKTLSNTSIATTTSEKRPGLFKQKSNGGNNPFLKSNPLHKRNSSLTSIKLQSGPPTPPPTQPSGFVLPPAPKAEPTNDVKIPASFFPDDSIYTNFPSLLLSSHHTLFNNSFKLTKELNSKLIPRLQMLLKQLSHKNQDIPTSLKNDSFA

SEQ ID NO: 19608 - protein, 393 aa, Candida albicans
QVWKIHFKSEYHQFLKTKVSNWSTHDWQYFISHNPCFINTAESTEENPKRENRTFKAIQLPYDNSVQNKCIRFGMMYKKSKVMKSYTRCYYVLSCNYLHEFKFDEDVNVTGKKSKDKIGGFIGHDTEPIKSYNLNEYTITPKNDSSYKFVLSKNNTKSKRTFKCATESDYNNWFRDLSELLKFGSDHYARYSFIQKKVHLYRASTVPEGKAGLKLDLGNALTPALTGMFTPSIRTPKQSPSEDNPFENMLSDIPTHSPTGTPKVLTPEQSSTNLVAVDTQHHEYLKLQNAFLHQQQELLDMKMKETSSFDLIQKKLDKIHEHQSPYLSTKGSSDSLNSFVIPLQAVPAAQQVIDDHLKHHSDKPIVFNLGEAADANAEGSTPPIPTVLISENH

SEQ ID NO: 19609 - protein, 491 aa, Candida albicans
ILIMSQAQTEVNNIELVENPLFTTPLKRDSISNGDGDLDSSTNQVANTTLGRESPLSDITASPVSFDLSLREADGEIQSTIDNIEKFLEEREPIDENRNNTNTKSKEGSEEADDAVQEVLKEIETEFAKELDHDDKVPKDSNITTGDDVKNRDSYESSELSDLDENQSEAETDKMDFLDEIGTVQDEDGSNGQSNGLSDLQNLSQLTELARLKDVDSDFGDDEDEDELNNLNLHSNGNKLAINGESHKRTLEIDDEHEQTTKKLKAATPVSDLKDKAQEEEQKDTPTVEIVENDKKKNKLDNDQQKIELIVLKDDQEISAEDNGAEAEPEDEGEDNDNGNNTDAPNAEEVANSEAVQQNKEDAVVIENEERDDVDLNKQRNLAIQELIAIEAKFAEVRDKLFKDKLSLLEKELQLCLDGSHPELSKIYGKINEFYQDGLRLANANLMYKLKCVDKETIATRTSIHQNFLRNLMDTKNAMIILLPQGSGHPR

SEQ ID NO: 19610 - protein, 283 aa, Candida albicans
RFIIPRFNNSLPTSIKYFYSNNDLTEANLSKFETSRNSHGLGLLSSAVLYQQQTNNLSLATPPRSLTSRTSSISSSSTPSSPYMNDGTVTKPSIEQPTISEPTPITTTTTTTSTKSQVQNKRRQRLGPSCDSCRVRKVKCDAEIQVINEDAITTEYSFVSSSEIDEIKSGKRVLLSSGSLLTSNNSNNNAKPTKIELIFSHGKFIKFKSCQNCTCKLNVDCCFKNGYTKEDILLNKKLKNSQSTASGTTITTNCSSISNITTTPTTTTTGGAKKIMKKKLQKH

SEQ ID NO: 19611 - protein, 170 aa, Candida albicans
EVPLIFFQLIMFRSVSKTIRLIIWVNATRLYSVSNASTTTTITTTSSSPLSTLKLSSNGSRDLYAIFRLHNLPYLVTKGDKVYLPYKLKNASVGDVLNLNDVVTLGSPQYTLNMKEGISPELFDLKASVVEITKEPRYQVTRKKQRCRTTKTTQVEPFQTVLMINELKLK

SEQ ID NO: 19612 - protein, 233 aa, Candida albicans
IYKYMNETKTDSTVNPDQSSQELVFFNYHEYLVPGSDDTSLVINHFPNIHTDLSSSTFKETRIIRIPRVYHTVQFPDLIPQFSCYYPGSEPGAITLTQLMSGSFDDNSLNESSSIPSLENIILRSEFENIVSLVNESLAVAFNPMSKRMLLENLLDLLSGGLFLSLLNFLGIYSFTKRKLMELESQIDSINQINEKKGVDFKIISPRVTGYLSVCIKKTTKRFSYIVWRTSLY

SEQ ID NO: 19613 - protein, 266 aa, Candida albicans
LDINSSIIINIRYNQKNQKETPGKHKFISTHIHTMLREYKLVVVGGGGVGKSALTIQLIQSHFVDEYDPTIEDSYRKQCTIDDQQVLLDVLDTAGQEEYLAMREQYMRTGEGFLLVYYINSLNSFQELNSFYDQILRVKDSDNVPVLVVGNKCDLEMERQVSYEDGLALANYFNCPFLETSAKQRINVEEAFYGLVRNINQYNDKIAEAEKQLLLLLQQLNANQQGQDQYGQQKDNQQSQFNNQINNNNNNTTAVIVLTAPGDHEG

SEQ ID NO: 19614 - protein, 331 aa, Candida albicans
QRFIHYTINTIMSLLLDSLHALTKNYDMCVIGSSNVGKSTLVLHYVYHHFDESLYDLDAVYTKRIITPDTNGKFREITIFESDFHIDMYTLTRERHVLNANTIVLVYAIDDYQSFTALEDYYERINQLRPLIQISVIASKLDLDTNREVSYHERAESAKRIGAVSFNECTRANVMGVNQAFESIANVAVKIQLDKDNTVPTVDNEIQQKENDQDSNITTTPTSTTTQSQTSNYLPQRSLQELIPVNNFTQYDNNPHQVNLNKNQFDAEQNTPLSTLTRESTMLTSDLNGSTPIAQTPSTSSRQRKTRLKQSSGPLAKSSQIHAENKCCIIT

SEQ ID NO: 19615 - protein, 188 aa, Candida albicans
RITIMLVKARKIAVVGSRSVGKSSITVRFVEDHFVESYYPTIENQFSKSIKFNNQDYAIEILDTAGQDEFSLMNEKHLIGIHGYLLIYSVTSQQSFETVEFIRDKILNSIGNESIPMVLVGNKNDLTYQRQVETTQGQELAKKFNCKFLETSVRENINVEKAFETLIDEIEKIQNPPIQKQQEKCIIM

SEQ ID NO: 19616 - protein, 236 aa, Candida albicans
  UNSURE (229),(230),(231),(236): Identity of amino acid sequences at the above locations are unknown.
SLFTHINLLSDFNERYVHSTKARYTCISITLYTHFCFVTDYKVVVLGAGGVGKSSITVQFVQGVYVESYDPTIEDSYRKQIEVDGRACDLEILDTAGVAQFTAMRELYIKSGKGFLLVYSVTDENSLKELLALREQVLRIKDSDNVPMVLVGNKCDLEDDRVLSIEDGVKVSQDWGLVPFYETSAMYKTNVDEAFIDVVRQIMRKEAAISAEKKQQKELQIQQQRPRPXXXLIATX

SEQ ID NO: 19617 - protein, 216 aa, Candida albicans
SNHNFFARIITKKTKSNQHKQTVNQIMTCLDELAHSLESKSDTTNFKTRNSKIKTIDLYQQNELLGKHLQDQDKFYRLPAIDPIARDKKPWKEDINYFNKCYISSLALMKMCTHAQTGGSIEIMGMLVGKILGHSIIVMDTYRLPVEGTETRVNAQNEAYTYMVEYLTERQQLLNGKNEENIVGWYHIHPGYGCWLSGIDVSTQSLNLHHRMEGTE

SEQ ID NO: 19618 - protein, 261 aa, Candida albicans
  UNSURE (28),(126): Identity of amino acid sequences at the above locations are unknown.
YSIFFWWWIFYFWTGTFFFCHTTMERLXRLLGPGAGLGGAAPTQSDGPAIDNSETVYISSLALLKMLKHGRAGVPMEVMGFMLGEFVDDFTIHVHDVFAMPQSGTGVSVEAVDDVFQTKMMDMLRXTGRDQMVVGWYHSHPGFGCWLSSVDVNTQQSFEQLNKRAVAVVIDPIQSVKGKVVIDAFRTIDTTTLMMGQEPRQSTSNVGHLNKPSIQALIHGLNRHYYSLNIDYHKTEYETNMLLNLHKKNWQSSPGGWKIQV

SEQ ID NO: 19619 - protein, 630 aa, Candida albicans
ESYLYTYNNTLIKFYQKMFRLIASGAQQGLRPSLILKVKPPTTTTTTSTTSKFTSTTQHFPFENNNLLGYQVRNNSSQAGVASEPKISLPETDVYQQKLLKYNIKKHEPYHLKFNPKTKNQRNNDSASSFSIDEFLQLLQDETFRNQLNEKHLFVYASNLYSGTINLRRARLNKSKNRDKDQRSAFREDMTLQSAVLNLTEIISTGELNSVLSARTLFKVFGTLLQFKLNDEIVNLWETGVNSDVGKLYLAHEVLSIVIQVGHETRRFNYDEIKQIYEMSVKEDKTVHPYLSDRMGQVAVMEGDYVTALDALESLMNLYEQNPNEKSVLGALAQIHLSFIGHSKDLAIAERFFEKGLQKEGLPYSVIMKAPYMTSFLSNCIAGGYSMEEVIDFWRRISKHYLEQDFDLISSQSTLHAGFFKSFFEKYPEPSKEAIDLLNLAIESAPKVNEVLLNTLISNLPWADKEIFNKLLNLYQEKNVTKSIVSHRIILKQSKQIEYTNEEILQLWNELLGKLDEAGYTYIANADWSALRASTMFSGKFSYQRTGLYLSVLGKYKDYMQNNFAAIQFLRNWVRDANAYRLISKITLEENPQFDGAIKVDIPEFDSLRPNINYREVTKQVTDADPRLLE

SEQ ID NO: 19620 - protein, 760 aa, Candida albicans
FMGTYIPNGKDECHPGTTTTTSTSTSTSTNYDNTNTNSNSNSNSNSNSNPDPNSLSTFTTTSPQHQQHIQESVTVTTPTSKVTINPHTTSSIASQQHQQEQELLSGYTVPNPPISTQQSTAIAADQESISGSELDNKPRTLWMGDLDPWLDENAIQDLWWSILQKKVVVKIIKPKNMKPDINFQGLTNSGYCFVEFESFEDAQHALSLNGQLLPDIAMPSQLNFPNNPDNQKKYFRLNWASGATLSAPIVQTPEYSLFVGDLSASTTEAHLLAFFQKNFPNSIKTVRVMTDPISGKSRCFGFVRFTEELERQRALIEMNGAWFAGRPLRVALATPRNVARRFNNRRFSPQHQQYQHQQQQQQQQHQHQHQHQHQEQQQHQEQQQHHHQSVFSSYGGGPNMHIGGGEYFDGDPNLSPLPQTGAPTVPPELMFMPPMGPNGQLGGSPVYGYYGQTSGSGGGGYGGPELERFSLDILQSPNLVQPMLGQQQFQHQPQYQNQLQLQHQHQHQHLQQGQQFVDPNNTTVFVGGLSSDVSEPTLHTLFKPFGLIQQVKIPPGKNCGFVKYSNREEAEEAIAAMQGFVIGGNRVRLSWGRVSVSNKKYQQQQQQQVAQVAQLQVQAALSMGMDPASAIAAAAAAAAAAATASGGGGGSGGYPPNIPLQHRQVVPPPPTSSSSVVHPAPPPPPSTSMSAMNLPPPIHGMNMNMNMNIPILPHIPQYQNIPYHSHFVSDDGRESSGGGGSGHNGDLIPSFNFTIIFNQK

SEQ ID NO: 19621 - protein, 297 aa, Candida albicans
LNHSHLHVHTYTSPPPLLPCSPFFFIKNDTFIHSNIMTESLFDTNFTSENESKPEPTQQQQQQQSTQQTSQQQQQQQPSSSTLTTSIVDQSSTLPSLQDKSNIDALINYRVLVSAKEAGCLIGTNGQVIDSIRNETNTKAGISRLIPGSHERILTVLGKLDDCAKALSYFAQALINANIESYNYFPLKQLSSTPNTEETTILRLLIPNSQMGTLIGSKGARIQQLQNNFNISMIASKSFLPGSNERLVELQGTVDDLYDSLRIISRCLIEDFSSIVGTTYYVPRRNSFTHEAARWRA

SEQ ID NO: 19622 - protein, 322 aa, Candida albicans
KAEHKLILTKYDMSDDGNDTNNIHVDTPDEPVLTPPIETVNHNITSTLKRKNEDADDNEGNEQSANSHSGNDTINSSSIKRIALDSEQLDLQDKEEELQQTAPIITNNSTSHVETESEELDKQNEDANKTQETLEPAYAPSELDHADDQNTGSSSSSKPVSNHRDRDDPTFIQLRMYCPVKEASTIVGRKGETINHLREKANVRITVSENLKGVPERIVAVKGPAENVARAFGLITRVILEEPEDEPASINSQQYNLKLLIPHPMIGFIIGKQGLKFREIEENSAAKLKAAENALPYSTDRVLSVMGVGDASAQHAGRRSEY

SEQ ID NO: 19623 - protein, 144 aa, Candida albicans
  UNSURE (118),(137): Identity of amino acid sequences at the above locations are unknown.
MFKSSAFRTFVRNMSKSDSEWRAILSPEQFRVLRQGGTEAPYTGEYTNTPASDVGYYECAGCKYPLYKANTKFKAHCGWPAFYEALPGAVKIYRDESHGMIREEMRCSNCDGHLGHVXKGEGYKTPTDERNCVNSVXIKFNPQD

SEQ ID NO: 19624 - protein, 159 aa, Candida albicans
ITITFTMAQGKVAIIIYSLYHHVYDLALAEKAGIEAAGGVADIYQVAETLSDDVLAKMHAPAKPDIPIATHETLTQYDAFLFGIPTRFGNFPAQIKAFWDRTGGLWAKNALRGKYAGVFVSTGTPGGGQETTIINSLSTLAHHGIIYVPFGYGYPGMTD

SEQ ID NO: 19625 - protein, 270 aa, Candida albicans
LMVHIAILDGVKIIHCYITIYSTTISPFDDFLTVFSHSFSFFPLLLLPSSFFLSSFLSFAFQLKNLQAIMSKPRVAIIIYSLYHHVYTLAESAKIGIEAAGVKPDLFQVPETLTPEILKLVKAPPKPDIPIAEPKILNNYDAFLFGIPTRFGNMPAQWKGFWDGTGGQWARGDLRGKYAGVFVSTGTPGGGQETTVINTLSTLAHHGIVYVPFGYGSPRLADLNEVHGGSPWGAGTFAGADGSREVTELEKSIAQQQGEDFIKTITQFKQ

SEQ ID NO: 19626 - protein, 227 aa, Candida albicans
PFSHFFPLSFLGVSFSYFAYFLIISIQTHIHTFNKPTMKIAIIQYSTYGHITQLAKAVQKGVADAGYKADIFQVPETLPQEVLDKMHAPAKPTDIPIATNDTLTEYDAFLFGVPTRYGTAPAQFFEFWGATGGLWANGSLAGKPAGVFVSTSGQGGGQETTVRNFLNFLAHHGMPYIPLGYANAFALQSSMEEVHGGSPYGAGTFANVDGSRQPSTLEFGPPGGESG

SEQ ID NO: 19627 - protein, 255 aa, Candida albicans
FLKYVLATLPHFSVFFFLKFQVLFKQFNFLPSSSLESWLLSIFFSIQSYTYTYKHTMAPKVAIIIYSLYHHIAQLAEEEKKGIEAAGGVADIYQVPETLSDDVLKLLHAPAKPNYPIATNDTLTGYDAYLFGIPTRFGNYPAQFKAFWDATGGLWAQGALTGKQAGIFVSTSGQGGGQETTAVNALSVLVHHGIIFVPLGYTKAFPLQTNLEEIHGGSPYGAGTFAGVDGSRQPTKLEKEIAFIQGKSFYETVSK

SEQ ID NO: 19628 - protein, 139 aa, Candida albicans
SSPVKMVSFSCEVCNDTVIKKKLDQHAQRCRGAYFTCIDCSTTFQGTDYRKHTSCISEAEKYEKGLYKGKNKQQQQPPKPSKQPPAKSTKPKSTIFNDVTGSQNLYKVLKKASKDDSKKLKEILKTLKITKVDGKIVIE

SEQ ID NO: 19629 - protein, 280 aa, Candida albicans
AELKTILTFGRMRQYRPEDKVISALKELKKLVLSANNDMIRRKDPIKDFNEVKNTRKRNTIHIEGFPKDLSQDDVENWVNEKVIVQLPKEKEVCSIRRIKSRAKKEFFGVVDIEFKTQEDAEFILNNVELSYPEGIISKEDAQSLEKKDLLKKMTLLTFQEMRESSKRFGVNEVTKRRNSFNENHKGGNKKFKKGNNNGKGKNNKNENDNGNGTEDKETKLEKVEEIDSTKENTEEVAAKETAPESTEKTETKEAPAPATETETETKTEVTEATEAAKEE

SEQ ID NO: 19630 - protein, 381 aa, Candida albicans
  UNSURE (364): Identity of amino acid sequences at the above locations are unknown.
DEIQLSSLLQTMSDDEAFDIAGSLALKDEDDYSDSSSNEGEDFQDEIIPLDDEKEPSPPPKKKSKPNPQAFPSLELSDNEGNNDDDDDDDSKINSYFINNNPTAKKAKAGSFASFGLTKFILANIAKKGYKQPTPIQRKTIPLIMEGRDVVGMARTGSGKTAAFVLPLIERLKLRQPGGVRAVILSPSRELALQTYKQVKEFSHGTNLQSIVLIGGDSLEEDFSKMMTKPDIIVCTPGRFLHLKVEMQYDLMTVQYIVFDEADRLFEMGFAEQLNELLASLPSNRQSLLFSATLPRSLVDFAKAGLTNPVLVRLDAESKISDQLQMAYFTTKKNEREANLLYILQEVIKMPLGSEALIKKSRDXCIMVLEIPRYSGGECFS

SEQ ID NO: 19631 - protein, 269 aa, Candida albicans
KRIDSDSEDDDDDEERKKGKKRYKFKKERLPPANRLPSPHSTIVFVPTKHHVEYVTKLLRDAGYLVSYIYGTLDQHARKNQLYQFRVGLTNVLVVTDVAARGIDIPVLANVINFTLPASSKIFIHRVGRTARAGNKGWAYSIVNEKELPYLLDLELFLGKKILLTSMHEAKVEMLKKSLTGTFIPPVVNYTERLVLGSVPRVDLETFQELYENLLRNNYEIKVLKDVAAKGEKLYHRTRQPASQESLKRSKELIESSWDDQHLLFGENL

SEQ ID NO: 19632 - protein, 187 aa, Candida albicans
IIRICHSEVKTFVNRRGRQLAPIQRKAKERKELLAKERLAGLTHGIEDEILRADGENGYGVDEDELQEAFEDADKKKSFRDPQFFLSHYAPASVIQDQQLSLSTSFANEAQAATFDLDNDDKIQTNKQVMRWDKKKGKYINSKSTDKKYIISENGTKIPASFRSGKFDEWRKQRNLKPTSTVEDDSN

SEQ ID NO: 19633 - protein, 136 aa, Candida albicans
RPIIIRPSPGLITPTSTTFDHAKIRSNSTGDLLANSLALSSNNNTQSKDPRRKHVCKVCSRSFTTSGHLARHNRIHTGERKHQCPWPTCEARFARQDNCNQHYKTHTNGKNKRNRQQHRTLEASHVGTKYNTKSLV

SEQ ID NO: 19634 - protein, 299 aa, Candida albicans
KITKSLFDQPTTPQSKTSIIMSTGLLDSWADAGDEFSAPPEVIANPDGTKTVITFRTNQDGKKVKITQKIKEVKVQEKVHPLIAQRKNWKKYGKEKNSPPGPDTSTTQLGEKVDLKLGTSWKQDEKKEEEDKAHERAQKIAVQTIKCRVCGGDHYTAKCPFKDTLGAAAGVTPSGTTPEPTSEGGAGAAGAGKYVPRHLRADANGNVPTREARDDSTTLKVSQLNSFVDEDMLRNELFAKFGPLQRVTIVRNRETGESRGFAYVSFATEEIAQRALDTFNGKGYHSLILHLEWSKKKKT

SEQ ID NO: 19635 - protein, 334 aa, Candida albicans
CYMLSVLFDGLNCPQKKNFFSYYERERKKEQMNLRNNNIGWIYTTLLLQRREQSERDQTFIFNLISIKRSIFFSSLSLCCLTKFVSFHPSKLEMDIFRILSRGASLNKKKGITTDYALPSEKQTQKQKHKQESLLNEVERETDFFHTRKHNSNSTTTSGKGDKLTNGANSNKEEQMETNETKAKEEEIPPPELTTEEDAQTFRNLHKSKVTGDDIPIPIGSFQDMIGRFHINKKVLSNLIDNEFVEPTPIQCESIPITLNNRDLIACAPTGSGKTLAFLIPLVQQILSKNVSKNHGIRGLIISPTNELAVQIFQELEIITRGCKQINVAILSSP

SEQ ID NO: 19636 - protein, 203 aa, Candida albicans
RRGLHPVVKETIFSATIPSSVEEMAHSIMKDPLRIIIGHKEAASNTIDQKLVFTGNEQGKLLAIIQMIQQGEFKPPIIIFLQSITRAKALFHELLYDRLNVDVIHAERTPKQREEVIKRFKNGDIWVLITTDVLARGVDFKGVNLVINYDVPQSAQAYVHRIGITGRGGKAGKAVTFFTKEDDKAIKPILNVMKQSRCNDGYS

SEQ ID NO: 19637 - protein, 169 aa, Candida albicans
KKKSTHNKVSPNQHHYFQTLTIPMSAQTDQPITEQQKKEQEQYTNLINSLPTRWEIELEFVQSLSNIPYVNYLAQNNYFNDENFINYLNYLQYWTQPEYSKFLVYPNCLHILKLLQDENFRKNIINQDFMNSLMNDMVKRWQLNANDQDENKEKEENKEVPEVRINGTN

SEQ ID NO: 19638 - protein, 390 aa, Candida albicans
  UNSURE (2),(8): Identity of amino acid sequences at the above locations are unknown.
PXNLSGEXQVSTPAPVAVPAPQPNQPQPPTMWNPLHSPLVRLPFGQQQLQTVYSPTQSTQLPLPPQQGPPQPQPAFPMMPQHNFHQHNQYHPRPHYRNNNGMMNVHRKNLRRKEDSAKYSDAKLQDFTGSILTLCKDQHGCRFLQRELINETNATLIFNEIYFKAVELMIDPFGNYLIQKLFTMINLEQRLVLINQCSNELFRIALDPHGTRSLQKLIDVIETNEEIEIITRNLYSNIVVLSRDLNGNHVVQKILTKFNTISSDSNSSDSNRDGVQHQNQNQFIFDIIQANLLYIACHRHGCCVLQRCLDYGNKQQCQQLSQEIAKHTIKLSLDPYGNYVVQYVLNKYSVGGDAQNTDNQVIDIIIQEIKSNFIQFPLSFTSVEQSRIIP

SEQ ID NO: 19639 - protein, 582 aa, Candida albicans
LHIMSFQQQQYLQLNNFYHPPRHSQNHSINSLSSIIEPTTPPNHSSATNGGNFQQQQQQGDSLQGQLSLLNQQSGLVITPATTATPASTSSASKSSSLHARSLSNGATGSFYGNNKLGNTSTGNKSILWDSSNKLNQNLNLPNFSIDNEVLSTPLVVPNAQQQFLPGNNNKGGNNLTSFDDKENIMVNKSVVSQNCPLASGVSTDRSVTVAVAAAPMKGENEIAASTGSGVSVVGTNSVTRGCTPTSSSSTSSDFAGTVTQPIRFPQKIDKEYLASINKLPLTQLKLEILKLAKDQYGCRFLQKKIDESLVPNYQVRLANFEIIFNQIYSHVYELIVDPFGNYLIQKLIVYCNESNLDLLMEILQYNLFQISINQHGTRALQKIIDSLNNSHQLGLLIKGLKPYIIELIKDLNGNHVIQKILNKYEPPDCQFIYDSIIDDLYIVATHKHGCCVLQKCLNHVTLQQLGEFSRAILKFENFKLLINDQFGNYVLQYLISINSLDINFQIFQNFVNFGISNLCNLKFSSNVVEKFLKNCYANESVNVSFSNLKFELIYIILVSDLNVLINDPHGNCLTRRAIDGL

SEQ ID NO: 19640 - protein, 437 aa, Candida albicans
STMAAQKKYICAFCARAFTRSEHKQRHERSHTNEKPFHCLHCTSSFVRRDLLQRHCRTVHHTNLNPSTLPSNKSLKNPTTNPLDLSNNEGTTTTTKTGNRKNNSNKNGAKNDKSTNPNPAVSNDDNRSSVGDITTQLPFQVQFNTQLPYQQQQQQQQQQQYPILQNQGIPMKQSFSMESDQHSLTTFDSPTSSLGVSMTPSGSTNSEIVLQQQQQTTKRRKRSQENNSNNNTKLIAKELNHDLVHLLSITKKLTTLLQHYDNVKVNITDSFLIGYVHIQQQAKNFTIFEKILKDLVYYLNTYHINNVQQQNQFPPSQQQNHYTINHFKIGISYCVIALGFLIDHKPNRAIQFFKKSWNLLIKTLIPQYNSNNNLLDQIEILYNLFLLCYIYLQFNLETFDINEKQHEHHSYEQGDEHEDHHQVFTTGSGIRASDKRG

SEQ ID NO: 19641 - protein, 367 aa, Candida albicans
IRHQQRELTLQIVEQFAAWAANMNIKVAVVVGGEDFVQQTLALQRKPHFVIATPGRLADHILNSGEETISGLRRVKYLVLDEADRLLSNSFGSDLQRCFDVLPTSDKRQTLLFTATITDAVRALKEKPPTPGKPPVFMHEVETVDKVAIPSTLQISYVFVPSYVKEAYLNSILHLEQFKDSTAVIFVNRTTTAEVLRRMLRKLDFRVASLHSEMPQSERTNSLHRFKAGAARILIATDVASRGLDIPTVELGINLIFPADLDDFIHRVGRTARAGRKGDAVSIIGEKDIDRIQSIEERINKKMELLEDVNDDNVIKESLSATSVAKRESLMEMDKENFGERKKINRKKHGLDKVKPERVTKPKKSKK

SEQ ID NO: 19642 - protein, 75 aa, Candida albicans
QNQTNLIQHTQYISITMSFNDLRVAKWLSESLDAMKIYKPTAIQSACIPAILKATNVMGGAQTGYGKTNAFAAPM

SEQ ID NO: 19643 - protein, 554 aa, Candida albicans
PQKRFHTNLSSLNTYLLCFVIFLLRSTFLNNLLVMSNYTQMDPANQPGGAQVATVLCCNCGVPMDGSLGLVMCYDCIKLNVDITEGIPREANVSFCRNCERFLQPPGQWIRAELESRELLALCLRRLKGLNKVRLVDASFIWTEPHSRRIRIKITVQGEAMANTIVQQTFEVEYVVIAMQCPDCAKSYTTNTWRATVQIRQKVPHKRTFLYLEQLILKHNAHVDTVSIQETKDGLDFFYAQKNHAAKMVDFLQAVAPIKVKKCEELVSMDIHSGSSSYKFSYSVEIAPICRDDLVVLPKKLAHSMGNISRLVLCNKITNAIQFMDPNTLQTADLSAPVFWRSPFPSLLDATQMVEFIVLDIEPTGDIRGKYVLADIEVSRASDLGSNDQTFYVRTHLGGILHPGDSCLGYYLTNTNINSELWDTLDTDNTPEVVIVKKHYARKSKKSKNRKWKLKRMAREHNDIVANDDSRQARQEQERAERDYELFLQELEEDDELRQTINLYKAGENQPQVSRNHDDMNDEDEDDDEDAPEIGIDELLDELDDMTLDDTPMN

SEQ ID NO: 19644 - protein, 159 aa, Candida albicans
KSRWCSHPDDSCLGYYLTNTNINSELWDTLDTDNTPEVVIVKKHYARKSKKSKNRKWKLKRMAREHNDIVANDDSRQARQEQERAERDYELFLQELEEDDELRQTINLYKAGENQPQVSRNHDDMNDEDEDDDEDAPEIGIDELLDELDDMTLDDTPMN

SEQ ID NO: 19645 - protein, 712 aa, Candida albicans
SLLQYPDHPTMPSHNPLVISLPYTFSNQDVPTEIMANRFSAWRSIIKDLVNYFKEYSSVQEEIIRQQSRLQQAVGQITNTTNNNSNYNNNTTPNSEIEAINNFFLPIGNGSVQDIPNALFKFHQKNVVDGTKTLKDINGLIIPKLEELRKDLLVKIKEIKNLQNDFKNNLSKELNDSKSLISQYNQAIELANKLGSTGNFSHITTLHEADSGKSDPYLVKIRLERQLKRQLVEENYLYDAYANLQNAGRQLESIVVLEVQNYVSMFLNLVNEENSNFSQHLLSNISNGFLSKESNFEWDAFIERNLPNVNNHGTISSGTFIDLNIPKRHLSDFVIKNFDSNLNVAIREGYLERRSKFLKNYTSAWYVLTCSYIHEFKSNDRKKDPQPVMSLPLDSCTVSDHSKNDGKLEGVYKFILTSKLHNTLMNKTHKWVFRTNTYQNMIEWFDSIKKMTSLPTPATRARTIEGGHGNSNNGKTNVSDITSGHSISRVSSTNTARSPARSLKTVSTNTTSASQAYKHRSLNQVSSSHKRLSSTFSQRNNNQSPRLTNMINSDGTIITPVDTDEDSTKRSSRIYQQQKQQQQQQQQPQQQGPCTPNQQPGPYHLIPVDTMGNQQPQQQQQQQQQQFVNPPAGYQYYIPSNAQQGVQQFYDPVQQQYYTITPTVPVNSNSSNNQQPQQQQQAPQPQYFSTSPLPTPQLIPGSPVAPAFGQYF

SEQ ID NO: 19646 - protein, 1216 aa, Candida albicans
FVEFSDLLITQLLSFSSLFVSLSIRLRNHTFNYNDIFNTLQFKLSPQKKKFFFLPFNNFNLTNLFLFFWFFFWLGFFMSSTDHTCRICRGEATSSQPLYHPCKCRGSIKYIHQDCLMEWLKHSNKSTEKCDICNSPYKFKIIYDPAMPQYIPLDLIWKKFLQITSSTVFKSISISLYILCIVIQVPLFWKFSGRVYTWAIDGTLPLVNQKFVDALLFGEFDINTYLADKLQTPLQLSLMKLKKFFGCTYFSGVRYLFVAIVANIALFIEREWVVRDEGYLKMLHKKIGKEHRAKLVDMLQNALQGLRTDGNNGDEAAAANLQRLETLATAINDLQNEDRDMNVAARGEAALRRAIDQNQLFGNEQQPILNQFENGIGQHDALPTHNFDAPENIMNGVFNGRNDIGSDDEEDEEQQEEEDDDEEAAVEEDVDVAAAAAAGADGGVVGEFLEAFGVTLTLSTPIYLMFLCNCIVAVYLFLIYLIPHMLGNTIVSITTFLFKLINVTLISYISKHIPFPTYIYEFASLYITSLGTFNPNKGVTLIERIFILGLGYGLICTTIYRLMKFLVSGPKPISGTPRKAFKVLFEISSTAKVFLIFAIEIFFFPVYCGWLLDFCAAPLFVPQFIQTAENGGKVVTFLVSSYFEMMQLPYLRVLLYWASGTLYMLFFALYIGMVRSTILRPGVLFFIRCPDDPNTRLIHDALVKPLSLQLSRIYLTAKVYSAFIIFGIGGVTWGLRYLVTPKDKDYNVFLPIQTPSYFTYLLLAIIVPTLVDSQATVTKYVRQYWERAFEISSHKLRLSHFIVGKPISSERGYVIYRNIWLQLFGLNVQPDYTQPVTRKEALAKFKQDPNAVAFFVPDGNYVRAPANDTISRKFVKKLFVAVSKDDRLLQEVKETPKRSGYETPTSDEDEDTTTTTTDDAYTIVYRPPNFKLRCFALILMLWIFAIIIILPVLLFAVVLGRPILRANLIIIDQLPHINIDELTNMDWRLTDLASIAIGLAVELQALIYYDKNFAADAPNNAGGNEIQQADPVRGMLLQGNLLNQAFNRLPAPVLYTLPSLMLWIMWILTVHKLCVDQPIRYMTGNLHVEFLLNFKTLLIHFLVSFWTILPALVYVTRRIPVEGQTAWQTLKRCGIIPCLLNFSMVHIPAFIVLYSLKVLDKANISVSFYIWPVLFICFALVKLITEGAKLYTNINNQVKQEKYVKGRAIENVEDDD

SEQ ID NO: 19647 - protein, 256 aa, Candida albicans
TVKEISQVIHSIDVVYRISRFNPRLHRNCKCKNGCENVLALDFENNKRKKKKTPKTLGILLAVPNNLSIMSDQIPVENQQVPSENSEEVKNKLEEMEQETAKLRELHSQLSSESTNGVTHPTDEEKRDTDARSIYIGNVDYGSTPLELQQHFSSAGVVNRVTILTNKFTGQPKGFAYLEFADTDAVNKAVATLDGSTFRERQLKVLAKRTNIPGISVKRGFPGRGRGNFRRGTGTGGTRGTSGFRSARSGPTFNPY

SEQ ID NO: 19648 - protein, 170 aa, Candida albicans
RKKEGLKMSEEKVRVPETEEERQERLAKQEEIDGRSVYVGNVDYQSTPEQLEEFFHGVGVIERVTILFDRFSGLPKGYAYIEFEQTESVQKAIDELHGKEFRGRELRVTAKRTNLPGFRRGRGRGGFRARGRGRGGFRGRGRGRGGFNSRGTRNGDSEQADGDAENEETD

SEQ ID NO: 19649 - protein, 356 aa, Candida albicans
EWFMVKRVREIFYIFYIYIYIFFQTFSVVCANLISSSSSSSSSSSSSSFLFLFLFLSLFLFLFLSHHQPTNKKYNPHSQTCQLTYSLTKLTPYIIFMNTIKQINQINQKELNSQTSYKSSWHYDYRDTNYLYIGNIPYNLTTKDLIIIFSQYGIPTHINLIKDKESSKHHRGFGFLKYANFKSCILAIDNFNGIKLGDRYLKVDHNYYKLRGDENEDDYLIDYEEIKREMEEKEKKEKKAKRVDNDGRLIEGNKEIKEIEGGEKKEEEEEEDNEEDNDNNDDDEFKDPMAQYLTKTNDKERDDDDDDDEFKDPMEQFIKDKKKKSGKHRSSHRSSHRSSHRSSHHKSKDREKSPTR

SEQ ID NO: 19650 - protein, 98 aa, Candida albicans
LNVRIEKVHVITSDARFFEGILEGYDKSTNIILSNCIERIIYSKDDEEGENQEIPLGVYIMRGNEIVCVGEIDDELYKSINWETLKGHALKSTKNPLK

SEQ ID NO: 19651 - protein, 762 aa, Candida albicans
EYFACLFLRLLTKKSIDIAFGGSWADADVDMASISVPIEKGSFHDGDGFNQHHLGDPVISGPPYIIKLLNLPVTANDSFVQDLFQSRFTPYVKFKIVTDPASNILETHVIRQVAFVELESASDMSKALKWHDLYYKANRRVTVEVADFNDFQNCIKFNQEHEREIMQIQQEFIAQKQQQRQPRHMALLDEFERNQRGPGSPLHQNHDHHNPHPQQQQQHHHFNPNLNRPSGRSSLPIDETSHSRRTSFEAQLHPHQQTHGQRIRQPSFDNAFPDTPHPPFGGGGGMRQQIHPTNQPGLPSSAPALKPFVTPISSASTSSRPKSNPFGAAKPVDTLSKQQEIEKKLINLNKTTVQTLGDVETPEEVQATIKKFHENGSPKLRRASVGTPRRLSSEKRPSVSILRRDLPERQQPPPPPQQQQQQQPPQQQDQNTKQTALHQPDQLQNHSSNVSLTQPSGESPLAETQSLSTNPYTSNGTGKSLAQLLSEQSDIMSAPPITGKKTPRSNSNTKKPVVAAKPVILKKKTPTSPPVQRIDLTIKESEYLKKQDETDDLIDANVETKLEKLDLNSETLLENGTKESTKTRIDNPKRENDQHDDRPNFKNLDQLVQKRNDSRASSSSSNSRRFEFIRGLKEENERVPSPSSSSSSSSATKTSQNNFEKSLESAISRTDDQQDLSSTNTGSEGRMWERGRGRGRGGFSFRSRGGFRGRGAGFRGSGRGGPRRRGGNGASGAGGTASGSTGSANYNLHYVRSKPTPVETNE

SEQ ID NO: 19652 - protein, 290 aa, Candida albicans
SISNMAPPLYVKGGVWTNVEDEILKAAIQKYGIYQWERISSLLPEKSAKQVKARWVEYLSPLLNKTDWTKEEDEKLLNLHKIFPNQWRSISNILNRTAVQCVERYQKLIDEAAGIKPGDDEENLGLSGPGIETLPAVGASSGLAVGEMNLNPESKPARPDDEDLPDDEREMLAEAKARLGNIQGKKAKRKARERMLEESKRIALLQKRRELKSAGINVKLTTRNKKKRKEFDYNADIPHEIIPQASPYDTAEELKQNDFEKQQFGQQVSTKGISMKDIDDRIAKEESSKE

SEQ ID NO: 19653 - protein, 176 aa, Candida albicans
RWAAVIPRTCYKCGEVGHVADDCQQEERLCYNCHKPGHESNDCPDPKQNTAKQCYSCGDVGHIQTECPNQAQGAKCYNCGQFGHISKNCDSAPSSTNNAPSFKRPSGRASGTTCYKCGGPNHFARDCQANTVKCYACGKVGHISKDCHSSAGGSNFSAKTCYNCGKSGHISKECTA

SEQ ID NO: 19654 - protein, 410 aa, Candida albicans
DANVYTKHNSIPIIMSDTEEHLQQQHVDSRELKKEKKSKSKLKSKISDSDEIEIDLNAQIPLSKKQQRQLKKGKLDLEKLARKNPSPKPETSTNDNNENSEDASGVNLTTVTSKKSPFGVWIGNLSFDTTREDLIRFIVGKTTTLDPKITEEDITRVNIPKKGNQIKGFAYVDVPSSSHVETIVGLSESILNGRKLLIKDANSFEGRPEQSKSDATQSGGINSSNPPSRILFVGNLSFDTTEDLLEEHFRHCGEIVKIRMATFQDTGKCKGFAFIDFKDEEGATTALKSKLTKMLINRKLRMEYGEDRSKRRPKRANDFGDHSNNNNDSYKENNRTVNDKPEFDSLNQRFDGNDSYGERDNKKRQYRERNDGYNKTNNSNKRMKSSVALASAQRASVAIVPSAGKKIKFD

SEQ ID NO: 19655 - protein, 109 aa, Candida albicans
LDVNNLKSHIGIHIQEKPFIGSKGGKLLARFQDKKRQELLHPGIKNFKCEGYLQDGTRWGCGKLFARADALRRHFQTEAGKQCVKRLLLEEQANSSGKPLATSSGVEIT

SEQ ID NO: 19656 - protein, 415 aa, Candida albicans
EMNLNFNDEQIQNVNERVRPRLPSIQQLTNGHIFHRDGNPSHPTDIIIPAVKSPIGGAQLSAIRMPEVQDLQQQQRRQNVNEQLQATPSVKQRLVKRYFCKICAQGFTRKHNMVSHELIHSSLKPHICQVCNLRFRRIHDLKRHEKLHTGEKPYSCSKCLRSFARPDALTRHQNSQNACTGSASVTANSRLDPQTLQTSSSNQSEIITNGNTSPGGINEKSVDSNIANGSSVHINSSSGHREINNQPSHSNSLPVENNEPISPHQLQHPQQHPPIRQLNLPQLQSKSPFPVNNTYYHPPHVTPQAQSYSQNYRTPMQTPPNGCPAKVVIHLIQNRPNSQPLSLPNQRPTSGVSNKSILFHHPNFTLPPIISPIIIQIPRFTIISPTAHNTIPMASLFQFNTNKIKSPSLTWVLSL

SEQ ID NO: 19657 - protein, 96 aa, Candida albicans
IMDIETTKERRRKVSRACDYCKKRKYKCSGIAPCNLCSKKQIDCIFSIVDKRTTKGSKVYKPSSIEILSHNNLAQRNSLITDDIQNKINKHSRAPV

SEQ ID NO: 19658 - protein, 543 aa, Candida albicans
YIMAVAEIKKEKGSSLSPEPSSPIQILSTEPDANTDIKQEKFTPKDILPGCKVHVSKDGEFRLAEILQEHIKKGRKVFYVHYQDFNKRLDEWIELDRIDFTRSLILPEIKADTKENKLKKKSKSKGQTKLSKNNTTANSTTGTPQPSDGQPIMGDDEMDLENLNVQGLKRPGEEFSREDEIKKLRTSGSMTQNHLEVARVRNLSTIILGEHIIEPWYFSPYPIELTEEDEIYICDFTLSYFGSKKQFERFRSKCSMKHPPGNEIYRDSKVSFWEIDGRKQRTWCRNLCLLSKLFLDHKTLYYDVDPFLFYIMTIKSDQGHHVVGYFSKEKESADGYNVACILTLPCYQKRGFGKLLIQFSYMLTKVERKVGSPEKPLSDLGLLSYRAYWTDTLVKLLVERNSPALFRKNNSQLEYDEAENGKDSSATPTPGPGSNASQSSILASAAASRLGLNSSPIFSNEITIEDISSITCMTTTDILHTLTTLQMLRYYKGQHIIVLTDQIMELYEKLVKKVKEKKKHELNPKLLHWTPPLFTANQLRFGW

SEQ ID NO: 19659 - protein, 265 aa, Candida albicans
LKFSKTTTTTTIINNTISIYIMSGTSQVLQNDSHQSQHACMAYNQRQPMMYPPPQQQPLHSQNSLPPLPPIPAPSLPPISNNISNGNTNELNNNNQQQQQHGQPPLPPPPINANQQYYAVPPLRAPPPLNTLSSVVNSLPTLTPTLTNATHSTMSSNSSAESSASSSSNSITKPKSKRSSKGRVFQCTGYPGCNMSFTRSEHLARHKRKHTGERPFTCPYCSKNFSRLDNLRQHKQTVHAYETYLTKDNRDSKLLIERSKLKKKL

SEQ ID NO: 19660 - protein, 134 aa, Candida albicans
YMSTMSTQKANSSTPGETDSSSSLPPPEITEPTYKKPEKSTKRRKKKLEIACVYCRRSHMICDESRPCQRCIKRRIAHLCYDEPSNSRQRKKAGALRKTQSERAPMVTSPITLPLNGVNGETTAVTVATITSIS

SEQ ID NO: 19661 - protein, 394 aa, Candida albicans
RGSSRPGVEDQQPQPQPQSRLIKNSVLSQTLPYNQQPFFYSEHANSEFSSLNDFLSMIDDPELVNGALNDDTDGLLNFGVGNNNNSGGSNSNINNTHNNNNNGFSISGGNSTTNLNAVLAYSPNSNLFPPTFGNEADSTQIQSQQQQPELTQQPPALNPVKVEPQAEKTEQQPVISDSARDKFFLTAADPTTEISPEERLKQVIKAKLEAGLLQPYNYAKGYARLQRYMDNYMNISSRQRILKPLSIFRPAFRAIARTLKDVDLVLVEESFERMLLDYDRVFTAMAIPACLWRRTGEIYRGNKEFASLVGVTTDDLKDGKLAIYELMSEESAVNFWEKYGAIAFDKGQKAVLTSCNLRTRDGIKRKSCCFSFTIRRDRYNIPSCIVGNFIPIDP

SEQ ID NO: 19662 - protein, 380 aa, Candida albicans
YAVFPSSNNFTSSVYRVSTTSFRTTNLSTTTATTTFASSTSISTTPTTSTFDATIRATSTSIPATATATTTTTTTFFFPLSLPVLQQQQVYAQPVNQSENYYIQAPRGYGYSSSLSSNTSNASVQQYPLNELRQANVHSITPEKQSINFNSENYNYLVPSLPPLNTIGGSTGSHTPQQQHQQQPQVYNTSPLSATYVHENAQYVVPSVDTVRGFPARGGIVPKRGRKRRHTATVHNMTPETAERNRCRICNKQFKRPSSLQTHYYSHTGEKIFKCPWDGCGRLFSVKSNMTRHYRLHERDFKRAQDLQFGPSQPQQPPQPPQQQVTGIAASHAPTTALQQQEPFNTNNQNLGSSDSAAKSQYPSYLSSSNLPTTDNNPSI

SEQ ID NO: 19663 - protein, 667 aa, Candida albicans
NQGRRQISREIYPDLDETCQLPVFVIDRNTNSEESSNLRHAVNLSELKAPTYRRVPQLSLTPTNLRFSKQLSEYGFQNPSKLTNKPNPDTYIRPFQLNASLRETTASIEKFIEKKKNLVEYDMDEQDYLFLQDRNNQPENVIKITPEVFEIMMTSLENQWCALELKMNSITTNVGSSTSDPGSNHKLLTIGHNNAKYGNDDGIVPGSIYDQKCAICNDSDCDNANAIVFCDGCDIAVHQECYGVAFIPEGQWLCRKCMINKNRTTECVFCPSTTGAFKQLDNSLWSHVICGLWINELYFANPIYMEPIEGMEGIPKSRWKLTCYICKQRVGACIQCCNRSCFQAYHVTCAKRAGLYMSMTQGIKGAISNKLTLKSYCERHSPAEFDETKVLDGIRRTRLYYRDTKLLNEENARLSKDRETANKLNIFKWNTEANTPIAPKLFSDVLVQILYQLKVENQISLPEESTNEVLHLKVLPNRTKMEILQDLRSIADEVCRYWCLKRKLKRGASLIRKNNNLIATSSILYDSNSLENNNACELTKKIEFAESLVSDIDRLISMGEMLTDEQEANHEINLVSFDVVDLVYFPLKQLIELTIMRLNNKFDFNETLRTYKPKSDAVISLNSISGKNSQYGYQSIDQLEQDVENLREYIFQENKPSYTEGPGRKRT

SEQ ID NO: 19664 - protein, 257 aa, Candida albicans
ISSIYGEKYYGTKYEAVKEEDGRDGGLEADSDGSIEVVKVEKIQRKCRKRKQDNVHITNTHESVSTKRPHKQPDIPRECALCPNTLQQTKYSHSALFELLQADTYGTTPERPRRVHKICASMFPHQLKCDFKTNTVHGLDDITKNQKKLRCGVCRQSEMGACFQCSYKKCTRAFHGSCGLVDGVQYDFDSGEAFCKFHRQGPTSAEFKVGMYVQFLFNHGVYFGQLVNLGDGDVEVEVYPSAQDVIEIPTTSIINVV

SEQ ID NO: 19665 - protein, 218 aa, Candida albicans
NQHMLQLNPVIHPNTSNRHFKFEPFLRQEYNFGLDPDRPVCQFYNPLNPDNSCPQGNNCPNKHVSAMYSNKIVCKHWLRGLCKKGDHCEFLHEYNLRKMPECLFYSKNGYCTQTSECLYLHVDPQLKIPECLNYNQGFCSEGPNCKNRHVRRVLCPLYLYGFCPKGPECEFTHPKFDFHNLNLRIRPDNLIQMTSKHVDNSKEESDKKEDSEPKEESI

SEQ ID NO: 19666 - protein, 539 aa, Candida albicans
MKFLVMTMMNEKLKREKKKIFGVITPFQKYLYTPRIINTVHLIIMSSKGITKKKVKSLKNLDYTKKLAEKIKQQALQKQQKQQKQQEQENANHNQTESSLSSSSSTTSSSITTIDPDAELKFKTFKELNLVPDLLESIESMKFTKPTPIQSEAIPHALEGKDIIGLAQTGSGKTAAFAIPILQSLWHAQQPYFALVLAPTRELTFQIKDTFDALGSSMGLRSSCIVGGMDMMDQARDLMRKPHVIVATPGRIMDHLEHTKGFSLKNLKYLVMDEADRLLDMDFGPALDKILKVIPIKRTTYLFSATMTNKIEKLQRASLHNPVRVAVSSKYQTADNLVQSMMLVNDGYKNTILIHLLNEFMGKSIIVFTRTVAHAQRTALLARILGFNAVPLHGQLSQSQRLGSLNKFKSNQANILVATDVAARGLDIPSVDVVINYDIPTDSKAYIHRVGRTARAGRSGKSISLITQYDLEMYLRIESVLGKKLPKEDKPPKEVLDALHVHVDKATAEAIRQTKEIHDKRNGGGGRRRNRDDADREER

SEQ ID NO: 19667 - protein, 215 aa, Candida albicans
YILLFTTVSYQQQKMAKTTKVKGNKKKSDTSKVVSKVSRKRSHEDSESEVEDNEKVVEELDADFDEVAGLLGDDIEDPESKSQSKKEKQKAKDEAKLEQLTKPQVSNEVPDNDNDDDSSEDVLFENADFSEPTMKAIKEMGFTKMTKVQAKTIPPLLAGRDVLGAAKTGSGKTLPFLIPAIELLYSLKIKPRNGTAVIIITPIREITLTNFWCCS

SEQ ID NO: 19668 - protein, 809 aa, Candida albicans
VYFFSLPFFKSISRDEIVGIFFYFSRIVFLPFLPLLISIQPSRIMAKNLKKGKKVFNKSTRKINRLKEEEELAKLQERINNYDPKTDEASVSQFSDLPITENTLKGLKEATFVSLTDIQKKTIPIALKGEDLMGTARTGSGKTLAFLIPVIESLIRNKITEYDGLAALIVSPTRELAVQIFEVLTKIGKYNTFSAGLVTGGKDVQFEKERVSRMNILVGTPGRISQHLNEAVGMETSNLQVLVLDEADRCLDMGFKKQIDNILGHLPTTRQTLLFSATQSESVNDLARLSLTNPNKIGVSSDQEVSATPESLEQYYVKVPLDEKLDVLWSFIKSHLKSKILVFFSSSKQVQYTYETFRTLQPGISLMKLYGRHKQTSRLETTMKFSQAQHACLFATDIVARGLDFPAIDWVVQVDCPEDAATYVHRVGRSARFGRKGKSLLMLLPLEEEGMLKRLKIHKIEPKLMNIKQKSKKSIRPQLQSLCFKDPVMKNLGQRAFIAYFKSVHIQKDKDVFKVEELPAESYAASLGLPGAPKIKIKGGESNKEKKNASRKLIALAKTDADGEVQTGNEKVRTKYDRMFERKNQTILSDHYLNMTGNKVNSDGESEDEDFMTVKRKDHELKEEELPDLTIPVSKRQAKKALSRKATLASKGNPTKLKFDDDGVAHAIYELEDEDDFIKAGDAKKQKEEFVNKERETMKISDITDKEVERQKRQEKKRKRKEIERRMREEEEEDFDNEQTVVTLGAPDLDRDLQYDNGSDVEEPVSKKPKWFEGGDDDKSKNTNDGFVEYDEPETLEDLESLTARLIGN

SEQ ID NO: 19669 - protein, 187 aa, Candida albicans
KSMFRLLIPRRFPTVRFYSIMQEPPIKKTKLDLMQLFLKEKPQIPKKPLVWVDCEMTGLDVFGDDNIIEICCIITNEDLDIVDENGYESTIYYLKSRLDKMNEWCIETHGKSGLTDKILANPDRKLSVVEDELSEYIKKYVPEVRTGLLAGISGYMDRFFMMKEFPKVIDHLHYRNVEVSNKMEFGI

SEQ ID NO: 19670 - protein, 99 aa, Candida albicans
QIFFFLVDTSVPHPKIVKKYTKKFKRHHSDRYHRVAENWRKQKGIDSCVRRRFRGTIPQPNIGYGSNKKTKFLNPAGYKVYLVTNVKDLDVHQTAGRTE

SEQ ID NO: 19671 - protein, 123 aa, Candida albicans
LALPVGAVMNCADNSGARNLYVLAVKGTGARLNRLPAAAAGDMVMATVKKGKPELRKKVMPAIVIRQSKPWRRRDGVYLYFEDNAGVIVNPKGEMKGSAITGPVAKECADLWPRIASNSGVVV

SEQ ID NO: 19672 - protein, 208 aa, Candida albicans
VKMGISRDSRHKRSATGAKRAQFRKKRKFELGRQPANTKIGPKRIHSVRTRGGNQKFRALRVETGNFSWGSEGVSRKTRIAGVVYHPSNNELVRTNTLTKSAVVQIDATPFRQWYENHYGATLGKKKGGAHAAHAAEVADAKRSRKVERKLAARSGAAAIESAVDSQFGSGRLYAVISSRPGQSGRCDGYILEGEELAFYLRRLTAKK

SEQ ID NO: 19673 - protein, 111 aa, Candida albicans
KRKGTKDARMPSQVLWMRRLRVLRKLLAKYRDAGKIDKHLYHNLYKAAKGNTFKHKRSLVEHIIAAKAEALREKALKEEAEARRVRNRAARERRQQRLAEKKEALFAEAAN

SEQ ID NO: 19674 - protein, 137 aa, Candida albicans
KFSKIQEFRAFERIPREVCRTHGFTLKEKVTKDPRMPSQVLWMRRLRVLRKLLAKYRDACKIDTHLYHDLYKAAKGNTFKHKRSLVEHIIAAKAEALREKALKEEAEARRVRNRAARERRQQRLAEKKEALFAEAAN

SEQ ID NO: 19675 - protein, 69 aa, Candida albicans
NKRQAYAVAENAGHQTSAESWGTGRAVARIPRVGGGGTHRSGQDAFGNMCRGGRMFAPTKIVHHAWKSA

SEQ ID NO: 19676 - protein, 83 aa, Candida albicans
PFVSRKKRRKNFSLFQSCTHHFFFFFPLFSFFLYHHYTTMSSRPQVSVISVKGEQGSSQLPLPAVFAAPVRPDLVHSVFVRVN

SEQ ID NO: 19677 - protein, 201 aa, Candida albicans
RYATASAIAASAVTSLVLARGHRVEQVKELPLVVSNEFESVTKTKDAVAVLKAVGAHKDVVKVIKSKKLRAGKGKLRGRRFTQRRGPLVVYAQDNGIVKALRNVPGVETASVKHLGLLQLAPGAHLGRFIIWTQGAFESLDSVYGSDSTKSIKSGYTLPSNIISNTDVTRLINSAEVHTVVRPAGDKNHQKSHVLKKNPLK

SEQ ID NO: 19678 - protein, 140 aa, Candida albicans
QPHIFTNPKAKANKKTKRWYKDVGLGFKTPKAAIEGSYIDKKCPFAGTVSIRGKILTGTVVSTKMHRTIIIRRDYLHYVPKYNRYEKRHKNVAAHVSPAFRVEEGDVVTVGQCRPISKTVRFNVLKVSAGASRSKKFSKF

SEQ ID NO: 19679 - protein, 120 aa, Candida albicans
LNISYPANGTQKSIDIDDEHKLRVFYEKRMGQEVEGDSVGDEFKGYIFKITGGNDKQGFPMKQGVMHPTRVRLLLSKGHSCYRPRRTGERKRKSVRGCIVAQELSVLALSIVKQCDNEIE

SEQ ID NO: 19680 - protein, 67 aa, Candida albicans
PKLQRIQRLVTPQTLQRKRALKAKKVKNAQQQRDAAAEYAQLLAKRLHERKEERAEIKKKRAESLKN

SEQ ID NO: 19681 - protein, 205 aa, Candida albicans
RFVYSHNFKDIILTFISSGAPRTYSKTYSVPKRPYESARLDAELKLAGEYGLKNKREIYRIGFQLSKIRRAARDLLTRDEKDPKRLFEGNALIRRLVRIGVLSEDKMKLDYVLALKPEDFLERRLQTQVFKLGLARSIHHARVLITQRHIAVGKQIVNIPSFTVRLDSQKHIDFAHNSPYGGGRAGRVKRKNQGKGGEEGAEEEE

SEQ ID NO: 19682 - protein, 71 aa, Candida albicans
TEDWKMLNNLAVLQEFLNRVKSNAAKKREAKANGETVYLKRQAAKPRGSRIISTEGNIPQTLAPVAYETFI

SEQ ID NO: 19683 - protein, 67 aa, Candida albicans
YFYSRGYRSGTRYAFQRDFKKHGAIPLSTYLKVYKVGDIVDIKATGSIQYERPDFHHSPSASVISPL

SEQ ID NO: 19684 - protein, 299 aa, Candida albicans
VKKKKFSVNIHSQFDSNFLEYLGVGRYKYLIIQTASISHYQMLSSKLINTGILRNTTRISVTQWSKSFSTSIISGNQYADFIPANAEQEQFLTRQTEKPLFSRKTYLIDFYKHLYDNNEILLFVHHNNLNKSDNKRYRQELFKSGANLHVIKSSMFKLLLRSINEADPAQKGMSAKNKDKVHDLDPLLAGPTAIITIPKSDPQVVTSVMKVLKSANERLLLIGAKIENNVMNLDEINQFKTLPTKESLQGQLVGLLTMAGGAGLVRTLETPGKVLYLNLDQRKKDMEGPKQEEKTENKE

SEQ ID NO: 19685 - protein, 119 aa, Candida albicans
AGVKTFELRTKSKEQLESQLVELKQELATLKVQKLQRPSLPRIHTVRKNIARVLTVINLNQRENVRAFYAGKKYIPKDLRAKKTRALRRKLTKFEASQETEKARKQRIAFPQRKFAIKA

SEQ ID NO: 19686 - protein, 135 aa, Candida albicans
TFGKKKTATAVAHVKAGKGLIKINGSPITLVQPEILRFKVYEPLTLVGLDKFQGIDIRVKVTGGGHVSQVYAIRQAIAKGLVAYHQKYVDEASKNELKKIFASYDKTLLVADSRRMEPKKFGGRGARARFQKSYR

SEQ ID NO: 19687 - protein, 222 aa, Candida albicans
NYFSLENSSTSYKSNHQKATMAISKNLPLLNNHFRKHWQERVRVHFDQAGKKASRRQSRLRKAAKIAPRPIDALRPVVRAPTVKYNRKVRAGRGFTLAELKAVGIAPKYARTIGISVDHRRQNKSQETFDANVARLQEYKSKLVIFDKKTKASEVASFEQVDVSATFPVEQPAPESGLRAVEVPEQTAYRTLRLARNEKKYKGIREKRAKEKAEAEAEKAKK

SEQ ID NO: 19688 - protein, 133 aa, Candida albicans
RIMPPPLSSPVVSTMPMSTEAAVSYAALILADAEQEITSEKLLSITKAAGANVDQVWADVFAKAVEGKNFKELLFSFAAAAPASGAAAGSASGAAAGGEAAAEDNPLNNNLLKNLMTTWVSVYSIKEFSQTNK

SEQ ID NO: 19689 - protein, 110 aa, Candida albicans
FLITMSTESALSYAALILADAEVEITSEKLLALVTKANVEVEGIWADLFAKALEGKDLKEFFFNFSAAPAAAAAGGAAGGGAAAEEAAEEEKEEEAKEESDDDMGFGLFD

SEQ ID NO: 19690 - protein, 66 aa, Candida albicans
LHGVNFKKRAPKAVKEIKKFATLHMGTTDVRLDPKLNIAIWKRSVQGVENRMRLRISRKRNDEEDA

SEQ ID NO: 19691 - protein, 148 aa, Candida albicans
LLGGIMMEDKFNSGVGGICFKDQLFNMGIPMSPLMALKTEKRLYPVIKSPFAQAKTRQNFHRVTYKKKLVAYDANPEIIDLWLSYINKNKFTDVEYKATVSSYESLNYHEELKSLKEFNLPDAYEGIEDPVAKKVQELLKCKSFKKHL

SEQ ID NO: 19692 - protein, 144 aa, Candida albicans
GKGISSSALPYSRNAPSWFKLSSDDVVEQIIKYARKGLTPSQIGVILRDAHGVSQAKVVTGNKILRILKSNGLAPEIPEDLYYLIKKAVSVRKHLEKNRKDKDSKFRLILIESRIHRLARYYRTVAVLPPNWKYESATASALVA

SEQ ID NO: 19693 - protein, 134 aa, Candida albicans
YTTHTRVHFFFPFNNFNTIVSCIFILSVGIESQFNLVMFSNILRQSSRGLINFTSVSSRPLGVPAFGMNPLITSSPLQSVVGLMQQRFKSRGNTYQPSTRKRKRKLGFLARLRSIGGRKILERRRAKGRWFLSH

SEQ ID NO: 19694 - protein, 147 aa, Candida albicans
RSLEVGKPADKTTISCNIYVRQEQGAAPIVGKVDIPFPVQRKTKPVVFTTQQPVIEELKKAGIETFGGRELLDKFINQELTPDMFTHAFATQEMAPHLKSVARILGRAGLQPTAKKGTITDDVNTILDVMRSFQIKQKENHISFPRG

SEQ ID NO: 19695 - protein, 87 aa, Candida albicans
VYTNCKMNKHFIRSFSQSGVVLRPGYSTVNPVHHLVKVEKSKLRPGLKELLLPKDDIRSVKFKPTEISQDRVNEYYQNALQSDLLLH

SEQ ID NO: 19696 - protein, 204 aa, Candida albicans
GSAGPSSRVVKKRSWGTDTPFKLYRPLRKPVGSTRPTKNIYPINNKNVPKLESIVVQSYNKNALESPWLNITTRLQLATITNVKPKILYGKSNILPWKVRVGRACGAKVELFDRDMSQFISTLTELVLPRIRAFKGIPRTSGDKNGNISMGLTPEDCQFFPELEHFQELFPNLNGLQITFKTTAQTDNHAKTLLSCYGFPFSKN

SEQ ID NO: 19697 - protein, 122 aa, Candida albicans
LFYYRFLKKEKMKYLAAYLLLVQGGNTSPSASDITALLESVGVEAEESRLQALLKDLEGKDLQELIAEGNTKLASVPSGGAAAGGASASAGAAAGGAAEAEEEKEEEAKEESDDDMGFGLFD

SEQ ID NO: 19698 - protein, 117 aa, Candida albicans
HFHVTNKNIVKYLAAYLLLVNAGNATPSAADVKAVLSAADIEVEEEKVEKLISELDGKNVEELIAEGNEKLSSVPSGAPAAAAGGASAAAGGEATEEAAEEEAAEESDDDMGFGLFD

SEQ ID NO: 19699 - protein, 167 aa, Candida albicans
SKMPPKFDPNEVKFLYLRAVGGEVGASSALAPKIGPLGLSPKKVGEDIAKATKEYKGIKVTVQLRIQNRQATASVVPSASSLVITALKEPVRDRKKEKNVKHSGNIPLDEIFEIARKMQHKSFGKNLASVSKEILGTAQSVGCRVDGKNPHDIIDAINAGEIDVPEN

SEQ ID NO: 19700 - protein, 135 aa, Candida albicans
SIRFTNIMNYYYSLLNTNIDGRIKIMYALTKIRGVGRRYANLVCKKADVELTKRAGELTQEELERIVTIMQNPTNYKIPAWFLNRQKDQVDGKDYHVLANNLESKLRDDLERLKKIRSHRGIRHFWGLKVRSSTY

SEQ ID NO: 19701 - protein, 113 aa, Candida albicans
IFKVTKPQNRIKTTVILTNQILIFIEGTPSLGKRHNKSHTLCNRCGRRSFHVQKKTCSSCGYPAAKMRSHNWALKAKRRRTTGTGRMAYLKHVTRRFKNGFQTGVAKAQTPSA

SEQ ID NO: 19702 - protein, 134 aa, Candida albicans
IKIDSTILELVEDIKIEWDFNIDIQSNETSQSNKNNSNTNNSIFIFIEGTPSLGKRHNKSHTLCYRCGRRSFHVQKKTCSSCGYPAAKMRSHNWALKAKRRRTTGTGRMAYLKHVTRRFKNGFQTGVAKAQTPS

SEQ ID NO: 19703 - protein, 275 aa, Candida albicans
RLQDHTEVVVETMKVKSLFVVEVVATRKRARLIDFHRWNAGRQEVVRIEYDPNRSGHIALLKHLETGDLSYILAPQGLRSGDIVESVRQGIPKDFMEEMERTNNGEIDDALLSARILQRGNCLPLRMLPVGSIIHNIGLRPGDRAQLVRSAGTFGKILSKHPEKNRAVIKLSSGEQRYVILDCHATLGVVSNKEHQLISWGKAGRSRYRGFRPKVRGVAMNACDHPHGGGRGKSKSNKVSQSMWGLKKFQKTRLRPNPDQIRNRKGHLINHDKFK

SEQ ID NO: 19704 - protein, 182 aa, Candida albicans
GEKEKTKEKFSSIPSSTYTFQGQLNQHIMLPITRRWLGNTASPAVSLLKYSRAFVRFNSTSELTELELQDIKYRKQRELSLKLTKMKNYGDAFPAHSHPGSTHYKKPVHDHLHKGRPIKELTVARSHRSSGRNNEGKITVRGRGGGHKEKSQINRFPSLECRKTRSCQNRIRSKQIRTYCIT

SEQ ID NO: 19705 - protein, 154 aa, Candida albicans
KNCLPKISHLFILSQPKSTMSDAVTIRTRKVISNPLLARRQFVIDVLHPNRANVSKDELREKLAEIYKAEKDAVSVFGFRTQFGGGKSTGFGLIYQSVADAKRFEPAYRLVRYGLAEKVEKASRQQRKQKKNRDKKIFGTQRRAQKRAARRNAD

SEQ ID NO: 19706 - protein, 121 aa, Candida albicans
LNMPKKRASNGRNKKGRGHVKPVRCLNCARCVPKDKAIKRVTIRNMVEAAAVRDLSEASVYAEYALPKLYNKLHYCVSCAIHARIVRVRSRTDRKIRTPPQRKRFTSDRKVSPQDAAKKAN

SEQ ID NO: 19707 - protein, 219 aa, Candida albicans
IKMSKITSSGVRENVHKLLEYSTETKKRNFLETVELQVGLKNYDPQRDKRFSGTLKLPQVPRPNMTICIFGDAFDVDRAKSLGVDAMSVDDLKKLNKNKKLIKKLAKKYNAFIASEVLIKQIPRLLGPTLSKAGKFPTPVSHNDDLYSKVTDVKSTIKFQLKKVLCLAVAVGNVDMEEDVLVNQIMMAANFLVSLLKKNWQNVGSLVIKSTMGPSFRIY

SEQ ID NO: 19708 - protein, 251 aa, Candida albicans
LTMSAEAPKRQFGDRRRGGRRGGRRDGEEKGWTPVTKLGRLVKAGKITSVEQIYLHSLPVKEYQIIDLLLPDLKDDVMKIRSVQKQTRAGQRTRMKAVVVIGDSNGHVGLGIKTAKEVASAIKAAIVIAKLSIIPIRRGYWGSNLGQPHSLPCKVTGKCGSVAVRLIPAPRGKGIVASPVVKRLMQLAGVEDVYTSSSGSTRTTENTLKAAFAAIGNTYSFLTPNLWAETPLAASPLEVYAEEAAAGKKRY

SEQ ID NO: 19709 - protein, 208 aa, Candida albicans
ANKEKRKVIFDRAAAYQKEYTEAERSVIKAKRDAKASNSYYVDAQPKLVFVVRIKGINKIPPKPRKVLQLLRLTQINAGVFVRLTKATSELIKLAEPYVAYGYPSLSTIRQLVYKRGFGKVNKQRIALSDNAIIEANLGKFNILSIEDLIHEIYTVGPNFKQVSNFLWPFKLSNPNGGFRARKFQHFIQGGDTGNREQFINALVVQMN

SEQ ID NO: 19710 - protein, 156 aa, Candida albicans
KMKIEVDSFSGSKIYPGRGTLFVRGDSKIFRFQSSKSASLFQQRKNPRRISWTVLYRRHHKKGISEEAAKKRTRKTVKHQRAIVGASLELIKERRSQKPSDRKAARDSKLAKDKEAKKAAKAARKAEKAKAVASGASVVSKQQAKGSFQKVKATSR

SEQ ID NO: 19711 - protein, 105 aa, Candida albicans
APPCYENQVDINSKLALTIKSGKYTLGYKSVVKSLRTGKAKLVIIAANTPVLRKSELEYYAMLSKTPVYYFQGGNNELGTVCGKLFRVGTLSILDAGDSDILSSI

SEQ ID NO: 19712 - protein, 72 aa, Candida albicans
GQGSTHCHLGPRKYDRILKDVPTYKYVSVSVLVDRLKIGGSLARVALRQLEEDGIITPVLKHSKQAMYTRAQ

SEQ ID NO: 19713 - protein, 173 aa, Candida albicans
SDKSQNVMRELRIEKLVLNICVGESGDRLTRAAKVLEQLSGQTPVQSKARYTVRTFGIRRNEKIAVHVTVRGPKAEEILERGLKVKEYQLRSKNFSATGNFGFGIDEHIDLGIKYDPSIGIYGMDFYVVMGRAGARVTRRKRARSTIGNSHKTNKEDTIQWFKTRYDAEVLDK

SEQ ID NO: 19714 - protein, 191 aa, Candida albicans
GCCGSDCVFPPNNFADTLIYSIFFSQKFFFFYFFQEFFFYNSTTSIMGKGKPRGLNSARKLRVHRRNNRWADQAYKARLLGTAFKSSPFGGSSHAKGIVLEKIGIESKQPNSAIRKCVRVQLIKNGKKVTAFVPNDGCLNFVDENDEVLLAGFGRRGKAKGDIPGVRFKVVKVSGVSLLALWKEKKEKPRS

SEQ ID NO: 19715 - protein, 219 aa, Candida albicans
GRWSFQPRGEDLGKIVLAARIIAAVPNASDVAVCSSRTFGQRAVLKFAAHTGATAIAGRFTPGNFTNYITRSFKEPRLVVVTDPRTDAQAIKESSYVNIPVIALTDMDSPSEYVDVAIPCNNKGKHSIGLIWWLLAREVLRLRGIIPDRTTEWSVMPDLYFYRDPEEIEQNAVEEAKTEEVEEAPVAEAETEWTGETEDVDWADSGATPAAEDAAASNW

SEQ ID NO: 19716 - protein, 76 aa, Candida albicans
KQAIMSAPINKEKVEQETEQQIHKIRITLTSTKVKQLENVSANIIRNAAQYNIVKKGPVRMQTKVLKITTRKNSNG

SEQ ID NO: 19717 - protein, 130 aa, Candida albicans
  UNSURE (3),(30): Identity of amino acid sequences at the above locations are unknown.
LNXLAIVVRGRYAGKKVVIVKPHDERYKSXPFPHAIVAGIERAPLKVTKKMDAKKVTKRTKVKPFVKLVNYNHLMPTRYSLDVESFKSAVTSEALEEPSQREEAKKVVKKAFEEKHQAGKNKWFFQKLHF

SEQ ID NO: 19718 - protein, 193 aa, Candida albicans
YYFKYQTSTTMVRALKHHEKKLLKKVDFLDWKQDQGHRDTQVMRTYHIQNREDYHKYNKICGDIRKLAHKLSLLQPTDPFRIKHEQLLLEKLYNMGVLLTKSKISDLENKVTVSSLCRRRIGVVMCRLKMAETISDAVKFIEQGHVRVGPNVITDPAYLITRNLEDYLTWVDNSKIKRNVLKYKNKIDDFDLA

SEQ ID NO: 19719 - protein, 235 aa, Candida albicans
VVFFLSYSRFPYSKKFFFFFLKTSFNLSLYLNQSTMSSFEKVVVIDGKGHLLGRLASIVSKQILNGQKVVVVRCEELNICGEFFRNKLKYHDYLRKATRYNKKKGPFHFRAPSRILYKAIRGMIPHKTARGKAALERLKVFEGVPPPYDKKKRVVVPQALRVLRLKPGRKYTTVGKLSSAVGWKYESVVEKLEEKRKVQSAEYYAKKKALTKKLNAAKASTAESEAAQKLAAFGY

SEQ ID NO: 19720 - protein, 262 aa, Candida albicans
  UNSURE (177): Identity of amino acid sequences at the above locations are unknown.
LFTNISISTGRVIRNQRKGAGSIFTSHTRLRKGAAKLRTLDYAERHGYIRGVVKQIIHDPGRGAPLAKVAFRDPYKYKLREETFIANEGVYTGQFIYAGKKASLNVGNILPLGACPEGTIVSNVEEKVGDRGALGRTSGNYVIIIGHNPDENKTRVKLPSGAKKIISSDARGVIGVXAGGGKIDKPLLKAGRAFHKYKVKRNSWPKTRGVAMNPVDHPHGGGNHQHIGKASTISRGAVSGQKAGLIAAKITGLLRGTQKTAE

SEQ ID NO: 19721 - protein, 108 aa, Candida albicans
SNFLPTTKPKKEKELITSKLELGYIGEFEYIDDHRSGKIVVQLNGRLNKCGVIQPRFNVKINDIERWTDNLLPARQFGYVILTTSAGIMDHEEARRKHVSGKILGFVY

SEQ ID NO: 19722 - protein, 61 aa, Candida albicans
NKMTRTSVLADALNAINNAEKTGKRQVLIRPSSKVIIKFLTVMQKHGMYFFFFGNIGQLFD

SEQ ID NO: 19723 - protein, 117 aa, Candida albicans
ELFKVKNLVLLKVRWLAKSVNFVKDLLRIAQANAEVKGLDSSKLVISHIQVNHAPKQRRRTYRAHGRINAYQSTLSHIELTLTEEDEIVEKPVEQKQIRLNSRQRGRLASQKRLTAA

SEQ ID NO: 19724 - protein, 69 aa, Candida albicans
VWVRTKKKNSTNKIFFKGKKNFLQLTFSHIEIHIKYNSTMVRYAATPANPAKSASARGSYLRVSFKNTR

SEQ ID NO: 19725 - protein, 65 aa, Candida albicans
VELYVPRKCSATNRIIKAKDHASVQISIAKVDEDGRAIAGENITYALSGYVRGRGEAHDSPIFNS

SEQ ID NO: 19726 - protein, 227 aa, Candida albicans
PKMSDVEEKYQEETQPVVQEELQVVELATTIPLDVQEAQREVKLFNKWSFEDVEVKDVSLVDYIQIRNPVFVSHTAGKYASKRFRKAQCPIVERLTNSLMMNGRNNGKKLKAVRIVKHALEIIHVLTEQNPIQVVVDAIVNSGAREDSTRIGSSGTVRRQAVDVSPLRRVNQAIALLTIGAREASFRNIKTIAECLAEELINAAKGSSTSYAIKKKDELERVAKSNR

SEQ ID NO: 19727 - protein, 107 aa, Candida albicans
IYRRRLLSSWCIFFVLIFFTLIHFILFILLFSKTLTNSYYYRKKHLKRLAAPSHWMLDKLSGTYAPRPSAGPHKLRESLPLVVFLRNRLKYAIFTHRGPKIRDKIRG

SEQ ID NO: 19728 - protein, 264 aa, Candida albicans
TTMGRGPKKHLKRLAAPSHWMLDKLSGTYAPRPSAGPHKLRESLPLVVFLRNRLKYALNGREVKAIMMQQHVQVDGKVRTDTTYPAGFMDVITLEATNEHFRLVYDVKGKFAVHRISAEEAAYKLGKVKKVQLGKKGVPYVVTHDGRTIRYPDPLIRANDTVKIDLATGKIDDFIKFDTGRLVMVTGGRNLGRVGVIVHREKHEGGFDLVHIKDALENTFVTRLSNVFVIGTEAGKPWVSLPKGKGIKLSISEERDRRRAQQGL

SEQ ID NO: 19729 - protein, 118 aa, Candida albicans
IRYLLSLHHQRKFFFIFLSFYLSFNFDLLTFILHFNMVLVQDLLHPNPITENEKNKLKKLVQEPNSFFLDIKCPSCFNIKTIFSHAQTAITCDKCSTLLSSPTGGKAKLVDGSSFRRK

SEQ ID NO: 19730 - protein, 231 aa, Candida albicans
TMPRSKRSKLVTLAQTEKKGKENKTRLFDEVRSALDTFKYIWVLQFDDIRTPVLQDVRNDWVGSKLILGKRKVLQKALGETIEEEYKDNLHQLSKLCEGLPGLLFTDESPETVEAYFKAYSKQDYSRAKSRAPIDFTIPAGIVYSRGGQISIEEDVPMSHSLEETLRNKLKVPTKIKAGKIILEEPYVVCNKGDVLDTRQALLLKQFGVAASEFKIPILGYYDGEVHKYDN

SEQ ID NO: 19731 - protein, 94 aa, Candida albicans
VLIDGPKIQRQAIALAKIVLTPIVLPNLPRGSRTATVTKKWAAADIDAKWAASGWAKKLANKERRSQLSDFERFQVMVLKKQRRFATKKALVKA

SEQ ID NO: 19732 - protein, 203 aa, Candida albicans
SIHIPTHLKMAPKGKKVAPAPLATKSAKSSESKNPLFESTPKNFGIGQSIQPKRNLSRFVKWPEYVRLQRQKKILSLRLKVPPSIAQFSQTLDKNTAAQAFKLLNKYRPETSAEKKERLTKEAAAIAEGKTAKDVSPKPVVVKYGLNHVVSLIENKKAKLVLIANDVDPIELVVFLPALCKKMGVPYAIVKGKARLGTLVHKK

SEQ ID NO: 19733 - protein, 265 aa, Candida albicans
LYSMTQPSSKKVAPAPLATKSKASTSTKNPLFESTPKNFGIGQSIQPKRNLSRFVKWPEYVRLQRQKKILSLRLKVPPSIAQFSQTLDKNTAAQAFKLLNKYRPETSAEKKERLTKEAAAIAEGKTAKDVSPKPVVVKYGLNHVVSLIENKKAKLVLIANDVDPIELVVFLPALCKKMGVPYAIVKGKARLGTLVHKKTSAVAALTEVNSADEAELSKLVSTINANYIEKYEENRKHWGGGIMGSKANDKIAKKAKAAAAAVSTA

SEQ ID NO: 19734 - protein, 203 aa, Candida albicans
HYTYISTTMRIYQCHFCSSPVYPLHGITFVRNDAKEFRFCRSKCHKAFKQRRNPRKLRWTKAFRKAAGKELVVDSTLTFAARRNVPVRYNRDLVATTLKGMSRIEEIRQRRERAFYKNRMKGNKERQLAADRKLVADNPELLRLREVELRRKAEKLAAKENAMEEDEETEVEEEGEGDEEMISGEEEWESEDESERESDTKTC

SEQ ID NO: 19735 - protein, 120 aa, Candida albicans
TSKKSKSVKKFVVDVAAPVENDVFDQESYVKYLVEHVKVDGIVGNLGNDISITAESDNKVVVVVSGNGSFSGKYLKYLTKKYLKKNQIRDWIRFVSVKQNQYKLQFYAVAEDDEEEEDEE

SEQ ID NO: 19736 - protein, 65 aa, Candida albicans
RYKFPGQQKIIIFKKWGFTPLNRDEYIAKKTNGEVIDDGAYVKFLSRKGNLEANLQQFPNYQYSA

SEQ ID NO: 19737 - protein, 250 aa, Candida albicans
IIYILHYLQDYICNKKVLSILTNNSFILDKMARRPARCYRYCKNKPYPKSRYNRAVPDAKIRIYDLGRKKATVDEFPLCIHLVSNELEQLSSEALEAARICANKYITKVSGRDSFHLRVRVHPFHVLRINKMLSCAGADRLQQGMRGAWGKPHGLAARVSIGQIIMSARTKDSNKDVVIEGLRRVRYKFPGLQKIIISKKWGFTPLNRDEYIAKKTNGEVIDDGAYVKFLSRKGNLEANLQQFPNYQYSA

SEQ ID NO: 19738 - protein, 62 aa, Candida albicans
GKVHGSLARAGKVKSQTPKVEKQEKPKKPQGTAYMRLLYTRTFVNVTLTNGKRKMNPSPASQ

SEQ ID NO: 19739 - protein, 87 aa, Candida albicans
PLQPITTPTMAREIKDIKEFVELARRSDIKSAIVKVNAKVNANGKKFKQTKFKVRGSRYQYTLVVNDASKAKKLQQSLPPTLKITNL

SEQ ID NO: 19740 - protein, 104 aa, Candida albicans
SAICFLLSTPLLHISVGAKNTRPWPSVGHSIINNYKNVLALSVATDYTYEGSEAVKDRLANPEAYAAAAPAAAAAGGAAEEAATEEAAADEEESDDDMGFGLFD

SEQ ID NO: 19741 - protein, 174 aa, Candida albicans
NKVEMGGAREKKVQYFSKLRELLEEYKSIFVVGVDNVSSQQMHEIRKALRGDAVVLMGKNTMVRRAIRGFLSELPEFEKLLPFIKGNVGFIFTNGDLKSIRDIVVSNVVAAPARAGAVAPKDVWIPAGNTGMEPGKTSFFQALGVPTKIARGTIEIVCPCYSSLTRQPGSAIIS

SEQ ID NO: 19742 - protein, 130 aa, Candida albicans
NTNKNSIYIDVSSSRSKARKAYFTASSVERRVLLSAPLSKELRRQYNVKSLPIRQNDEVLVVRGSKKGSEGKVNSVYRLKFAIQVDKLQKEKSNGASVPINIHPSKVVITKLHLDKDRKALIQRKGGKAE

SEQ ID NO: 19743 - protein, 132 aa, Candida albicans
MTRIFQPPWSKNLEDNTLLVSGPFKVNGVPLRRVNARYVIATSTKVNVSGVDVSKFNVEYFAREKSSKSKKSEAEFFNESQPKKEIKAERVADQKSVDAALLSEIKKTPLLKQYLAASFSLKNGDRPHLLKF

SEQ ID NO: 19744 - protein, 280 aa, Candida albicans
KFFTRNFFLLRFSLVSYNHQLKYNMAVGKNKRLSKGKKGLKKKVVDPFTRKDWFDIKAPTTFENRNVGKTLINRSTGLKNAADGLESRVFEVCLADLQGSEEHSYRKIQLRVDEVQGKNLLTYFHGLDFISDKLRSLVRKWQSLVEANVTVKTSDDYVLRVFAIAFTKRQPNQIKKTTYAQSSKLREVRKKMIEIMQREVSNCTLAQLTSKLIPEVIGREIEKSTQTIFPLQNVHIRKVKLLKQPKFDLGSLLALHGEGSTEEKGKKVSSGFKDVVLESV

SEQ ID NO: 19745 - protein, 204 aa, Candida albicans
  UNSURE (12): Identity of amino acid sequences at the above locations are unknown.
RVPTNIEKNCKXKKQSDVMRFLYRVRCWEYRQKNVIHRASRPSRPDKARRLGYKAKQGFVIYRIRVRRGGRKRPVPKGATYGKPTNQGVNQLKYQKSLRSTAEERVGRRASNLRVLNSYWVNQDSTYKYFEVILVDPSHKAIRRDARYNWIVNPVHKHREARGLTSAGKKSRGINKGHLFNKTKAGRRHTWKKHNTLSLWRYRS

SEQ ID NO: 19746 - protein, 107 aa, Candida albicans
  UNSURE (98): Identity of amino acid sequences at the above locations are unknown.
CGSHQIICLIVFEDWFFFFLSVFLNTQKAERKKFFFHNSTVFTYYHQPHCIYYLTMARQNFVGVVISQGKMNKTVKVRVQGRVYDKRVDKEILTRKDXLVHDESIIC

SEQ ID NO: 19747 - protein, 100 aa, Candida albicans
IGIAAGVNKGRKTTAKEVAPKISYRKGASSQRTVFVRSIVKEVAGLAPYERRLIELIRNAGEKRAKKLAKKRLGTHKRALRKVEEMTQVILHHGRLEGPP

SEQ ID NO: 19748 - protein, 113 aa, Candida albicans
RIKLGYTNTCIIEGVVVAKKDFNQPKHDEIDTRNLFVIKALQSLTSKGYVKTQFSWQYYYYTLTDEGVEFLRTELNIPEGILPLTRLKNAPAERPRPSRGGPRRGGYRGRARD

SEQ ID NO: 19749 - protein, 186 aa, Candida albicans
IKRFTNLISIIYRKMSRLNEYQVIGRNLPTESVPEPKLFRMRIFAPNTVVAKSRYWYFLQKLHKVKKASGEIVSVNIISEAKPTKVKTFGIWLRYESRSGIHNMYKEYRDVTRVGAVETMYQDLAARHRARFRSIHILKVVELEKTDDVKRQYVKQFLTKDLKFPLPHRVQKSKKLFQATAPTTFY

SEQ ID NO: 19750 - protein, 148 aa, Candida albicans
FTNKYILLFRDVPAQDFINAYAQFLQRQGKLEVPGYVDIVKTSAGNDLPPQEAETWFYKRAASIARHIYLRKQVGVGALNKLYGGAKNRGFRPHKHVDASGSINRKCVQALQKIGVLEISPKGGRRISENGQRDLDRIAAQTLEEDDE

SEQ ID NO: 19751 - protein, 164 aa, Candida albicans
AEVIWNTVLTMSFILGRTDAPFNKVILKSLFLSKINRPPVSVSRISRALKQKGAAEKTIVVVGTVTDDNRLLEFPKATIAALRFTAGAKDRILKNGGEAITLDQLALRAPKGQNTLIVRGPRNSREAVRHFGFGPHKGKAPRILSKGRKFERARGRRRSRGFKV

SEQ ID NO: 19752 - protein, 287 aa, Candida albicans
TCCLMFSLPSLTQKLAISKASFLTPIRQLGALGYLKPHEGSTFNYKKLGRGQSSGKGKTAGRGQKGQKARSKVPWWFEGGQTPYYKRFPITGFRKPYQTVLEEVNLLKIQDFWDNGRIPLQKGETLNIKVMKDCGLVTGSLKDGIKILGKGVENYNVPLNIEASRASDIAIQAIEKAGNSFTARYFTRLGLRAHVNPEQFLLKRGYVPLQARPTHKRDIEFYSNPDKRGYLQKDRSILLDPLEKAREELANKKPTKKLSKFKSLEEQLEEASTISYKPSKTISVSDV

SEQ ID NO: 19753 - protein, 130 aa, Candida albicans
AGKAAPAPPVGPALGSKGVKAIDFCKEFNARTAIYNQGVAIPVIIQFKPDRTFTFEMKSPPTSWLLMKAAGVEKGSGKALKEPVGEVSLKHIWEIAKIKKTDDRHKSVDLKAIVGSVISTAKVVGIKVVP

SEQ ID NO: 19754 - protein, 63 aa, Candida albicans
KAAGVEKGSGKALKEPVGEVSLKHIWEIAKIKKTDDRHKSVDLKAIVGSVISTAKVVGIKVVP

SEQ ID NO: 19755 - protein, 186 aa, Candida albicans
KIHELTSLIVKRFKLSPEGIAIYAERVEERGLSAAVQAEALKAKLLSGLPIRRAAYGVLRFAMGAGAKGVEVVISGKLRAARAKSQKYADGFMIHSGQPTRDFIDIAIRHVLMRQGVLGIKVKIMKDPAANRFGPRALPDAVKIAEAKDEDEVIPAPTVKSYKQTAEDETETDAPVEAEAEVEATA

SEQ ID NO: 19756 - protein, 111 aa, Candida albicans
QSSCVIVNVPKTRKTYCKGKECRKHTQHKVTQYKAGKASLFAQGKRRYDRKQSGYGGQTKQIFHKKAKTTKKVVLRLECVVCKTKAQLPLKRCKHFELGGDKKQKGQALQF

SEQ ID NO: 19757 - protein, 125 aa, Candida albicans
RVKMGVVVFGKSIKHNFPVRIGLAKTIFGIGYQTAERLMAKVGIYPNCRMNQLTEPQIMDLNKEISQLLVEGHLKHKINNDIKMKRTIGSYAGSRHALGFPVRGQRTKTNGSTARQLNRTERFRL

SEQ ID NO: 19758 - protein, 61 aa, Candida albicans
YPARYFHGCLNNELIVAGNSLEAVSQNAADIQQICRVRNKDIRKFLDGIYVSERGTIVEEI

SEQ ID NO: 19759 - protein, 132 aa, Candida albicans
  UNSURE (10): Identity of amino acid sequences at the above locations are unknown.
RARIMFPDEXQEQEKTTNEQEAGQLEDSESETKQKIIKLDNNQLVVDKFGNDLGLICIEDLIHEISQLSDNFNSITNWLLPFQLNAPVNGWGPQAKLARLLKADENKQKISLAQDFKLQEVEDIDKIIDEQN

SEQ ID NO: 19760 - protein, 126 aa, Candida albicans
KIEKKNIQKSSESFFHIQQHYIYLQKEFKMAILNSNPEVLLRKRKNADRKRIEKQEQIRERQLNKNKLKKKNQNKFIRAETLVSNHKSNELERKRIKSLIKKQKQTQQQQESAAADSGDAKLLFFT

SEQ ID NO: 19761 - protein, 196 aa, Candida albicans
SNTPPYNNQLVMIRSLFNGIRLVKPNNTNINGITRPITSYMNSINSNIPILKNHNINNNNNNLSSFNQVRHSSLNQIQKYKHYDPIKPNVTKSPDLDNNPFKKGVVLRIMILKPKKPNSALRKCARVRLTNGNVISALIPGEGHNLQEHHVVLVRGGRVQDVPGVKYHLVRGAFDLVGVANRASSRSKYGAKKPKQ

SEQ ID NO: 19762 - protein, 199 aa, Candida albicans
SNTPPYNNQLVMIRSLFNGIRLVKPNNTNINGITRPITSYMNSINSNIPILKNHNNNLSSFNQVRHSSLNQIQKYKHYDPIKPNVTKSPDLDNNPFKKGVVLRIMILKPKKPNSALRKCARVRLTNGNVISALIPGEGHNLQEHHVVLVRGGRVQDVPGVKYHLVRGAFDLVGVANKASSRSKYGAKKPKQYKEIVYVT

SEQ ID NO: 19763 - protein, 145 aa, Candida albicans
IFFLIATTKASAAKKAALKGVNGKKALKVRTSTTFRLPKTLKLTRSPKYQRKSVPHYNRLDAHKIIVAPIATETAMKKVEDGNTLVFQVDIKSNKHQIKSAVKELYDVDALYVNTLIRPNGTKKAYIRLTSDYDALDIANRIGYI

SEQ ID NO: 19764 - protein, 128 aa, Candida albicans
FKKNLVRNAQIEEYYPILYGARVQEEDYSRGFRIPRPMGFNPKNLRASRAANGTQMKRPAVVKTHLRNMIVVPEMIGSVVGVYNGKVFNTVEIKPEMVGHYLGEFSITYIPVRHGRAGNASSKFMPLR

SEQ ID NO: 19765 - protein, 141 aa, Candida albicans
  UNSURE (54),(90): Identity of amino acid sequences at the above locations are unknown.
ESWLNWGWHPVNLIDVARAGQTVTPHRTFFNHQVYRVGKVTDEAMCPTEFDRTXKTINPMGVFVRYGNVNNDFVLLKVSIPGVKKRVVTXRKSLYVDTSRRAVEKVNLKWIDTASRFGKGRFQTPAEKHAFMGTLKKDLEN

SEQ ID NO: 19766 - protein, 266 aa, Candida albicans
KQFSKIPLLPGGRLENFFFFGSCGKKIIFTSVHVLTPCKKLSFFDRESYWFTIVYSTGVFFFWGIVNQQQIAKDQASSLIMSFKILSEHPSELELKVAQAFVDWESQADLKAELRPLQFKSIKEIDVNGGKKALAVFVPPPSLQAYRKVQTRLSRELEKKFPDRHVVFLAERRILPKPARKARKQQKRPRSRTLTAVHDKILEDLVFPTEIIGKRVRYLVGGNKIQKVLLDSKDSTAVDYKLDSFQQLYSKLTGKQVVFEIPGESH

SEQ ID NO: 19767 - protein, 157 aa, Candida albicans
EEKIKKMSDVEQEQIVEEVVVEEQSGAITIEDALKVVLRTSLVHDGLARGLREASKALSKREAQLCVLCDSVTEESIIKLVEALCNEPEEKIPLIKVSDAKLLGEWAGLCQLDRDGNARKVVGASCVVVKNWGADSDERNILLEHFSSTNIMDFFHH

SEQ ID NO: 19768 - protein, 105 aa, Candida albicans
HFFIVYVKGKHISYQRSKSVTNPNVSLIQIEGVASPKDAKFYLGKRIAYVYRAPKEIRGSKIRVIWGKVTRTHGNNGLVRANFKKNLPPKTFGASVRIMLYPSNI

SEQ ID NO: 19769 - protein, 135 aa, Candida albicans
KVLSDGGLYVPHSPNRFPGWDIEAEELDAELLRKTFSVVTVAEYMEELLDDDEEKYQSIFKNYIEEEIESEDVEEIYANAHEAIRADPSFKPTEKKFTKEQYKAESKKYRQQKLTRAERQAKVAKKIAEFKAQQE

SEQ ID NO: 19770 - protein, 211 aa, Candida albicans
LSFPFFFESRYHIITKLDIMPMQKEFRTSAYHSRFQTPFRRRQEGKTDYYQRKRLVTQHKAKYNSPKYRLVVRFTNKDIIAQIVSAHITGDVVFTAAYAHELPRYGIKYGLTNWSAAYAVGLLVARRALQKLGLDETYTGVEEVEGEFELTEAVEDGPRPFKVFLDIGLQRTTTGARFFGVLKGAFRWWFVRSTLTKQIPRLGYRSRRIGC

SEQ ID NO: 19771 - protein, 99 aa, Candida albicans
LIIFFLNRTKRTKKVGITGKFGVRYGSSLRRQTKKLEVQQHAKYDCSFCGKRTVQRGATGIWNCKSCKKTVAGGAYTVSTAAAATVKSTIRRLRKLAEA

SEQ ID NO: 19772 - protein, 289 aa, Candida albicans
RKEKKFFRDHISTDYCQQVSSINNSKHQITLEVMASVARPAVAPSNATFKDKEKPQEVRKANILAARAVSDAIRTSLGPKGMDKMIRTKNGEIIISNDGATILKHMAVLHPAARMLVDVSHAQDVEAGDGTTTVAILTGAFLGAAERLLSKGIHPTLIAESFQRAAQRSVEILLDMSYKISLDNREQLIRAATTSLSSKIVSQHSQLLAPLAVDSVLKVINEEEISSGPDETIMKKNVDLNDIRLIKKVGGTIDDTHLVNGIVLTQNVVKHAGGPVRVDKAKIGYIHPR

SEQ ID NO: 19773 - protein, 184 aa, Candida albicans
VLVNLIEELVSSGSKIVEITGVKSRNIKPTVSVIIRGANNLFLDETERSLHDALCVIRCLVKQQALIAGGGAPEIEVSRQLMKEANKLSGVEQFVYKEFAQALEVIPTTLAENAGLNPINVVTDLRNRHENGEKDAGISVRRSGASNTYDEHVLQPVLVSTSAIVLASECVKSILRIDDIQFSR

SEQ ID NO: 19774 - protein, 81 aa, Candida albicans
VQLLLRITQLLPRTPPIKMSTVYFDVSADGQKLGKITFKLYEDVVSKTAENFTALCTGEKSVGYKGSIFPRVTPQFMLPSG

SEQ ID NO: 19775 - protein, 68 aa, Candida albicans
  UNSURE (10): Identity of amino acid sequences at the above locations are unknown.
PICGPSTAVXEHGSQFCITTVPCPWLDGKHVVFGEVTDGLDIVKKIESFGSGSGATSKKIVIEESGQL

SEQ ID NO: 19776 - protein, 394 aa, Candida albicans
LEESGGIEINLKMVKVYLTGMQIQHPNGNDDSPVMPLPQVEITGDGITTLFLLVGELLKQAERFISEGVHPQVIVDGFEIAREISLEFLDQFKQKVEIFDREFLLQIARSSLATKVTNELADVLTPIVTDAVLTVKEESQRNLDLHMIEIMTMQHGHSKETELIQGLVLDHGARHPDMPRRVKNAYILILNVSLEYEKTEVNSGFFYSSAEQREKLVASERKFVDDKLRKIIELKNEVCDLNSDKGFVIINQKGIDPMSLDVLAKNGILALRRAKRRNMERLQLICGGEAQNSVDDLSPEILGYAGLVYENAIGEDKFTYVTECKDPRAATILIKGSNSHVLQQTKDAIRDGLRAVSNVIKDASILPGAGAFWLSCNNYLLQSDASKKILIGKN

SEQ ID NO: 19777 - protein, 558 aa, Candida albicans
NHTIMFSTARSDTLFLGAQKISGDDVRTQTVLAAQTVANVVKSSLGPVGLDKMLVDDIGDVTVTNDGATILSLLDVQHPAGKILVELAQQQDREVGDGTTSVVIIAAELLKRAHELVRHGIHPTTIISGYRLALRESIRYINQVLSQNVDQLGKETLINIAKTSMSSKIIGSDSDFFGKMVVDAMLAVKTTNGKGETKYPVKAVNILKAHGKSALESVLVDGYALNCTVASQAMVKSVKNAKIACLDINLQKARMAMGVQINIDDPDQLEEIRKREYGIIIERIQKILASGANVILTTKGIDDLCLKEFVENDCMAVRRCKKEDLRRIARATGATLVSSLSNLEGEETFETSNLGYAEEVVQTRISDDECILIKGTRQHTSSSIILRGPNDFSLDEMQRSLHDSLSVVKRTLESGHVVPGGGAVEAALNIYLENFATTVGSREQLAIAEFANALLVIPKTLALNAAKDASDLVAKLRTYHAAAQIAKPDDEKRRKYKNYGLDLINGKIVNEATNGVLEPTVSKIKSLKSALEACVSILRIDTIIEVHPEPPKEDPHAH

SEQ ID NO: 19778 - protein, 288 aa, Candida albicans
RFSFKILNSCYFFFLYSIQLNKTLQMSSILLAVIFLVNLVLSSVIPQTDLKLSVEEQSHLEGDPSVTHKVVFTIKHGDELLGDLTLALFGETCPITVENFYQLAIRGEDGQGYKNSKFHRIINNFVIQGGDYDGRGGKLIYGDSFNDENFILKHNKLGRLSMANAGPNTNGGQFFILNGKPTPHLDGHHVVFGQLVDGFDTLQKISTVETKDSSPLKPVVISDVKTAIDKSKVNQKEETGTSSSSETEGITAVSTSVYSYLFIILLLGVVFAAYKMMPRRDQITTIKD

SEQ ID NO: 19779 - protein, 246 aa, Candida albicans
QEGRLLSRKCKEKKSLHMSRSFTQFHSPTKPQLSMKSLTSIALIASIIVAFYTQLVLGGSSNLPKNPPVTNKVYFDVEEDGKSIGRITIGLFGTVVPKTVENFRVLCTGELGPSYENTVFHRVIKDFMIQSGDFEYGQGYGGYSPTHNNGKFDDENFELKHDRKYRLSMANAGKNTNGSQFFITTALTKWLDGAHVVFGEVLDGKDVVDYIENVKTGRGDRPVKEIKIVASGELKDSETNPSKDEL

SEQ ID NO: 19780 - protein, 120 aa, Candida albicans
EILKSVECKRKTKSGDFISVHYSGKLEADGKEFDSSYLRGTPLPFNLGGKQVITCWDEGLLDMCIGEKRELWCHPNVAYGSQGIGPIPPNAALIFTAELIDIAGVDKEEQEEEVVNKDEL

SEQ ID NO: 19781 - protein, 308 aa, Candida albicans
LTLIVPTRAFVEKKKQPLNLDPAYHVIITTMDQTIAQIINDDIDLYAVLGVSSDSTPQDIRRAYRQKALLFHPDKYDGDETKFNLILKSYEILSDTSLKSKYDELCQIKLTKLENRAKLDDLTRRFQDELIASELKRQKHRHPDIESMKQEGLKKRRIQEQKLFNEKKTCTTIYDIPLNNNVSVSLTYANTTVSLKYKFKKELETLIDENVLSKIMLIFGEVTKVTMNGHDNRYAYAYIDFATIDGCNQALRHNYSESARKWDGTDVRKLASLLRECKKADTGNSDFTNNAKVNQILRDYLKSVNSRI

SEQ ID NO: 19782 - protein, 203 aa, Candida albicans
KKLIESKLSNCTLIKMPMILKLLKKFQELGEAYGILLNPESRKIYDEFGVEGMKENPTMQQAADIDPAEFFSMIFGGDSFKQWIGELSMLNDMSKMGEIITEDEVELDNVEEESKLGKQHGATDSLNESVQTLTISDNNNNNNTKVSSSNNKPTSNLTSEEIKKLKKQKINEQQREQMLKYQEEAKQAKLKRIDDLTSGMLKR

SEQ ID NO: 19783 - protein, 196 aa, Candida albicans
RQKLMIDKANATIHASKTFGVSKIFTSVKSKTETVKNGYSILKTAVDAQLSIEQMVKEQEQFLLAQEEGHQPTQEELVKQAEMERIITGKFLATAWATTKFEVTDILRKVCHNVLRDKTISKKERVARAEALLYIGKEMSKVERSPEEEEEARIFEEMMAEAQAKKSSKKQKSMNNKELEEYMKKMAAENAEAEEN

SEQ ID NO: 19784 - protein, 338 aa, Candida albicans
TLRRPPKSKFFYNRRVFSKCFFSNSFLLNNPTTSYWKVMKFIKVFLLFVTIVVAAHWSKEDYEIFSLNDKLQQDLGHDITFYKWLGLEKGPKSNLQEITKAYRKLSRKLHPDKFASASRSDKKKANKRFQRLSLVGNILKDQSLKRRYDYFYTKGFPKWKGTGYYYSKFRPGVIFTLIILYVLVGFLHFFSLKINRKQAFKRIVDLKNEVKNQAWGGLQFPPGDGSDRKLSNEATGKVFLVKADGTVWLVENDGEQHLIDEYDVNVNPGFKESLFFKIPVKIWNLILGKWVPIDTSVEYKKQETSPQEDDTKKKVQKKKSKGKKVELPNGKVVYSRKK

SEQ ID NO: 19785 - protein, 290 aa, Candida albicans
  UNSURE (34),(281): Identity of amino acid sequences at the above locations are unknown.
PKPFVHRRFVTKLSYYFPNLAVDVILRLKGCTNXNHIQIIKKVGGKLSDSYLDQGFILEKKFGIVQPKKITDAKILIANTSMDTDKVKIFGAKFKVDSTSKLAELEKAEKLKMKNKVDKIAKFGINVFINRQLIYDYPEQLFTDAKINSIEHADFDGVERLALVTGGEVVSTFDSPDNVKLGHCESIEEIIIGEDTFLKFSGVAAGEACTIVLRGATEQVLDEAERSLHDALSVLSQTTRETKTVLGGGCSEMLMAKAVDQAAANETGKSALAIEAFSRAXRQLPTILAD

SEQ ID NO: 19786 - protein, 99 aa, Candida albicans
TGKKKAKKKPSLVFLVQHLQTPYSSSLHIPHLAINFTKMVKDTTYYDILQVEVTATDVELKKAYRKQAIKLHPDKNANDPKAAEKISRIGRSVRYFTES

SEQ ID NO: 19787 - protein, 515 aa, Candida albicans
TIPLTINMVVDNTYYDLLNIETSATSLEIKKAYRKAAIKLHPDKNPNDPDAAAKFQEVGEAYQVLSDETLRAKYDKYGKQESIPQEGFEDPAEFFSMIFGGEAFKDWIGELSLLLELSKSAELSGYSDDADKKKDTKTAGTGSDESKESNESKKQKLDTTENGHKSSTEPRLLANGENTPGNQLTEKELEEKKRKEELEKFEEECRVKKIETRNELSKKLINKLSLFTETDMKDDVVESFQTKIKYEAESLKMESFGLEILHTIGHIYKTKSKIFLKNQTFFGWGGFWWSMKEKGGVVKDTFKTVSAALDAQRTMEEYTQMQQDNEYHAKKEAEEEEAKKQANEEVSKLEKELEEVKKEQQQQKSQDKPAAETEGSSTGDSQLKEGQEAEGSVSKSETKEPAKHTAEELAEMEKYLMGKVLAAAWNGSKFEIQGTVRAVCDNILEDKDVSLETRVARAKALRLIGDVFVSMTRTEAEAEEARVFEELVAEASKKREKKKTPTEAEQQQERAEHAS

SEQ ID NO: 19788 - protein, 487 aa, Candida albicans
QQLSVMAFSNQTPTIVVLKKGTDSSQGRGQILTNINACLAIQDTLKPTLGPFGSDILIVDSNGKPTISNDGATILKLLDIVHPAAQMLVDISRSQNCEVGDGTTSVTIIAGELLKEAKNFIEDGINPHLIIKGYRKACQLSIEKIESLSIDVLENNTDSGNFRDLLEKCATTAMSSKLIKTNSKFFTKMVVDAVLTLDRNDLNENLIGIKKVPGGSLEDSLFIDGVAFKKTFSYAGFEQQPKSFSNPKILCLNVELELKAEKDNAEIRIDQVNQYQQIVDAEWKFIFDKLESIYQTGAQIVLSKLRIGDLDTQYFADRNIFCAGRVSDDDMNRVIQAVGGDIQSSCSNLLKDGKLGQCESFEEIQIGNERFNIFKGCPQTKTCTLILRGGAEQVIAEVERSLHDAIMIVKRSITHKKIVAGGGAIEMELSKYLRDYSRQIHGKQQLIIAAFAKALEVIPRQLCENAGFDSIELLNRLRSYHAKVKVF

SEQ ID NO: 19789 - protein, 692 aa, Candida albicans
NHFNIMRSSQSSWLPRIGLLYVALVILIPFLVSPKHAFAVAAVSDDESSTDNYGTVIGIDLGTTYSCVGVMKNGKVEILANDQGNRITPSYVSFNGDERLVGDAAKNQASSNVNNTVFDIKRLIGLKYNDDTVQKELKHLPYKIENKGNKPVVKVEYQGEEKTFSPEEISSMVLGKMKSIAEDYLGKKVTHAVVTVPAYFNDAQRQATKDAGTIAGLNVLRIVNEPTAAAIAYGLDKGDQEKQIIVYDLGGGTFDVSLLSIEGGVFEVLATAGDTHLGGEDFDFKIVRYLAKQFEKKHNIDITANAKAISKLKREAEKAKRTLSSQMSTRVEIDSFVDGIDFSETLSRAKFEELNIAAFRKTLKPVEQVLKDGGVKKSDIDDIVLVGGSTRIPKVQELLEGFFDGKKASKGINPDEAVAYGAAVQAGVLSGEEGVDDIVLLDVNPLTLGIETSGGVMTTLIKRNTAIPTKKSQIFSTAADNQPTVLIQVYEGERTMAKDNNRLGKFELTGIPPAPRGVPQIEVTFSLDANGILKVEAADKGTGKSESITITNEKGRLSKDEIDRMVEEAEKYAQQDQELKEKIEARNSLENYAHVLRGQLSDTSETGLGSKLDDDDKETLDDAIKETLEFIEDNFDTATAEEFEEQKQKLIDVANPITAKLYGGAAGEGAGGAGDAKFGDDDSDDEFDHDEL

SEQ ID NO: 19790 - protein, 529 aa, Candida albicans
MSIQAPVVYLNTSTQRQQGRQAQVANITAAKAVADIIRTCLGPKAMLKMLLDPMGGIVLTNDGHAILREIDVSHPAAKSMIELSRTQDEEVGDGTTTVIILAGEILAQTFPYIEKNIHPVIIIKALKQALKDALEIIHDVSTPVDIKNDAAMLKLIKASIGTKYVNKWSTKMCELSLKAVRTVMVEKGDYKEIDVKRYVRIEKIPGGEVTDSEVLDGILLNKDVVHPKMKREITNPRIILLDCPLEYKKGESQTNIEITKEEDWNRILQIEEEQVKLMCDQILEFKPDLVITEKGVSDLAQHYLLKGGASALRRVKKSDNNRIARATGATIVNRVEDLKESDIGTKCGEFKVELIGDEYFTYLVKCENPQACTVLLRGASKDILNEIERNLHDAMAVTRNVMFEPSLSPGGGATEMACSVRLAEKAKTIEGIEQYPYQAVADAFEVIPRTLIQNCGGNPIKVLSQLRAKQAQGQYTYGIDGENGKVVDMKDYGIWEPEVIKQQSIKTAIESACLLLRVDDIVSGVRQSQ

SEQ ID NO: 19791 - protein, 490 aa, Candida albicans
RNKIIVNKLGKKFITNDAATMLNELEIVHPVVKILIQASKQQEFEMGDNTNIVIILAGEFLNVAEKLLTLGLNVSEIIQGFNLANKFVMKTLDELVVEKVESFETDLLKAVKPVIAAKQYGVEDTIAKLVVDAVALVMKNGSFNVDNIRVVKVMGASLSQSQVVKGMVFPREPEGTVKNAAKSKVVVFTNPIDISTTETKGTVLLHNAHEMLDFTKGEEQQLDQLCKEIHDSGVKVVVAGSSVGELALHYLNKYGILVLRVPSKFDLRRICQVCGATPLPRLGAPTPDEMGEIDIIETKEIGGDRVTIFRQDESSSRTATIVVRGATQNNLDDIERAIDDGVNSIKGLIKDNRLLPGAGAVEIELMKRITAYGESTPGLLQLAIKSFAKAFEVIPRVLAETSGHDSSEILSKLHAAHAEDTGLRAGIDIDSGEVADTAVLDILATKKSAIDLAVDATNTILSIDQIIMAKRAGGPVMPQQPRPGNWDQDD

SEQ ID NO: 19792 - protein, 566 aa, Candida albicans
LLLHTQVANNFHISFIDNMARAPQGMPDLSNAIVAQDEMGRPFIIVRDQGKKERKHGIEATRSHILAARSVASIVKTSLGPRGLDKILISPDGEITITNDGATILSQMDLENQIAKLLVELSRSQDDEIGDGTTGVVVLASALLDQALELIDKGIHPIKIANGFDEACRIAVEHLNTVADNILIDDKENLLRAAKTSLGSKIVSKAHDHFAKMAVDAVLEVADLDRKDVDFELIKMEKKVGGSIEDSSLIKGVLLDKDFSHPQMPKEVRDCKIAILTCPFEPPKPKTKHKLDISTVEEFKVLQEYEQKKFQEMIDAVKQSGANVVACQWGFDDEANHLLLANGLNAIRWIGGSELELLAIATNGRIVPRFEDLTPDKLGTAGVIRELEFGTTKDRMLVIEECSNTKAVTCFIRGSNEMIAAEGIRALHDSLCVVRNLVRDSRVVYGGGAAELTCSLAVSEAADRQKGIDQYAFRAFATALDTIPMTLAENSGLDPIETLSALKSKQVNENSSHLGVDCLGKGTNDMKELFVIDPLIGKRQQLLLATQLTRMILKINDVIISGKDEY

SEQ ID NO: 19793 - protein, 158 aa, Candida albicans
NHSLHDNFLMISYYKVLGVTPEASIPELKQAYKLKLLTSHPDKIDNSSAQVDIPLIKQAFATLVDPTSRKQYDKQLIESSKLKGFNINGGGLDIYSLDDFEFDNDEWSKSCPRCTAHNSICLTETDLEKGTPDKDGGFDIIVQCNSCSLWIQVKYYEE

SEQ ID NO: 19794 - protein, 684 aa, Candida albicans
FFLSLFFFYIKSTPNQDILHHQPNYCSFIIHIYRMKGSLFIFYILSIVFCAILGIDYGQQFTKAVLLAPGVPFEIVLTDEGKRKDLSGLCIRKVSNNDLERVYGSQMGSLVTRFPHNCILDLKQLLGKSIDDPSVNQYLKNHFVKLVADEARNGIKFDLGFNNSTLEFSVEEILAMNLNEIKSRALNDLEANPHAAALVEDVAVSIPPFASQAVRQAYLDSLALANFSNVLGLVEEGTSVALNYITNKKLDKDLYDNVKHYYLIYDVGAGYTTTTLFSFTPKSIGQSVLEIESIGYDEMLGGKTLTNSAYSLVLEKFLNQFNLEESDLTDKIAARLQDTAEKAKIILSANSDFQTTLESVYNEKDFKLSITRQEFEDINADIMNHIADPVLKTVLEAGLKVDDIEYVILNGGSTRVPFIQKHIATLVGENKISKSVNTDESSALGTTAKALRLKAGVSSGKDMILLEKSFSNFEVGLNDQEETKVVFAKGATIGNTTRVHLGKISEDRIAISLYENGALIKSYNFDDLLSKAKKLDCKLIEDKNIFGKLSLDNNKIFDLVGLEVECSSGKEGSFFDKLMKKGHSENDEGSDNQEESTPENSTNSTKNSNSSKKVRSPKVIYVPVSKPTYPHIKPIGRVAKQSLLDKLAYLKAQDELKIATDHIKNELEGQCYKLREFIETHHSA

SEQ ID NO: 19795 - protein, 368 aa, Candida albicans
VMNILKMMMTMRRRLRRKMNWTRKKERKKQKQENFSQKSIGKKSSKKDEDEEEDDEEEDDEDEDEDEDDVFEYIVCTLSPRHQYQQTLDLTITPDEEVYFVVTGSYPIHLTGNYIEHPADQDEEDYDDEDEDYDDEYDLSPDEDEIIYGAALDDEYDDEEESEEEGTPKIEEIVEEKEKEKVKESPKESKKRVAEESTSKKSKKAKKDEKKSVQFSKELEQGPTGSTLVEKDNKKATPTKDKKETPVKDDGDKKKKFPTKTLLGGVITEDRKIGSGATAKSGAKVGIRYIGKLKNGKVFDKNTSGKPFSFKLGKGECIKGFDLGVTGMAVGGERRVIIPPKMGYGSQALPGIPANSELTFDIKLVSLK

SEQ ID NO: 19796 - protein, 187 aa, Candida albicans
DVTYTVTIDHGKGTYTCNTEKGESSWCKHLYMYHKMRFLVFGDNMEKQMDFPVEDSQDYFSDEDDGSFSDIELENQERDFHFDNELASSYDDPLDIIDVVNLTSSNNEGTSTGQSDQNIPQKTFEELSTEIEGYLENISKRYKEILENSPEKVSELALYMRSFSQQLEYISTGKQDLDHDPKRRKKN

SEQ ID NO: 19797 - protein, 95 aa, Candida albicans
HNKCSIYFKHSVMSSSYTKEQESIVLKVLSYKPHQFYEILSVEKSASEGEIKKSYRKLAIKCHPDKNPHPRSSEAFKILNKAWEVLSDPQIEENI

SEQ ID NO: 19798 - protein, 118 aa, Candida albicans
IFQKFNYNYKTYQKVMKTCYYELLEVSSTATDTELKKAYRKKALLLHPDKNPDNVEEANHKFSLVRAAYEVLSDPQERAWYDNHKQSILNDEDEIIERESYFPSISTGRIFRFFNPSM

SEQ ID NO: 19799 - protein, 433 aa, Candida albicans
RNPNMLNILKFPGYEEYHDDDDKNINAINPSLIKYPRFGNSQSSYIDQIRPFNNVWGSFQTCKTFNWKDEYRYSVAPDRRTRRMMERENKKLRDEARKEYNETIKKFVSFIKKRDPRVKLGQEELNKLNKRKQLQEYENQIRQQQQLNKLKNNNNGGDAKFTEQDWQKLTPEELQELEQMLQEEYEEEEEADSTDSEFGHDDNENFEVHEFECIVCDKIFKNEQQFQIHEDSKKHKKNVRQLQWEMKQEGIELGIDKHDGDDLSEFETASSEFHDDDDDDDDTDVSEELEEEVLEDQDNELKTDEDNLVEKSTDNIDLDNLEVDDEIDEDIVVNTTTTPKKESKPTLNKVEEDLAHLLGQTSLSTKGIDESDDDWLDNKRKPKKGKKTKKKSQTNSKESTPNTENKPIINNIEKCSVCGTTFESRNQLFNHVK

SEQ ID NO: 19800 - protein, 305 aa, Candida albicans
QLQTGQMIFNYLLALFQILVLASARAQADEYASDPNIFELTPSNFDKVVHKSNYTTLVKFYAPWCGYCQKLQPVYHKLGKYINKDAKYSINIASVNCDKDYNKQLCSQYQVRGFPTLMVFRPPKYEKGKQVKLQKHASEVYQGERTVKSITKFLTSRLKNYVKKFHNIRSDGIAEWLAEDIPSVLLISNANLVSPLLKSIAIDFLDRVNVGMISKFNDESHKFVIGDKEIEVPATSKSSLFYFNKEKGELVAYTKSDKLNDKIKITEWIIEQTQQQPIEGPLSKKEKKYYYKYRTGKKKIEHDEL

SEQ ID NO: 19801 - protein, 663 aa, Candida albicans
NFFFLLLHHPKTSHINFLSLMKILKKLFSSTIFYSQRRYHSMSVETISDSLKQLGLSQPAAIEGTHPQYNVVDVFRNYIAEELHRISSVDKSIIIQALDTPKVLDQGDIIVPIPKLRLKGINPNEKSKEWAENFNKGKFISEIKPQGVFLQFYFAKTLLYNLVIEDVLKRKSDYGYLPLGVGKKAIVEFSSPNIAKPFHAGHLRSTIIGGFISNLYEKVGWDVTRINYLGDWGKQFGLSAVGFERYGDESNLASYPINHLFEVYVKINQDVTNETSEATGETPAETIDASEQDEKKIQSSTNEEARRFFRRMEDGDESALKIWARFRDLSIEKYVDTYGRLNIKYDVYSGESQVPQEKMKEATKLFEDKGLIDIDRGAKLIDLTKFNKKLGKALVEKSDGTSLYLTRDVGEAIKRYETYKFDKMIYVIAAQQDLHCAQFFEILKQMGFEWAHNLEHVNFGMVQGMSTRKGTVVFLDNILQETKEKMHEVMQKNEEKYAQIEDPDKIADLIGISAVMIQDMQSKRIHNYEFKWDRMTSFEGDTGPYLQYAHSRLCSMQRKSGISIEELEHANFDLLVEPCASALARTLAQYPDVIKKAVKGLEPSTIVTYLFSVTHIVSQCYDILWVSGQEKDVAIARLALYEAARQVINNGMTLLGLTPVNRM

SEQ ID NO: 19802 - protein, 213 aa, Candida albicans
LYWENTFCKYSNNNCIPIIIPRCIRITTKDPCLIPCAIDQDPYFRVCRDVADKLRFTKPSLIHAKFFPALQGASTKMSASDTTTSIFMGDTAKQIQKKINKYAFSGGRATAEEHRELGGNPEVDVAFQYLSFFSYDDEKLAQLEQGYRKGEILSGEMKKECITVLQEFVSAYQERRSKVDDQVVEKFMKPHKLVFGNKERKVPAKQREKKAKK

SEQ ID NO: 19803 - protein, 255 aa, Candida albicans
QGLEYKSLHISLMSVEEKVSQLKVTEESEQKITPWEVEGAVVDGKSMGIDYDKLISQFGTKHITEETLERFKQVTGEEPHPFLKRGVFFSQRDLDRILDLYEHGEPFFLYTGRGPSSDSMHLGHMVPFIFTKWLQEVFDVPLVIELTDDEKFLFKHQLTIDDVKGFAAENAKDIIAVGFNPENTFIFSDLQYMGGAFYENVVRTSRQITTSTAKAVFGFTDSDCIGKIHFASIQITTAFPSSFPDVLGLPPKTLV

SEQ ID NO: 19804 - protein, 435 aa, Candida albicans
RHGNLLKYRGKELDEFKMHPQQQQQQQEVKQELSPAESNESNESLAKDSSTTPASISDSPLHSETESTVSSTIIANSNQIFKCPSCDAEFRVRGYLTRHMKKHSTKKAYTCPFHDKSIYVDENNITHKCHSSGGFSRRDTYKTHLKLRHFNYAKPIKSAERSKVPGQCAMCGEHFNSAEIWCEIHVEGGECKFLPMGFKGKSRIKNRLKKQIQKNKMIDPELVPFASKVLEEVEQERQKKKNYRTTGTGSESSIQSQESESSINSTPLSMQISAPVPMPVSIQQQHQHQHQHHHHVQNQNQQQSIATPASIYSSSASSTSSYESTHSPYTPQSSRSPLSHMYNPQQPPYFNQIAQAHQQDGQKNQVKDDYDDEYCLDVDQLNTTFVNETVANYLQIHDFHSMNQYQPGQQHQQQQQQQQQQQQRQHQEQQPSMYF

SEQ ID NO: 19805 - protein, 442 aa, Candida albicans
RTNSITMLILSIGLIHHTSNKSLYTISPNKGKRYEPFTTTSLGNFQFHVVRFLHRLIYGTQRYQELFPPIQKIKNINNVKQHRIFPVNCAADDLDLGFGESDQIELFNHPSKDTYGQFNLIQLIDIFDPPQVHAPSSADEFFKSNKGSEHIDIFDMITRQPPPFHQHQLNIETPYFEDFATPLVLPPHEVSSDDVESYFSGSVSTVSSIEPLDDEFVPPPQPPRTHTSRKRKHDSISPPASSDSSSSSSYVPQLIPSSSSSVTSNGDSPVSPTTKRKYTKKKQPVFSNVDEPIVITTTTKTNNIDVKKITTTKNGTVENRFDCPSCDASFKVKGYLTRHLKKHSTSKAFECPFFDNHGVHGSKCHPTGGFSRRDTFKVHLRALHFIYPAGVKASQRNSFNGRCAGCFQYFDNNSEWLENHIEAGKCTGTVQYKQNVSNLLLD

SEQ ID NO: 19806 - protein, 393 aa, Candida albicans
NHEMETKDHEATHSPQQSIQLSSSTVQQDQNQKGLPLQQQQQQEDEQQPQKYQTDNIRVPSQLPSNYDFTTTTETISSSYVMPLSNIQGNSQYQKQHFSTDPVPSPVPHQFSYPGSAVSQAPPQSSAPPSQSHSIPLYHQYFGQSLPNDQLQLHSSVHEPRNTHLSLNSTRPYYSSISQPQPPPPPPPAPQRLPSLPTYSMPETESQQQHYVWSTQDSQSHHHQVPPSAITTDSSTASTTTRNTMPFQVSTNIDINRFPDVTSLVNSNANIVVPLVESRFVDAKICTICGKRITRDMSRHLRTHQVEARFHCVFPKRQCRHKLGKFNRPYDFKKHLLNRHFIFDDSAIKRLHNLSDKLDHWGMCPCGLRFTGKDWLNDHILTNDRTKKCRLVE

SEQ ID NO: 19807 - protein, 258 aa, Candida albicans
QASFQSDLILLKPLIFNMSTKVYSYSDSQDVANSVGKYVIEQQNKAIEANGSFKIALSGGSLGKILKQALIDNKEIGSKAQWDKWEVYFSDERLVPLYHPDSNFGLFNEMVLKNLPQETTNMKLHVIDQSLLTGKDGKLDDLVDQAKDQEIAKEYANGLPKQFDLILLGCGPDGHTCSLFPGHKLLEERDELISYISDSPKPPPRRITFTFPVLENAKAIAFVATGAGKAPVLREIFLGQSKLPCALVNDIKTGVSVS

SEQ ID NO: 19808 - protein, 456 aa, Candida albicans
CYVICGKVRFEYLSSCQSFSQYVLGIVFEIHLLVELSVFFAFTHNLYIYRQSVQFLISCAFTFITSTIYHCIINYNINYNMLSMAVTPSNTLTSQYPTKQENYNQNYCSIKSPSPTCTPTSTSLTMTSPPQLHNPHASITLPSIHSLDIPAFPHYEQEYSRASVFQNYSSNSPTPSNSSYSPTLLIPSNDRPASSSVYSNSSSTLLLSPGMSTTPNVNCIAPVSRPRSTSNLTENSEQLFTSQQLHPAILSNATITSPQLSVKSEDEQLHEPQNSNTIISPRQNKKNWKPRKKKQCPECNLYFSNLATHKSTHLKPNNRPHICKYCERGFARPNDLFRHVKCHWKEIGSDQGQFKCPFKNIDSSKRENQEKVTGNTGVPDHCCHNTGIFSRCDTFKNHLKAIHFQYPNGTKKEQRNLVNGKCRMCQQEFRNVDDWMHNHIETNLCPYAINLIKKEH

SEQ ID NO: 19809 - protein, 367 aa, Candida albicans
SNRNIVISLTSLTFLTFLNKMTTTVPLIYSFPEFLGVADAVADHIITAQNQTLYNTTDLDQIELIKQRSGNTPSHTPRHSQSGIELPSTTASGALNTPLSRNGSSPKLNNNNGNTTTTSSSGRPKKEKKIQKKQEVRFKIAISGGSLIKILHQGLLPRQKYIEWDKWDIYFADERLVPFESPDSNYGQAKREIFDLITGDKKPRIFHVDESLIDDSQEAADEYEKQLINNFAKKDSVKLPLFDLFLLGCAPDGHIASLFPNHGEQLREKLAWVLPVSNAPLGPENRITLSIPVICHSARVTFVVEGLTKAPIIKTIMERPEKGLPSSIVNEGAAGRVSWFVDDDALNDLFDITKKKYKYLSIPEPSH

SEQ ID NO: 19810 - protein, 247 aa, Candida albicans
AHLIHCKYIYTSLIVTGNRKFKKRDTEKKKNHESSKLQPSMPPPDKARRDVLISKALSYLLRHGAEKEKLSIDDQGYVKISDVLSHQRLKSLKTTRDDINRIVQENDKKRFTIKDDMICANQGHSLKAVKNDNLTPMTVDELNQLRIYHGTYRTKLPLIKSSGGLSKMNRNHIHFTCEQYSTCSGIRYNANVLIYINASKCIEHGIVFYKSLNNVILTSGDKDGKLSWEFIDRIVGLDGNEINKEQV

SEQ ID NO: 19811 - protein, 420 aa, Candida albicans
YKNIEFPNWILTAFFEVTIKNAGKTYDIELQEEDNGQTLKSKIQQLTLIPPERQKILIKGGKLTDEVIVSTLNLKSPVMVLGTPDKNLPSKPVEKQVFLEDLNKNQLVKVSNEPSGLTNLGNTCYLNSSLQTIFHIDDVNNRLKDYTFGGANQANSAFVLSLKSMFQQMSKKQEVITPSTFLSLFRRSYPQFAEQQNGIYKQQDAEEAFSQILSSLRSELKIDDVFKITFNTKTQCLAIPEDVTEGFEEAYKLNCHIGVKTNFLRDGLLAGLKETIEKHNSTLNADTEYETTKTITRLPKYLTVHFIRFFWKRDINKKSKILRKVQFPFELDLAEMLDVSIKADKVSNRDTIRKVEKDNLDMIRDFRKTKNDTSLTPLEQLEEDEMKITSIKSKFKDDLNSALPNVDFNTTTENPSSVYE

SEQ ID NO: 19812 - protein, 215 aa, Candida albicans
AAQGQRKELTEEEKKAKAAAKEAKKAAKAKANAEKNKQQQAPVATPPNPSMIDFRVGFIEKAEKHPNADSLYMSTIDMGDAEGPRIVCSGLVKYIPIEEMQKRYVVVVANLKPVTMRGVKSCAMVLCASDSEKVEFVNPPAGSKPGDKIFFEGFNGTPEKQLNPKKKVWEAVQPHFSTNENYEVTYTEEGKEPKRLVNEKGELCKNSSIVKADVK

SEQ ID NO: 19813 - protein, 174 aa, Candida albicans
YTKDAPSYLKLQVGQIQLCKRHDDSDKLYVSQVEIGNDTTIQVCSGLVPYIPIDQMQNRKVVVVTNMRTRKLRGEKSMGMILAAEKEINEQLNVEPVIPPTTSIIGERLHFGIADNFEPPKLKDKVWEYIQPRLKTTADKKVVFVDEEDNELVLRGSDSSDAAHVQSLDGAKIL

SEQ ID NO: 19814 - protein, 230 aa, Candida albicans
  UNSURE (198): Identity of amino acid sequences at the above locations are unknown.
DLSIHPKRRIFHNESLFHPLTKGPYTTMSDLIAKFSKISLADISKSDSSKFPELSAEQKALASQFETLANRLNEQESLIALNDSLRTKTFIVGNIPSHADLVVFEKVFSLASQWTSKDDVAKYRHILRWADLVQNTLVNVPETIKINYDIDIPGEVGEMKIPAEEAEKSATPKPKAKATPYAARGPRLELNRGRPECXGNRPEKPRILAKAKSKCWKKIKPTPAPGWPHH

SEQ ID NO: 19815 - protein, 237 aa, Candida albicans
GGLKTHRMSDKEDLNLISDNNRVISMRQLILQLLTTGINKKYKRYTNMFDSTTATQADVTVYKAFQKEFPQFTRWFNHIASFTEEFEDLPAGKAPAASGSAAAAAEEEDDEDVDLFGSDDEVDEEAEKLKQQRLAEYAAKKAAKGPKPAAKSIVTLDVKPWDDETDLDELLTNVKAIEMEGLTWGAHQWIPVGFGIKKLQINLVVEDALVSLDDLQAAVEEDEDHVQSTDIAAMQKL

SEQ ID NO: 19816 - protein, 175 aa, Candida albicans
IIMTGVTEGGDTKVIESKINELNIDKPKLEDNNEAKGNGNGNESGGGDDDDKEEDDDNDEITEPSTSTASGDKKKKKNKNKKKKKKKIVSIDSSYPEGIFPEGQWMEYPLEDINSYRTTSEEKRYLDRQQNNKWQDFRKGAEIHRRVRHKAQSSIRPGMTMIEIANLIEDSVRNY

SEQ ID NO: 19817 - protein, 440 aa, Candida albicans
IIMAGVTEGEDTKVIESKINELNIDKPKLEDNNEAKGNGNGNESGDDDDNEITEPYTSTASGDEKQKKNKNKKKKKKKIVSIDSSYPEGIFPEGQWMEYPLEDINSYRTTSEEKRYLDRQQNNKWQDFRKGAEIHRRVRHKAQSSIRPGMTMIEIANLIEDSVRNYSGNDHTLKAGIGFPTGLSLNHVAAHYTPNTGDKLILKKDDIMKVDIGVHVNGRICDSAFTMTFNEDGKYDTIMQAVKEATYTGIKELGIDVRLNDIGAAIQEVMESYEMEENGKTYPIKCIKNLNGHNIDDFVIHSGKSVPIIANGDMTKMEEGETFAIETFGSTGNGYVLPEGECSHYAMNKGVEHLKPPSERSKQLLETIKQNFGTLPWCRRYLERTGEEKYLFALNQLVRHGIVEEYPPIVDKRGSYTAQFEHTILLHPHKKEVVTKGDDY

SEQ ID NO: 19818 - protein, 204 aa, Candida albicans
SIMGKEKTHVNVVVIGHVDSGKSTTTGHLIYKCGGIDKRTIEKFEKEAAELGKGSFKYAWVLDKLKAERERGITIDIALWKFETPKYHVTVIDAPGHRDFIKNMITGTSQADCAILIIAGGTGEFEAGISKDGQTREHALLAYTLGVKQLIVAVNKMDSVKWDKNRFEEIIKETSNFVKKVGLKPKDVPFRSNLLVGNGGQHGL

SEQ ID NO: 19819 - protein, 460 aa, Candida albicans
SIMGKEKTHVNVVVIGHVDSGKSTTTGHLIYKCGGIDKRTIEKFEKEAAELGKGSFKYAWVLDKLKAERERGITIDIALWKFETPKYHVTVIDAPGHRDFIKNMITGTSQADCAILIIAGGTGEFEAGISKDGQTREHALLAYTLGVKQLIVAVNKMDSVKWDKNRFEEIIKETSNFVKKVGYNPKTVPFVPISGWNGDNMIEPSTNCPWYKGWEKETKSGKVTGKTLLEAIDAIEPPTRPTDKPLRLPLQDVYKIGGIGTVPVGRVETGIIKAGMVVTFAPAGVTTEVKSVEMHHEQLAEGVPGDNVGFNVKNVSVKEIRRGNVCGDSKNDPPKGCDSFNAQVIVLNHPGQISAGYSPVLDCHTAHIACKFDTLVEKIDRRTGKKLEENPKFVKSGDAAIVKMVPTKPMCVEAFTDYPPLGRFAVRDMRQTVAVGVIKSVEKSDKAGKVTKAAQKAAKK

SEQ ID NO: 19820 - protein, 439 aa, Candida albicans
NKRMSETEAEKNIEIWKVKKLIKSLEMARGNGTSMISLVIPPKGQISLIQKMLTEEYGTASNIKSRVNRLSVLSAITSTQQKLKLYNSVPRNGLVVYCGDVITDEGKEKKLNIDFEPFKPINTSLYLCDNKFHVEALNELLENDDRFGFIIMDGNGALFGAVSGNTREVLHKFTVDLPKKHGRGGQSAVRFSRLREEKRHNYVRKVAEVAVQNFITADKVNVKGLILAGSADFKNELSKSDLFDNRLQAKVIKIVDISYGGENGFNQAIELSAETLANVKFVQEKKLLEAYFEEISQDTGKFCYGIEDTLKALDLGSCEKIIVYENLNTIRYTLKDIEGEEVVAHVNPELPDKSWQLDKKTGTEMEIVKEESFLEWLAENYKNYGAELEFVTDKSSEGAQFVQGFGGIGAILRYKVNFEQLADESSEDEYYDDDDDSFI

SEQ ID NO: 19821 - protein, 361 aa, Candida albicans
ILVQQVCIPQSILGTDVLCQAKSGLGKTAVFVLSTLQQLDPVPGEISTLVICHTRELAYQIRNEYARFSKYMPDVKTDVFYGGTPIKRDIEKLKNKDTCPHIVVATPGRLHALVEEKAIRLNNVKSFVIDECDKVLESIDMRRDVQDIFRATPHQKQVMMFSATLSQDIRPVCKKFMQNPLEIYVDDEAKLTLHGLQQYYIKLDEKEKNRKLSDLLDSLEFNQVIIFVKSTRRANELNKLLCACNFPSIAVHSGLPQEERIERYRSFKEFNKRICVSTDVFGRGIDIERINLAINYDLPNEADQYLHRVGRAGRFGTKGLAVSFVSSKEDEEVLEKIQSRFDVKITEFPEEGVDPSTYMNT

SEQ ID NO: 19822 - protein, 66 aa, Candida albicans
IIQILKKSPFQPTIKLLGEAQSNDKESDKKGSYVGIHATGFRDFLLKPELLRAIGDCGFEHPSEGM

SEQ ID NO: 19823 - protein, 401 aa, Candida albicans
LIMDDFDRDLDNELEFSHKSTKGIKVHRTFESMNLKPDLLKGIYAYGFETPSAIQSRAIMQIISGRDTIAQAQSGTGKTATFSIGMLEVIDTKSKECQALILSPTRELAIQIQNVVKHLGDYMNIHTHACIGGKNVGEDVKKLQQGQQIVSGTPGRVIDVIKRRNLQTRNIKFLILDEADELFTKGFKEQIYEIYKDLPPSVQVVVVSATLPREVLEMTSKFTTDPVKILVKRDEISLLGIKQYYVQCEREDWKFDTLCDLYDNLTITQAVIFCNTKLKVNWLADQMKKQNFTVVAMHGDMKQDERDSIMNDFRRGNSRVLISTDVWARGIDVQQVSLVINYDLPTDKENYIHRIGRSGRFGRKGTAINLITKDDVVTLKEFEKYYSTKIKEMPMNINDIM

SEQ ID NO: 19824 - protein, 159 aa, Candida albicans
PAWVKKYQQGYNNRGGYQQNYNNRGGYQGYNQNQQYGGYQQYNSQPQQQQQQQSQGMSLADFQKQKTEQQASLNKPAVKKTLKLAGSSSIKLANATKKVDTTSKPQSKESSPAPAPAPTASASTSASQEEKNEEKEAAATTPAAAPETKKETSAPAETK

SEQ ID NO: 19825 - protein, 139 aa, Candida albicans
RWIFQPAGEYQNQQYGGYQQYNSQPQQQQQQQSQGMSLADFQKQKTEQQASLNKPAVKKTLKLAGSSGIKLANATKKVDTTSKPQSKESSPAPAPAPAAFASQEEKKEEKEAAAATPETKNETSAPAETKKETTPTPCC

SEQ ID NO: 19826 - protein, 177 aa, Candida albicans
QMLQRKWIPLANHNLKNHLQLQLQLQLLSLPKKKRRKKKKLLLLLLKPKTKLPHQQKPKKKLLPPPAAKKESTPTPATATTKESTPVSNSASVATADALVKEQEDEIDEEVVKDMFGGKDHVSIIFMGHVDAGKSTMGGNILYLTGSVDKRTVEKYDREAKDAGRQCWYLSWVMDTN

SEQ ID NO: 19827 - protein, 63 aa, Candida albicans
DAPGHKMYVSDMIGGASQADVGIWVISARKGEYETGFEKGGQTREHALLAKTQGVNKIIVVVN

SEQ ID NO: 19828 - protein, 276 aa, Candida albicans
MDDSTVGWSKERYQECTTKLGAFLKGIGYAKDDIIYMPVSGYTGAGLKDRVDPKDCPWYDGPSLLEYLDNMDTMNRKINGPFMMPVSGKMKDLGTIVEGKIESGHVKKGTNLIMMPTKTPIEVLTIFNETEQECDTAFSGEQVRLKIKGIEEEDLQPGYVLTSPKNPVKTVTRFEAQIAIVELKSILSNGFSCVMHLHTAIEEVKFIELKHKLEKGTNRKSKKPPAFAKKGMKIIAILEVGELVCAETYKDYPQLGRFTLRDQGTTIAIGKITKLL

SEQ ID NO: 19829 - protein, 720 aa, Candida albicans
ARRTTNMAPKLKKQAATQSKSKKLKDLVDERFQAIVLTDSFETRFMPLTAVHPRCLLPLANVPLIEYTLEFLANAGVNEVYLMCSAHADQIQEYIENSKWMGDNSPFSVTTIMSIESRSVGDTMRDLDNRGLIAGDFLLVSGDVVTNMDFSKALQFHKQKKAQDKDHIATMVLNQASPLHRTRSQIDPAAFVLDKETNRCIFYQSIPPVSGKKTCISIDPELLEDFQGELQVRNDLIDCHVDICSPHVPQIFQENFDYQYLRSDFLKGVLTSDLLKKTIYAYISKDSSEYAARVESWSTYDAISQDILARWCYPLVPDSNLVEGNSYSYELNNIYKEDKIILAQSCKIGTSTSIGRNSSVGEGTQIKNSVIGRNCTIGKNVVIENSYIWDNAVIKDNSVLNRSIVAADAQIGNNVTLSPGSVIGFNVIIGDDKVIPHNVKIVETPIVTENEFGDFDDESNSEDENEYEDGNAVPVLAVKDVELVGETGKGFAYESEIESGDEDDEEFVGNGTYSGIIYQMKSLNVSDDSIASVSNKKVKKHSHRRRLSMNSMISDNGGAFESDEGEEEEDFGVEGLATVTRAIENNHDIDTALLELNTLRMSMNVTYHDVRSVTTQALVNKIVDFITTGTLTPQEAATKIFTKWGIMFKRQVFSPEEEVDLLNIVEENSSVLDKAYNQIVLFLGVKSFYDMEVVEEENILKWWNDGENDEVRTLTAKFIT

SEQ ID NO: 19830 - protein, 485 aa, Candida albicans
EVPSDDPFCTAIRNCDPNADLMLYVSKMVPTSDKGRFYAFGRVFAGTVKSGQKVRIQGPNYQVGKKEDLFLKSIQRTVLMMGRSVEQIDDCPAGNIIGLVGIDQFLLKSGTITTNEAAHNMKVMKFSVSPVVQVAVEVKNANDLPKLVEGLKRLSKSDPCVLTYMSESGEHIVAGTGELHLEICLQDLENDHAGVPLRISPPVVSYRETVEGESSMVALSKSPNKHNRIYVKAQPIDEEVSLDIENGVINPRDDFKARARILADKHGWDVVDARKIWCFGPDGNGPNLVVDQTKAVQYLNEIKDSVVAAFQWATKEGPIFGENCRSVRVNILDVTLHADAIHRGGGQIIPTMRRVTYASMLLAEPAIQEPVFLVEIQCPENAIGGIYSVLNKKRGQVISEEQRPGTPLFTVKAYLPVNESFGFTGELRQATGGQAFPQLIFDHWQVMSGDVTDENSKPGAIVKEKRVRAGLKPEVPEYTEYYDKL

SEQ ID NO: 19831 - protein, 237 aa, Candida albicans
ESLMVHWLSLIPLKVSVIKTETVLRQALGERIKPVVVINKVDRALLELQTTKEDLYQTFARTVESVNVIISTYCDPVLGDVQVYPQKGTVAFASGLHGWAFTVRQFANKYSKKFGVDKEKMMERLWGDSYFNPKTKKWTNKDKDADGKPLERAFNMFILDPIFRLFAAIMNFKKDEIPVLLEKLEIQLKGDEKDLEGKALLKVVMKKFLPAADALLEMIVLHLPSPVTAQAYRVGIL

SEQ ID NO: 19832 - protein, 141 aa, Candida albicans
CIIVAFTIEQIRGLMDKVTNVRNMSVICHVDHGKSTLSDSLVQKAGIISAAKAGDARFMDTRKDEQERGITIKSTAISLYASMTDEDVKDIKQKTDGNSFLVNLIDSPGHVDFSSEVTAALRVTDGALVVVDTVEGVCYQN

SEQ ID NO: 19833 - protein, 153 aa, Candida albicans
HTFETADAGAALTFPMQCSALRKNGHVVIKNRPCKIVDMSTSKTGKHGHAKVHLVAIDIFTGKKLEDLSPSTHNMEVPNVSRQEFQLLDIDDGYLSLMTADGDTKDDVKVPEGELGDKLQSEFDEGKDLIVTIISAMGEEAAISYKEAPKGSA

SEQ ID NO: 19834 - protein, 531 aa, Candida albicans
SMSYDDIENATPDIVIGSTIEEPEEDYQVESDNELQAADHESSQINEESAKGKKSVAFTGLDEDEENAEELARKEFEEGGGLPEQPENPDFNELTPLSPEIINRQATINIGTIGHVAHGKSTVVRAISGVQTVRFKDELERNITIKLGYANAKIYKCDNPECPEPDCYRSFKSDKEIRPKCQRAGCDGRYKLLRHVSFVDCPGHDILMSTMLSGAAVMDAALLLIAGNESCPQPQTSEHLAAIEIMKLKHVIILQNKVDLMREESALEHEKSIIQFIRGTIADNAPIVPISAQLKYNIDAVNQFIVNYIPVPMRDFTASPRLIVIRSFDVNKPGADVDELKGGVAGGSILTGVFKIGDEIEIRPGIVTKDDQGKIQCKPIFSNVVSLFAEHNDLKFAVPGGLIGVGTKVDPTLCRADRLVGQVVGAKGNLPSIYADIEINYFLLRRLLGVKTEGQKQGAKVRKLEQSEVLMVNIGSTATGARVVAVKADMARLQLTTPACTEINEKIALSRRIEKHWRLIGWATIKKGTAL

SEQ ID NO: 19835 - protein, 399 aa, Candida albicans
HRKKKFFFCFGLETHLLMLLFTLRRAMSFTTRILKVRPESIQFVNDKPQISDNETLINLEIAAKELTTTHNAIGFPTETVYGLAGSALSDESVKSIYKAKNRPADNPLIVHISSIEQLKRKLINYEIPQVYVDLISHFWHGPLTILLPITKDSPISKLVTANQDTFAVRMPNHPVARALIAMSDTPIAAPSANASTRPSPTLAEHVYHDLNGKIPLILDGGACNVGVESTVIDGLVDPPMLLRPGGVSLEDIKRVGGKLWENIVVAKKTAGKLEPVKTPGMKYRHYSPTAKVVLFVNCGDGINAIENYLTNNKVDASTTKIALLKSKHFGEDHPHFIIKRLGTTGNEISHNLFKYLREVDEEDKVELIFVEGIDETNEGLAVMNRLSKAAMEVVNGGEA

SEQ ID NO: 19836 - protein, 214 aa, Candida albicans
  UNSURE (8): Identity of amino acid sequences at the above locations are unknown.
IRKESLQXDSLVAIDAELIMLTPEELEIHYAGYIKLVKPKQLSLARISVLRENGIPFIDDYIVHTSDIYDYLTNFSGIEPNDLNLTLSNRENLVTLQTAYRKLWLLLNLGVIFVGHGLYNDFRTINLQVPERQIRDTAVIYYKSDFKRQLSLKFLAYVMLKEKVQSGNHDSIEDANTALLLYKKYQNLYNKEDFELILNYIYSEGQQLRFKVPE

SEQ ID NO: 19837 - protein, 315 aa, Candida albicans
SKDFVNFLQPVEQPDIIDSNFEIIDIDANVPLSIVGMPYYKELLLSNYPNDLRFVKETAKLPEPIDIELILENETRNNGTKKFFPYDKLKYGPGNVYKPYQSLKDNKENKEILIPKFISERSTTTTTTTKELKADNDGKFIDDSIFQYKFQGKLNKVPNCYSRLQIQYSKFGIKDFDFSYYNKTKECCGLENHTDNSYINSLLQLYRFQSSIYNQVVGSLSKEWLPNDITTIITTNNPEGSSILNELGYLFDMMFKAQSNNVKIYNLSQVLNHHPNAQKLLNNNELLNLNSQQVRDLVIEFNNFLLTTLHLDGQA

SEQ ID NO: 19838 - protein, 267 aa, Candida albicans
TKFHMGGDSRGYTRSFTGSFATNSLYGNLQLYPYTKFHTSDVNYNNPIKQILSHREGILSLLNNAISFNSRRGLSKLQVTSKTFNNNATTENKFNNLQAMTFNCNSFNDVVVGTDTSMMKFDLNKPNVLSSFDHQGGISLLNNLGKFLTIANSNGSLDIFDPVSNSTVKTFSAHNGFISNLDVRGNYIATCGYSIKPKRYYHNQPAEYIVDPLVNIYDTRIMRAIAPVPFPAGAASVKFHPKLPNIIIIASTSGQMQFVEIFDQTNV

SEQ ID NO: 19839 - protein, 602 aa, Candida albicans
  UNSURE (602): Identity of amino acid sequences at the above locations are unknown.
DTTAVEKPIVEEKPVEVNDKVELQIELQSPSVEGDSESIVENEDEEESTISEKGEPQTETETETETQTEPEPESEPTPTANAPEFTISQFLERLKIATPIDDILATKYPETIQGVDGSKQISGKKYRYDPQFLIQFRDVISYTIDPTFKAHLESLDIHPNAMKRSGSTRDASSRGGLPNKFTGGLPARFNGPGGKGGGQFDGGRQNSRSGSKRGGGRGASSRDKSTRKGTPSKRGGRGGDRSEMRERGGAGAGAGGENDGNNQGDGKPVEEVKPLEKSANRWVPKSRMQAKKETKVAEDGTILLEPEDIEKKTKSLLNKLTLEMFTAISDEIIALTNQSKHEKDAATIKQIISLTFAKACDEPHWSEMYAKLCAKMCTSVSNDITDESITLKDGTHASGGVLARRLLLATCQKEYEKGWTDKLPTNPDGSPLEPEMMSDEYYAMAAAKRRGLGLVKFIGHLYNLNMLNDHVIYVCLKDQTKNTVDPSDDSLENLTQLIQTVGPKLDSNERTRTMLKIVFDYIEKVLEGVKLPSRIKFMLMDLQDLREAKWVSLKGDAGPKTIEEIHRDAEIKKMEEERPRMKRKRNNINWVDDDVDVVVLIX

SEQ ID NO: 19840 - protein, 520 aa, Candida albicans
KFSVLSNSHLRSTVISIHHIMADVEKKPEAVSSDPAEKKLSNKELKELKKKEKAAKRAAQKEAIGITPEQQKKIAEQKIEKKKQQQTTSASNVKKQLNQTIVKDERKVPALFGHLETREQRNAASPTISNVVHPTILSLTLKYSSYKVVGSSSRLSNMLQAFKQVIQDYSTPENTTLTRHLTAHLSHQIEFLKTGRPLSVSMGNAIRWLKQEISVISIDTLEAKAKEILCTKIDDFIKEKIVLSDRLIVDSASRHICNGSTILTYGHSQVLEELFKYCVVEQGKKFNLIIVDSRPLFEGKKLLKNLVSTSLEEKVETNSVSSLTMEKVPITQSHISVQYVLINALSSTLLEDVDCVFLGAHAMLSNGFLYSRVGTALIAMMSHTRNIPVLACCESVIFSDKVQLDSVTTNELADSEDLIQGIDSKKPPQKQSFALEQFLKESEQENKQPKQVKGKLEADATADQSDDLEPLKNWQDVKNLNIINIMYDLTPPEYINKVITELGALPPSSVPVILREYKNA

SEQ ID NO: 19841 - protein, 406 aa, Candida albicans
SYINNKHLIMASEGITEIDSGLIETNYDNVVYKFDDLNLKPNIVRGIFGYGYETPSAIQQRAILPITEGRDVLAQAQSGTGKTATFTISALQRINENEKATQALILAPTRELALQIKNVITAIGLYLKVTVHASIGGTSMSDDIEAFRSGVQIVVGTPGRVLDMIERRYFKTDKVKMFILDEADEMLSSGFKEQIYNIFRLLPETTQIVLLSATMPQDVLEVTTKFMNNPVRILVKKDELTLEGIKQFYINVELEDYKFDCLCDLYDSISVTQAVIFCNTRSKVEFLTNKLREQHFTVSAIHADLPQAERDTIMKEFRSGSSRILISTDLLARGIDVQQVSLVINYDLPANKENYIHRIGRGGRFGRKGVAINFVTDRDVGMMREIEKFYSTQIEEMPADIGALFA

SEQ ID NO: 19842 - protein, 176 aa, Candida albicans
  UNSURE (9),(29): Identity of amino acid sequences at the above locations are unknown.
DYMKPWGEXLSRKYGHAYDALKIFITDLXVLNSVDVLSKDVLEELKLYISRRLTPQAINIRADVDVSCFSYEGIDAIKEALKAAESVSTSQMQVKAKLVAAPLYFITVQALDKNEGVKLLEKAIEKITESIEASGGNCKVSMPPKAVSANEDAELERMLQRREAEDKDSSDEEDDA

SEQ ID NO: 19843 - protein, 118 aa, Candida albicans
RMSTTNCRFYENKYPEVDEVVMVNVQEIAEMGAYVKLLEYDNIEGMVLLSELSRRRIRSIQKLIRVGKNEVAVVLRVDKEKGYIDLSKKVVSAEDIVKCDERYNKSKAVHSILSLHHA

SEQ ID NO: 19844 - protein, 205 aa, Candida albicans
  UNSURE (180): Identity of amino acid sequences at the above locations are unknown.
FNPIMEKTMKLEYSIDNNDPLTNNFPEVNYSRDYLISLLNQSPERIRNVSIIGDFQSGKTSLIDQLIMYIHPKINIKKYLDNHKLEIERELTIKSSPITLLLSDLKSRSQILNLIDTPGHVDFEDETLAALNITDGVVLIIDAVLGMTIQDQYLIDQVIKQRLSMIIIINKFDRLILELXLPIKECYYKLVGINDDINDYIKSIH

SEQ ID NO: 19845 - protein, 518 aa, Candida albicans
DTVDTLARVTKLIESSDGKSFSALVRIYKGGLTMGDKIKIYGENYHEDKDDYRLEIIKKIYLPGGRYNFPINQASLGNIVLIDGIDSIIKKGSAIITNESTNDTEDIDKLSFVPPSPPKYTNNSVFKIAIEPEIPSELPILLEGLRKINKSYLSSIINVEENGEHIILTKGELSMDCILHDLRFFFCDDLEIKVSDPMVKFSETCIENGYIRTSTTTTTTTTTNEDKDKDKDSLLSMTIIVEPIIDYKFSHDIEIGKLKFDNIDIDSKQLIKILKTEYGWDSLAARSLWAIGPINDLQNPSILLNDTLNQHHQQDNNNIIESIKSSIISGFKWSINEGPLCGDPIRNVQFKIIDITTNNNNKTTTLDNNNNNNKLLLSPAQIIPLMRRACHNAITNAIPKLMEPIYQLNVICSYKAINVIKHLLLNKNPQQQQQQQQQQQQQQQQRRGEIDTVTPIPGTPLFSIKGYLPVIDSIGILTDIKLNTQGQAIGSLKFNYWEIVPDELSEEFIIKTRKRKGI

SEQ ID NO: 19846 - protein, 229 aa, Candida albicans
FFFSCCHFSTMSQGILYVLKLSPRSSILTDLIKYYKLDIEISTDTESESFIKLFPLRKTPTFIGNDGFQLTETIAIGIYFLSMIPNHDLLGDNDQEFASIIRFLSMLNQEGAMSWVGAFFRLSGRLPYNKEIIDENLITLDIIGQILDNRLANDRISGYLVGDKISYADLYGVKLFGIALYTLLGEPYLTKYPNFAKWFKRASDNEFFRGQYKDIKFPQQQLTYPGSED

SEQ ID NO: 19847 - protein, 91 aa, Candida albicans
AKVNNKLFMLVTESHKFVRLFPLALNDLPNSISHFDYDENRTEELNHSGQELFETRFVDFTPHEYITALITDLGVLTPSAVSEELIKIWYD

SEQ ID NO: 19848 - protein, 145 aa, Candida albicans
SRMADFDIKETYLKFLEEDKDMTMPIAAIESLVSMLKAKSPSTSSELINLVSKNIDLLKSSIPNNISLSAGCDLFMRFVLRNTNVYSDWESFSQNLVENGELFVQRAKESRLKLAEYGVPFIKDDDVILVHSYARVVYSLLLKAK

SEQ ID NO: 19849 - protein, 176 aa, Candida albicans
NAGKGSFALAWVMDQTEEERSHGVTVDICATDFETDTTKFTAIDAPGHKDFVPQMISGVSQADFALLVDDSISGEFEAGFALDGQTKEHTILAKNFGLEKICVAVNKMDKENWDEHRFDAIKSQMTEFLTSPEVDFDKSQIDFIPISGLTGNNVVKRDLSVDSFKWYVGPTLASSS

SEQ ID NO: 19850 - protein, 236 aa, Candida albicans
VSSMDFSKKKSNEKKNLPSTLLLCYTMSKLAQLAKARSQRPDSSVPRSIAILDKLTNTTTPVRQPRKRKPSPEVKQPKPQPTPTITFGISVDDSILLSQPREDVSVFWCRNSSTTENHKRRRLDSIYQPITNLSIEKITKAKENFTQPSPDDVVLNAQKQAFEGVANLKIAPPKQTKPFKKVDISKALLSPDYAKPRKSFVVIGHVDAGKSTLMGRLLYDFGIIDAKTVNKLVKEA

SEQ ID NO: 19851 - protein, 140 aa, Candida albicans
QTNMLAQSWLVLVCCFCLCQLRSVCMVKRFVKTVSTRISKSMKNFFFFWQVFSFSEPTTMDYDDDDLDYSSHEEEEFDENKLNNDEYNLLHDTLPALKEKLKSYNDEIPEYDLKEALYYNYFEIEPTVEELKSKFKKSMY

SEQ ID NO: 19852 - protein, 198 aa, Candida albicans
PFFLSVHDVYKDKGELKVSGKVSSGVISSGETIVALPSGESLQVQSLKVSKKPVDFAISGELAQIAFKTSQISNESVDQIRIGDLITKPGSPVKTAHKLLVLLHLFNMDKPLLVGTPFVLFRNNTQVPARVSKIVEVVNGKKKKKVLHLVSRQTAIVEIALTNALPVTKFDDNKVLGRIVIRREGTTIGAGTVIDFSE

SEQ ID NO: 19853 - protein, 438 aa, Candida albicans
KNFFSFLIISFFLSFFFFFFFFFFLSTTFWKMSAASESKYSTEVLSELLSKLQVADNKDEAASNISTFLNSSIVEHDVPVEFFEDLKKQIQSKDAKVSLAALDAYKHIASTNGLSPSVEPYVVDLVSEVAVKAGDKNKDVQTAASDALLAIASAITPTAVKAILPKLIDNLTNTNKWTEKVAILRAVSQLVDTAKAQIALRMPELIPVLSESMWDTKKEVKEAATATMTKSTETIDNKDIEKFIPQLISCIAKPTEVPETVHLLGATTFVSEVTMATLSIMAPLLSRGLAERDTAIKRKAAVIVDNMCKLVEDPQIVAPFMDKLLPGLKNNFANMADPEAREVTQRALNTLRRVGAVGENDSIPEVSTAGDIDVTLNEFNKLVADKKIAKRFDVALNYIAAIAGDLVDEREIQPEAWLQNVLPFATIFLHHEGHDRLD

SEQ ID NO: 19854 - protein, 187 aa, Candida albicans
KEALASGQFRPLTRKEIEEHCAMLGLDAELVSHSRIRGLSGGQKVKLVLAACTWQRPHLIVLDEPTNYLDRDSLGALSKALKAFEGGIVIITHSAEFTKDLTEEVWAVLDGRMTPSGHNWVQGQGSGPRIEKKDDEEEDKFDAMGNKIAAAKKKKKLSSAELRKKKKERMKKKKELGDAYVSSDEEF

SEQ ID NO: 19855 - protein, 77 aa, Candida albicans
YSTLFKLLDGEYTPTMGKLTSSENVRIAYIKPHVFVHNDNHLTKTHSEIFIEDSKLWKIEKPWIELLDKSMKEMNKT

SEQ ID NO: 19856 - protein, 593 aa, Candida albicans
RRCENHVDRAKSTLSDRLLEMTGVIKPGSKSQVLDKLDVERERGITVKAQTVSMFYNDGKQDYLLHLVDTPGHVDFRAEVSRSYASCGGALLLVDASQGVQAQTVANFYLAYSMGLKLIPIINKIDLDLANIPGAREQIETTFELDPNECIPVSAKTGLNVEQIIPSVIKNIPSPVCDVNKPLRALLVDSWHDPYVGVVMLVHIVDGRMKKGMKILSAHTNRTYDVKEVGIMYPDRTPTSFIKAGQVAYIIPGMKNPREALVGDTFYQMGKHEGLEPLPGFEEPKPMVFVGAFPADGKEFNAMDDQMQNLVLNDRSVTLEQETSNALGLGWRLGFLGSLHASVFKERLEKEYGAKIILTAPTVPYKIIYKNGEERIVTNPDDFPDNQKHHDVESYMEPYVEAIMTVPNEYVGNVMTLCLNNRGEQKEIEYLTTGQVLLKYEIPTSQLVEDFFGKLKGCTKGYASLDYEEARYRKSDIVKMQLCVNGEPQDALTTVIHRSQAQARGKEYVTRFKKFLSYQLFEVAIQAKINNKVVARETIKAKRKDVTQRLHAADISRYKKLLERQKEGKKQMKLSGRVTIKNDAYQAFLRRED

SEQ ID NO: 19857 - protein, 375 aa, Candida albicans
ITPHQRYNQSMSKLLTPEILALIDPVVSSLKRHQLVDDKEIALTIAQLLMKVISAARWSNTYDLIELIRQIGVIFTEAYPRKVIPGNIVRRVLALIRDETETETENETEQTDNIPMMSSMFSLLATHNKNETIKEQTQLQLKKQTSDMRAIIIQGIRDLVDEISNVNDGIETMAVDLIHDDEILLTPTPNSETVQHFLIKARLKRKFTVVVTENYPNDIKAAHKFVKTLAEHNIETILIPDTTIYAVMSRVGKVIIGTNAVFANGGCLSNSGVANVVECAKEHRTPVFAVAGLFKLSPLYPFTRNDLIEVGNSGKVLNYDDFELVQNVDVVTNPLEDYIPPQHIDIFMTNIGGFSPSFIYRIVLDNYKAEDNKLE

SEQ ID NO: 19858 - protein, 301 aa, Candida albicans
GHQGVIWSIDVDPETHLCATGGGDLAIKLWKVENGQCVYTWDSPSPVRRVAFSPDGKKLLAIADQVMGHIGTVSVFDINDDDATLSQQKAEPSLVIETKSEGSKATVAGWSGDGDYIIVGHDNGYVSKYDSKTGKLVTSLQAHGIHNEEKNVSITDIQFAPEDRSYFITSSKDKTATLIDVDTFEILKVYKADAPMNTAAITPVKDFVILGGGQEARNVTTTAESQGKFEARFYHKIFEEEIGRVKGHFGPLNTVAVHPDGTGYSSGGEDGFIRVHTFDKSYQDFLFDAERTERAAAAGTI

SEQ ID NO: 19859 - protein, 168 aa, Candida albicans
RHFFFLFNSTLYSTMGKSSGKGKGGKNRRRGKNVNSGQKRELIYKEEGQEYAQITKMLGNGRIEVSCFDGIKRMGHIRGKLRKKVWMGQGDIILVSLRDFQDDQCDVVHKYNSDEARTLKNVGELPENAKINETDTFGADDDEEVNFEFGGADEDESEEDEELDIDDI

SEQ ID NO: 19860 - protein, 629 aa, Candida albicans
TLSAVPSTPWGRRQSRGKKNIDKLEQIATLEKLLEANVSKSSPFELISIYQMLLSVRFDASSNQAFMPLEQWQKNEHDLGKLLDLLEANVDTYQVSELGSTTDDIDIEPVANAQGVKVIFGSITSSIDRLDDELTKSLQHTDPHSIEYVERLKDESTIYNLIVRGQAYVESITPEDVKYKSEQLARIVLRRLEHIYYKPKQLIKANEEEAWRNIEYNSSIVSKGSSVDEVIDQLTEFLQKQQKNKTYGKHAILFSIYYYAVNSQYEKAKELFLRSQFYSNINSAESSLQVQYNRALVQLGLSAFRAGSIEESHKILNEIVNSQRSKELLGQGFNSKFPNQATVLERQKLLPFHQHINLELLECVFMTCSLLIEIPTLAAIANNHKDSKRKNASLKSFKSKLDFHDRQFFTGPPESIKDHIVHASIALQKGDWLKSYNLLSSIKIWKLFPDNDKLLAMMKNQLQIEGLRTYIFTYKSVFKKLSIEKLQQIFQLSKDEVVSILEKMITTGNVSGGEIIDNKFISFTSTTEPQRSKLQELAIVLNEKIQLLTEKNEKTQSNGYGKKQQNKDQQNQQNQQQQNQNQQQQQNQQQQQQQQSSQQQSNNILSEESANKFRYANVNSNNDEFQATA

SEQ ID NO: 19861 - protein, 116 aa, Candida albicans
LLFLLHCMSTIQNLNAFDPFADTGDSEAQPTNYIHIRIQQRNGRKTLTTVQGVPNEYDLKKILKVLKKDFACNGNIVKDDELGEVIQLQGDQRVKVSEFLTAQLQLPKKNIKIHGF

SEQ ID NO: 19862 - protein, 654 aa, Candida albicans
LIMSQWIPLSHAILGSVIEYLPSPIVAQRERIDKILDETIYSAVDSELDKSKLVDPSFVKAMQECDSSHPETHTIAYVSKLLSIPNEDLPKASNAATGGLTADEIQERGRIARELAKKASEAAALAQEGSKNEDEFAIKPKKDPFEWEFEEDDFENEEDESDANAVEESTETIVGFTRIYSGSLSRGQKLTVIGPKYDPSLPRDHQTNFEQITNEVEIKDLFLIMGRELVRMEKVPAGNIVGVVGLDNAVLKNATICSPLPEDKPYINLASTSTLIHNKPIMKIAVEPTNPIKLAKLERGLDLLAKADPVLEWYVDDESGELIVCVAGELHLERCLKDLEERFAKGCEVTVKEPVIPFREGLADDKISTNTNNNHDDNEDHELDENEDELADLEFDISPLPLEVTQFLIENETIIAEIVNNKQDTHEIRNDFIEKFATIIDNSNLATQFPDTKSFINNIICFGPKRVGPNIFIEDYGLNKFRHLLGESATESRFVYENNVFNGVQLVFNGGPLASEPMQGIIVRLKKAEKREVDEDKIVNPGKIITQTRDLIYKRFLQKSPRLFLAMYTCEIQAAAEVLGKVYAVVQRREGSIISEEMKEGTPFFTIVAKIPVIEAFGFSEDIRKKTSGATSPQLVIDGYDMSDIDPFWVPHTE

SEQ ID NO: 19863 - protein, 160 aa, Candida albicans
EQPTNIPKISPETVHILQLDASCIRYICILAHVDHGKTSLSDSLLATNGIISQRMAGKVRYLDSREDEQLRGITMESSAISLYFKVMRLQQGSQEPEVHEHLINLIDSPGHIDFSSEVSTSSRLCDGAVVLVDVVEGVCSHTVNVLRQSWIDKLKFATRR

SEQ ID NO: 19864 - protein, 82 aa, Candida albicans
HIHRERMSDFKKSETTIQSGQHVLIRLPSEGLKIVHLQDTGIIGLGKFGSFEVSNILGYPLGTSFEIIADHKVFTTAWKIHV

SEQ ID NO: 19865 - protein, 315 aa, Candida albicans
KRAGQEGFDKKTIFSQQKYLKRKQQKFLRRFTVDYLGGSELLQYYIEKDLNRVLDLSVETLGLMLTYSNVRPGGKYLIIDETGGVLTYAMMERMNCEGTIVSIHENEHANLIALRYSDYGNELETKTVKSVNWLQFIDPQSERIDWTDLPDEEVKKIKNKSQYKKRRDRALQINEVIQLVEEGNFDAFISVSTLNMSEVLEYVLPKIGGSRPIVVYNQFKESLLEVQQALSGDKRVLAPSIYETRVRPYQTIPGRMHPVMTNRGGGGYILWGTRVIPHDAITAVGKGFAKRKRVETPSKTDTGTVEVQNDQENSA

SEQ ID NO: 19866 - protein, 327 aa, Candida albicans
ARYRPAPVGEDRAIDNIPQPPSFEDEEDEGEDLCNCEFSLAYGAKILLNKTQFRLKRNRRYGLCGPNGAGKSTLMRAIANGQVEGFPTQDECKTVYVEHDIDGTHADTTVVEFVIEDGEVGLTKDVVVDKLREFNFSDEMINMPIQSLSGGWKMKLALARAVLNNADILLLDEPTNHLDTVNVAWLVNYLNTCGITSIIVSHDSGFLDNVTQYIIHYEGFKLRKYKGNLSEFVKKCPSAQSYYELGASDLEFRFPEPGFLEGVKTKQKAIVKVSNMSFQYPGTSKPQIQDINFQCSLSSRIAVIGPNGAGKSTLNNVLTGELLPTTG

SEQ ID NO: 19867 - protein, 117 aa, Candida albicans
RFQTVEDRETMDRAFRQINEGDEQNMNQIFKIEGTPRRIAVFNARRKFKNSYEYEISWMLGENIGMKNERWVPMMSVDNTWLPRGELMETHAKLVAEVDMKGSFGFWSIQTINQKRN

SEQ ID NO: 19868 - protein, 373 aa, Candida albicans
YFWIQQIQFIFKIRFPTVSSNIPKLDIEKLTREALASVPESHHTLPYCWTIWYHSRNKKKEQGQKVSEELQESIEEQLPEQQQQQSVGVDSYLQTTNELEFIDFSTGNPIHHIASLEQLWSSFSSIKKTYTLNIGTEFLIFKTGVNPVWEDPINSKGGRWVFRFNRKIMDGYNNNDKKSNKQELFRKRTSLIWERLVLKTLTGSLIPDSNSSEIQELLLNDICGLVLSVRKDEDIISLWNSNLNFFGKKDQTKKLTSFQARRIICDSILRVIRECDLINQGSDCVETIDTGSNERVFGVSFDYRIHADNEREREKSIASNGANGSTTGGSTGSNSGQTYGNHYNRRYNKYNSNSNNSNNSNSNTASKTDSIAK

SEQ ID NO: 19869 - protein, 222 aa, Candida albicans
FESELNANLVFLVMSEELAQKTEELSLDSKTVFDSKEEFNAKHPLNSRWTLWYTKPQTNKSENWHDLLKPVITFSSVEEFWGIYNSIPPANQLPLKSDYHLFKEGIRPEWEDEANSKGGKWQFSFNKKLEVNPIINDLWLRGLLAVIGETIEDEENEVNGIVLNIRKQAYRVGIWTKDCDESKLKTVGERLKKVLQLNDEQKVEFMSHDASNTRGAEPQIVL

SEQ ID NO: 19870 - protein, 89 aa, Candida albicans
NNITPTSELGLKADYHLFKKGIRPEWEDPQNKHGGKWSYSFKDKRSVPIDDLWLHAQLAAIGETLENDGDNEVMGVVVNVRKGFYRVGL

SEQ ID NO: 19871 - protein, 284 aa, Candida albicans
SLRGPAHSRGEDIEDKKAKIFPQSYTIYSDTDENGNESPMFLDTYSQADIEFHQALSIRTQMCWRYPAATVSNKLLNSGIFLGSCLQIFSVFDEQKDKFTESYFEKRSLMKIVRDLARRSWKHALHQASVGFFIVPKQATFFRCNNLPVLMEANRYFMKKQAIAKSASQNTQAPNKQDKQSGAHVGNDSLVGENTELGEKTNVKRSVIGSNCKIGKKNKITGCLILDNVEIHDDVTLENCIIGHDVIIQGKCKLTNCNVESTNEVAHNTQAKNSNLLCLTLEGH

SEQ ID NO: 19872 - protein, 153 aa, Candida albicans
  UNSURE (85),(86),(87),(88),(119),(121): Identity of amino acid sequences at the above locations are unknown.
SEMEFTAVIVCGKGKALTPFSQARSTGIPKPLLPIANKPMVQYVLDWCLQANFSRIIVLFEKEDESSGVLEQTIKRSQEEKEKTXXXXNESHVSIDVIPYNCENNGLILYKLYELYSEXKXSNNNFIILPCDLITNLPTQVIIEAYEIKIESD

SEQ ID NO: 19873 - protein, 181 aa, Candida albicans
FLLYDMAKYTEEQLLELKSEAHTPKPEILDAFNKLIEEVKESIEQHQQHQRKWHNGDTYIDEHGHERSYHHINRRRQSKGASGVPRPNLRKKSEPVVDEDGWATLSKPKKGSFAEGDAIEERIKFRETNNSGAGIKARPNNKNLGSSKAVDPREIASDKQTKAFNAFAALGDEDDDDEDDE

SEQ ID NO: 19874 - protein, 308 aa, Candida albicans
TIFSNLEFFKTNERDIPVEKLELKDVVVNFAWEPNTERFITISRLDDGNPNPAIPKNTISFYAPEVTKGGVNHNLKKKGGAAIAAAVAAAAINNQLSTKYKAYTKIENKHSNTIFWSPKGRYVVVATISRTSGELEFFDVSFDDETNKKSLPANVKLLKTDKFSGMTNISWDPSGRFVAAWSTSWLHAIENGYRLYEFTGNLLRDDSIDQFKDFVWRPRPPSLLTNSDKKKVRSNLREYSAQFEEADAMEADAAVKEIILARKKALEEWRKYRAKHISKQGNSKNEVQAEIIEEIKEEIIEEKEEIVE

SEQ ID NO: 19875 - protein, 285 aa, Candida albicans
NMSDLGFDPSLKKKKKSKKVASVVDDTDSKESTPQPQNPGDASVDDLFSGLKKKKKSSSKKSAEESGSPSVDEDLSSSLGDLTLKKKKKKSTKSLDLNEFEQQLEEAGVEDLTESTNGATNDQSAIGLSYPDLLSRFFDILKKNNPELAGDRSGPKFRIPPPIVQREGSKKTLFANVQEIATVLQRSPEHLIQYLFAELGTTGSIDGEKRLILKGKFQPKQMESVLRRYIIEYVTCKTCKSMNTELKRESANRLHFLSCKACGSTRSVSSIKTGFQAQIGKRKKF

SEQ ID NO: 19876 - protein, 1196 aa, Candida albicans
  UNSURE (491): Identity of amino acid sequences at the above locations are unknown.
TMSKSFDDFIKQQKQQQSKPKGFGYRNNNQGGYNYNQAYGNVPTFQPGNQQFQYQGGYNQGFNQQQYQYQGQGYNNQGYNSNNRYNNSNNYNYNNNTNQSSTISTPVDSLPTSGRSTPNPNASTTSLTSLNTALAKLNVSNIPFEENLSNIEKAGKIAEIRPEVETIVKIIDEQEDLSIINEWKLNEILKSLLKPKSPALVKEGALLIIQQLATKFGGQTPKEAYLLQFLSTAYDMFTDKDKNVVKAAKSATDALFGIYPVEALGSIVLDEYLTIFKSGAKWNSKVAALVNFDKLIDDVPADILEMKFIDVVPVLTDLSTDFKPELAKAGLSTLKKFVKVLDNLDLQNKYDLIVDTLADPKKVTDCIKNLSSVTFVAEVTEPALSILVPILNKSLKMSSSSNEQLRQTFMETEILTRLVNNERGIEQFIPILLPGVEKVVNNASLPEVRELAGKALKVLKDAENEQTDGKFHGRITLEQAERFYTEDIPDXQHQQPVQLLKDDILKKYLATVLQIDAHVNDWKRLQEYLMMATNNNETYSQLVVTHVKNLFNPESAADNENDDGAVVIVDTHFSLAYGTRMLLNKTKLRLLKGHRYGLCGRNSAGKSTLMRAISKGQLEGFPTADELKTCFVEHKLQGSEADMDLVSFIGLDPELANVGREEIEQALKDVGFPDERLQQQVGSLSGGWKMKLELARAMLMKADVLLLDEPTNHLDVANVKWLQDYLVENTEITSLIVSHDSGFLDAVCTDIIHYENKKLAYYKGNLSEFVKIKPEGKSYYTLTDSNVKMAFPPPGILTGVKSNTKAVARMSNVTFAYPGADKPSLKNVSCSLSLSSRVAILGPNGAGKSTLIKLLTAELVPQESKVEKHPNLRIGYIAQHALQHVEQHKEKTANQYLQWRYRFGDDREVLLKESRKVSDEEQEMMKKEIDIGDGRGKRAIEALVGRQKLKKSFQYEVKWKYWLPKYNSWVPKEVLLEHGFDKLIQKFDDHEASREGLGYRELTPSVIRKHFEDVGLDGDIADHTPMGSLSGGQLVKVVIAGAMWNNPHLLVLDEPTNYLDRDSLGGLAMAIREWNGGVVMISHNNEFVGALCPEQWHVENGEVIQKGTVAVDAKRFEDQGGDEASSSKEGTPVPEPVKKRADDDDSPANIKVRTRKKKMTRNEKKAQAERRRLRYIEWLSSPKGTPKPVDTDDEED

SEQ ID NO: 19877 - protein, 195 aa, Candida albicans
LVINLADPKSKLLGKNAVEYSQILRWLSLANTELLPTEARVFQPLNGIIPYNKKQVDDNSAYLAKVVDIFEKRLADFTYLVGARLTFADIFAATLFVRGFDFLFGKEWRKQHPNTTRWFKTIIATPILAEFLGDYSFIEKPIEYVPPKKEKKKDAAPKKDAAAAPKKKEAAAPAASEEPAPAPKPRLFTTRWQDQ

SEQ ID NO: 19878 - protein, 77 aa, Candida albicans
NIFIMSQGTLYVTQQIRSLAPKALVKHFKLDIKLSDKDEAFNKAFPLNKIPAFIGPKGFKLTEVIAVCLYCMYNLSR

SEQ ID NO: 19879 - protein, 389 aa, Candida albicans
NWRVKLIGIFIQEFPLGKIPALVGVKVSQLTETIGIPIIFLSLIPNQELLGKNNQEYANIIKYVSLLNQEGVISWAAAYFRLNGRFPYNKKEVDENLKIFNTIGEILEKRLHDFTYLVGERISYADLFAVKVVIGAVATVFGKPFLTKYPSIARWVKTVSQNEIFQGQFKDLKFPEQQLAFVPPKKEKKKDATPKAESAAPKKKETPAAAAAAATSASEEPAAAPKPKHPLEALGKPKNPLDEWKRTYSNEETREVAIPWFWKNQYDPEEWSLWKVDYKYNDELTLTFMSNNLVGGFFNRLSASTKYMFGCMVVYGENNNNGITGAFLVRGQDYVPAFDVAPDWESYEFTKLDGSNEDDKKFINNMFAWDEPVVVNGEKREIADGKVFK

SEQ ID NO: 19880 - protein, 363 aa, Candida albicans
RLFIMSFINICRDNTDPFYRYKMPPLQSKTEGRGNGIKTAIVNLAEVARALNRPPAYLVKFFGYELGAQTQILNDRYLVNGAHDSNELQDSLDGFINKFVLCGSCKNPETEIVLKGKDSLERDCKACGKISMIDPKHKLYSFIVKNPPDNKKGKKSATATANVVGGGKSISDIASGHNGQGGEPGNNNNNGGGANGENGENGEGYDEDDEDDDLLAKKINAEVAQLKAMEIKDDEWAVDMSQEAIAAIARELEGLSLQNNKFDEFGEWLLKESNGSKDDLPSDVEIYKRIVELEIADTPETLQVLGQVLFDDDIINQIEPHVGLLTKLINGDEEFEKALLRGLEKFLVYKNQLIPKRHRTYIL

SEQ ID NO: 19881 - protein, 251 aa, Candida albicans
CDSCKHPETEIVLKGKDSLERDCKACGKISMIDPKHKLYSFIVKNPPDNKKGKKSATATANVVGGGKSISDIASGHNGQGGEPGNNNNNNNNGGGANGENGENGEGYEDDDEDDDLLAKKINAEVAQLKAMEIKDDEWAVDMSQEAIAARARELEGLSLQNNKFDEFGEWLLKESNGSKDDLPSDVEIYKRIVELEIADTPETLQVLGQVLFDDDIINQIEPHVGLLTKLINGDEEFEKALLGGLERFFGL

SEQ ID NO: 19882 - protein, 316 aa, Candida albicans
LPAMACRRCEDSNLPWEVEESNVIRHFEDRMQAKDIISDIVLPKDRDTGRLRGFAFVTFNDRALLEESLNLSMTEFQGRKIYVNVAAPPKGEDGDWRAGRSGSNRRGGEDREPAPELDWGAARNSQAELPPRQRSNRLGSGSGPSGESSSSSRPSRRQEVELDWGSARNSRDGLPPQRERSNRTPRKQEPEFDWNTARNTQAELPVRERERPQRENPDGTPRENSTRQTPRKQEPEFDWGAARNTKTSLPPRERLNRTGSNSGKKSTEPDFDWKRGQSLPSRNVSRSSGNRKDVIKDEQQNQPPKPHIHPDVPIQL

SEQ ID NO: 19883 - protein, 288 aa, Candida albicans
TMSNVGLQVRQAVPSIDPIVAEYAVGYIQHVSNSTEDSVLAQQVDIPQEMEFINDLLVQAGGSLEKVEALTQGLKKQLSDKLNENMEKLALTGDTSKRLLDINVLQNNTKRDINSSLALLNSGNDIAHTGRQMESTVDKKKLEKQERKIAKKVAKRNNKFVKYEASKLLNEKKEEDYDSFFLEINPMEFGSSAGKSKDIKIDTFDLYVGDGQRILSEASLTLAYGRRYGLVGQNGIGKSTLLRALSRRELNIPKHISILHVEQEIIGDDTPALQSVLDAHVWIKSLLQ

SEQ ID NO: 19884 - protein, 342 aa, Candida albicans
SLEVKKLYNERYDLESHLQEVSDKLYEMESHKAESIAARILYGLGFTKETQHTPTKQFSGGWRMRLSLARALFCQPDLLLLDEPSNMLDVPSITFLAKYLQTFKSTVLVVSHDRAFLNEVATDIIHQHSERLDYYRGSNFDSFYATREERIKNQRREYESQLAYRKHLQEFIDKFRYNAARAQEAQSRIKKLEKLPVLEPPEDEKTVTFKFAEPDSISAPILQLQDVSFGYDTNKMLFKDVNLDVQMDSRIAFCGGNGTGKTTLLKLVMDQLSPTSGYVNKNGRLRIGYFAQHHVDAMDLTLSAVSWMSQAFPGKTDEEYRRHLGLLSSVFTTEAAASALIY

SEQ ID NO: 19885 - protein, 298 aa, Candida albicans
GTVVKDEIVPDLLKRLKEPNALLALKDIMLNKSDVIFPILLPTLLTSPVDTEALAALAPVAGSALYKRLAVIINTLVNAESEAIDEVMLSVEDDGVHTLMQIIMGLLKDEDTKRRVFIFSRLAGFFANTELDYSMYLEDMVTRLILSLADPSPDVVKGAFEALSALVKRQPKEVLEKLVKPAKQTLDLCIDIPAFSLPKGPNCILPIFLHGLMYGNHKEEAALGIADIIDKTPAENLRPFSTSITGPLIRVIGEKVASDIKAAILVALNNLLLKIPQFLRPFIPQLQRTFVRSLSGQQ

SEQ ID NO: 19886 - protein, 446 aa, Candida albicans
LIQKEEKEREKEKEKVKKKNVEKFFVSSREKKNFLIRVREPTHSFSSIDMTDSWETLEPVYEKGILDSLVSVRIPILSSIKSVLSEIPEQELNKIVVALLKTFNYYHDAQSRNTVLSVVQAIGGHNPNYFQVYIRFIKQQVDGPTLPITDYMTLLQWINAFVVALARLGKLDDSVALAQGKLLSKCITFEGKRRRIYKSAIQTTKTAISDAVAIDSGYLDIIVKNKSFALLGVLDLALDKHPGLFEVYKEKYAPEILDFFVNQGLLSKVPPPTQDLAVFGSCIKSLVIDFSGLVPHIEKAILRSSENSFVYTLPVLFENLSIDIELSAKLVNAIISGIKSTKEHVRTGAAKTLELTLQKNTADLVDEIFRAIKATSNAEAKALIIKSLLHLHDSEKIVKQLLPLVSKDQNETSLASSVRVFTYHSLKYHNDEVVKQFNTGFNSPKL

SEQ ID NO: 19887 - protein, 1059 aa, Candida albicans
YAIADPFSPVVEHDRQRSPLLNDSRIFSKLDEVELKWLVRALKNDPAGWIYVLTNAPYKIRLFALEKVVLNDELSEGLIKELLNGDLAHVGPVFALLSRYTKNFTSLILPASKAGVDWIALAQKSKIDLGKLVGENFGAIFNECVNDGSPAAIKAIADIAFIQPDLIEPIVSLIDLDVSKLNFSQQEIDIYQGQEGELVVNVLNEKQLDKNSKDYEIKKWEQSIKKELKQPKKLSKEEQALVNKQLAKESEIRTRVGEVVKRTNFVISLIIQLTKQARLVNNGANLWFPVAVNKLLALPQSPLFNPIDAFLELSLLISPRLGVLCKFIGVATLRSYGLKLDESLEQEPLVSLLGRILYRIKMLSDQQPLDSLSLSYVLPLLTRVLYDGKAVAIKNASKVAVTSEFVEEDPEEEQLLLAIEIISAHAESFEDDKIPRTSILEVLISLMKLPSKAKLSKECFLSLCQHIAFNICEGDLQLLLGSLITPHVFVRSTLLEGLDAEFELEKYSKELFVVAHDNDQNCREIAQTIWDDNELKVEDASNLLSLFGNSDAGLRNSIAHAYVDACQQTSLNIQELFALYEEKKDPPAPKLDQFGLVIKSTIDNRDRWEERSTVAIALKLLAPLYTEAHVKQLFEFLVETCDKDELVAQELQDAGVEAIKLHGASNVEVLIPIFENSLAKTSKESVVVLYGTLARDLDKNDPRLKIIIDRLMKSLDTPAVQYAVSECIAPLVVAMDNLPQVFDELFEKLFTAKKVSSRRGAAYGIAGLVKGSGIKSLSSYDIIRNLTDAAEEKDAIKRESVSVAFETLSRSLGKYFEPYVLEILPIILKSLGDPIPEVRLATDNAVKEIMKNTTSFGVKKLIPLAISNLDEIAWRSKKGSVELLGSMAYLDPTQLSASLSIIIPQIVGVLNDTHKEVRKAASAALQRFGEVIRNPEIQAIVPDLINAIGDPTKYTDEALDKLIKTQFVHYIDGPSLALIIHVIYRGMKDRASTKKKACQIVGNMAILVDSKDLRPYLNELVGELEIAMVDPVPATRSTAARALGSLVDLHPRGWKDPRS

SEQ ID NO: 19888 - protein, 121 aa, Candida albicans
KRANSDNAYMSDNATIAIGKLLLLGVESKELVDQLALNAVAPKSSSPDTRRLSLVVLRTVTIHKGITDLDTVVPNIFACVRDPIIPIKLAAEKAYLEVYDMVNGSAKFDGWSKNENLSYHG

SEQ ID NO: 19889 - protein, 300 aa, Candida albicans
TKMSFFQYKNYIEEGDLVLAYISRSTIKPINVKKGEIFNTRYGHFEHDKMIGMKYGEQMPGAKGYGFIHLLHPTPELWTLSLPHRTQIVYSPDSSYIIQRLNVKPGSRVIEAGTGSASFTHSFARTVTLLGKVFTYEFHEPRYLEAKKELEEHKLDNTTITHRDVCNDGFSIDNESIEGDVVFLDLPSPWDAIPHLDSVISTSKAAGICCFSPCIEQVDRTVRALEENGWTEIEIVEVAAKRWSARKEMVRSVADAVQRIREIQNGRKTGLEVMKKGPSEEPPPKLQKTDFCPRSRKSRS

SEQ ID NO: 19890 - protein, 182 aa, Candida albicans
FNLLESINMELQVIQHRPTNDDINSYSSTSSNRLETQDSRSINKSKKNGGGGDGGDDDDDDDYGFTTKLESIPKISYQVSDLINKQGKILQPFTITSQRQKLKEKVFGTGQILPSMTVEEYLDYELANGKMLKDEVKDNNPANKDDNDSDTEDSEAEEEKRRWDDWKDENPKGAGNMKANIG

SEQ ID NO: 19891 - protein, 326 aa, Candida albicans
  UNSURE (5): Identity of amino acid sequences at the above locations are unknown.
GYRHXEYISRNNTIIFLKNLLAVYPTVDDHGAQIVNLIEKLSTTEKRNDLKLASNALLVHVKSKSKNWVPIWDFISMSEEEKEEIIKAKEEEKQRIIKEEAEAKRQKELELEKEKQMKLAKEEEEKKKLLAAASLNYDSLTAGGSGGGARTQTRTTQIGRTYEKYAIETKSEAHSRQTTPIPTQPRTLSSVPTSPSSLSKENKLQERVNKMKQAYKESRFSSDTENKVLNSESLDGHEATSNEKEAKQEESNDQEKLDSEAKEKANPGQNNEETQLSTEKEDSAGDNSTNTSNLAAQKESEQKRSPLPPQNEIKKSISLGRFQGTN

SEQ ID NO: 19892 - protein, 477 aa, Candida albicans
LNNIYSFNYQAHSPPINLSPPTMSLLYITEEVVENFSGSGMDLLFEVLESYQENDAESEEILAQIFTELLITFEENKLDVNDIKKFFTQAIKSDDQARIFFQVLNSFAVSKNIHDLLHLLFRDNKIKIETLALHLSSDFLKSVEIVPKDYFQRTLSHKIRDEYFTQKKFNLLHEEVEGYSKFTSEMHSILDSSDAEFQLDYAIQVMEKLIGHYDLDPNRCLSLLFQVFTGTIVPHYRFILNVLKKSRWWPNVESDNSSLLSLGNGGSETAAKVIGLELVGECGTRDLPETYKCLVAILIKEGLISFGSLYKFMGPDESEMDELEAEYKKKLDRDVLVAGATALALAAPLADEEDEEGEKGESKTKNKTSQASTEKDLSSLLKLNMKFQFLKVFLGVGLYWPAIFILTKYPYLAQIDEEIPILINRLFATMIDPLYNKIRIFSDEEISNLQKPKGITFSRPHNTFLSIFTTTWKDRIG

SEQ ID NO: 19893 - protein, 184 aa, Candida albicans
KKQFFICSQLPKKKNFSVSFSSTMFLFKGFGSAIRPLRFVNHGMFRFQSTRAAKPQGIKALMKEYGYPALAGNLGLSGIDLPICDVLVHSMGPEKIEVFENKVKQTFGYGISDEKLKKNPEINKIQQDFESPGQTTPENSGSMVSYLIEPIFMEGFGPWRLGIHKSVNFPLGCQSLAGHYAREY

SEQ ID NO: 19894 - protein, 154 aa, Candida albicans
KIMFYKKGPYYLSTKYSNLVLFKSNDSLMNLQGLPISKHFGKHDQGKSALVVLHDELQVDLGKYQIRKPGTSSRGHNGLKSIDKYLKNRYFKLGIGIGRPPASQSVVHYVLKKFLLQELDVIDWEVLPKCVKDLENMVIKDLELQSGKEKINGI

SEQ ID NO: 19895 - protein, 206 aa, Candida albicans
SSNGFFPSTQFPLSCSRRYLFMPSIGNPEPQYANTRHNAGHRLMNQLIDVYWKDHVYKKGPYYLSTKYSNLVLFKSNDSLMNLQGLPISKHFGKHDQGKSALVVLHDELQVDLGKYQIRKPGTSSRGHNGLKSIDKYLKNRYFKLGIGIGRPPASQSVVHYVLKNFLLQELDVIDWEVLPKCVKDLENMVIKDLELQSGKEKINGI

SEQ ID NO: 19896 - protein, 372 aa, Candida albicans
NHRIISHKSMTSTPQESSNLKRQLENSEDSSSPNKKSKTETTTENQSSWESDFNSLPVELLQTETNGTSSAPAPATPIDTTNASSTKERDQDTSKLNDAIAAAGVDIQQEEEILLQQQLNRKSAEGMASNLKSVIRSSKLHPFVHNYHLAAFIDKVAKQNGIQQNFLMDGEMLELISAACETWLSNLATKTIILSRHRRRGIPVINKKSGSSSVPRSEISKELRSLALKQKEMEEKRVNKRVMLGLEKSTKDASKNDENGESKAGAEETLHRAANATAAMMTMNPGRKKYSWMTSSATAGGGSDFGKSSGGSSKDSGKHQSPIISVRGDNGLRFREIRSGNSIIMKDLLGAIEDEKMGTRNAVIKGYAKLKD

SEQ ID NO: 19897 - protein, 549 aa, Candida albicans
PKNTVIDAKRLIGRAIDDESVQKDISSWPFKVVESNGQPLIEVEYLDETNTFSPQEISSMVLTEMKEIAEAKIGKKVEKAVVTVPAYFNDAQRQATKDAGAIAGLNVLRIINEPTAAAIAYGLGAGKSEKERHVLIFDLGGGTFDVSLLNITGGVFTVKATAGDTHLGGQDFDTNLLEHFKKEFQKKTGNDISGDARALRRLRTACERAKRSLSSGTQTTVEIDSLFDGEDFSANITRARFEDINSALFKSTLEPVEQVLKDAKISKSQVDEVVLVGGSTRIPKVQKLLSDFFDGKQLEKSINPDEAVAYGAAVQGAILTGQSTNDDTKDLLLLDVIPLSLGVAMQGNVFAPVVPRNTTVPTIKRRTFTTVADHQTTVQFPVYQGERVNCTENTLLGEFDLKNIPPMQAGEPVLEAIFEVDANGILKVTAVEKSTGRSANITISNSIGRLSTEEIEKMISDAEKFKSSDDAFAKRHEQKQKLEAYVASVESTVTDPVLSAKLKKSAKDKIEAALSDALQTLEIEESSADDYRKAELALKRAVTKGMATR

SEQ ID NO: 19898 - protein, 180 aa, Candida albicans
TVLYKQHFIQQIITMGQAFSFGNIFSKLWGTNKEIRILILGLDGAGKTTILYRLQMGEVVTTKPTIGFNVETLKYKNITLNIWDLGGQTSIRPYWRCYYSNTSAVIFVVDSTDKDRIDTACKELHQMLKEEELQDSALLVFANKQDQPGAMTAAEVSQALSLTDLKDRSWSIVASSAIKG

SEQ ID NO: 19899 - protein, 239 aa, Candida albicans
PVNMMAYKDIVPIGTSLIIGSTCFGLGIIYGNWPYDLNTLWIHDIPEAFDASLRHYQQWGNSPMYVHYTLHAVGLLGLIGHFIKLYKPDEDAKYFEYGSLGLFMVGVVIYLTNLRTGVNSCLVGQWGDVDYQTGINVMAASQVMIIFVLLGVLLLQGGLYYAQWYDNKLKEEFYRQEAKEAALAAESQAQQEHDIATKGKKDKAQPQGEVIEEVTGATTTTGAASATKGQKKTTKKRKS

SEQ ID NO: 19900 - protein, 266 aa, Candida albicans
RINKIYIHRSKSIMGVIEIESEQQFTELTKADPSKLIALYFHTPWAGPCKTMNQVFKTLADSKESDNSIIFLSINADELPEISEIFEVSAVPYFILIRNQTILKELSGADPKEFIQALNQFSNNTNSTTTSNNDNVQASINSTTANTNSNNTTTNAPEVEESEEALNERLNKLTKAAPIMLFMKGSPSSPQCGFSRQLVAILREHQVRFGFFDILKDDSVRQGLKKFSDWPTFPQLYINGEFQGGLDIIKESIEDDEKFFEHALEA

SEQ ID NO: 19901 - protein, 820 aa, Candida albicans
CENYQKKKKNCFQLARLLTMDDVGRIRYQISPVIESIHLEDETITDITTYENNLYVGTSNGQLLHFHRFDDTTEYIPITTINVGTHSVSKILCIESIQRLLVISNRIVLSYVLPELSPCRMKKMKDVTDLQKLDSLVLVLSPTKIRIINIQADTITLAKEINYQGGVACRSCKDSNFIVVANNESYDIIDLDNNRKVPLFSYKSESTVHPWIIPFDGEYLLSVLSDTNTSMAMFINSVGDVTRGTLTWVDKGYPENSIALEGEYVFALFKNKMIVSSLVSLDTVLEMENPGYTITKVPPAIVNDKSLANIIDTIQPTASLILTNGKQIFGLHKVHKLVEIQQQFINDSLTELNPASYTGNARDYITYLALVQAVITKNDDKFWEFANQETNEQLVVSPQFVFYILGGGEKHLPFPGLKEICQHYGTYKNDKLLKKYIQGLPDKYLSTDIKLYYYQNCTNEEGLAFTERVTFEDNPQPIIDLLIHQHRIKCASEVYKKVPLLIEYNTFINKHLLDSLVDDAVALLLSGKLDENEYSKTLISLLKFDDKRGIGVLKNGPSKYYNINQTVMKDLSETTQDEKGYLLLRIELMEITENSSEELLQLIVQAMNLLYDSLKDEFTLLHQEFRRLNSLENERWPKLSWPNFLDISGKSKELLTFVELYLKSFELAREAPDGPIFDYHRMFNNHDIDALLEFGDYSTAESIATGTNPFPKKTFYGTMDFTSQPSTTGLIQILNFYLTQYSSGKQVENTIKHFAEAYYHTIAPWQFLQLIPPDFPLAHLVGYFHLVTTDQTQQYRDVLIRKSISRAENLRTKKLLDVSK

SEQ ID NO: 19902 - protein, 192 aa, Candida albicans
SAMTSPKRRIEKDVMELMMSDHDVTLIDDSIQQFFVIFHGPPDTPYEGGVWKIRVELPDQYPIKSPSIGFTNKIYHPNIDEGSGSVCLDVINQTWSPMFGLLNIFENFLPHLLRYANPSDPLNTEASNLMTKDEAKYNDTVKKYVQQYAKNNFDITGKDDNEDNDDDDDELSDVRSLSSDDDNEDVSGSMEV

SEQ ID NO: 19903 - protein, 464 aa, Candida albicans
LVFPYTHTLNSINTFINFDTSSTSDPVILISPPIFIMSNLRRSDNSNEKYGIVIDSGSSGSRIQIYKWTDQKFELKSSKDQSVLQSPPKITQEKGWTKKITPGISTYNSKDKFGRIWQDHYSELLKFAEGIIPSEKQPETPVFVLSTAGMRLLPKKTQKSIVKETCTGIKQNTNFYIPTENCENFVEIIDGSTEGIYGWLGLNYLMKQFNNYDSSQDILHESIGFMDMGGASTQIAFVPSSKEQITKHKEDLSTVTLRNINGETQTWDLFVATWLGFGANQARKRFLNQLINLAIVNGENWNSEINDPCLPKGASMEYNYENKKYLVKGVGNYEMCIKTIYPLLMKNMVCIDEPCLFNGIHGPKFNFEKDKFIGISEYWYTANDIFQSGGEYNFKTFNAKVKEYCESNWDEILKNSEQGQYSKLDPDKFLKDACFKASWVMNVLHEGFELPIIGFETENEDHTE

SEQ ID NO: 19904 - protein, 266 aa, Candida albicans
DKKITNAHVPFKSADSVEGEELSWTLGKILLFASSQIEPKEGDTEAKQIGIYPSQISGHKFVPGGVLLSSDGDYSTDDEDDDLGGQFSHILYSLIFVLLLLFFLFHFGKSHFGRWTNKFRRFQIPVEVKRAVNSIGSKIPGVRHYFENIVMFLDLQDQNIILEEGIFDNTSSNNTNFKSLQNQQQPASASVLRTRLAIGLNEDSGNDHKSGSAQSLSNFNSKGNNYYNKSFSSPNKNIYISANNSRESLARASSNASIPRSKSSLD

SEQ ID NO: 19905 - protein, 108 aa, Candida albicans
YTLRDSYLSCGMNWPYELVNVGPFLRQEKVMHQLNLIDLQKWNECNGRVVRTFQARHFIHAVHTLPVLINDIQLIIINVIMEVHYNIYKWHYLLILQLNILPRLPRNQ

SEQ ID NO: 19906 - protein, 525 aa, Candida albicans
SIKHKSIMKLILSTLIVFIHTLLVLALPTKEGSDPNSAKKYLVSDLPGLHENITPDNSIPLMFAGQLEIYPETDTHYFFWKFSDLNPETVTNRTIFWLNGGPGCSSMDGALLETGPFRINSQQQVISNNGSWHKMGDIIYVDQPAGTGFSYSDTYITDLDQVAEYFLKFMEKYYELFPEEIGYEIYFAGESYAGQYIPYIADAILQRNKKLVDGEHKYDLRGVLIGNGWVSPNEQSLSYLPFFKDHGLIDVHHPKWATLLAKHEQCQKIVNKIDSTFDDGVVHYYEVSSSTCEAILTDLLEYTQDTASEKDQRCVNMYDYTLRDSYPSCGMNWPYELVNVGPFLRQEKVMHQLNLINLKKWNECNGRVGRTFQARHSIPAVHLLPELAKEIPVMLFNGANDIICNSQGVLSYLQKLQWNGETGFTNKDNQISWIYDNKEVGYIIWERNISFINIYNSSHMVPYDLPDVSRALIDLITGKYDEKDVDGKKSFVTYPLGSRKESDASADGEENAGLDKYPGDSLHRL

SEQ ID NO: 19907 - protein, 189 aa, Candida albicans
VEVIASFLSFFALHTMAEKRLFKEYNQYQKHLPQLNNDQIVSLSPLSPDKNILLWEATIAKPTKKDSPYYYGGQWKLSINVPTSYPIDPPTIKFVTPIVHPNINLGSGEICLDILKKESWSPAWNLEHLVVAILMLLDQPEPDSPLNIDAANLYRQDKVAYESIVQFNIWKHNNFYSAFVRDTSGVRSL

SEQ ID NO: 19908 - protein, 125 aa, Candida albicans
SLVYFPKMLQNIETKQQFSSALQNKNDMIVLDFFDECSHCSDLNDKLDEFSDMYEAQNIRFYKVNIEEDRELAEDYKVSSIPTTLFFKKGKVFDKVVGPEPNEIKKVLDKNLMGWSGRPLQSSRT

SEQ ID NO: 19909 - protein, 329 aa, Candida albicans
SEMSIKFVKSSKDFEGYLKNNTHLVLNFTASWCGPCQAIKPVIDQAYGQFQNVEIVRIDLDSQRELASKYNITSVPTFVFLETGKEVDRIQGANPQALITKLQEFNTKANGQKRRGNGTASEDLITQNSSLKDIKPLIPKNFEILNATIDYSGYEVLNCLPLYKDSKTKHVVSLDNTDKSAVISDSDSQLLFYIPFLNISKIYSILVKVKSTKTYKEVDESALDVDSDDLDEIQPPNLIKVWCNTQSILSFDEASADTSAPHIEKVSTNDEEQWLDIKFKFVRFQNVQNLTIFVDGEDEDYHTVIEKIVIVGVNGESKEQGKINQIDDE

SEQ ID NO: 19910 - protein, 490 aa, Candida albicans
KNMQKKKNKCYPVCFFFINIYSFLLNNYDFFSRSMYISLQCNDQQYTNFYKSFAFLDSPSINWKTIIVGFTIGQYVFETYLDLRQYRVLQLKTAPKSIEKEVSQETFDKSQEYSRAKAQFSVFSSTFSLLQNLAIFKYDLLPKTWTLAGTIMKSSAAVLPKAMSGVITQSLFFVFTTQILTTLIGLPLSYYKNFVLEERLGFNKQTIGLWVSDMLKGIGISIVLGSPVIAGFLKIIDYFDDKFIFYLMGFILVVNLIAMTIVPTLIMPLFNKFTPLEDGELKTAIEKLALEQKFPLTKLFVIDGSKRSSHSNAYFTGLPWSKQIVLFDTLIEHNSTEETVAVLAHEIGHWKLNHLPKMITMMQGHLFLIFSLYSAFIHNKSLYTSFGFVKQQPILIGFMLFNDIFQPVECLLTFVLNLISRKHEYEADKYASDCGYSEELSRSLIKLSNENLSSMNADWLFSSYHYSHPILPERLSALGYVSKVKVKKDE

SEQ ID NO: 19911 - protein, 109 aa, Candida albicans
LYFFSKMVHVVTEVNEFQTLLKENNLVIVDFFATWCGPCKMIAPLLEKFQNEYSNIKFLKIDVDQLGSLAQEYNVSSMPTLILFKNGEEVNRVIGANPAAIKQALASLA

SEQ ID NO: 19912 - protein, 208 aa, Candida albicans
KDCVYKFYHHRNQASTMFNLVNRAQAAANLAFTSSIVITSVVIVLTLLQLYKDNVWSLNTTSITNIRPTASIKQSFHYGSLNRKPKENAKIQFDLSSDLTPLFNWNTKQIFIYLTAEYPGKSEGSSNKVTFWDKIITNKEDANLTLTNQRGKYSVWDVEKSFRGRNATVRLEWNIQPYVGPLIFGSTEGFGEFQFADTQKKKESTKNT

SEQ ID NO: 19913 - protein, 392 aa, Candida albicans
IHFRNLFQMLLSIQALSDLMIVDSIYNFSVSSSLYNSNQTAIMKYGYGGQFPVYFINETIRSNDWKLSNLSVGLANISDMDSFSGILGIGFTRQELFKTNYLNFPYLLKDQGYTKSVLFSFNGQDQNPSIIFGGISTNIIDGPLVRAPFIKVISFINQLDYWLMHTFTVNQIKLGDTIVSNQKTLYQIDSGTNGFVPPTPVLNNILKILGDDYIQDDNGNIYFDIKYIEGLNITFSVQGYDIGFQLVDIVGDTIERNSTTFVALNVASCDIGYNAYEGLLPNLIFKYHYAIFDYDNAQIYFGKYKNSNGEANVVAVENGYQLPVPTVDVPDVEDTYSVIYIAESETTVTVAPTEVQSTYSSFSISEGTSSNLTSGSTSDDKITSVTCNPQYC

SEQ ID NO: 19914 - protein, 159 aa, Candida albicans
KTKVAREVLDITASNVKPGITTDELDAILHKECVKRNAYPSPLNYYNFPKSLCTSINEVICHGIPDKTKLQDGDIINLDVTIYYLGFHADLNETYYVGDKAKCNPELVNLVETTRECLDLAIKHVKPGIAFRELGNIIEKHASENNCSVVRTYCGHGCG

SEQ ID NO: 19915 - protein, 154 aa, Candida albicans
NYNPLIYIYIYRHVKDYVLLEVCTTPLQPTMNCFFSATTLQTNFKKPLIEQHNNKCYKYIKLNNNGLKVLLISDCHHHGGLKNHFTCSMTIKNFGSFNDPMNYLGLTHLLEHLIIFNHYQFINQLKKMGGDINGYTLGDFMNIYFDVLINEPQR

SEQ ID NO: 19916 - protein, 358 aa, Candida albicans
CEIHYITKWLCGILSMQDNEREKKNCGGGEDSCRTKKKKLWCMARCNNFFFPIKINFKDHRFYICICIYILMIIPSLKLTTTRSSFVSVSKYYSRMSNQFTILSDDKTIEKPLLDDRSYRFIKLNNNGLRVLLINDPTTDKAAASLDVNVGSFTDKEYNISGLAHFCEHLLFMGTEKYPKENEYSNYLSKHSGSSNAYTAAEHTNYYFQVGADYLEGALDRFSQFFIAPLFSKSCQDREINAVDSENKKNLQSDMWRLYQLDKFTSNSAHPYSGFSTGNYQTLHTDPVAKGVDVRDILIDFHKQHYSSNLMSLVILGKEDLNTLTNWAIEKFQQFLIRIYLDQIITENWCISLNNWEN

SEQ ID NO: 19917 - protein, 822 aa, Candida albicans
LGNRKVSAVPNKDLSRPNYNGELVYKPQQLGKLIKAKPIMDNHKMELNFLIPDDLEDKWDTKPNGYFSHLVGHESKGSIIYYLKQKGWATDLSAGAMTVCQGTSNFYIEFQLTPKGFENWQEIIVITFQYLNFITNDEPQKWIWDEIEEMSQVNFKFKQKMEASKTVSTLSNKLYKFDEYIPASYLLSSAIVRKFDPEAIKRFGSYFTPENLRITLASQLLTGLNKQEKWYGTEYEYDDIPQELIHQIKSQPYDNNQNLHYPRPNHFIPTNFDVTKPKLKHPQVAPYLIEHNNKINVWYKQDDTFEVPKGSIEVAFHLPSSNTDINTSVMSNLAIEMLDDELNELTYFAELVGLKVKLHAWRDGFLINVSGYSHKLSNLLQEVLNNFFQFKPKQDRFESIKFKLLKNFKNFGFQVPFQQVGVYHLQLLNDKLYQQDDKIEALEKVTYEDVYQHFTQNIWQLGIFAEVLIHGNFDFAQSKQIRDIINESMENVKPWMEKYNEEQFHLQSYVLQPNETIRYEVPLKDTANINSCIEYYIQINTNTDNLKLRVLTDLFATIIREPCFDQLRTKEQLGYVVFSGTVLGRTTLGFRVLIQSERTCDYLQYRIEEFLVQFGNYINNELSTEDFIKFKHALKNIKLTKLKHLNEETVRIWSNIIDGYYDFDSRTRQVEILENITKDELVEFFNTFIAKSDNTGKLITYLKSQNPIEFTESKKLHSGIINYLYRNQIEINHELIDNLVKQYDEHKDLAVIAKELSHDINVNKDKLLKVLNKSIAQPVPEIYPTGKLVVNDKEFRKNRQLSGTPKPVNPLSKFLYNDQSHL

SEQ ID NO: 19918 - protein, 273 aa, Candida albicans
FVDMDLLAAVCKPPTNVEVTKPKLKHPQVAPYLIEHNNKINVWYKQDDTFEVPKGSIEVAFHLPSSNTDINTSVMSNLAIEMLDDELNELTYFAELVGLKVKLHAWRDGFLINVSGYSHKLSNLLQEVLNNFFQFKPKQDRFESIKFKLLKNFKNFGFQVPFQQVGVYHLQLLNDKLYQQDDKIEALEKVTCEDVYQHFTQNIWQLGIFAEVLIHGNFDFAQSKQIRDIINESMENVKPWMEKYNEEQFHLQSYVLQPNETIDYPNDAGRIHA

SEQ ID NO: 19919 - protein, 190 aa, Candida albicans
IFFTLLTTTIETVKTTYQFPTMSQLKKTNLNSVNDLRQTTDDHLGLVFQQLGYNESFTLIDLKLGLGLSTVVIAGLLFLVDKKYAWKDSYNLTVIACVLYGIISGVLYLINFFNKNVKYIGYDNKGNKLSVATSSNKLDPIYNVTISLNDRSVNAAFGFNKFFDVVGFFNRDAFTKLVENELNKLNKKNE

SEQ ID NO: 19920 - protein, 374 aa, Candida albicans
  UNSURE (354),(358): Identity of amino acid sequences at the above locations are unknown.
ITFTPFFSFFFTFFNPYTQSPHITEMTLTTPELNFKAYTYKNSSTPVQLTDKSIKLVKDPSNPDSYVAPPGKILLKINYTSLNPVDVKLHHLATSLVSLLVNNNNGFGRDFSGEVLSIGDNVKTNVKVGDLVQGIYHKVYSQGTASQYLLVDPNEVDMIAKPDNISLAEASSWPTVFGTALLMSKDLKYKDSKVLVIGGGTSVGRYLVQLAKQGGAKEVVVTCSPRTEDVIKSLGADTIIDYTKHKNILYPVLESVKSTGKFDYILDSYGGHELFPEINNILTEKIGRYYSIVGDYPGSSFYNLISTVSKVAWRQLLGALGLLSFNYKFIMLDNFKESMPEARDLIGSGNLKIXVDSXYPFNQLESAIEKLDSG

SEQ ID NO: 19921 - protein, 362 aa, Candida albicans
STINWISFHLYPTMTKLTYKRYGFKNGGSPLEIITDSFDFPTDAQGNFIIPKNKILIKIYYASLNPVDYKLKKITYFPPFSLHGIGKDYSGEIVGLGSNVKNFKVGEFVQGFHPGVITDDGTFSQYLLIDTKGLFKTEIATVPQNISLEQAAAWPLVLGTAIKVIGDLPIKGKKILVFGGATSVGRYLVQLLQAEKAGEIVVSCSPRSQELVTELGATKIINYRENVLNQVLENVKDKPFDYIFDTWGGNELFPHLKQILVNNGTYHTIVGDDPHSFFTGTSKSFFRTFLSRLHLLDYSYQYVLLGAGGTGWINKAREYVANDDVQIFIDKIYKFEDLNDAIEYNKTGTAQGKLIINVKDFK

SEQ ID NO: 19922 - protein, 280 aa, Candida albicans
LKEFKKVVIKREQSMFSLLEMVVDLVILVICDGYTNSIYSITVGAIDYKGLHPQYSEACSAVMVVTYSSGSGEHIHTTDIKKKCSATHGGTSAAAALASGIYSLILSANPNLTWRDVQYISVLSATPINEEDGNYQTTALNRKYSHKYGYGKTDAYKMVHFAKTWVNVKPQAWYYSDVIQVNQTITTTPEQKAPSKRDSPQKIIHSSVNVSEKDLKIMNVERVEHITVKVNIDSTYRGRVGMRIISPTGVISDLATFRVNDASTRGFQNWTFMSVAHWGE

SEQ ID NO: 19923 - protein, 396 aa, Candida albicans
GVTFTGAGRKDSPRGLESDFRNSTDSQLSDIFEDLENYSGLSGQKIEDFNDSPLFQSVLMRYKNEGISGRTCGIFSLVAIFLWIGSVIIYSRVNHSTIGNDLTWKTNIIQLNGENITLNEYNPNFKNITMNDWRKGKYHTFEKQIRWLTSKQSPKSKHGGGFYVLDEHDKIVVNQIGQVDKSDTFLSNKQFEYGNNFFKIQDFILNPLQSIEDSEVVHFIITDTVHQWRHLSFALYWLFKPLVGTYTPIQPPRNNNKGNGLEVDALDKLHYADFSSDGKYIVFGFEHNLFIQDLATGEIQQITDDGSPNIINGKSDWIYEEEVIASNKMIWWSPSGNHFIFAKINETKVQEVDMDYYTKQNTNIGMQYQQVGESKYEGVNQYPINTPLKYPKTGNK

SEQ ID NO: 19924 - protein, 526 aa, Candida albicans
NTLKPGTSNPILSLYIYDIANKKTEEIIDGDDNLGTEYILYYAKWIDANSFLMKQSDRTSSVLTKKLYDLDKNHVSIVSSSNVTKEYKGWVERMNPITLLDDGKYIDNVVIDNRNTLALFDSPHLVSPSKVLVDNKDWDITGEAIYDAQEKFVYFLSTVRSSMDAHLVGIDLADNYKLYNITDTKKDGIFETKFSENGQYLSLVYQGPNQPWQRLINMANVHDFIKSEEYGKSTIEEAVILNQPIVNSLANLKEINLPTVRYKEVTIGKKEDQVTLNIMEILPPNFKAKNQKYPLFVYTYGGPGSQTVMKKFDIGFLQIVSARLNSIILVIDPRGTGGKGWKFESFAKNNIGYWESRDLKTITSEYIKKNKKLIDKERVALWGWSYGGFVTLKTLEYDKGEVFKYGMAVAPVTNWLFYDSIYTERYMGLPDTDPNYETSARINDFDNFKSVKRFLLVHGTGDDNVHVQNLMWLLDQLNIHNVENYDMHLFPDSDHSILYDNAGVIVYDKLYYWLQNAFRGNFDELN

SEQ ID NO: 19925 - protein, 152 aa, Candida albicans
IWKFGDVGGQESIAEIGVPGTLSNAMASYLKLILTITEGFPDGYATMIDIAPGDIWRQIDEDDKNNDNDNSNVDGTVNVPIIMMANKQDIPQAVDLVSLKTGVFIKLVSELEATDSKLLPVSVLENQGLQESLEWLVTRLIYNRRNKKPEYK

SEQ ID NO: 19926 - protein, 373 aa, Candida albicans
INSAIMVHYRNRYLNYIRRKPLALLAPITLLVVIYFYFFSAHGFSSNKQKYNYNKKSRGWFYKNRDTVILKDLPKNHISHYDLNKLTASKDALNKREEVLILTPMSKFLPEYWENINKLTYDHSLISLGFIFPRTTQGDDALKELENALKKTKREKRLNFKKITILRQDSNSLQSQLEKDRHAFKVQKERRSMMALARNSLVFSTILPSTSWVLWLDADIVETPVTLIQDLTGHNKPVVSANVHQRFINQDTKQPDIRPYDFNNWVESEEGLKLAASLPDDEIIVEGYSEMVTHRALMAHFYDPKGDPSTEMTLDGVGGGAVMVKADVHRDGAMFPSFPFYHLIETEGFAKMAKRLVYEVYGLPKCRGADRYM

SEQ ID NO: 19927 - protein, 155 aa, Candida albicans
RRSRNHQSPTLLLILSLFTMTSIKPFQMEDLFELNPVNLDPLTENFNVSFYSQYLIEWPQLFYKSVETPNGQASGYMMAKTEGQLSKKEWHTHITAVTVLDQYRRIGLASKLCLELENLTQVKDTLFIDLFVKVTNTLGRILYEKLGYSVFRRVV

SEQ ID NO: 19928 - protein, 642 aa, Candida albicans
IQTKTGVTNIRLAYCWNNILTILELDNKSVSGRILDFINNAKDKNKVISKLPFKKIARLTDERIIRDIKWLQSDILCVFLDNEMITIYSNGTMLVPAASQTIGNISDINLSKHRVIYTDESKLFIGKLLGWADILLNKLSQGLYAEALSIADNYYNSNSVGKLTVVGLPQNQKQRGDLIEPYLIKIMREAMPHLIQSDHESYITLCLNIIAYLAVPNDLLEALYEIVQDNSIFFQALEPFILSGLILSLPPVVLKALIQYYVKAENQQSTNMDDDGELLTEIICTLDIKLLDIDLTIQLCKQYNLRECLVYVWNFVLNDYQTPLVDFFVDIKKNPSSPDNFKVYTYLSYILTGRQYPIDKFINNDMVAKKTICDILFSSSTISSVPTENGNTIFPYLYTLLKFDSLEMLSCLNEFFEDLFLNEDPKLNRQYLIEALIDIFEANDEQFTDFDKCQLLIFIARNYPKYSQFLRLSDSILSDVFNRLCENKSESIFLDCELALQSLLPYFEPEDEYYVEKLEVAKYYNVLINMYESEGMFSQALKMWLKREHENASEDTLDNETPEMDIDGGSDDHDHDHVDQLYLLLESSFASSKNPSDRLNLVKIVKDNFGKFLKLNYVSDYNISRFVNLIEQFSPNLHLEVL

SEQ ID NO: 19929 - protein, 267 aa, Candida albicans
ILKDIFQWNELKTISDTINSPEFINLHGSRLFVKSNAVYIAIITNRGNIVIFNYRQEIDYILVPTQSTDENCSISCIAFSSDCSYLAAGLQDGSIRLWNLKKATKGNHIPNLPFYTIYPISLKSRFAQNVQGHVINTKITYISFVGESNYQLITADDCGLVFFHNGIKKFMNLIYVTTKLLGKNDANLDDSKFKIRRMEMLPLGSAHQITDKMGIVAIMTDDLLVIVSAISLNDDTVLYVKQHFKIGKPKHIIHEQDFPSYCLSWMP

SEQ ID NO: 19930 - protein, 344 aa, Candida albicans
KILLGTLILIKLMDWKELLLLMLLPMLKLMKVTKNLQTLISHNDGSEWDKLVPPTIDSEGIKYPCTGQSLNKCALHLHGFTERADYRDTFSSGSATGFLIGVGNVGEFLTPMDDPSTATFLSTDGGVTWKEIKKGVYMWEYGDQGTILVLVNAVENTDVLYYSLDEGQTWKEYKFSEYKVNIYDLATVPTDTARKFIIFAENPKDHRDIQTFTIDFTNIYPRQCQLNLDDPEHDDYEYWSPTHPIGGDKCIFGHESKYLRRAKGHTDCFIGSAPLSEGYKLEKNCSCTRRDYECDYNYVRDVNDNTCKLVKGMTSADRKTTMCSKENAFQYFESTGYRKCGPRE

SEQ ID NO: 19931 - protein, 101 aa, Candida albicans
NKLALFSLKESSLEEPKKIFENIVGYAITGTYVVVATIDDNTDSLLSKVTVDGDIFADADFPHDLKVEPHQAFTVLDSSSKAVFMHVTTNEKPKFRIWSTS

SEQ ID NO: 19932 - protein, 362 aa, Candida albicans
INDYVSRDGENFVRADLDIDIKYGVMSFLPSSVSSLFLTIMDFNSRAFQTASFYGSDSSGLHFTKLLDNVAGGNIQKIENIDGAWIANIGVDSNNPYDGDKSLLDNLFGGTYAKSIVSKVSINDGKDWSLIKLNDNSCKIEDECSLHLWDFTELDGEGKFVTGPTPGILLGVGNKGKNLAHEFEKMKTYVSRDGGVTWNKALDFPAVFAFGDQGNVILAVPYNGKKKYEAAKHFYFSLDQGKSWEKVDLEHPIYPLSILTTIDGTSRKFIMGGIDDSRRAENEYIYSVDFTNAFDGKTCGDDDFEEFVARKSNDNGNDEPLCVYGHREKFRRRKQDAKCFVNKLFEDIKVIERSLSMYRTGF

SEQ ID NO: 19933 - protein, 245 aa, Candida albicans
KSPLFFSIFIKYPQNRLINKSKNAKMAEETVTPEPEIVKISVFTPLIYVGVVLSIFITFSIIYRKRRLQSLTKVEPLFKENYTAVLYQHLKDQYTNKDLPKDQRPHEKVMKAALLRRAVEAIRRSMKLKENEPVFNKLYQNGLIGDDIFKQYQIQIKFQELELKDIVTECETYKKGWVQTFFPLAQEICFNEALRRRLKALDDIADTFSKLWETYADKSEKSLESAKKVESKKTVEGSESRKIQR

SEQ ID NO: 19934 - protein, 502 aa, Candida albicans
IPTFYLVRLLDLVKFFLPILPEIEYPFEKVSFDEKIVFTVGSAIIFLFGQLPIYGLIPNAQFYLLDPFSNFRSIFAMNKGTLLELGLLPIITSAFIWQIAAGLRLINVNFKLRIDRELFQTGQKLTSFIFSLIFAIGLIYSGYYDNAIRGYNPLQDGIPYGSYALILLQITAWSWIVTLLVEIFDKGYSFGSGILCFLAIQSSTNFIANLLGLENFPVVNSNKFESYGALMNLIKNFSIFNPKQTVYQIWHSFFRIQLPNLTQFYISLASILIVVALQNFRIELPIRSTKVRGMNNVFPIRLLYTGGLPVLFAFTVVANIQVVGYLIHSVLSKLGTSPIVISIIGNYVYNPSSNELDLNSGILNYFTSSSSLVESIISPIKTTVYSITIIVLAVWFANKWSYISGSSPKDISKQFKDQGISLAGKRDISITKELSRVIPVASVSGAFILSVVALIGDFFGGLGYGVASIIGVTASFAVLEEFMTEYQQNGGGQFSNALASFQ

SEQ ID NO: 19935 - protein, 324 aa, Candida albicans
  UNSURE (38): Identity of amino acid sequences at the above locations are unknown.
HTNNEMYVDVIETLNVIIKPTTKKAKRHLQLEKQNQGXDSAFYSSASSRSLNHDIENHLISGYIDGEINFLSRLTGVPSLQLSLNSIGTSRIELPSLHRCIDFDVWNEKRGILSFIPPDGKSTLMRYQIDLNQTNQYGTSNKQSMLSMIKSTSIEAEFICHENTSDFEIRLNLSPSISKIDSLNVEIVCEHPEDQIKMNRVTHGDFSSKGNGKAEWILRQLKPNVFSPVFYGSIISNTENSSDEEEEEEKEGARDENNQAKHDKKVRISKPSYIKLSYSHKGPVPSGLKVDSLKIISAKGLGDTVKPYKGVKYMTKSGNYIVRS

SEQ ID NO: 19936 - protein, 204 aa, Candida albicans
  UNSURE (5),(9),(15): Identity of amino acid sequences at the above locations are unknown.
LRGLXDVPXPCVKNXRVMSEAIYISDSTNSLVYEYTTSLCIPKFKSLVPKVTSFNDSTTTNKIPLNSKLYLFVHHHQQSGLQFYLLCKEIDNANPLIPSIFIQRLIEVMEDYFGDLNSVKIEANNEILTLLLYQMLDDGTPYITDFNKLRDLVSYKSLLSKLLSSATTVASKATGTAMSNKGPLDLHKTNNHQTSDILWRRSNV

SEQ ID NO: 19937 - protein, 210 aa, Candida albicans
GFTNITKHIKYIDEVDLELVNQELNFHSPDNNLVIKGGCELFTTKPIGSDRKLFKTIDKHLDQIIEDNQFSRSIEREKRNSISSMFGSNASSPDLRRHSAISISDMRRRASSNLGSINFNRNSLPKNEQHNDNNNTSLLSQSLNDSGVIDDNEHAIDESPFGPLKNVTTRKTFAYLIAILNSSFPDQDFTNLQPTTENFYRIESPDELVH

SEQ ID NO: 19938 - protein, 165 aa, Candida albicans
TNTRSIFLVNLLMSLLNKGFTNITKHIKYIDEVDLELVNQELNFHSPDNNLVIKGGCELFTTKPIGSDRKLFKTIDKHLDQIIEDNQFSRSIEREKRNSISSMFGSNASSPDLRRHSAISISDMRRRASSNLGSINFNRNLYRKMNNTTTTTTVSGLAQGWKIRV

SEQ ID NO: 19939 - protein, 134 aa, Candida albicans
IFFKAALFDKNRRMLFCGNRIGCFNGPIITGREEAVDAYFKALQLKPTFVRARNNLGVSSINIGCYKEAAEHLLSGLSMHQVEGVDTVSTLNHNQSTSLTETLKRAFIAMERRDLLELVKPNMDLNQFRGEFSF

SEQ ID NO: 19940 - protein, 288 aa, Candida albicans
GHILHRAKCTTPLPKTEVPVNAQWPGGLSQAPATQQHNQRPGQLALGLGGYGPMMGMCMAYQLQRQQQQQQRHIQEPQVDWENQFKEIEELTNKAEEVEEIQREQSPEIVVDDKYQATFQEVWDSLNSESFENDFINQQYEDFKRTQKDGFPADMNQWEKDFAKYASTRAHFGDYQFEDKQSNQFLDLPKDQDPYEIGLQLMENGAKLSEAALAFEAAIQRDENHVDAWLKLGEVQTQNEKEIAGISALEKCLELHPENSEALMNLAISYINEGYDNAAFATLVSTTA

SEQ ID NO: 19941 - protein, 248 aa, Candida albicans
  UNSURE (247),(248): Identity of amino acid sequences at the above locations are unknown.
YFHYMQTSSTPPRKINRISFLDQGFSIGDSEYNAPGSPIKRSHWKQLSSVNRCTLCDTTLSVKNGIVNCRKCGELFCNEHTHYKVRLRNPDKGETTPQYDSRGVWCRCCETCFFNKQKSTEVNSVDLTEQFKQKRLAKVEAQQLHRTRIQRNFIKLTDSLMNKSSVDGIANWSPNTKNCSICFVEFNLFIRRHHCRLCGSVVCDDPNGTRKGCSMNVPLVKLVEKLPQLNYTHEYEEIDENLRFKCXX

SEQ ID NO: 19942 - protein, 72 aa, Candida albicans
  UNSURE (9): Identity of amino acid sequences at the above locations are unknown.
RLHLLRGLXKKEIREMREQLMVMNEQKFLVKNLIKEYTKARRFDELDSLIANKNELNETIARLESELGEFGF

SEQ ID NO: 19943 - protein, 392 aa, Candida albicans
RINYTISGFYNIIYLDHKMGEETPNQTHEILFNDFIPLSFRITVAIHFGLILWLILNLLLTNFTSINVLHLLKLSYTPHNYTHLDDLLHNQDTNINTNNNHNHNHNQIESLGEYAAFLPSDPHENDRLIKGIWSNLKFVSIINITCWIIYKSIANISWLTPLFYTLPLVSLFMTIYKLFFKNSYSSPGQIRIFTTIKRIIRGNINSQTMRTNDILISDSLVSYSRVINDLGLVIWNYWFDSNIGYNYKFESMILSIPTWIRIKQCWYEYKLTGKTQHLFNLIKYSTGLGPLLINVLLKRMLLNATEQEKTSGELLLKLNHLNNWLYFALAVNSTYSFIWDIKMDWHLELFDGLFLVISGKKTSHSVVSVSNYRFQILRKQLALPRSIFTHGT

SEQ ID NO: 19944 - protein, 466 aa, Candida albicans
SHLHFIKFPLNWHIWKNRNPKIDPKPIIDKNANHNPVPNSRFRLKDLPDLSKLKFFDVKNISVQNKETELQFHYTTINLPPSSDSVIVDIKFGGLNALDYAKINQYVLNLSNVKVGMGYEFSGVITNVGSSMAKNYSVGDYVFGLIDPTSRRGSLSSSQLIYPNRDVLIKVDEETLNKLHQIDININTAGVGKDFQIEEDEQSSTTPKEDSKYEVASTSHKNSEPHSTLPPLAKLCSFPLLYNHSKQLLQHLNPKNTEANILINGADINLGLTLLQILLIEYPNLEYMKLILVIREKSLKFMEGIVDQFQKKYYNPSQTRDFKIISFDLFNDGLYFPGEKIPVNFKKPNFFASEVINALLVPLRHNGDVGEQQKIDEKNINDYKLDMIIDLIGCKKYFQTNSTKINEIEEINLPFKQNISTSLGKLFNGNVRAPFLTMNLKPKKYGSSLVNACYFDISEPTYDNDH

SEQ ID NO: 19945 - protein, 539 aa, Candida albicans
RLRTRNLAQVIEIAEHAGKEEELITFLDMARETLREPVVDGALINAYATLDRLSDMEKFVGGSNVADLEAIGDKLFEAKNYKGAKILYSNVSKYSKLATTLVYLGDYQGAVDCARKASNTQVWKQVNSACIENKEFRLAQICGLNLIIDAEELPELVKTYEYNGYFNELIALFENGLSLERAHMGMFTELAILYAKYSPEKVMEHLKLFWSRINIPKVLTACEDAHLYPELIFLYCHYEEWDNAALTMIEKSEVAFDHSSFKEIIVKAPNLEIHYKAIQFYMNENPSLLVDLLKVLTPKLDLPRVVRMFVQSDNLPMIKPFLISVLDKNNSVVNSAYHDLLIEEEDYKSLRSSIENESNNRFNKLDLAERLEKHDLIFFRQIAATLYTKEKKFNRAISILKTDKLWPDLLRTVAISKSKKIAHELLDYFVETGNHECFVALLYTSYEFIANDYVMELSWLHNLSNFIKPYEISIAFENQKKLNEVYQDLQKRKEADRKQEEEPGVGQPLMLTNGPMSYQGTGATGIGYQPTGTGFGNAF

SEQ ID NO: 19946 - protein, 392 aa, Candida albicans
TFSFQPDGSPDFPISLQASNKYGIVYVLTKYGFIHLYDMETGANLFVNRITADPVFTASSYNDGTGLITINKAGQVLSVEVSRDKIIPYVLDKLSNVPLALALSSRGGFPGAENLFQQQFQTYLNQGDYSNAAKVAASSEQLRTQDTINKLKNITPQPGQISPILQYFSTLLDRGTLNKFESIELAKPVLQQDRKPLFEKWLKEDKLTSSEELGDIVKSYNDTTLALAVYIRANVNIKVVSCLAELGQFDKILPYCQKVGYNPDYTNLIQNLVRVNPDKASEFATSLLSSPDANLDVEQIADLFFSQNYIQQGTAFLLDALKNDTPAEGHLQTKVLEINLLHAPQVADAILGNQMFSHYDKPTIGKLCEKSGLFQRALEHYDDCSPPGWKIR

SEQ ID NO: 19947 - protein, 275 aa, Candida albicans
  UNSURE (92): Identity of amino acid sequences at the above locations are unknown.
TMSNDIPIDFTELTQLIELGIPQTSLDFKSTTLESDHYICVRESGAQGNTVAIVNLKNNNEVTRKNMTADNAIMHPKEFVISLRANGTTLQXFNLGSKQRLKAFTMDQPVIFWKWLDDTYLGLVTQSSIYYWNVFDGTNNGPTKLTDRHHTLNNCQIINFVAEPDLNWFAVTGIAQEDGRIAGHIQLYSKSRNVSQAIEGHVCKFASISLSGGVQPTKVFCVGNKNAQGQGNMHIIEIDHVDGNPQFQKKVVDIFFPPDASKISVLTRRQKDQTS

SEQ ID NO: 19948 - protein, 380 aa, Candida albicans
  UNSURE (297),(306),(318),(320),(323),(345),(371),(373): Identity of amino acid sequences at the above locations are unknown.
SDLIGAAKLIKIFEEYKCTEGLYYYLSYIVNLTQDPDVVFKYIQAAGRMNQTKEIERVVRDNNVYNGEKVKNFLKEFKLDDQLPLIIVCDRFNFVHDLILYLYKNQYFKFIEVYVQSVNPANTPQVVAGVLDVDCDENIIKGLLMSVLGRVPIKELVEEVEKRNRLKILLPFLEKTLEGGSNDQEVYNTLAKIYIDSNNSPEKFLQENNNYDTLVVGKYCEKRDPYLAYISYSKGGNDDQLISITNENKMYKYQARYVLSKSDIELWNKVLSSDYIHRKKLVDQVMSTGIPELDDPXTISITVNAXMENDLPEELMEXLXKIXLEPSPYSENASLHGLMILTAIXAESSKVSSYIGKIKRFEPNENAPLCXEXGMHEQGF

SEQ ID NO: 19949 - protein, 173 aa, Candida albicans
FSSVQQFINSLIQTNHSMALNLSNIKKAYFDKLFLVQNDTTATATTTSVSSNNSTPPSKIKPRVLLLDKYTTPIISMCYTQSELLANNIILIELLQNYHDLSSMKHLDCIIYIKPCQESVNDLRQELHNPHYGQYKLFLNNCIHKNQLESIAEADEYEVITKVIEIIPRLSYY

SEQ ID NO: 19950 - protein, 81 aa, Candida albicans
RLHIMLSLSSSKCVAVLVMLLQLSNALHFYVKTGETKCFYEELPENTLVVGKIHAYEKQDHSNEYVKNPNLKVQIIVEVCT

SEQ ID NO: 19951 - protein, 144 aa, Candida albicans
ETFDNNHKVANQKSAPDGDFAFTSLDSGEHRFCLTPVYSDNTNNKVHRIFFDVAQGSANEYVDSKSTRMVDDLTGKVNQLYDKLDKIHWEQEHMREREATFRDQSESTNSRVVKWSIVQLIVLVGTCVYQLRHLKSFFVKQKIV

SEQ ID NO: 19952 - protein, 61 aa, Candida albicans
KTQISNMVNFLNLILMVLILFLLLIMSIENTVGYVDFDKIDGLEGTIIVNVVAHAQANEGY

SEQ ID NO: 19953 - protein, 285 aa, Candida albicans
LKDPCPCTEQDFEGGPGFRLLEKESTNVCDPDRTQLTQLCQSKSEITWPNKVLVEGNTCNMGDKKLEDFVSQETLKCSDYVDNGGDGNGDEQNPNQGDSNQIEVHINDFEGKLSQYQYIAESKDNNAADNVVIKTMDDRLWISNNGGVSFVRVPISDKILGFYAGPIPGQITLITATNIIYVSDDGGATFIKRKVPTQPSPRVDRAIAFHSKNVERFIWFGEECESNGRCTSNAYITDDAGATFNKLMANVRTCDYVGAVLESGDHELIYCSGQNSLDNNNNNKN

SEQ ID NO: 19954 - protein, 252 aa, Candida albicans
LDKLKHFKMRNNNWNWLIFLVPFILSLTTAYTPDISVVKNKSPAREIKYFDDSSNLLVLRDEHLLISKNDGKSFEEIPDIKDPIIYFEMDPTNKNRAFAMTLSQKQYITEDQGNKWRTFEIDIFNGEMASIPKITFNFENPNYLMISNYECPEGQRLNRNCKHRYFFTKDGFKSKPNKLPVDAHVCRFAKSTKTSKIGKSETIFCTVNQLNSYGHIVESHLYNSNDFFQNKNDIKIKPLDSSSGEIIDVNIQ

SEQ ID NO: 19955 - protein, 268 aa, Candida albicans
RENLAAQENNSELEQEMWSQLLLVPVSHFKSIKTLLSLENFYHFYTKLDNKALQKQIAIAIVDRILEIASDNDNELLHSVDEIDGVFKYLMVLIKESPSKLDTAKHLGVTKTIKVNNGEALITEEFLETQEKICKLIHLVELSDDPIKNVSNLMYVRKKYLNKNFENIIHTYPTLISKILFKLKLAGYVNLHQRKKSRSDTVDLQITSNFKNLSVIIDELYQYHQEYSSELILNIYLNVATVADQLKLESICYELFNQCFVVYEDLHH

SEQ ID NO: 19956 - protein, 260 aa, Candida albicans
LSFDFNFSITFLTIMQLSAGEQNSILQSCIANINQQSNLMKHDLNENKLLPALKHCSNFLNELRTNSLSPKQYYEIYMLVFDSLETLSTYLLNSHTARQKSKNREAKGNDTIKNGKPENDGEGTSAFLADLYEIVQYSGNIVPRLYMMIVIGTTYMSIEGSPKKDLMKDMIEMCHGVQHPIRGLFLRYYLSQRTKNLLPFQNQIDFEETVEFLIKNFIEMNKLWVRLQHQGHSSERELRYRERKELKILVFTKPLERKPL

SEQ ID NO: 19957 - protein, 350 aa, Candida albicans
SATMSIFFKAPLDIEIRLDNEDTRKHVEVKTPQGRVEKLPIYKDGESVKGVVTLRTKEGRKLEHLGVRVQLLGSIETNTDGILSSEFLTLATELAAPAQLSHPESYPFEFKNVEKQYESYRGKNVRLRYYIKVTVLRKSSSEIIREKELWVYHYTTAVPKPVTGLSSSSTADSKLGAKKANEDTLQKPATPSSNDDASANTSKGSTISKRNESHSVKMDVGIENCLHIEFEYSRSRFSLTDAIIGKIYFLLVRLKIKHMELSLIRRETVGAPPNQVTDSETVVRFEIMDGAPVKGETIPIRLFLSGFDLVPTYRDVNKKFSTRTYLSLVLIDEDARRYFKQSEIILYRDQ

SEQ ID NO: 19958 - protein, 210 aa, Candida albicans
LLCILKQTQKMKIYYIGILRSSGDKALELTSARDLSQFSFFERNGVSQFMTFFAETVSQRTQPGQRQSVEEGNYIGHTYTRSEGISGIIITDKDYPVRPAYTLINKILEEYLSLHPKSDWENIDKANETLQYGQLEAYLKKYQDPTQADSIMKVQQELDDTKVVLHKTIEGVLQRGEKLDSLVDKSEALSSSSRMFYKQAKKTNSCCVIM

SEQ ID NO: 19959 - protein, 309 aa, Candida albicans
RLKIMDAVLISLLTILLGFVLILIIFFIQTGGLKSLVSTTTSKKSSLYHPTFLILGANNSGKTSFFYKLLQLSNDDEIDDKANTTTVAATVSSLEPNVTKINLPISNPSIGKPFQLIDYPGHLKLQKVFERLIIDEITLKNLKGVVYMIDSSSVNINDDTNLESIVKFLYNLFSITERIPNGVDFLIAINKTDLFDSVPVHKIKTKLELEINKLIRHEIENVEKTSGIDDNDNDNGNQNSNGGGGNSSNGDNSDGINGESLRAFWMSVVGSGNFTFDKLEGNVDFVGGSVLKNKISQWENWFDEKVVNP

SEQ ID NO: 19960 - protein, 432 aa, Candida albicans
  UNSURE (1),(10),(18): Identity of amino acid sequences at the above locations are unknown.
XTEFKGYRSXETIRDALXDERNFFENHPSYRAKAQFCGTPYLAKKLNGILLHHIKSTLPDIKMRIEHSLKKYQQELSMLGPEMAESPASIALSMITNFSKDYTGILDGESKELSSQELSGGARISFVFHEIFKNGVNAIDPFDQIKDADIRTIMHNTSGSAPSLFVGTQAFEVLVRQQIKRLEEPSIRCINLIFDELVRILSQIISQPQYSRYPGLKEQLSQNFILYLRDLLIPTTEFVNDIIQAEETYVNTAHPDLLKGTQAMSIVEEKFHPKPQVAVDPKTGKPLPPSQQPAQATSPKPEDGSSNGFFGGFFSSKNKKRLQQMEAPPPVLRATGTMSERETMETEVIKLLISSYYNIVKRTVGDVVPKAIMLKLINKSKDEIQKTLLEKLYSSPDLDDLVKENELTVQKRKECVRMVEVLRNASEIVSSV

SEQ ID NO: 19961 - protein, 189 aa, Candida albicans
KVISKMDETLIATINKLQDALAPLGGGSSSPVDLPQITVVGSQSSGKSSVLENVVGRDFLPRGTGIVTRRPLVLQLINRRPSKDLKKANDLVDVNASESTGGQSENNADEWGEFLHLPGKKFFNFEDIRNEIVRETDAKTGKNLGISPVPINLRIYSPHVLTLTLIDLPVLNKVPLVITPNILKDYSQI

SEQ ID NO: 19962 - protein, 238 aa, Candida albicans
YIVYLHLIYLFQVKFIFMSNKQSNQRFAQFKLVLLGESAVGKSSIVHRFVKNTFDDMRESTIGAAFLTQTITIPESETTIKFEIWDTAGQERYKSLAPMYYRNANAALCVYDITSRSSFQKAQDWIKELKKQAPEGIVIALVGNKSDLDDEREVESSEVQEYVQEQNSDGCSIITAECSAKSGDGVLDVFNKIGRALPVDEVIDASRSRQGAGAGGRRPGGVDLNRPRGQVNQSNSCC

SEQ ID NO: 19963 - protein, 204 aa, Candida albicans
NILLGDSSVGKTSLVHRFTTNRFDTHTPNNIGAAFITKEFSPHENHERKVKLEIWDTAGQERYRSLTPMYYRNARVALVCFDLSKFESTFNTAKYWIQQLELNNSSDSREKIEIRLVGTKRDLVSTIDDATKDQVNKLITEQSNVVKFHETSSKEGTGIESLFEAIVTNIEETFFTQYYEQNRDTSDQIGNMLRTRQTSNSYCC

SEQ ID NO: 19964 - protein, 161 aa, Candida albicans
RQQKEGIKLEDANYNVKRKLWLKFAKYLIDRLDDLNETLHHIVNVSMLDLKDLLPLFPETILINNFKDEIVESLNEYNKRIVHLSLDMNNSSEHLREMKKKVIYNKKKTNVAIIEPGEPCRKCGKLLVQENFVYFPNCHHAFHKECMKKNQCLLCNDFLNL

SEQ ID NO: 19965 - protein, 811 aa, Candida albicans
MSSNGHKTKSIKSETNSSYTVHSLDQQQASICDNLQQAKFELDSVHLQFSLSNKLNKLLVSSNIMYILLTNVVYKIDLDNPSQVENYALPGKVTNAWLNPNGQTLIVQIEKQTYYTFKKKVFKSLKFKSIEVTSIAFSNHNMVVGTKDGIIYVYEKSLKQVYKVDSPVQGVMFSNDYSQINVLANSLYTWDCFDTSYVELQKVFKQTAPVIKSINPPVIFTSNPQNYVYISSDNEIITNDEEMQLDRVDEGFLQIALAPHHLIGIEGNSLKIYNKLNKQLQELSLSENKIRGIAVDNLFNTYWVYTKNSIYEFVIENESILVWYDYYKMGKYSEALKYLDEDDEANFLKRDLVLIKQGYDYLQRGGFGILSDDLSLQIQGIQILAKLTEPFEKVCLMLLNHKQSDALLIEYLLAKLNKKNKVRVIVLSAWIIELMVRNDDSRVYEFIKTNYKLLDRPTMYQILNSEKLIFYAELIEDYNFILKYYIDKKNWTLAVKTLIKLYTKGDIEIVYENATILLMNYPKVTETWLKLDLEYEKLLPALLKHQEQAIHFLQQVIMDKHYKKNKQLNNAYLCLLITKPGTDKQIIKFINFTSNFDTNFILRLCISHEKFHPAVLIYIEIGLFDQALELALKHDLTSIDEFILNKYAEDKQVEGIKLEDANYNVKRKLWLKFAKYLIDKLDDLNETLHHHINNVSMLDLNDLLPLFPETILINNFKDEIVESLNEYNKRIVHLSLDMNNSSEHLREMKKKVICNKKKTNVAIIEPGEPCRKCGKLLVQKNFVYFPNCHHAFHNECMKKNQCLLCNDFLNL

SEQ ID NO: 19966 - protein, 660 aa, Candida albicans
PGKVTNAWLNPNGQTLIVQIEKQAYYTLEKKVFKLLKFKNIEVTSIAFSNHNMVVGTKDGIIYIYEKSLKQVYKVDSPVQGVMFSNDYSQINALANSLYTWDCFDTSYVELQKVFKQTAPVIKSINPPGIFTSNPQNYVHISSNNEIITNDEEMQLDRVDEEFLQIALTLHHLIGIEGNSLKIYNKLNKQLQELSLSENKIRGIAVDNLFNTYWVYTKNSIYEFVIENESILVWYDYYKMGKYSEALKYLDEDDEANFLKRDLVLIKQGYDYLQRGGFGILSDDLSLQIQGIQILAKLTEPFEKVCLMLLNHKQSDALLIEYLLAKLDKKNKVRMVVLPAWIIELMVRNDDSRVYEFIKTNYKLLDRPTMYQILNSEKLIFYAELIEDYNFILKYYIDKKNWTLAVKTLIKLYTKGDIELIYENATILLMNYPKVTETWLKLDLEYEKLLPALLKHQEQAIHFLQQVIMDKHYKKNKQLNNAYLCLLITKPGTDKQIIKFINFTSNFDTNFILRLCISHEKFHPAVLIYIEIGLFDQALELALKHDLIGLAEFILNKYDEDKQVEGIKLEDVNYNVKRKLWLKFAKYLIDKLDDLNETLHHHINNVSMLDLKDLLPLFPETILINNFKDEIVESLNEYNKRIVYLSLDMNNSSEHLREMK

SEQ ID NO: 19967 - protein, 374 aa, Candida albicans
FHYMSSSQPRTKPWEVSQGKSAASTTEPLTSNIPPSSLSNSSTTATAQGQPQLQIQPPSVPELPTSLSSDLNTMAESSPYGGYGNSSMNRYGTTGGYGSSMYGGGYGSSMYGNSMYGGGYGSSMYGGGYRGYGSGYGGYGSYGSGMYGGGMYGNNPSMMGQGGLGEGTQATFQLIESIIGAVGGFAQMLEATYMATHSSFFTMVNLAEQFGNLKNALGSILGIFALIKFVKKIFYKITGRVYNYGINASEFTKFEKNQKKLEENLRRNQSGQKPRISLKPLVLFLVAAVGFPYLLSKAIKLIEEKNQRPPPVPSKIQFARALYEFNPQNPQVEAPLEPKEIVAILDSRDNWLRIRKRSGTMGWVPLNYVEVIDT

SEQ ID NO: 19968 - protein, 96 aa, Candida albicans
KTIQELSLFLMSRTDAYLRTKDYIKAFNDADFLLNMQLNTPDNFLRRGVANFFLGNYEAARSDYQRGLTFDENNERLQKELNICLDKILEENGDYL

SEQ ID NO: 19969 - protein, 169 aa, Candida albicans
RLLLENLFFFSPQNFYLLIHSGHLTTSFPIGNSTFFLLTCSVVKFSTLKQQQIFFFSFNATIFSSSNNTIMSGFRVLDLVKPFSPFLPEVIAPERKVQFQQRVMWTIITLLIFLVMSEIPLYGIASSDSSDPLFWLRMMLASNRGTLMELGISPIVVFTTGLERSAIAK

SEQ ID NO: 19970 - protein, 324 aa, Candida albicans
LPRFRKCGSPSSAVCEDKGYGLGSGVSLFTATNTCEQVFWKAFAPTTSTSAKGTEFDGAVVAMFHLLGSRKDKKRALIESFYRPNLPNMFQLLATLLVFFAVVYLQGFRIELPMKSTRQRGPYGLYPIRLFYTSNIPIMLESALASNIFIISQLLFMRWPNNLFVKLLGTWDARAGSSQLYANGGLAYYIQPPFNFTDALLDPIKTTIYIAFVLGSCAVFSTTWIEISGTSPRDVAKQFKEQGLVIAGHRDTSAYKELKKIIPIAAAFGGATIGALSVVCDLMGTLGSGTSILLAVTTIYGYYELAVKEGGFNKSIVSGFSDGI

SEQ ID NO: 19971 - protein, 705 aa, Candida albicans
TLQLQKNMKDINATENNLASKFQRFNDKTLENLINQISKIYSSNNLLVLDAVLSPLINSLTNFTKLKELGKFQNIVWLDNELVSIGSSVLAKYASLIVVVPTSSLENINILNKLIHSQPDLHSLKLNIIVKDLKMSFMYQINKVFNGIVNFESILSPEKYQKPISVTSRIKIYNWKTSPIYTDEILVTEINKFNGIDDYFSKPLKQVNQLSEALMQLLFMGIQNGKHDHLFKLRNIYGKGNHSKLLIDQLQNSKIPEFMNENMTTLEIDFYSDVLHSNTDLVVLERNLDFTSCIFNQLNYHGIIDDMFSIKFENIEQLLSNEISKSLANDKLYSQDLKHLNFSSIGLRLNKLAKYIQQQFKTSSAQKNSSSSEPNISDIKQLVSNLGTLSIQQELVKKHTIIGEEVMEKINKNYEQFLTFQNDIFEMDYKSQVAKLREFVNCNYPIEFVLSAILLIGYLNDGISNKEIDWLSLEMQDNYGLEAVFTLEKLIQFNMIRVIHGSSVDFFSSLGFTSQKKKPTTHSQSEFEDDKNVGISGSGDVFRNNYTLINKFWNLHPLDDDESLSQNLTESGSNELTNLLDLYSNPSFTLPGNTVPLIYRFVEALYFRDFLKHKPINNLKRRPNWDNLGVNTMFAGKTIDLNLDNVNDDRSKYLVIVVIGGVTRSELTCFKYLQERFRKQGKTKEIIIVSNGIVNSSKLMQFMSN

SEQ ID NO: 19972 - protein, 199 aa, Candida albicans
NNNLHDDPVQSESTNVNQVESSTPKGNFLDIAGSEKEQSGVEELSLKVGDSESKTTSDVPTEDVSTSDANKSHKHRFPINDSSEQNKQSHKPFDFQTFLVQLRKKSADPIVRYIRSFLSSFIRQGHTFTSDQRIKIILDFKIFMNEKSTLYEPFASMDQIDLENSRERLKTLIMNRLHDLCFPQKLLNKTCLTSLNLIH

SEQ ID NO: 19973 - protein, 338 aa, Candida albicans
FVFPPEIVKQNLSYIPEPYTLDLQKDESFALQLEKFSWINGNHLDIDMNDLANKIVKNDQSFLEYAITELNKINNYRAPRDKIICILNACKIIFSYLKLSKQETNADSFIPILILVIFKAKTDHLISNIHYIENFRGQEWLLHGETSYYLSSIQGAVEFIQNITAEDLTISQAEFDAHMEAWDAQRKQKVQQLKLVQPIPTIPTTPTDGTGETNLKPDMSHTPNGLSPSKVLFSSAEMFTKSITNFLSPLPHLSESEPEEFQPPPNSPPPQDQNDPSAQYQPLPPREEEINAEQMRKAYDTLIEIFPSLDTNILKDVIFINRGDIDVCIDACLQLVDG

SEQ ID NO: 19974 - protein, 164 aa, Candida albicans
ASPDSQFLQRRRRGLHRFLNQLIKHPILSQEPIVQSFLTVPTDLTTWKKQAKIDSSLEFKGQKIQTDFINVIWPIMGEPFLKKWRQAEENIQFIIDKWVKIIILVERYERRPQQISFDNGKFAEMSNGFSKLNTKMYPDNEDNNNSTRNDVNVNVVVVDNNDNY

SEQ ID NO: 19975 - protein, 180 aa, Candida albicans
  UNSURE (11): Identity of amino acid sequences at the above locations are unknown.
QEFDFNSSGDXININQCVNSIGEFFNKSSQVLNDESDIINTKTLEKFKNYLDYLNSLQELFERTKQLSINQIDLLDKRIKDQEIKFKKISEENPDIKGGELIKLRQSIINDKQEIFQQLNKDWLIKQCCLQEFIIFQETQFLITELWVEWCKDRLKCQEKLVGLYDNLNQEIIHDMPLER

SEQ ID NO: 19976 - protein, 477 aa, Candida albicans
  UNSURE (442): Identity of amino acid sequences at the above locations are unknown.
TTIFRSTMPRIKNQVEKEEQLIEEPKHERDNEYKDEQGVEPQEEEQDDDNDDDDEQLAEEDSEIAPARKRGRKRKITTVVEDEDNNTTKIRKKVKSEDDEGQAANENEEEDDDDDDEEEEEADEEDDDDGETEGDGKKKRGRKKKPKVQLYGDDVFDDEGNPLIIENDEVVIPQEDPKGKEKIDELGYLQGDRKFRMKTFKLLGKGDRLYMISTEPARLVGFRDSYLLFKTHRTLFKKVADNDEKMDLIQRGIIPNSYKGRAVNLVTARSIFREFGSRMIENGKKVIDDFWEQRAIDNGDIPGELADPDQLYKTKLSNVLGDSGIVSTGHATPLTATPIVNYQGDPTWMYQIAKQTSEYNKKLYELRTNNMYKGYKDTYTNLTLYPQSTQPTQIKYLKFNNNNGKLVYDIVMTNKNIRKPITGLAKVPQAILNEIDDPEIKXAIIDSQEYEISAREILRKTSWDIFLYISLDIALLL

SEQ ID NO: 19977 - protein, 330 aa, Candida albicans
NPNDTEAHDKFLEIGEAYEVLSDPEKRRNYDQFGDPNGQPQPQGGGAHFDFGDMFGQFFGGHGHGHGQQQRQQPGKRKGDSAQLGLNIPLLDFYNGKIVEFDVEMMNDCEYCDGTGSKDKQRKVCDRCQGTGHITVTHQLAPGMVQQMRMACDQCGGIGKVVNDPCNHCHGQGISRGPRHYEIYVKPGQPRDSPHVLEGEGDKNPNWIPGDLIVLLKEELDKSWGYRRIGSHLYRTEALTLNESLYGGWERKIAFLDNEEPQLTLSRDQGIPVFDGEVEIVSGKGMPIVTDHDEEERFGDLFIEYKVIIPGGAPKGKNSNSKKGVTKDEL

SEQ ID NO: 19978 - protein, 63 aa, Candida albicans
YHFISSRKYLYIMSWFGRATSDAPVATISQVELDNKIVEATSESIPNGEIDLSIAFEITDLIR

SEQ ID NO: 19979 - protein, 746 aa, Candida albicans
LRTLDIRSLPAAVCEDMDYLIDFIFKIHYNTKELTYGHGGGDVGNKIKIGEMILKYLQNWKIIFENQQQLQYVEKKYQELKNQGFEFPDNNNNSGENDDFNDQVTQLNSKFVVDSEVPPDWVDNEECMICYSPFSMLNRKHHCRACGGVFCQTHSSNNIPLVNLGIMEPVRVCDNCFAKYDKSKKHLRNTSSSGDYNHQLRSIQNDYGGTHGSRRPGNNNDDDHHEEEQIRKAIELSLKESGAGGSGSGGPNSIPSQSRPSAQPPIDREPELETGNADDDEDAEMKAAIAASLKEYETEKSRQSQYQQIQPVQSTQSTQPELDLYNISFPTFSSTSNYPQPQFTASQPPPQQQQQQQAQQQAPSQDLSQAEEEQINLFITLMNSIKNDSRKQKDIMYDTNLNELYGKVIKLRPKLNKSLRNSIEKYETFLEMNNKISTITRLYDQFLEQKLNMAYGNHHISTQFTGVPQQQQEGQFTGSQQQQQQQQPHLPAQGTGYPRYGGSDTNVAQQQQQPPISPNEFYNNLPQHTGFQNYPSYPQNQGTAPDNSYLSQQPSGASTRQQQQQPPIQTYPNQLQPSEPDFEDDDNEEPVNTPQIRVAHNRTSSGSCPLYPTNDIIPDPYSANTNKSTTPNSDDHNYVAVSLPHYPPPEDLSNELPPQQHYVRRASSSLPPNAYEDASLKYPTLENVEHDYDKKKNQKQQQSVNESDFPDVSKVSQFNNRGEENEGRRNSGASGASSNKKFVVEP

SEQ ID NO: 19980 - protein, 156 aa, Candida albicans
RLVVVCFAVELSQIHASARDIFRGFVPSKQMFDGNGMTIATSIIGSTVMIHSLFLGSGLVQPRLRDFDVKHGYVNLDDILNKNDQPQFPVIESSTTTPSEKKDDAKNNVKVSMYEKEADYFYHYYKPSYQSIKYSLKYSIVELTITLITLALFVNS

SEQ ID NO: 19981 - protein, 218 aa, Candida albicans
RSRIFTFHQSILVINIPKKQQESFTCVTPKEMTTTSSSTNESIRPKNNHTTISTTGVSTTLDQTTTTRFRNNYDDNNNNSVISKDSSTFAYVVNRSKSVLKKYGSFVGPGMLISVAYMDPGNYATGITAGASNEYSLLFIVFLSNVIAIFLQSLCIKLGSVTGYDLARCCREYLPKQLNWVLWFLAECAIIATDVAEVIGSPIALNSLTRTGKEGNAL

SEQ ID NO: 19982 - protein, 507 aa, Candida albicans
ILNISVKKTLLITKKTISIQIMENKVSEISEMTTDLNSNSETKFDHLTSTTKTTTDQIQKKSTETTTTTQSISINSKDEKKAGSKLSRVVKVSRRALTTYASFIGPGLLVSVAYMDPGNYATGITAGASNKYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSLLKFVKIFEYAVGCLVMIVVICFAVELSQITANVGQVFRGFVHSKEMFDGNGMTVDTSVIGSTVMIHSLFLGSGLVQPRMRDYDVKHGYVNLYEIAKEEKVQEEEEEDQTEISPVASNPIQNNIAPTYEQEAKFFRIKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISCSTTGWISPASG

SEQ ID NO: 19983 - protein, 278 aa, Candida albicans
DLFLSIQLQMITAIFIYDSKGDILISKLYKDGIKRNISDVFRIQVISQTSTNRAKEYRSPVLTLGSTSFIYIKLGKIWITAVTRSNQDCSLIMEFLYKLEALLRTVLGRDKKKQLMELTDNYIINNFALCYEILSEVCEFGFPINLDLNYLKKYIDDINVDDSIFKIAPLKRRSTINPLLGKSITSGNTNTTSNNNNSSNSSLKRSSAEENITWRSSGIKYRRNEIFLNVTERVNVLMNSQSDVLNAYVDGSIQMKTHLSGMPLCTFGFNDNTNLLFP

SEQ ID NO: 19984 - protein, 122 aa, Candida albicans
EKLPATNVSLQIPTPRGGTILSNLSSSIGKTKFHPEDNLISWKCNKFFGEQEHVLTAEIEVNLSSDELLYWTRPPIKLDFFWDMFSSSGLTVKFLRVQGKNNYRTVKWVKYGTQSGSYEIRY

SEQ ID NO: 19985 - protein, 176 aa, Candida albicans
TSFNKGFIINQQNFIMWSLILCVLGLTQFISASAFTFILGANQKSCYYIFTEKPKVPIRYYFAVQSGGSFDVDYEIVDPNGNKVVSDSKQRQGDFVFNADFVGEYEFCFSNTMSTFAEKVIDFEIKFENEDNAEKFRANLPNQPDVKPLTHVENMQTTIDRIDAHLDGLYKAMPYL

SEQ ID NO: 19986 - protein, 147 aa, Candida albicans
VGSSSRRGRRQTEPGSIQQLQQQVQITYEPINAEELEQQTLLILEREREIHRIQQDTQEINDIFSNWSSIVNEQQFQIDSIENNIFSYSSNAREASNELRRADRYRKRSSGRLLCWLHDTCCYSIIYNFNRVDFLENKCTEEKFALY

SEQ ID NO: 19987 - protein, 308 aa, Candida albicans [sequence omitted]

SEQ ID NO: 19988 - protein, 157 aa, Candida albicans
RFRNVQNNYMKFLKNDDEEEKEEEEEEDILNMNDEQATLLNEGNDSKSTTPRTTTTTNFTNQQQQQQQQQVQVQLQLQHQQGNNNIQYLQQREREISKLAHGIIEILTIFKEMESMVIEQGTILDRIDYNLVNTVQDLKQADKELIKAHHYQKRSTK

SEQ ID NO: 19989 - protein, 237 aa, Candida albicans
YFYYLYCMVAFRIKEPKYILAMSQHPAPATAVKLVLLGEAAVGNSSLVLRFVSNDFQENKEPTIGAAFLTQKCTIGERTIKYEIWDTAGQERFASLAPMYYRNAQAAIVVYDITKPASFIKARHWVKELHEQANRDITIALVGNKLDLVEDDSAEDGETLRKVSVEEGQSLADEEGLLFFETSAKTGNNVNEVFVGIGSKIPSVTVTGGEAQEGSNGRRIDLTANTDNANAPRSTCC

SEQ ID NO: 19990 - protein, 163 aa, Candida albicans
IKKQSSLDPIKVDGALRSLEYAWKVQESLHLQVKRISGEMMFERKGVIDFTEKKIQRLMKGYTLHKVEHHRKILKHFENIRLDVRSVDDKGGLSRLNRDNLTNLKHNLTQSQSSQGDSWSSRTFRSLEKEEEENENKKSDVNGFESATVDARNAASLLGVATF

SEQ ID NO: 19991 - protein, 319 aa, Candida albicans
SRGEDPEDFENNNPFAEPVISDQVNGVHSQTENNETQLPEGEPTAPQSGEPSPDPNSESILTEDELRKLIPERFTTKYSLSIQLVEIEKNKPGNPILKMNVKVKGLPRYRQSIYKDVRTTFNEVVKFNRYLIVSNLEVFVPVIPSAITSYPTGGEDERKKLFVEWQEWLDRITSNPILIRDEEFVYFVENDFGYSVINTNRKTSVASGIMRKTLKQFAVPYDPYEELANFRPIIKEAYLTFQKLHKLLDRNSKTEKQLSIHIYDMANKLNQLSEFETTHPGMKNMWEKLGKITQKQSDFTSVDSINEMATLGDGTQILI

SEQ ID NO: 19992 - protein, 676 aa, Candida albicans
VIIMGSSEYNYDELGETWPFFVLALLSFILLPLTIKYISRVFTNTNPTKENQSIVGAIQENSETLKVPNLSEIKSFQSKQKSLKIFNKTLIFLLIGWSIVIYVAKYVTKEADLTVLFDPYTILDVSFTASEREIKSHYRKLSLKYHPDKLPKDLTEEQRSQAEQAYIRLTSAYKALTDEVTRENFLRYGHPDGEQPATHGIALPQFLVEGKYSSLVVVLYFMVIGILLPFIVGKWWSNVKSHTRKGLHVDTAANFVRKFTDRDPAKVITPDVILDYVLESEEIRQEFPNASHAELKDLVYRYLNRQFDSDPKVEKKKVDLIARLPFLINGLIDIAIVFRLHETIFAAEDLKKSIIQAVKPTGRYQELLQLPYVDPEIVSKQSIRKLGKLFAISKDEAKKALGIQSDEHLERALNVAQHIPTLRIIDAEIKVPGEEDGAVHPNSQGHISIKFLVKSPKLKSCPDIEDERLKDEETLEYMKNPLIVNEQQKKLPYSYAPYFPQPIRNSWSCYVIGQKENRLLEDSTNYVLENIDLNNLELLQEAWIKGTDVRIGTYKIQLPGAIGNVGNYYYRLVMKNNAYFGCDVDIPIDLEVTPVSIGKSLAGLKKKFDEEDESEDSESDSDISDPEEDSLAGAIAALRGSDLKKKKSSKDEVEEESEDEEVFTDINTDTEDEGDN

SEQ ID NO: 19993 - protein, 94 aa, Candida albicans
GKVREPTEFGDGHIPRALNIPFKSSPGALDLPEEDFQEHFGFPKPSTDKELIFYVLGGVRSTAAEELANTFGYKKRGNYLGSWEDWVKHENKKN

SEQ ID NO: 19994 - protein, 76 aa, Candida albicans
QIDDTVGIMRDNINKVAERGERLDSIENKTDNLAISAQGFRRGANRVRKDMWWKDFKMRMCRLHHGPLEGAQLALG

SEQ ID NO: 19995 - protein, 474 aa, Candida albicans
LLFYLFFFFGPFPNNTTILLYLSLWIIQHITASTAIMNGYNWQNGNLHSNNNSPTPLNFRSIQHLYPDQFKNNSADQLNPHNYTPMEVHSDNNSYDNISLLRDLEDGIPLSLTAQELTLQESKTYMRWYSDILARTNSRTISIHDVYNFLNNFKIPEKIKEIINKIFFKILHSINIGEFFALLRLISHTLQGETPLRSLIKIKAPVPTPPSILSKKRLQEEEETDQNQEPQQPWDIDGFTQFLLTGERPSSNKRSKKSKSVEFTDEVHVHDASLISPAQSPLLVDPLQLLLQQQQRLDYLLPMDKLLQQMKKPDEEEKEVLKDMESQMNHFQNLNAVDTMSVGGTPYLQPNMTGPAQMARLFSPSPEPLRPNVTGPADMARMFAPSKDSQTTTTTNNNSNDFNDFITNDNSYNNSLEHNSAPLPPQPKVSLSAFTSQMTGQTMENTIQNSGSSLLGPIPPPSRHRSASSPLPNK

SEQ ID NO: 19996 - protein, 209 aa, Candida albicans
LLVNHFAMASQIHFLDIKGKPLLSRDYKGDISSTTIEKFPLLLLELENTVDDGEYKPFINHEGINYIFINHNNLYICALTRKNENIMTIIIFLSKLVEVMTQYFKSLEEESIKDNFVIIYELLDEMMDFGVPQTTDTKILKEYITQDYYSLIKSTPTHLVAPPNALTNSVSWRKEGIFYKKNEAFLDVIESINMLITANGHVLNTEILG

SEQ ID NO: 19997 - protein, 376 aa, Candida albicans
AISQLEIHSTTDLKSIARKHCHDNEVPYLTPVLNLIDSKYTTTAENIANEDNFEISKQVNWRDHSAYIYNDEVALKISYLNNNIHWDKSNDINQFDSIITQWNEILSLHKSDTERNQDDDDLEQVQNRAILLTYINYNLLFTTLKRDLLLIGQLAKIDDNKDIIRLFNGILVIVQNLKDLPGVYNDEDLYDSLDNLEKFFIAQKNQVIAESYQFNSQFAELLKIYQFINQEISNATTTTKQGSSSFYKTDFPFNISTNEQIAIFKNDITKKILQNQISAQFEQSKVISSSPYTIENLNKYPKGLTTIINLNKIEPMMCKPVLFDVAFNYISYDSTKQTTTNTATTTPVETSSPDVDETIDNENSKKRGFFGIFGRR

SEQ ID NO: 19998 - protein, 450 aa, Candida albicans
RGSPPVVKTLSTLNTTQTLALLDKASQVVHAELSGEDLVSELLPIKLTTAYVYQLTGESNKSLEILESIDVEKINDLLIKLIVKNNLYSHSTITNINLVDRDLNYQQNLHKLSQKLTVLQYERVLKNSLVLKFASGTLSKSQLNNQFINNFQQTFPGDLLPLSYKVLSTLNIDHKDLQDLTKLKQIGRKLVKYIPTQTDNDLKIVATLILVSVNAQIGSFDQSLPILEQLTHESLATPKALPGLIGTLIAVYENTHNTKKLTDLLLKVLEKLLYTPKELLSGDINYYNFAKIVAFKALNQGHDKTATQLFEYLYEVNSNDQLIHSILSNTNNDLLPLDELTSKKPIDEILSVDIDTLIPTTKNKPIKPIVKKVSKITKKKQNPKFGPNKVLKPIEDLQLDEERWLPMKLRSYYKPTKKEKKKASGGGGQQGASECSTRTTSLSKKKKKKG

SEQ ID NO: 19999 - protein, 319 aa, Candida albicans
KLKHNEFHVIFQRLSPNITHTIKLQTMSAPTPPQTGQFQVATSAQRSPVAVNIVNYLFQNPILKQRTGLLDNTNDIEFFRFKRLQRALLSDDYKQKQQNPKNGLIPVANNEDVQKVFVLLIQNQLLLPLQKLHYAEVKAVKGWKPNKEKPTLKRADKAVMDPDVYYGWLYQKPNPYILLYSFLAIAGVFAVILFPLWPNFMKRGVWYLSMGALGLIALFFATAIVRLIIYIISLVAFHKPFWLFPNLFEDCGVIESFQPVYAWEEPKKKKGKKKKEPKLEVVEEKVGSSSGDVKVTGSELSNGSSTTGKRKVTLEEVEE

SEQ ID NO: 20000 - protein, 324 aa, Candida albicans
SASACVRDFQNGNYELSTLILLYLQDNLTTSQFFKILSQTESVLKKENSTKQTIQKLDIDVKSEYMQVTGEVVGHAWEESIAKNVSPRLLETYLKHEDRVNELNIFKIQQFKRDPELHKDNYYELYKSVLTKAINRSTNQRISKALQREIQVLELQKKLSETYLTDFYQEKTLMAILKRMIAMNQIKPAKKIVANFQLSVEKFWYLVLNTLMDRREFDQLYEFAFGSSDQTSGNSPIGFEPFAELGLQKNAPQSHISTYIKNSNKYKYEEKISMFIKNDDYESAALEAFRNKDIDILKSLLQKIPNSNQADIQVVNSYIQQLGY

SEQ ID NO: 20001 - protein, 278 aa, Candida albicans
KKIFVINNKFDQILLDYDTSNESIDPYQVEWCGNDAIVLSFRDEIKLIGPGQQSISFFYDIEDDDEFDLDNLMVRKDNKNTDYKKFDDLLFTIRILQTSIDGLKIVTTNKVQFLSRVPETSVEMYQVGSTAPSSILADCIDKFSANASKADSNISLLRADNTLLKAMEDCIQVALDEFSPDWQRRALKAVSFGKVYYDDYFDSDKFVSVVDIIKVLNLIRSPELGLFLTYQQIEKIGGWEEVIKMLLRRNHHDLSLDIIDKLTFGERQTFSIYSKVLL

SEQ ID NO: 20002 - protein, 180 aa, Candida albicans
SMPSNPSFNWLKLQNVYYNIRTCYDEMDWSIDNLYSNYLVSLSPNTTLIAIASKSAPHPNLIEIYSNSGHKLWSVVYNSTHNDYIQSFHFTSDEDLIIVLNNGRYRHYYNLISSFNEYNFVEDLVTMDNISQRHNTGDKIDANPDNTRMITNLENNQTEEIIKIIEVNTWNQFLVVRLES

SEQ ID NO: 20003 - protein, 252 aa, Candida albicans
AAPSSARGRRSDIQGLIEHVQSSNLHQDEGHKQTIEHIKEGKFTLRDFQNQMNNFLKMGPLTNIASMIPGLSNIMSQVGDEETSKKIKNMIYIMDSMTIKELESDGRIFIKEPSRIVRVPRGSGCAVVEVEMILQQHRMMSTMAKSAMAAQGGQPGQPGNPMANNPQMQRMMQQAQSNPNFMQQAMNMLGGAGGGAGGAGGLAGMMNNPAMMQQAQQMMRLNPQMMQQAQQMMKNPGMMQKMMQQFGGMGGM

SEQ ID NO: 20004 - protein, 295 aa, Candida albicans
FNRMSFFGFDPAAPPQGANKKDDAYDFENTYDGLGELEEDDAFNQETFGTSTSDIRKDFDFGQGDSQQSETHAKASAPPAQTISYAQAATVPVNDDEFMQELWGSSNAPSKNHADSTEDKPAGGQPEKKILSLEEIEAQLTAIDHSQQPPQQVPQQQFPPQPYGVPGMMPPPPQFGYMMAPGFMPPQYPYPGMIPQQMPPMQQGQFPPPQQQQQQQQQQQQHQPPPQQQPQQPPPQATGTVYKENTEAPVRSPASNKAQKMDLSNFPLLGSKYAQSHPQIFPQIISTSATLSPPS

SEQ ID NO: 20005 - protein, 253 aa, Candida albicans
QILLANLRNVKGNQELELMLILVHYGNHWSIGAFFIIWGEESAVHPFIQCLNYNKMLQILLRLFKFLTREQILTIVTLIMYNLENLLVIKNGSYTTYPNKKVPENIVKLVEAYTLTFSKVLMNAVLDFKFNEIIGLLVILIEHNNVSFVSTTKIGLSILTTLLSRAELIIGEGSISATDLSEWSSCYDELFTSLESRIAAIFPPNPEDVDDGSSGENYIWQFLATLSLGGKLSHQRIIVDEVRDEIFRSNESS

SEQ ID NO: 20006 - protein, 563 aa, Candida albicans
  UNSURE (16): Identity of amino acid sequences at the above locations are unknown.
RKSILTSRYWLGILRXWQAKFYGWIVADLDRYHHNLGLPFRTIDLFETLWADFHSPIIKFFQHQHAVVFEEINNNLIECQREGKPGSFKVKPVEMRKINDSFIKFIKDVFGFYSRLLKYFVTHYRNSYSPKKFMESFNFTVEKLAVYCADDNFQANVLYLVHRCCLSLGDIHRHRTFIETSFVTPASSNREYFRIRSSTDKTFLFPAYSKALQYYHLCIMLLPALNEPYNHIGVIYNLVDEKFTAVYWFLRSQFTRIPDYKLGLANLTKLLQKHWFTTALVDIVKSTPERRFSNTRIMNVYLVCLIGYIYCPEKYKSGPNIVKKILFSKIETDFFKMLDKNFEEEVVLQQLVVAFSFLKLDGQEKLVKFTFRFVERVLGCLKTQESLVILRFLLNVLRENQEFLRVFQSRRKCVVYLCAVLNKYYQEVSHRPTRAYYFWEDVHFRDFSLIKYQFKDFRDDGIFEANDIDVLVGDYAGDRLNENDLRAKAVLVLGKKILGGAEGYEVKEADKLSIKRRDQAVVVPQSLEEIQLLISNQAKELCMDIDQGMQNMVDKLVEDDPIW

SEQ ID NO: 20007 - protein, 495 aa, Candida albicans
  UNSURE (1): Identity of amino acid sequences at the above locations are unknown.
XPRGSELSSGVTGLKSLGVRDLTYKLAFGACHVASMVNKAGGNEQLEVDLNDQEVFLTSLSDAEVLQLKEMVKDEHIYDKLVNSIAPAVFGHEVIKKGILLQLLGGVHKQTVDGINLRGDINICIVGDPSTSKSQFLKYVCGFSPRAVYTSGKASSAAGLTAAVVKDEESGEYTIEAGALMLADNGICAIDEFDKMDIADQVAIHEAMEQQTISIAKAGIHATLNARTSILAAANPIGGRYNRKLGLRSNLNMTAPIMSRFDLFFVVLDDCNERIDTQLASHIVDLHMLRDDAIDPPYSAEQLARYIKYAKTFKPRMTKEARDFLVTRYKELREDDAQGLGRSSYRITVRQLESMIRLSEAIARANCTEEITPSFVAEAYDLLKQSIIRVEMDDIEMDDEERPTGEPGQAQEQDQPQDQDTQQSQPSERVPPVSISYDKYVSIMNMLVKKITEDEKNGGDGLSADTLVEWYLLQKEDEISDRNKNTYEKENWLIR

SEQ ID NO: 20008 - protein, 353 aa, Candida albicans
VIMSNFVSSPGRIPSAAAQLLNSQTLSSFGRDNSTPAQPILYSEDLPPHLQLLQQQQRAIAGRRRQIAVPKVVDVTGEKVRESFETFIEEFVDPEQADDDWDGKIYLAQIEAMKTYEYSTLYVDYQHLLLRENGVLATAILEQYYRFSPFLLKGLHRLLKKYAPSLLHTSLLHNTEETVSETSTSSQANERVFQISFFNLPTVQRIRDIRSNKIGSLMSILGTVTRTSEVRPELYRACFTCDLCSAVIEGVEQVFKYTEPTACPSCENQSYFTLNVSKSQFIDWQRIRIQENSNEIPTGSMPRTLDVILRGETVERAKPGDKCKFTGCEIVIPDVSQLGLPVSNLSNRRKDHC

SEQ ID NO: 20009 - protein, 285 aa, Candida albicans
PNMSQRIADFVSKIALPAGITIALAQSALYDVPGGKRAVIFDRLKGVKQGVIGEGTHFLVPWLQKAVIFDVRVEPRVITTTTGSKDLQNVSLTLRVLSRPEVRKLPTIYQTLGLDYGERVLPAIGNEILKSIVAQFDAAELITQREVVSARIRQELSRRAAEFNIELEDVSITHMTFGREFTKAVEKKQIAQQDAERSKYLVERAEQEKKAAIIRAEGEAESADVVSKALAKAGDGLLMIRRLEASKDIASTLANSPNITYLPNGGAGGSDSDGSKNSLLLNIGR

SEQ ID NO: 20010 - protein, 324 aa, Candida albicans
VEGYLIYKMNDQNWKNLSNELRRRAEQARSSSNMKSPKSPLGIFGGIGGLLLLGGATMFIQNALFNVDGGQRAILYSRLDGVQSKIYPEGTHFVIPWFQRPIIYDVRAKPKEIASLTGTKDLQMVNITCRVLYKPDIWQLPTIYRTLGLKYEEKVLPSIVNEVLKSVVAQFNASQLITQREKVSRLVRENLVRRASKFNVLLDDVSITYMTFSPEFSQAVEAKQIAQQDAQRAAFVVDKAIQEKQQLVVKAQGEAKSAELIGEAIKKSKDYVELKRLDTAREIANILAASPNRIILDNDTLLLNTVTDNRKYHQPFEYDKQRNY

SEQ ID NO: 20011 - protein, 433 aa, Candida albicans
RRTKPSKKRRSQSPLEDMLNKQKPHQPEVPRTPEKAKVHLDKVVEEPKQRIFTKKEPRDSKIKESNFLNKLYETSNKHDKEDAHKIDFSKRRFEFQLDKYTFTPKDVVDDLEPISKLYLRRRYLAQLQIADIIAETDSNMKFLKIDKFLAKTHKSNNYAEPKYCNWCLVAFVVRKDPVQVAANNSKYIKLKVGNFMNSVDLMLFDNAFQKNRIIQPGDLLFILNPLINKYEIQVGKGQFQSGFNLKVENTNVSSILEIGSLRDFGFCKFTRKLDNSRCKRAINTRTQEFCDIHLDMKFKSSTRMELNGSVSIRSPQKNKKKMYMNKNGSGFIKQYNEESTVIGTSYGSPLDPKRYQDPKVLQNQIKRRKLIDDKAKEMLEQKLSKLGSASLLNNLQLSKKEATDKLASDRLKSKGFTNTMISHSLPHGPENPR

SEQ ID NO: 20012 - protein, 85 aa, Candida albicans
DTRGNQGCGVYLKWKEPDVDGLIEFMVKQKGFSEDRIRSGAEKLKKGLKGGVQGRLDGFFKVVKTDDKKRKADPKESKASKKKKK

SEQ ID NO: 20013 - protein, 225 aa, Candida albicans
LRLTMGVKGLNQLIKEHSPSAYKEFQLKNLFGRKVAIDASMCLYQFLIAVRQSDGQQLTNEDGETTSHLSGMFYRTIKMVENNIKPVYVFDGKPPVLKGGELEKRLLRREEAQKQKTALGDEGTVEEVLKFEKRLVRVTREQNEEANKLLQLMGIPCVDAPCEAEAQCAELARGGKVYAAASEDMDTLCYEPPFLLRHLTFSEARKMPIDQIEYKDAIAGFFNTP

SEQ ID NO: 20014 - protein, 600 aa, Candida albicans
FEILQQTTTFNVHHHPPLVNTMYITPNQYAKTFQDIKRSSLSHSTCKLVIFVSCLDVDALCAAKILSLLLRKELIQYQLIPTTGYSDLKLHYDKLDSEVTNIILIGCGAMLDLEGFFDVNPEEFLGDNSTTNGHTIDNDTELELDAVKTDNFALTRKIYVVDGHRPWNLDNLFGSAMVVCLDNGYIDGNLNEEKEAYNVLVEMSDSEDEDEDEGHNQNGHADDDQEGDKTDADDENDESSVSTSRKGVKSINEDKIQTYYNQSSTIASSCSITVYALVSAIGETNVDNLWLGIVGASGFDCSIFVDEVRRFSTDSGIHMERGTYLPLLRHSSLYDALLYNWIDGDKRIHKILAKMGVPIVAAKQQWQYLDPPIKNKLPGLLKKYLPELPQVEIFYRCGVTSMDVFVSLTALLETGVGLNNTSANSIDHGDLEDENELIRREIKSRESSYIRNFWSAFDSVSSFGISNNIGLEKGITAAKLVQKELFQTIKYIIEQKLIKNLKVYRLCILKDESSHLGFDNPVLLIKLSNRIMDYLKQQTLKPLVVAAELSNTYFVLGMGINNAFSKISGAQMKKDFFEASLVEIKKEDLAPFLEQLTFNL

SEQ ID NO: 20015 - protein, 653 aa, Candida albicans
LLFFFSSFVGPNYTSQMELTPTQLDIVNHNYDPQTVLSIQAGPGTGKTFALIKRIQKLIADGVPPQSIVVLSLTNRTVNSLRSALSEYIGGDTGDVVIKTFHSFAFDLIESNLQEYFPEKGRQMLLDDISFQNYRTLFMTGNSVKQLHLEKALLEVREGKDVANVAEKYGISQSDLHETIKFLNDNGMIRYLDFIRDAIELLDVSKGEIVKDIRVLIIDEFQDMQPQLVTFIEKLVEGGNKHITLAGDSNQCIYEFLGSSPDITQKFVSSLGWETEEICLNESFRLTPENLHISNMVIDQNKLVSKKEPSAEPTVYSLVSKYDEYNYIGSEIARLICQLGGLLKFSDFMILASQNREVDSISEFMTNHFGFNVNKYSLNSEWVNSNTHVLIDILSILNKGRGSDLALLCTLMKLGSLKQLIRELYLGYRLSQSTSLEDYLKSESASCKFNSKPRIKFKRQIDLLLNVIEEERKNLGDAVSIMSSLARIVRETDIITYLNKPSRGHKDQENEIKLVNNLTSFYESLSLSYKKTPSLDYFLNNYPEDEPVLEERSINVSTVHKAKGLEFPVVFVTNFPRYFGSANERLLYVALTRAKNLLYTGYQGNTFQAYNNSRGFEMNRTWITNAARDLNRSAPSKHLLNASMRILKTSRLI

SEQ ID NO: 20016 - protein, 511 aa, Candida albicans
FNIPGFFFHQSIKPIPNTLISRVSIHIYTYKHILIMINITKPLTPKSISQQKQQQQHPYKNISTTKSNNNPQASGSKSFVQEKYPSQLYESEIKIHNQSLAEYDLDIYDIMVNLIETNKPNLSLYKQQPYLTFTIRLKLIDFLLKMSIRLKILPFVFFKAVKIFDRYCSKRIVLLDQSQLIITTCLWIASKVMGGNNHFVNINNLDKIGQENFRTINDLGMDVVGNILVQQKRIRLPKLHELVKLCGAKCKYDQGMFKQMEVHVLNTLEWSLNDPSIEEFIIDSHEFNVININNNNEYEQTITTNDESANANANADANDGNEFFKIKEFLSYAALYSHDLIDTNIIELGQVIMDLINETFQLQPFDKHYQTILNCDSDHPIRFDMQRYKHIKKAVIKSVLNASDFMMKVFHSKGPQFIYQQFNLQYKLNYTTNSIIGGFGNSGYSPTTITTTTSDNISTTPTNSTGSTTPVSSYIGYANSRSSSVSSTSSVASSSNANTQVHQVVILQQLH

SEQ ID NO: 20017 - protein, 228 aa, Candida albicans
FQTMSSPPQSTNQNNSNPAQDSLERESGSISQSQQPPIVSSPLFFNSSNPGSDIGNFNSQSQSQSQSQRRNDISSPLHYTSSAQPTSDIGGFDSQRSARVQDVGRIMRRAQRSDVTDSVSSPQRSRRYFTQGRGNGPSNLNSSTSAQFSTDPAEPNDEPVRVIWGTNVSIQECSNIFRDFLLSFKYKYRRELEEQAIEPEDHELYYVNQLNNIIELGLTNLNLDAKNL

SEQ ID NO: 20018 - protein, 163 aa, Candida albicans
AIAVRPARGENGEDARSSEKRITATTRQLESMIRLSEAHAKMRLSERVELIDVKEAVRLIKSAIKDYATDPVTGRIDMDMIQTGTTAQQRRVQEDLVSEIMKIIEENNNLIRFNDLSVKLNERSSFRVENLVINEGLRRLQQEGKIMETGDSHRRTIRKIAIV

SEQ ID NO: 20019 - protein, 173 aa, Candida albicans
DCLIQIINDANATTSPAQSKLDEIETNVYTIRPYNVNLVEKGIRELNPNDIDKLVSVKGLTLRSTSIIPDMKVAFFRCNACGHTVGVEIDRGVISEPTKCPREVCGQTNSMVLIHNRSSFSDKQVIKLQETPDLVPDGQTPHSINLCVYDELVDSCRAGDRVDLPHRAKSAYG

SEQ ID NO: 20020 - protein, 498 aa, Candida albicans
TTRSFIPEVHNIMRSYKSSITDENELTKQRLRAKSIANLSSNHTTAGQPSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNEDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSQS

SEQ ID NO: 20021 - protein, 435 aa, Candida albicans
ESGGSENYLIKCVHKMAMILFPSSTMAAGNFFAKLIKIAELKIPKTNRKRQMSLLQDFEVDLSEPIDDLVIPIQSNLQIQIPSHLNSKHKGFSRSSSISFDGFDDNVNIFFSLQMPRQLTVRGSDGNAYRLMVKSDDTRKDAKVVEFTTMVNRILSTSTEARKRGLQIANYSVVPLSDHFGIIEFVMNVQTMKGVISEQRKRQGIPINERKVFMHIDSLQKAKKKDSKQLDKLVAGFRAIMDRCPPVLHTWFVEQFSDPSAWYMARNAFTRSSAVMSMVGYIMGLGDRHCENILIFKNTGAVLHIDFDCLFEKGTTLPTPEIVPFRLTQNMVDAMGITGVDGIYRITCEVTGTLLRENEQILMNILETLIYDPLIDWRNHNPREDLSKVRKKIRGLINEDEGLPMNIHGQVDVLIQEATSLERLSQMYAGWAAYM

SEQ ID NO: 20022 - protein, 114 aa, Candida albicans
FDILKDNKFHDDKSKAKVQLQYANWLDESNHLSAHQIITEYNKAFHLNMVDEKCNFDIGKYYNKLMESSNDESGGIRKKPHLTVRNYIKAVSVGTTYIFEALPQLLTIWLDLAD

SEQ ID NO: 20023 - protein, 479 aa, Candida albicans
NMVGRCHIFLLKRASIDIGKVIQKAKTRTLYFQSYAVLIQREHDIPLCEHLLRYVALSHVINEGVPEDLHKEFLHILKMDSKSTSPDRAEQLKLCYQTIFSVVDYFNQWVSNMRVVTSNSGSELTSSDIRHKMDAVAKFSLFPQDLLTTRSAECDAYERTIMYLENCYRDSQSEKSFKLSNLNGAATLQDMYAHIDDYDALNGTLKMFSTNNLNEKLTTFQYSDSWSLAHESFEPLGSTKNSVSDNTKWLQSLNEHGLYNEVLSTLSARTDSNDLKSIPLDWSLMGLHAAVYKGDSKQLEKWLQVINYIGKPHDMETMINYELAKALSFLFQSRIDMFKGSMDKLYNIIGCSLVPSVSSNFTRNITLMNQLHAIYDVSLIVLSKDSEDTLDLRIGNVDQDFDTQRNILTLHNVANTVMKNPAMISKNLLRESSLARKYNRLDISTTSIVQAMSLEDDQANIEFAELQWAQGKQSEAIKC

SEQ ID NO: 20024 - protein, 321 aa, Candida albicans
LQATLEEHNFHVLSLRCWNELIKKVPPSHLISLIDIIISIILQKFESFGSEAKSIAIEILRKIYEEIKDKYNRYSLYFLSLPFLSYMEDYQMVKEFRNMKSPSRAMIFLEFTRRLQTSNMYVVKHALFDLSNYFEKYQINCQKDLFKDPGLTPAITSLVRTILDTAAKFKNKDTTVSTACAKALAIIGALDSNKFQFKTVKLLIIISLDFEDIEENSTFLVDLIENHLLKIFWASNDPHKQLFAAYVMQSFLAVMGLDERVLNIKDNRVWNKFTDVAKSTLTPFLKSKYAAPKPKLDNLKFPFFKLGMKYETWLVDVTFFY

SEQ ID NO: 20025 - protein, 778 aa, Candida albicans
  UNSURE (767): Identity of amino acid sequences at the above locations are unknown.
LIVCVCQISLKKLNNIWYKGIVENNHSEKKNQNQSKTLLYGKFTTIKKNASETNQLVKNIKNGMTSNQSISTTELLQFLTDIETNIDDHETDFRKLLLYLLRFTNEKLIVIAQEENKTPTELQLLSKLIDTIELVLSKKTPLLSTLLTIEDVNIIHTTGSGSLVYEVPLHEWCISFALLHIPNFVSHTAGLNQLKRLVFLIVNLVSTQLHSFKVIKSTRIHLLKTLDDNLNFCLQNLLSANTFLFKSKLTTAVNLFSIVHDYDISQKLSLNLNNYQLKFESCSRKIWFILNEISLVSELDNLNLLDCLKSVFILDQSSALVLNVLVGWNQIGFLLSCIVEYLQQDFRTLDSNTNNFEFVNLNRSISLSLLNVYIVCFDKDLLENFMSFSNIKGILSKLIYDDSIPSVIRKTLNIVQYTYQLMSNPDGDDIKLYSTSVYNDYVWTPFVDSELESLRARLLDLQGNHEDSRKEELLSFSIDETHKLAKLTNSLNYTDEKAWIRTVKKLIGIDKNVLEDETTLYTLVTALSHYPCILKGDYDYTINECTKCGFGPLTKNNYSSIDPNRFPLNYSTEATTLQDIIQQFLIPKLETQQDPLLCCNTLLLIFNFYASFLPMADMQDHNILDFLLRLLATNDNRDVRMLVARILPLYLIQLKDDKLLDETFKYIFQKVTSIDFSSQHRLHFGESTIRAVVELATVSTGERLCAIYFKLVDWLGEQNEQHLNYVYCGILNLASAKSLPPHKLLSPYLPSVAEIIIKKPQVIRTSXVCLRRLYPYIG

SEQ ID NO: 20026 - protein, 229 aa, Candida albicans
QAPSPSPLSKQPNSMTTSYLDTENDNDIDDNEEEEEEELANLPSTVKFFPNLSDLLDDEEYQDDDDDDGTNNNNTVINEWALRKFGTLQMKLEKMQHSRDTFQSFGSRDNLTNFSRNILYNLANEVFGFDGWSTTILDCNLTKRENKDENKYSALCVVKIRLILKDGTFREQLGQAESTNMPYKHMCYASARKKAVTDAIKNAIVGLRDLYLEYEQEQLMKQFAPEYDI

SEQ ID NO: 20027 - protein, 427 aa, Candida albicans
TPLLKKIKKKCDASKKKKKPQQLSLFIMNTLRRRRIPKPIPRIFEDDEYKQYTRPHNWRLLSLVGICWVLLIHYFERTRPQNTLSTCQWKNWEQWNSPDSAHRIVLIADPQIVDDYSYPKQFKIINYFTKKLADNYLHRNYEMIHSVLAPDTTIFLGDLFDGGRYWDDKQWIDEYKRFTKIFPKKINRRDIRSIPGNHDIGFQTIRHKVVKRFAEYYGELNDYIELGNHTLVLLDSISLSHPDKLIRKEPDNFLDQLNNRISSTFPRILLTHVPLFRNPVTQTCGPHREKRKPFPLQRGDQYQTVIEYEISRRILNTIKPTLIFAGDDHDYCDITQEYDGGAAREITVKSAAMTGGIKHPAVQLLSLNTNEPTRTYETEMCYMPNAYHGLYAYITFLLLTSFFIDRSIVFLNLVWPLFILNVYYMTI

SEQ ID NO: 20028 - protein, 488 aa, Candida albicans
YNHIYQMLKLKSTHFLLLILLVIWVLTFYLQERYLTAATILKCQWPQLSTSLSQTNILLIADPQLIDNHTYPGRNELLLKLSKHTVDTYIKKNYNELLDQLQPNYIMFLGDLLDNGRDATDEYFAQEYNRFKRIFRPLDKMFLNVPGNHDIGFGNGVKIPMRTRFEKSFGSANTVVDIDGVDFIILDTLSISSTDETINKQLKDFLYSIAKEKSKPRILLTHVPLYRDPNLSCGPLRESKTFDVNGYGYQYKNSVEESLSRDILNQIQPDITFTGDDHDYCDIQHENGYREVTVKSISMAMGKKYPAVQLLSIKNEDNFKMETEICFLQTPYINVANYVVLAIVSGILIFWWNLKTKLTRYTYTSILPLHDVVNIPFEHTKKLHRFIKEQDDEHMEQKHLDISLPTSSSSNAYSLPSSIPQYTFTQSSRPQFVTKFNNTRLGKIYILNKRRLFTFIKRYSLVSFFKQSLMVGILVVSIYYVGFVLTLY

SEQ ID NO: 20029 - protein, 219 aa, Candida albicans
APRVLVLSGPSGSSKSTTVKLLAEELITVRDAFDSVVVEYDELEDFLKFLQDCRYKSKNVILVEELPNIYHLETLKKFRDAIRDWIYQDDNGFSLPPLIICLSEIEYDSNDLRISYSIENNLTVDTLLGKEITGLNQVENIKFNSIANRFLKPTINKIIKPEGILKIVNQQILMRFLDDIFQIGDIRSIIFNLEMWIKNVKQSSTNRISIDSFMRRKFN

SEQ ID NO: 20030 - protein, 325 aa, Candida albicans
DFWMTFFKLEIFVPLYLTSKCGLKMLNNLRLIESQSIHLCEENSINLFHAIGKIIYSSSKVNKNRLKIGNNDDDSDPLDKDDIDYQSIEQVLQLFPEKNMDLLNLSLLENYHIYQDSNYDLKLASNIVDDLSVNDIIKLGDTGIRSTRINLSKAQKLSTSRSTSMPPSKLKMKFPRHLKMIKMMNKTKNQISSYRRYLNPQTSFQDLNLIDGYYMPIIYNSQRKTRYRYNRLGGKFQEVYADDTIPIDEGEVTYEYDQFEIDIKNKINLDLDMKYSEVIDEDMDNMSDPIESDDDLEDIGDIGDNESDAFLSDSELELLLTQGKV

SEQ ID NO: 20031 - protein, 509 aa, Candida albicans
PKKFKTSVSGSGMARDLEVAFEKKKQQQQPLLFIMTPPVKLQFSLDDFFKKSKYLNPVKAPVKPVFQRQDSVLTSLDDDAGFDDVDVSYDTSVEVVNLRNTVLPTQTKRSADVLEVYQPRKLTKVEPTKEVAPQEICLSPEQQMVVDTVVHAKESIFFTGSAGTGKSVVLKEMVKACKGVYGDNFGVTASTGLAACNIQGQTVHRYLGIGFGRDPVDKLAAKVRKNVMLLRKWQQMRLLIIDEISMIDAGLFDKIEEVARIVRNNEKPFGGIQIVACGDFYQLPPVNKDGKARFCFEGKSWHKVIKKSIVLKQVFRQKGDTEFIDMLNALRLGNLNAAVLEKFATLQREIHYEDKLEPTELFPTLNEVRQANLSRLARLPGKERVFVATDRGDPRQHKMLDNLMCEKVLRLKEGAQVMNIVNYSEDIVNGSLGVVLFFATRELYYKFIQHYGPINANDEDAIKEMRFICHRIDESEYTAEEKEYYEGLLNERQGVGTECYKRCRERNWC

SEQ ID NO: 20032 - protein, 912 aa, Candida albicans
RNHQLYMLNANKSIIRLATYSIRNRIHHLRTLHSLNYINSRINIQDTNHIRPTRPCGSKQFMLESELDLALIEFLDNDDPFSDSEIKEFDELLKGQSHVYNGSPVTKNLILQIEKQQIQKSPRPTETNKRMQIRKDPDQNDNGDDDSLSSTFEFSDMDDDFMEALKAAEEITGNNTNCIKRTASTPLKKPIAKSMKNLSTPSKSAGKKYCKYIKTSSPSPSHYLIRESGSGVDILEGSPNKVQADNASPFRITSSFSSPSQIQNQGVGANPGPKSKAEQNVSSASQSSSPPMTVSQVRNPFKVPTQFRRNYSTRPITNQGSDTKKGNSHHTILLATQKPGVPFSNPSDRSYHKLEKTEGINEAQSEAKNVKPIILSNEQEYVLKQVLLGVSLFYTGSAGTGKSVLLRSIIKSLRDKYPKGVAVTASTGLAACNIGGITLHSFAGFGLGQGKVENLIKKIKRNKKAFTRWRETRVLIIDEISMVDGHLLNKLNEIAKNLRRNNRPFGGIQLVACGDFYQLPPVVKKTAHDGTELDDVEVFFAFESSAWKETIQRTITLKEIFRQKGDQRFINMLNNLRDGNVPDDTARDFCRLSRPLKCPEGIVPSELYATRYEVDMANSRKLNTIQGDVVVYNSVDTGILPEPQKTQVLTNFLAPQVLNLKVGAQVMCIKNFDDQLVNGTLGKVIDFVDRDTYMKSESKENPSTETSDEVSGLNDYIFNDFQKPKKVVKEDAPIAEQVLFTGQLSQKVEDELESSKRKSKLKDDLMKDYKNKKYPLVKFLLPDGITFRTVVVEPEQWTTEDEDGTVLVSRIQFPLILAWSLSIHKSQGQTLSKVVVDMKKIFENGQPYVALSTAVSRAGLQVLNFNTSKVASHRKVIEFYKNLSSHEKESRSGQQRLNFMQTSVKSVARAQI

SEQ ID NO: 20033 - protein, 100 aa, Candida albicans
QDFKMEKASKKVTDQLDDLNVLAREQLPLLLAWAMSIHKSQGQTLDRVRVDLGRSFADGQAYVALSRATSKDRLELRHFRPDKVTTSNAVRMFYQSLEQV

SEQ ID NO: 20034 - protein, 113 aa, Candida albicans
LCHNDKKGKLFQGMNFNLSSNLNGGIDVISRVLKDHGMNKYKEIKTPNNLSKSLIKTNYKSDEKIILIANKKKDTKLINNFKKSVKSGIILEWDWCVKSIFKMELQDFKKFQI

SEQ ID NO: 20035 - protein, 269 aa, Candida albicans
  UNSURE (49): Identity of amino acid sequences at the above locations are unknown.
QQRTKQALALEEDTKKGQASFVETKKITFKPKTDPFANIDKSKFLNKSXYKLSLVTAESRTVPARPLSAFFDDGNTPRIYSQGNRSTPSVQDYVKEELAKGESYEFNEPDGTLEFLKSREEEKLNQRNDTGGSFKAAFKNGLRKISTGGNISANNTGSSVKSNRRASLKRIITGGSNHNRKHSEENTKNVEDSNPVSSAPKKLSIQHRMQQLLNQNDHQRVQKSAQGYGKYTDIKASEDIDEINKPTLSKHSQKKLSPPVFTTRGRPMN

SEQ ID NO: 20036 - protein, 543 aa, Candida albicans
EEPTYKKNIVKHPLSKLLDGTHLNYSLLSGFLTYTVYSIMFQNCNFLIIKSKQLTQDKDLSQLLLANNVANIYIKDDFDNSKNYMDPPKITHIISNTIDFIEHDLAIKSMIPIVTPSWVYDSISSQKMQNIRTYNPDPAYFFKDCFICCADNLPPGDKELIYAPVQQFGGGYLDNITKYTTHLIAMDISNEKSILASSIIHDDDDNDSNGDMPNIKIVLPHWIDHCITMGKKLNEDNYLLPDAKILHDESNDVLKNEILPEILNDSLPPQNELDSELQFFKNKKFYINSDFNLSQRSSNAIKFVIERHGGLIIKKFDVSEIDIYLGKYRQGDTYKKSCASNRIIVGNLQWLYFILASKSWTLPLNSNILYYPQPSTPLDGLQGLKISITNYSGEARSYLSKLITIMGGVFTKTLTRDNDYLVCGKAEGKKFDAALNKWVDSEGNLEIKVVNHLWLEDCYVQWHKVDSSLDKYKNFGDESIGMEPWVGRAHLDQEVLKQWYEDEEKTASHSSRNIDDSMSEHESTQSPTCATTKEQLDHSQTSE

SEQ ID NO: 20037 - protein, 156 aa, Candida albicans
KLNAEVNARFNFLHTIIQSSIQEAKRTFEKAMWLRGFQGTLKFDFAEKTLQLNVQTGNDEKKRTVESLSGGEKSFSQIALLLSIWKVMNSRIRGLDEFDVYMDSVNRSISIKLLLKELKRYPKSQNIFITPQDIAVVGELNDKGVKIHKMSAPREE

SEQ ID NO: 20038 - protein, 409 aa, Candida albicans
LLVAIFMYRINTINWRHLLSTILNKTLDSFIVTYEGDRSRLDRLLKQYQIRSNIIVKKTERLNYASGKADYAFTTVLDMLNVENDTILYALIDINSIEKNVIVESASEARDSCRRRNVQNSLVLFRKDSGHRMSYQNNTFRQDPIYYQNGMAKFGVANMSDLISDLQRELDEEHRHQNDLERRARSIKMKLDAKRDNLVSESRAIKRNLDQLKRNRSTLEDQLEVEVDYSNITTLEARIEDNNEQIRRLVALNEALLENLSQMNENYKDLKQQIEDCKSKKVKHETIREKFVKQLVEIETEIETQEDLKKRYLYKITELEDRIKRADDILAEGNRKLEEFVAKAEEHCSRDRVTIYPNDTQETIAQDYQETRFDLERAESALGTSLEEVLDQLENGLSDRPLEDPRRGE

SEQ ID NO: 20039 - protein, 306 aa, Candida albicans
  UNSURE (298): Identity of amino acid sequences at the above locations are unknown.
SKDGKSIFGITMVLKIEGSEAYKPEVLGKKFIIERKLQRSGSNTYSIKNEAGKVVSNKKSVLDEILYKFSITIDNPLAFLSQDKAREFLTSSSDKNKYEYFMDGAFITDILENYTSISNNVQVLDNKVRQAEEYTKVAKQEYKAIAKVHNAHRTNDALRNKLEMLNAKIYWFNVQTIEKKIDQENRQKDTCLQEIEQAKNQIDVCEKEIEAKIPRKDAADQQVKEVESQIKDIVEEFEGLRSKRSEMKSELEINKKETKKNIDEMNSLKEDITRTETKIEQERRRIQELQGATRTKLXKMSSPARI

SEQ ID NO: 20040 - protein, 879 aa, Candida albicans
AKQEQKYRHLSVECQPFQRLTRLIASQNYHQLEEDEIEETTIPNLQSGPDSPIVIDDDDDDFLDFTTQLNKEREIDFIELDSDDDVQEEQWPKESNAPPAPAPTNPVLTIDSDDAFSDDDEDLKEYFTENRASKGSEPFMDEVHSILNNVFKLKSFRANQLEAVLATLLNKDVFVLMPTGGGKSLCYQLPALVKSGATKGTTVVISPLISLMQDQVQHLLAKNIKAGMFSSKGGNDDNKHTIHLFREGFLDIVYLSPERANKSNAMQTIMTKLYNNNQLARVVIDEAHCLSSWGHDFRPDYQGLGFFKDKFPKVPIMALTATANEKVQMDILHNLKMKDPVLLKQSFNRTNLFYEIKLKKSNCLLEIKDYILSRFLGKSGIIYCHSKQSCEHTSMKLNEYGLKTSFYHAGMSADKRFNIQKRWQENKIQVICATIAFGMGIDKPDVRFVIHLYLPRTLEGYYQETGRAGRDGNFSECVMYYCYKDARSLQNLIQRDEELSELGRESHLAKLRQVIQYCENTTDCRRKQVLQYFNETFDPANCHKQCDNCRDYNHVTLVEKDCTEYAKDIIKLVKSIQDEQVTVLYCQDVFRGLSHKKITEAGHHENEYHGKGQSLDKNDVERIFFYLLSQQCIVEYHVMHGGFATDYVKVGKNADVVLNGQKKIIILFSSRPGSASNSLGRTAANTGKPVEYQESFITARQMTTVDVPDSSFSQRCLQELREAREKALTECSISNLQIVGEVTLRDMLAKLPTNKKDFAKLEGIKKGQLEHFTHFKKILTSLAREKKKMANTSISTVVSDISSISTSTVSPYFQPSQQDQEILDTLRAASQPKPSKSSTQSSYTKKKGSKKFNKGRSGNYFKKAAPKSLANSHRNVMPM

SEQ ID NO: 20041 - protein, 274 aa, Candida albicans
ENTYINTSEESKKQKEYKLFSFSFDLSRYTNSLTIMAKAEFGTAKYQSKKLRAAGLQKLKFYCQLCSKQCRDSNGFKNHLSSPLHIKKVSEIHESGDSSKLIETYSTKFQDKFIKLLRINHGTKFINANKFYQEYIRERDHIHMNSTRWRSLTSFIKHLGKNGIVKVQTNDESNEEEEGFNLEIKLIDRTQTLNAYQIKSGGNSLEDNDEMNDDKLLQRQIKRGQEMEKDKDAEKSKTLEQLVPTSAPVKLTLKKKKTATTKKLVNAFDENESE

SEQ ID NO: 20042 - protein, 330 aa, Candida albicans
PPVNLYTSTRHFMFRVYPGNGEVVQDSYTWDIVLRIIYKIIAKFLDRRQPPKPLLLTPPIHRTSDKYILTTKTKLGFLKENEIDGLVDNRPYHGKEAPLPRIPTIAHLPHQCTSTHTTPHLTSSQTNLAPEKFRVINQVDRKFILLAADDQLVVLDQHASDERIRVEQYLQEFVLQPNPGLRLHSPIAFGVHASELMLFDQYAANFNSFGICYTTDTAQVVITHLPLILLTKVEDDAEFLKDSLLQHCYDLHDHVKRISPNFDNWFETSYHLPRIITELINSKACRSAIMFGDILTKDEMQDLVNKLSRCKLPFQCAHGRPSIVPIANLM

SEQ ID NO: 20043 - protein, 202 aa, Candida albicans
SSKPINFPLNSLSPVINTRTLLPTDLSITSKGNTVCGTVSSDMIVDKKEKGFFLVSTKKKILFPLSTMILRLDESVITQIRSHTIFHSLDLVVRELLQNSLDAGANEITIKIDLSSLSVYIHDNGTGITPDDLEKVTLQHYTSKWHSHNYKGEALFALKVISNLTIISKAPDYTTPFKLNNLVAELYYEYSGSSPRGWKVQR

SEQ ID NO: 20044 - protein, 175 aa, Candida albicans
HTDSSDLRKYKPLIKKKMLSDKEVSLDKQLNYWRKQKDTLTKATTYLKEQANINQLIDKYSAIAQMASNYLYNEYCLKFTKLGGYANWQLQQWKENQSNNVDYELESLYSSYFDSEEFNQLSDLEKREIMLDYEEKFGRDDNNEENIPVFTDVFTMKDLYSILNLDYELVYPPSK

SEQ ID NO: 20045 - protein, 482 aa, Candida albicans
IISFYTTSMSTDSYTPSQEPGSKRLKTGESVFARRGVSPSTGGVASAYGNESEKKPSWLQTNKSDIDGKYDKYGERRNAHTTTRDSRLDRLKRVRQKLAEREDVGHEGDEGDEDEGILPYIHLQAANPAIIHNEKQENYRTFQSRISNRENRDINSIVRAHYNQRTQQAKQQGSRVNSPIYKMRNFNNAIKYILLGNWAKHNPEELDLFSFLDLCCGKGGDLNKCQFIGIDQYIGIDIADLSVKEAFERYTKQKARFRHSNQNSNRYTFEACFATGDCFTQFVPDILEPNFPGIIERAFPVDIVSAQFSLHYSFESEEKVRTLLTNVTRSLRSGGTFIGTIPSSDFIKAKIVDKHLQRDEKGKAKFGNSLYSVTFEKDPPEDGVFRPAFGNKYNYWLKDAVDNVPEYVVPFETLRSLCEEYDLVLKYKKSFTDIFNQEIPKYFSKLNKNLIDGMKRSDGKYGAEGDEKEAVAFYIGFVFEKV

SEQ ID NO: 20046 - protein, 180 aa, Candida albicans
YIIMASTSTGLPPNWTIRVSRSHNKEYFLNQSTNESSWDPPYGTDKEVLNAYIAKFKNNGYKPLVNEDGQVRVSHLLIKNNQSRKPKSWKSPDGISRTRDESIQILKKHLERILSGEVKLSELANTESDCSSHDRGGDLGFFSKGQMQPPFEEAAFNLHVGEVSNIIETNSGVHILQRTG

SEQ ID NO: 20047 - protein, 539 aa, Candida albicans
KKWSMNINLDTAKDTLCKNILIYGYCKYENKGCAFSHNRQQPAQQQQATNTSNNSTSVITPNSANSTASSADLSSKKKFNLNTPSFQPSVSNLSNKFSTLSPKLKEIPVFKPENGVSEPDTVDSPTTQRPFTSKRFNVSTPSFTPTNFDFANNSNADGNRGGASTPIGISSAPLVQNQQQQQQQQQQQQKQPLAVPSPLASGAQPPTMQHRILSMGVSQSSPSTNPYFANNLDMSAPTPGLETPGPVLPGSAGAAAAAANQPMYPLQYHLYAPAPPPRLTIPLQPYETNSQAMFIPNDLREYLHKKNEASLQSLSHLNLPEHVNQYHSLVPIDKSYEPVSKLWLGKNSLIFKCLDNIDGNLYVMRKIEPCNEIINEKPFKTIKRWKSIKNANIVGLQDAFTTMAFNGNQSGNTSLCIIYDYYPNSISLLEHHKKGLRVEPVNEALLWNYLIQLINAIMAIHEKGLLASSTIDLSKIIVTNKNRIKLSSVGISDILEFKDDETNQDIKIRQLQDIQKVGKVLMELPILYLHHGLPDPTIL

SEQ ID NO: 20048 - protein, 137 aa, Candida albicans
KQNQFPAAKKTRTLQDYINSNTHFSLRKLDGTTAVKRQETIANQVQDPKIRALITNGPKLAIGNIRLPDLKKKLQNLNMTAEFKSEGTLVVNDILAVRKIAYGLVESDESGDIVIDGNVGPLYYKVKECIREMLAYV

SEQ ID NO: 20049 - protein, 345 aa, Candida albicans
KKKTQRKSFLHLLQQSQNHFFKGDTMFGFSLLTPGDNDHSFKAALLEFDNEFKLIADPSWNGVDVNAAMFMEEHLKETNAILLSHSTAEFISGFILLCIKFPILMSSIPVYSTLPVNQLGRVSTVEYYRAMGFLGPVDSAILELDEVDNWFDKVNLLKYQQSLNLFDNKVVVTPYNAGHSLGGTFWLITKRIDRVIYAPAWNHSKDSFLNSASFISPSTGNPHLLLLRPTAFITATDMGSVMSHRKRTEKFLQLVDATLANGGAAVLPTSLSGRFLELFHLIDEHLKGAPIPVYFLSYSGTKILTYASNLLDWMSKSFTKEWEELSSVPFNPSKVDLLLDPSELL

SEQ ID NO: 20050 - protein, 192 aa, Candida albicans
QFKTINAMGSKVRNASDIKQEQITRDEALRLYTNTLNFNVISRYDPAIKQLLCNTSHCVLYNFNDETEEWVKSDFQGTLALYVRDFKVPSTATAPSYRDLQNLFCYGLILLNRNNPECFSLGLLPNKISSQFFPNGLDDSSILEMDVELNDNLIIIRNLLGEIYGLWVFNESDRIKLFKSIEFCLNTEASLS
